United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 23

SEQ ID NO: 93266 - DNA, 1044 bp, Glycine max
  Peptide Sequence Number=SeqID_210044
atgggtgactcagagatgacaaaattcggcttaaaagtcgggaagaatgggtttccaaggggactagatcctgcaatatccaagttttttgtgcagctccaaattgttgttaagtcacagctgagtagattagcaaaacaggatggaatgagtttgatgagatccgtccaaagaaaaggggggtctttcagttactctgaagctgaactgaatgagcaactgcaagcatggagagaaaatccatcttgggtcgacaagcctccactaataaaggtcactgttcccaaaggttctctttgcaaccttgatgtagaagttgatgttgggctgccccctgatgcagtatataatatagtgatagatcctgacaataggcgagttttcaaaaatatcaaagtagcactctctcagttttctgcaactcaacttggtgatgtctttctttgtaaggaagtggtatccagaaaagttttggttgatcagggtcataggcaagtggttgatcttgaccaagcagccatttggaaatttctttggtggtccgggactatatcgattaatgttttggtagatcaaaacagaaaagaccactctatgaagttcatgcaaaccaaggctggattcatgaaaaaatttgagggctgctggagggtagagcctttatttgttgatgaagcaatgtgccatccctttaagccggtgacgaaggaagactataatgcatgtacaagaggcaaaggaagaattggatctaaagttagcctggaacaaatacttcagccatccattgtccctccccctcccctatcatggtatttgaggggaattactgcccggacaactgagatgcttataaacgatatgcttgcagaaactgctagaatcagaggtggatatgaggctgaaaagtctaaggcagaggagcttcaggtaaaacctggtgaaaatgtggacctggtttctaacacaagtgacattaaagaaagctggaaattgcgtagaaaaaatgcaaagcagagtcacagaagccttctgaccaagtga

SEQ ID NO: 93267 - DNA, 693 bp, Glycine max
  Peptide Sequence Number=SeqID_210045
atgaattcaggtagtcagccacaagaaaatcctggaagtcagtcaatagctattaaggccacaggtggtggggcgtacaaatatgcagaccttttcaaggaaagactgggaatcatttttgacaaggaagatgaaatggattgtcttgttgcaggagcaaattttcttcttgaggtggttcaccaggaagcatttacctatatgggtgatcaaaagcaatttgtgcagattgatcagaatgatctgtatccctatcttcttgttaatattggatctggtgttggcatgattaaggtggaaggagagggaaaatttgagcgagttagtggaacaagtataggcggaggcactttctggggtttaggaaagcttttaactgaatgcaagagttttgatgagctgctggatttaagttatcgggggaacaatagagcggtagatatgcttgttggagatatttatggtggaatggactattcaaagataggtctttcatccactgcaatagcttctagttttggaaaggcaatttctgataataaggagcgtgaagattacaaacctgaagatattgctcgatctcttctaagaatgatctcaaataatattggacagaaccttgggagaacaacaccacaaaagctagctattgtagttagtccaaggccttatgaaccccacattggaatctga

SEQ ID NO: 93268 - DNA, 330 bp, Glycine max
  Peptide Sequence Number=SeqID_210046
atggcggcaatggatcttagccttgggaatcctttgtatcgaaagtcttcctggtggtgggtccaggcagcgtgtcccgcagatggggcagcgtgtggtgtcaagttcccttgtgtggtggctcgtgatccaccgataggaattagtgggagtcttctcagtttagaggaggcagtgggagtaatggcattagaagaagggaatgtgaagatcgagaactttgatggcagagatttcaacttttggaagatgcaggattatctatatcaaaagaagttgtatcaacccttatcaggggataagccaaacgacatgaagcaagaagaatga

SEQ ID NO: 93269 - DNA, 717 bp, Glycine max
  Peptide Sequence Number=SeqID_210047
atgggatttactttagtagaccttaataaggtttactacaaagaggaacctttcattatggcagaacaagctaggcaggtgttttacatccaagatctgtgtgattctagattattagtggtcctacaaggaagaccaattggtattacggaagaaaatgatcatgcaacacttgacatttgtgagactcctcctttttccacaaaaatgccttccatatgtgaacaacccaaggtggatgacgtatatgcgattcgtaatgatcatgatgaagggtcatgggaacaccgccaaggttccctccgcaatcatatgcctagaccaacggttactgtcgatcctgcaattggaaaaggattcggtctagaaaaacaaaagttccaccgctatttatgcgtcatagctcgagaaaagctctcaattgtacatagcaattggaaagatgtgtcgaaaaatcttaagaacctagtatgggatgacattttgtctaaatttgatatgccaaaagcctcaaaggccaagaagaagaaacaagatccttctataaaatatggtatggatcaagaaacttgggatgcatttgctgcaagtcgcaagacccctacatgggagggaccagttaccaaagccatgagcaagaggctccaagaggattgggctagagctgttgaagaaggctcaagggttctcatgaacctcaggggctccataatgtag

SEQ ID NO: 93270 - DNA, 378 bp, Glycine max
  Peptide Sequence Number=SeqID_210048
atgacagaggactttgagtcctatgaaagcgaggactttgagtcctctgaaggcgaggaatttgagtcctctcaaggtaaggactttgagtcctatgaaggcgaggactttgagttctttgaaggcgaggactttgagccccctaaaggcgaggactttgagtcctctaaggactttgagtcctctgaaggtgaggactttgagttctctaaggcgaggactttgagtcctatgaaggactttgatccctctaaaggcgaggactttgagtcctctaaaggtgagccaaaaggtactagtaccaaagggctcaatcttatgagaaagcaagagattgactctttgagagggcctcttatcccaaactcaaaagtttga

SEQ ID NO: 93271 - DNA, 264 bp, Glycine max
  Peptide Sequence Number=SeqID_210049
atgtcgacgatttgtctttccctcatagtgatgcgcacacgacgtatcttggtcatcctgggtgttgatgaattagagctctctagggatatctcgcgtctaaggccagaccgcgtgctaaccgttggtgaaaagaggccgcgggggaagtttaactgcgacccgacggtgggcaccaaatgtacttaccaaaacctggaattgactgacgtcataggagacgtagcttggatgggctccacgatttcacacatcaaactgtag

SEQ ID NO: 93272 - DNA, 267 bp, Glycine max
  Peptide Sequence Number=SeqID_210050
atggcctgcacatccattgaggccgacagttgctccaatatagatttgtcgaccttctccccaagggtcaacaaatcctcatcaaaagacttgaagctgatggggtcagatgttgaaaaaaggtcacaaaatctcaaaggccctcaccatggcccaactattagggtggagttgagaagggactatgttcaagtgttcaagcatagcacacttgtacttaccaaaatccagagttgtcctatgtcagggtggacatggctaaggtag

SEQ ID NO: 93273 - DNA, 159 bp, Glycine max
  Peptide Sequence Number=SeqID_210051
atggcaagagtgagaggactaaaggaaaagttaggaaccaaaggttctatgccatttgtgggtggtgaggatctcctacaattccaacaagtggtatcagagccaccgttattgttggattattgggatttaaagttctttggttcctattatacctag

SEQ ID NO: 93274 - DNA, 666 bp, Glycine max
  Peptide Sequence Number=SeqID_210052
atggccccgaagaatctccctgctaaaaaagctatgaagactgctacaggagaaggatctagtacaactccacttgtggacatcgagtttgatgggcgccgcttccaaagtgaggagcatcagtgccactttgagttggatgagcccattgctaaatatgatcctgaggtagtcatggagttttatgcttatgcctggcctactgaagaaggcatcatggataaacgctccagagtgcgaggccaatggattccctatgacacaaatgctatcaaccaattcttggggcatccattgcatcatgacccagatcaatgtttatgtggcacagcttatctcagatgccatccactagtttgtaggtattgcccatccaagacacctagtggacccacagaagttcaacaaggcactgggattttcggcattgattacaagtctctaccaattctacggagtaccagtgcactgacaaagcttatccagcctcccattaacaggtcatccattgagaaatattgcatgccaaggcaggtcctacagatgctcaaggagctacctaaggggacccaggtggagctgaggatgatggagacacggcagatttgcttgatttcttcattggaggaggctgagctccccgaccatgatcttctaaatttatga

SEQ ID NO: 93275 - DNA, 279 bp, Glycine max
  Peptide Sequence Number=SeqID_210053
atgttgattgatgttggaaatgcattggcatgtgcatgttgtgtatgttcgtggggggcactgtgcactgaccttccagggtctttggcactactttttggccacgttcatacgttggatgttgtgtatgatcgtggggggcactgtgcactgaccttccagggggcttgtcacttggtagggaacacctttggctcccaggctgatcacctatgggaggggggctgttacatgcacaaccgggtggtctcgacaaactcagcacagttccctaagtga

SEQ ID NO: 93276 - DNA, 279 bp, Glycine max
  Peptide Sequence Number=SeqID_210054
atgccatctgcaccagcatctgagttaaagcagcctatccctcaggattcaccagccgctcaggagaacatcatccacaagaagcgtggttcaaagcaaatttgtcccaaatctggaggagtaattatcaagcttcatagcgtgacagaagaatctagcagagcatcaatatcaaggtcactcgctaagcctgagatcagtgcgctaagcacagcagttgtcttcaaccaggctcagcgcacaactggctctaagctcaaattcacttactcgcgctaa

SEQ ID NO: 93277 - DNA, 252 bp, Glycine max
  Peptide Sequence Number=SeqID_210055
atggcatgggtcctcctccacgcagctgacactgtccaccagcaccgcccgtgccttcaacgaagcaatgcagcacttgtcgtcgccgtagaagcggaggcgaaggacgacacaatgcatggagatctcagatgcgtcactgttgaagaagaggttttgctggagaggagggagagtgcggttagggtttacgcggagagactgatgcgatgggccttggaagaaggatctttgccgccacgatccagctga

SEQ ID NO: 93278 - DNA, 114 bp, Glycine max
  Peptide Sequence Number=SeqID_210056
atggagaagaacttggtgtttgctacccgtgatgatgttttgcattgcgctcgctctattgcgtatgatattggttttgtggcaatggtaatgaagtcagacacaaatacttga

SEQ ID NO: 93279 - DNA, 619 bp, Glycine max
  Peptide Sequence Number=SeqID_210057
atgtttgggcctttttcccttataaatgtagttggtggcattgaagagtttgatgatgctggacaaagccggaaaaatatggttgaagtagcaactgtgatgaaaataattaaaaattgttttaaaggacatttccttaggagtagcaattgggtcatccacacagatatctatgtttgtgtaattgatggcttgatgcagcattcatggtccataatctgcgacaattgcagggtacaagcaagcaagcaggggaaggaactttgtatgagaaagaggtttgaaagggtcagcgccccccagacaggcgcttccacggagcacgctacacgtggcacagcgcggcgcacgaggcagcagcagggtagcgcccctgacgagggcgcgtctggtagcgccctgccgctgggcgcgactggtggcgctcagcgcgtgggcacgactggtcatgcccctaacgcgggcgcgacccaggcgccttccccccacacccccaagcctcttcccacaccccccccccccggtctcttcttgtcacaccccccagcctcttcccaaacccctcagtctcttcttctcacaccccccagcctcttcccacaccccccaccccaaaatt

SEQ ID NO: 93280 - DNA, 588 bp, Glycine max
  Peptide Sequence Number=SeqID_210058
atggtatcaaggtatgcgctaaaccagattgctgcaaagtttgagcgtgtaaattatgttgacatttacaattctcgttgtggatgtataatgagaactactcatggtcttccatgtgtatgtgagctggctagatatgttcttggtagcataccacttgacacaatccatatgttttggtggaagcgaagttttttagaccaaggtttatctgaacccgaagtcaacataaccaaaaagatagaagtcatatccaagtggtttgaagagcttgatgtatgtggcaaagtgactctaaagagtcaaacaaaaggtgctcaaaagaaacaaataagcaaacaacaaagatcaacgaagcgttatccgtcttactgggagtatgtggatgcattacatgaagattcatggtctttggttcgtaaccatttgttgaaagaacttgcacaatctgatgagtatatgcacctccttggtggcatagacagatataaggagttaaagcggtcgctacttatatccatggttaccatggataagtggatgaatataaccgacatgggttatgtgattgcatcaaggtatttctaa

SEQ ID NO: 93281 - DNA, 252 bp, Glycine max
  Peptide Sequence Number=SeqID_210059
atgatgcaaaaagggtcgaggggagttggatctgatgctcttacttcttacgagagcttgaggccggttattaacttggcctatattacaaggaactgttggaatatgaatgaccaaaaagttaattttcctggggcaaggaagaccaggctcagagcagctgatgctccttcctcctctgtaccaatagctggcgtaccctcatcttctactcgagctccacctccagtatcagcagacccaacagcctag

SEQ ID NO: 93282 - DNA, 498 bp, Glycine max
  Peptide Sequence Number=SeqID_210060
atggatgccgccaagcccaacatggttaatctctgcgatgtcaagatcgtgaagaagctctgcaacatcgtcgatgacacagagcatttgaaaggtcgtggtggttttggtggtagcggtaggttcaggggtagtggtaaaggtgacagaggcagaggaaggggtggtggaggaagagggggagacaggggcacacccttcaaagctagaggtggtggtggcaatggaggaggaaggggtggtggccgtggtggcaacagaggtggaatgaagggaggtagcaaggttatggttcaaccctatagacatgatggttttttcattgccaaggataaaaaagacgctattgttaaaaatcttgttcttagtgaagctgtttacaatgagaaaaggattactgttcaggtttcttttctttctcaccattatttttttttcttcttaagtattgaaccatggatgcatgatgtcgcaacctacccttcggcgggagggtga

SEQ ID NO: 93283 - DNA, 759 bp, Glycine max
  Peptide Sequence Number=SeqID_210061
atgagagcagttactcttgacggcaaaacaattgaggagtacttgcaaaaaatcaatgggtttgtggatgaacttgcgggtgttggtgtccctgttcgtcatgaggaatacgttaacgcgctgcttgaaggactgccatcggattgtgcatcggtgattgaagcgttgctctacggacatgaaactcgactcatgcgctacaacaaagaagcacaggtgatgaactctgcttcgataaattacacgcaaggctatttgtatccaaacacctataaaattggtgattctggtggttctcgcaatgcatatggttgtggtggtagtcgtggtgccttttcggactgtggtgcgggacatggtggtggtggctccggcagaggtcatggtggtggacgatttgcaaattttcaatgtcaaatatgtctcaaattttggtacatggctaatgtttgtcattttcgatctgatgtgaccttccatcctcatgaatctttaactttcattgatcctactacattacgtgtacaacctatcccatactctattggttcagtcagaacctcaaacacctgggttaatctgaattctaagaattttggtccaagtcatagtcagcctagtgccatgctcactagttcaacctctcaagggaattggcaagttggtaccacctggattccagattttggagctagctttcatgtaactggagactcacaaaatattaaacaattcacccactttgatggaccagattag

SEQ ID NO: 93284 - DNA, 180 bp, Glycine max
  Peptide Sequence Number=SeqID_210062
atggttcgatcttgcattttaatctcttttcgatttgtctcacctcgccgtcattgggtcactacttactatggaggccatgtttggctcactgcagcaagttgtgtaaccaaggatatcaaagagcttgggtttaggagaaaatatctggttcagatctttcttgaggcttggcagtga

SEQ ID NO: 93285 - DNA, 1305 bp, Glycine max
  Peptide Sequence Number=SeqID_210063
atggattttctgcttgagggtaacgggaccagagaccaagtgttactgggcatgcgagcattgtactcttgctacatagcttccttccactcaggagatgagagagcatgtttaacaaaagtaggttcagtagcagttagaagaggagtagcaaacgggctcattgattgtgaccaaatttggaaaggaaaggtttacatgaggagaaacaaggaagttgaagatgcacaaactctccagcataaccatgagtctgaaccgagggagaatttagttagtggtataggtaaaccttcttcttctaactccaatgatcaagataacccttctgaaatgaatatacccatagctcttcgaaaaggagttagatcttgtactaagcatcctctatccaaatttgtgtcatattcaaatttatcttcatcttttgctgcgtttacctcccggttgtcttgtgtagaaacctatggtatagactactcagagacctttgctccggtcacaaagttaaacacggttagaattctcctatcacttgttgcaaacttggattggcctttgcaccaattagatgttaaaaatgcattcctcaatgacgacttggaggaagaggtatacatggatagtcctcttggcttcgaacacagatttgggacaaagtctctaagggcatggttcgaaaaatttacccaatcagttaaaaaacaaggatattctcaaggccaagcagatcataccttatttacaaaattttcttctaaagggaaaattgctgcactaatagtctatgttgacgacatcatcctcactagagatgatgaagtgcaattggctaggctaaaaaagaacttaacagcagaatttgagatcaaggacttgggatccttgaggtactttcttggcatggaggtttctcactcaaaaaggggaattgttgtttcccaacagaagcatattctagacctcttggaagaaacaagaatgagtggttgtagaccagcagatacccccatggatcccaaagggaaactttgggaaataggaagtgttcctgttgatgttggaagataccaaaggttagttggcaaattgatttacttgtctcatacccgacctgacattgctttttcagtgagtgttggagaccagtcagggtcacagtgtttagcgagaatgctccaaccatgtgggatcgacacatgcttaaaggagcactcaaaccgggtgaccctcaaggcctacattccgaagagtccgttagggcctctccctcctgattcaggtccaacccagaaaacattttag

SEQ ID NO: 93286 - DNA, 849 bp, Glycine max
  Peptide Sequence Number=SeqID_210064
atgttgacaattgctcttactcatcactggtctattcagaaaatcgatgtgaacaatgctttcttttatggctatttggaagaagaagtctacataacacagtcacctggattcgttgattctgataaaagtatggctaagatggttgatgccaaaccaatattcactcctctgccctctgatctcaagttaactaaacatggtacaactaagcttgtttcagtacctgttgttgatgatgctaccctctatcggccagaagtgagctacaatgtaaacaatgtctgtcagtttatgtcagaacctatggaggaacattggaaggctgtcaagcgtatcttaagatatctaaagggtactatagactatgggttgtctttaaaatctgctcctcatggagaactctatactctagaagctttctgtgatgctgattggggaatggatatagttgacagaggatcaatttcaagggaatgtattttctttggtcctaattttgtttcttggtggtcaaagaagcagtcctctattgctcgatcaactacagaagctcaatatcgaagcttggatgtttctgcatcagaacttctatggattcaatccttactaagagaactatgtattaaaattactactccagctgtctattgtgataatctcagcactgttgctttgagtcacaatcctgttcttcactcaaggaccaaacacatggaattagacatcttttttgtgagagaaaaagttttggataaatctctgctggtgtgtcttgttcctgcctatgctcaacttgctgatgtgttgacaaaacctcttgccaagcagtcttttctgaatttgtga

SEQ ID NO: 93287 - DNA, 294 bp, Glycine max
  Peptide Sequence Number=SeqID_210065
atggaggagcatgaggaatcatgtagccatttatttttgacatgcagagaagtagatttcatatggaaatattgctttggttggcttaattacagttctgttcttgccgcaaaatatcagcttcacagcgtggtcatggcagatccaaagactttagctaatccttcaaccaatgatgcgtcagtcctggagcatctttggggtatgaagtttgatccctttggttatattattctgcttggtattggtgtcaagttaagttgttggaaggtgtcgagcattttgaagtactaa

SEQ ID NO: 93288 - DNA, 348 bp, Glycine max
  Peptide Sequence Number=SeqID_210066
atgggtcttggaatgggtctcgacccattagttgacccgacagaagcagtggtggtcgaccattatagctactgtggagtgatagtgcgccagcttgtgttccagcaagcgcataatggagatcatgcgatggtggagcacacgcttgaacgtttcccattgaaggtgaagttcagtgttggtgaggaccttgaaccatacgattctgccttcacgagccaccctaccagatcatcgtcggtgaaaggaggaaggtcaatgatagggaaaacacagatcacagagcaggggtacaaagagaacattcagcagaggtgcagaatatggaaaagcccaaaaggagagtaa

SEQ ID NO: 93289 - DNA, 386 bp, Glycine max
  Peptide Sequence Number=SeqID_210067
atgtggtggcaactgggttccaacccatgtctatctgggccgccatttgcatctccttatttgggaaggaaaggatccatcatcaccgaagctacggactcaccagtaactgacaatgttcccaccagcaatgatgaagaaatgttgtgtcaaacactagactatggtgcattggacctaggcgagcttgctcagtctcaaaccatcaagtcgaagtgttcttcccatttcggggtgcaagcagcgcaggtaaaggttgggggttatactctgattgtagatgcattcgtgttggacctgggttgtgttgatttaattccagggcactatgatcaatctgtaagggcatcaccttcacgaccgttacagaacaatcgcattataag

SEQ ID NO: 93290 - DNA, 2862 bp, Glycine max
  Peptide Sequence Number=SeqID_210068
atgaccgaaccacctccttcttccgccgacaaattggaagagcttctcgtccgcctcacccaccaacaattatccctcaccagcaaaattgacgatctcatacatcacgtttcccctttgataccacccgccccgtccttctcctcacctttacctcgtcaattccccgttcctgtaacccaccatagaatgaaattagacgtaccacggttcgatggtacagatcctttgggctggatttttaaaataaaccaattcttcgagtaccacggcacccccgagtacgagcgtttaacgattgcatcgttctatatggagggccgcgcactctcttggtttcagtggatgaccagcaatggtcacctcacatcttggcctgtgtttctccaggctttgcaatcccggtttgccccttcgcagtacgaagaccccacaagggcgctgtgcaaactcatgcagaaagggacagtagctgcttaccaggcggagttcgaggatctttcgaatcgtgtttccggcattcctccagcggtactcctcagctgcttcatctccggcctcctcccggatatccgccgcgaggtgcaagcgcaccagcccctgaccctctctcaggccgccggcctcgcccgcctgcaggaggaaaaactcatcgaccacagacccccaccgccaccccctccccaccgccctcgccctccgccaccttctccctcgaaccccatttcacttcgccctaaccctcttccccctcttctcacgccttcccctcgacccccacccccaccgccacccttcaagcgcctcaccttcgacgagatagcctctcgccgtgagcgagggctctgcttcagctgcgacgagaagtaccaccgggggcaccgctgcgcctctcaggtattcctgttgctagctgaagaggaggataaccctaacccacctcttatagagccattggaccacatacccgaacccgctcctgacccgcccgatacccatgacccgtacccggcccaactcagtttaaactccttagcgggccacttagcccctgaaacgctccgtttcgtagccaccatttccgaccgtgacgtcgtgctcctggtggacggaggaagcacgcataacttcatccaactgcaattggtctcccaattgggcctgcgtcccatgtctacgtcacccctccgtgtcatggttggcaatggccaacaattagaatgcaatttgttgtgctctgctgtccctattactattcagaccaccacatttcacgttgacctttatgtactaccaatctcgggtgcaaatgttgtccttggagtgcactggctcaaatctttgggcccagtgctcaccgattacaatcacctgacaatgcaattcttctatgaaggcaacttgattcacttacagggggacatggatgctgccctgagttcactttcttcgttacaatttcgcagactgagtcgtaagaacagggatgggctctattaccatatcaccctcttacccaatgttgacacctccacgcaggacttgcctccaagtatccttactttattgaccaaatacgataccctgttccaccctccgaacacactacccccaacccgtgacaccgaccaccacatccatctccttccccaagcacctccggtcaatgtccgcccataccgttatccccattaccaaaaacaggagattgagtctcaggtggattcaatgttgcaaaagggccttattcagcccagctctagccctttttcctctcctgttttgttggttaagaagcaggatggttcatggaggttctgcgtcgattacagggcactgaatgcgttgaccgtgagagaccggttcccaattccgacgatcgatgagttactcgatgaattgggtggcgcaaggtatttctctaagcttgatttgctccagggctaccatcagatatgcatgcaccctcccgatatccctaagactgctttccgcacccatcatggccattacgaattcaaggtaatgccattcgggttgtgcaacgccccctcatcatttcaggccaccatgaatgctattttccgaccatacctccgccaattcctcattgtcttcttcgatgacattttgatatacagtaactccttggatgtccatgtgcaccacctcgagctcacctttcaggaacaggtcgaatacctaggtcacctggtttcccaccggggagttgaaccattgccgtcaaaggtcgatgctatccagcagtggccgactccaagaacggtaaagaccttgaagagtttcttaggccttgccggcttctaccgccggttcatcaaaggctacgcaaccattgcggcccctttggttaaggcaaccactagtgatgcactccgatggacggcggatactcaaactgcttttgatcgtctcaaacacgcgttatcatcggctccggtcttggccctgccggactttaccctgcccttcacggtggagacagacgcctacggggttggcatgggcgccgtcctttcgcagcagggacaccccattgcctacttcagtaaaccatttagcgccaagctcctccggtcatcaacatatgtccgtgaattgtttgctatcacggcagccattaagaaatggcgtcaatatctcctcggacatcacttcatcatcgtcactgaccacagaagtctgaaggaattgctcacacaggtaatccagaccccggagcagcatacctacttggctcggttgcttgggtatgattatgaaatccaataccgggccggtgctcataatcaggccgccgatgctctctcccgattgccggaaaccactgcttctctttgg

SEQ ID NO: 93291 - DNA, 1308 bp, Glycine max
  Peptide Sequence Number=SeqID_210069
atgtatgtcggggtaaagagtgtcacacaaggggcttcccccacttgtgcctgcaatcactctatcaacctacaaccaggaaccatccctatcaacgtaaggccatacttctatgcttaccatcataaggacgagattgagaaacaagttcgagagcttcttgacaacggtgtgattcatcactcaattagtcccttctccggtcccgttatattggtcaagaaaaaagattactcttggcgcatgtgtgttgacttcagagtcctcagcaagattaccattttggataagtatccaatccctaccatcggcgagcttaatgacgagtttcatggctcacactactttttcaagctcgatttgaaatcccgatttcatcaaatcagaatagtagagtccgacatcccaaaagatgtttttcgcacatatgagggatattacaagaggaggccaagcttcatttgttccatcatcaacgatcatgatcctttgttacttagcaagttttggggcgagttgttccgtctccaaggtaccaagctgcgaatgagcaccacatatcatccccaaaccgacagccaaaccgaggtcgtcaatcgttgtttggagacatatctgcgatgcttcacatccgagcagccttccaagtggcacttatggctatcatgcacccttcatctcattcggccacaactaaaacaccctttgaggttttttatgggtgacccccaccatccatcttgcgtttccttcccagcgagatgcaagtggactctgtcacttctgttctatttgaccgcgatgaaccttttcaccagcttaataaaactacgctacatcatgtgtcgcatcaatccaaaactctctccacgctattttggtccttttcatatcctgtcccacgttggcgaggttgcctacaagctgcaacttcctgattctgctaaggttcattctgtcttccatgtgtcacagcttaagaagtccttggccccagcttccagtgcctcagctctgcctccggggctgctctctgatgatcctgatgcacctgttccagaagctgttctagcttctcgtgagggtaagactgctggacaaacagaatggttggttctgtggcgatcccaacctgtggaagaagctacctgggaagcagcagactccatccatgccaaatttccaacatttagccttgagaacaaggctgatttgacagatgggggtattgtcaggaaatgcacctcaaaatgggagaagccctttaaggtgtatagtcataggcccaagaccaagttaatgagctga

SEQ ID NO: 93292 - DNA, 339 bp, Glycine max
  Peptide Sequence Number=SeqID_210070
atgtctgttgaaaatctcccatgggtcatttctgacggacatggtgatcgcaaatttttcatggaccattttcgatggatttttgcgtcgcaaattttcgtcggaaatgagagtgtctatgttggtcatctgcttgctgatcatctgtctgctagtcatctgcttggtcctggtgatggtcctgatgttgttggtgaggcggttaatctctgcagcatcttcagcgcgcctggaagatccttgcgtgtgctgcttgaagctgtcacttcctcatttgtaaggtctaagggagtgagttgggatttaccaacacttgatgcagcatcagacctagcttga

SEQ ID NO: 93293 - DNA, 837 bp, Glycine max
  Peptide Sequence Number=SeqID_210071
atgagagaaaggagggtggtgatgaggtcttcatctctaagaccaagagttagttggctcgggagagataagtgtagaagaccagaaagtaaccttcaacttgagcaagaggctgaccttgctgcacaacacctgactattcactcttcattggaaaaggccttgataaatgctattgattgcctgaccaatgagggggagaaggatctcagagcctgtttggaggacttagacaggttaaaggagatcctctcatgggaatatgcttttgaaaaattgaagaaagacaacacaatagagaagcccaaagtgaaattgaaagtattacttgttcacctgaagtatgtatttctagaagaaaatgaagtcaaactagtagtgataagcaatgatttatcttcagatgaagaggcacggttggtggaagtgctcaacaagcacaaggcaaccattgggtggcatattttttatctcaaaggaattagtccttcctattgcatgcataagatcatgatagacgatgagtatagaccaatgagacaaccgcaaaggaggctcaatccatccatgaaagaagaagtacgaaaagaagtcctaaagctacttgaggctggacttatctatcctatttctaacagtgcttgggtaagtccagtccaagtggtacccaagaaaggcaaaatgactgtggttcgcgatgagaaaaatgacctcatttcgacttggactgtcactggatggaggatgtgcatagattatcgcaagcttaatgatgccacaagaaaggatcacttcccccctgccattcatggatcagatgttggagcggttaggtag

SEQ ID NO: 93294 - DNA, 844 bp, Glycine max
  Peptide Sequence Number=SeqID_210072
agggctatacgccctcaccttcaaaggactacacgtcctccccatcagaggactatacgtcctcgcctttagagggctacacgccctcaccttcagaggactacacctacacgccctcgcctttgtagggctacacgccctcaccttcagaggactactcgtcctcaccatcggaggactacacaccctcgcctttagtgggctacacgccctcgcctttagaggactacacgtcctcgccatcagaggactacacgtcctcgccttcagaggatttcacgtcctcacctttagagggctacacaccttcgtcttcgtaggactacacgtcctcacctttagagggccacacgccctcaccttcagaggactacacgtgctcgccttcagaggactacacgtcctcgccatcagaggggtacacgctttcacctttagaggactacgcgtcctcgccatcagaggactacaaattctcacctttagaggactacacgccctcgccatcagaggactgcacgtcctcaccttgagagggctacacgccctcaccttcagaggacgacacgtccttgccatcattcctgggccaccccctgatcctagaggagggcgaactgtgcgagcacaactagaggaggaggctatcacgcagctactatgcataccggggcaagatttcacctgtgcctctgcaaagagacgagtgtggatcatgcacaccaacatgaccactgttacacagatatggatgacgttgctacttagaaacattctgccgagcgaccacaatgccgatctccccctgcggaagtatcagttggtctgtgccatcatggcatag

SEQ ID NO: 93295 - DNA, 723 bp, Glycine max
  Peptide Sequence Number=SeqID_210073
atgtcgaccttcgaggtcttcctttctttttctttttgttttatgtccaccttcagaggactacacgtccttgccatcagagggctgcacgccctcaccttcagaggactacatgtcctcaccttcagaggactacacgtcctcgccatcagagggctacacgcccttacctttagaggactacacgtcctgccatcagaggactacacatcctctcctttagaggactacacatcctcaccatcagaggactacacgtcctcaccatcagagggcaacacgccctcatatttagaggactacataggactacacgtcctcggcataagaggactacacgtctttaccttgagagggctacatgccctcgccatcagaggaccacacgtccttgccttcagaggacttcacgtcctagccttcggaggactacacgtcctcaccttcaaaagacttcacgtcctcagcttcaaaggactacacatcctcgcctttagagggctgcacgtcctcgccattagaggaatagacgccctcacctttagaggactacaggtcctcgccatcagaggacaacatgtcctcacctttagaggacgacacatcatcgccatcagagggctacacaccctcacctttagaggactacacgtcctcgccatcagaggactacacgtccttgccatcagagcgcttcacgccttcacctttagaggactacac

SEQ ID NO: 93296 - DNA, 186 bp, Glycine max
  Peptide Sequence Number=SeqID_210074
atgcatagaggccatgcagcagatcccccaagtgttgtgacagtgcaagaatggtacgcattctacgacagtcataaggcaaggaccgatgtagaatggtatccaatctacgacggtcatgaggccaagaccaatgtagaatggtacccaatctacaacggtcctacgcatcatagaccgatgtag

SEQ ID NO: 93297 - DNA, 258 bp, Glycine max
  Peptide Sequence Number=SeqID_210075
atgtccaacattgtgaatttaatgtgtttcaacttcaatttcagcgaggcttgtgcgcttagcgagaatcatgcgctaagcgaggcactcagcccgcttagcgacgcgcccagctcgctcaacggatattcactaactcgcgctaagcgtgaaaatggcgctaagcaagccttcgaggacagaaagccctttttaaggctgaagttggaaaactcaaggattggtatgatagagcgtggattggaacgtagagagtag

SEQ ID NO: 93298 - DNA, 279 bp, Glycine max
  Peptide Sequence Number=SeqID_210076
atggtagagaagtgcatagaggttttcatggacgattgctcagtctttgggccttcatttgatgactgcctgacaaatctagagctagtgataagatgttgtgttgaagcgaatctggaaggaatagtgttgggtcataagatctcaggtcgggggatagaggtggaaaaagccaaaattgatgtcattgagaagctacctccaccagtcaatgtaaaaggtattaggagtttccttggacatgctggcttctatcggtggctcatcaaggacttctaa

SEQ ID NO: 93299 - DNA, 657 bp, Glycine max
  Peptide Sequence Number=SeqID_210077
atgggagtactaagtatttattacctatctttaacaaaaataggtcagggaggtggagcattgggaagtacaggcggtccccatgttgtgcacagcaagaactctttcccaccatatggcttgccttccaattatacaccaccagatgctgcacacactctcgatgagaatgtcaaaaactccactcccatactcattgagagccaacgaccccaacctgatcatgcacatgtctctcaacccatgggggagacacatgaagcacctcgagaccacaatctagctgactttgaacctcacctcggatatgccgctaaggggcgggcattttgtggcgtacccctgccaaacactttagggggccctcagtatcacccacaaccacaacccttgcattttgaggtaggaagagtccctcctactatggtggaaagggagaaattcaatcatatggaggaaaggctaagggccattgaaggaggcggagatcatgtttttgctgacatggaagaattgttcctagtacccaacatggtcattacttcgaagttcaagatgccggatttcaataagtacaagagggatacttgccctaagaaccacctaaagatgtactatcagaagatgggggcatatgcgaaagatgaaaaattatga

SEQ ID NO: 93300 - DNA, 405 bp, Glycine max
  Peptide Sequence Number=SeqID_210078
atgacattgctacttagcaaacattctgcccagcgaccgcaatgccaatctccccctgcaaaagtatcagttggtctgtgtcgtcccgacatggggatcgcacccacaaagacacccagtggacctgaagaagtccaacagggccctggggtttccagctctgggagtgcctgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaag

SEQ ID NO: 93301 - DNA, 167 bp, Glycine max
  Peptide Sequence Number=SeqID_210079
atcaagaagctatttgtctcttgaattgtgagtttcctaaaaacaagggaaagggatccctcgagatgtcagaagttataaaaaggaattttacaatgttagtggaaatctcaagtgggttgcttgaggactcgatgtcggcacaggaagtggccgaaccaggataa

SEQ ID NO: 93302 - DNA, 264 bp, Glycine max
  Peptide Sequence Number=SeqID_210080
atggatactacaggttttaagctttggtacacgaaaaaagtcagaggaaagaatggagaaggtgttatgatggacaaggtttggaaagaaagtgtggtggatgaaaaaaattggagacaaaatcttagccttaaaattaatggtggcacaagagactttcaatgtcaccaacttataaaagtggaagctcaagatcgcagactgatttctttttgttcaaaaagcatatgcggaaaagcagacaagttacaaatccaaggatga

SEQ ID NO: 93303 - DNA, 552 bp, Glycine max
  Peptide Sequence Number=SeqID_210081
atgtcgagcattaccgtgtgcgcgcgctttagaccttcgaactcaaaagagaagcaaaatggcaatgactctggctgcattcggaacatagacaccgaaactttcatttgcaaggatgagaaggatgaagaatttgtgtttagctttgatagagtgttctatgaaaaatctgagcaagctgatgtctatcaattcctagctcttcccatagtaagagatgttgttgttgatgcattcaatgggacagtaatcacttatggccaaactggagctggaaagacatatagtatggagggtcctggaatacttgaatgtgaagaacagaacaaggggctgcttccaagagttgtagaaggactttttgattccataaattctttggataaagaaaagacatattcaattaaattgtcaatggttgaaatctacatggaaaaagtaagggacctatttgatttatcaaaagataatatacaaattaaggagattaaatcacgaggaataattctacctggtgttacagaggcatatggtcttatgtacaagtactaa

SEQ ID NO: 93304 - DNA, 534 bp, Glycine max
  Peptide Sequence Number=SeqID_210082
atggagaaggtgagaatggagattgatgaaaagaggaagaggcaagcgaggaggttcatcgaggctattgaagttggagtgatgaagaagctgaaggcgaaggaagaggaaatagagaaaatcggaaaactgaattgggcgttggaagagaaagtgaagcatctttgcatggagaatcaggtgtggcgcaacttagcggaagcgaacgaagccacggcaaatgctctacgctgcaatttggagcaagttttggcgcagtgtggcggaatcgcggcggaggaagaccgcggcggcgcaaccgtgtgcggcggcgcggagatggacgacgcggagtcctgctgcgggagcacagaggaggactgcgaaggaaagaaagtggggtggcgcacgttagcggggtgcgcaggggtgaaggataaggacgaggggggtgagagtagtaatggaagagtcgtgcgtgctgattttgccgtgccggcatctgtgtttgtgtactgcgtgtgggtcttcactccacatttgtcctatatgtaa

SEQ ID NO: 93305 - DNA, 768 bp, Glycine max
  Peptide Sequence Number=SeqID_210083
atggtgaatacgcctactagtgatggtgatggttgtttactccccggtgatagctatccagattggttaaccttcaacagcgaaggttcatccgtgacatttaaaatccctcaagtgaaagggcgtaacttgaagaaaatgatgtgccatgtccattattcttccccagaaaatataacttcagatggtttgaaaaatttgttggtgataaatcactcaaaggccatcatccaactttataagagaaatgcattagtctccttcgaagatgatgagtggcacggggtactatcaaaaatagagcctggaaacaaagtgcaaattgttgttgtcttttggagcaaattaactgtttacaagacaacaatttatctcatatatgaaccaatgaatgaaaaaatagagcattcccatgcgccaaataagaatgtaatggattctagtggtgatgaaaatgaatgtgttgttgggaccatctcacttcaagtagaatccatatataagccaacaaatgacataatggagcattgccatgcatcaaataagaatgcaattgtttccagcagtgatgaaaatgcatgtgttgtcaggccgtcctctcctcaagtggaatccatagatgacttaagattggtggctactattaatgctctaaatctgattgctaaagaatggatacttggggaaggtccacttgttttgggatcttggtttctaagggagtccaacttgagcttgattctgatgcccttgattttaatcctttga

SEQ ID NO: 93306 - DNA, 375 bp, Glycine max
  Peptide Sequence Number=SeqID_210084
atgcagaccattcatgctcctcctgtcgattcaagggtctcgtatgatgatatacacgacaggtggatgcactacgatgatcatatcgtacttgcaagtgagccccgagtcatccctcaggccccgcagacgaatatccatcgcgtgccagagccaggagcatcgtcgacatctgcggaggagcccagacatgcagtggaagtttgtgatgacattgctgagaggttggagcgtcatctgagtctaggggtggtcacgcctggctcatcgacacatgaggtgatcgaagaatgcctcagattgaccaggagtgtgacacaggaccatctagtatacgttaggtgtagacgcaggcgacacactgatcaggcgtag

SEQ ID NO: 93307 - DNA, 975 bp, Glycine max
  Peptide Sequence Number=SeqID_210085
atggcatcgttcagccagatgcagtcccagatgcaatctcagggacttgcactgcctcttgagcctctggttggaaacgatcctgagacaggtgactcagataggtgcggcttgtacatcgaagcaaatcctgaccgcctggttaccctgtggagagtttatgagggatccactgttgttcataacactcctttgttgcctagccaagtaaaggtgggtgtggaggaggttaaagatgcagatgctccagttcctgtacccactgatgaggtttccttagtgaggcaggcaattcacaccttctttgcttggctgacacatctggtcaagtctttatcacagcaagcagttgtgtctccggcaaaaccacctcaaaagtcggatctggaggtagatgatccactttatctgatgacattgaccatctcagaccttttcttgaggccttaccaggttacatgggatgccaccgtgttcggggtctttaatccagacttacccctctacataaagcatgaagacctctccaaaatcacacatggtggtcaatgtctcaccatatcagtgttacagttgtggatttttatgcgagcggggaattcggatatctatggattcctcaagccacagtccattcagaggtctgggcaattgcagtttgagactgaaagttacttaaagagttggatgcagagtgcaaaacgtgatgtttatcttagggcctacctgaatggcggacactggcagatggtggtcattgtgcccaaggaacacctagttgtctggttttgttcattgcataataggccagacaactaccttaagggaataattaacagtgctttaaaaggtcttcatgatgctccacaacctaaatcaaaggctcctgctaggtggattgtcgtcaagtattttaatgatgctagaccattggagccagagggattaaaggtgttgcggatccagtgggcatag

SEQ ID NO: 93308 - DNA, 258 bp, Glycine max
  Peptide Sequence Number=SeqID_210086
atggacgccaagttcggaagcctcttcgaatccatcggaaacttcttcaccggcggtgaacagatcccgtggtgtgaccgtgacgtcatcgctggctgtgagagagaagttgcagaggctgctaatggtgactctgaggagcggaagaatgagagtataatgaggctgtcatgggctcttgttcattcaaggcaaaaggaagatattcagcgcgggatagccatgcttgaaatatgccattctgatctgcttttgtaa

SEQ ID NO: 93309 - DNA, 186 bp, Glycine max
  Peptide Sequence Number=SeqID_210087
atggcatgtttgggatactatacttatacatccatgattgcacctgattggaggcaggcactatcccttaagaaaatagttgaagatcgaattgctaaagatggtgtaataggaattggcatcactgcaacagctgtgggacttatagttggtggcattgctacggcactggccaggaggaattga

SEQ ID NO: 93310 - DNA, 609 bp, Glycine max
  Peptide Sequence Number=SeqID_210088
atggcagcaacagagattgggttgttggagtgggtgagagtgggaggggaagaagaagaagcagaacaagcaaaagggtgtttgagcaagttcgtcgataatggcagcgtggagagtcacagatactacttgtctcgcagaaccactctcgaaatgctcaaagacagaggctactccattccctctcacgaaatcgacctttctctctccgatttccgcgacatgcacggccaattccctgaccctgatcgtcttcgtctctccctcactcatgccaccaactcctccaaaaggattttagtcatattctgtgggccaggtgttgtgaaagttactgccattcggaacattgcggggcagataattaatagagatactttgactggcctcatattgatagtggagaatcatattactagccaggccttgaaagcggtcaatcttttctccttcaaggttgaaattttccagcgctattgcgtagcagaatttctcggatccgcgattttgactctgtctgctattgcagccactatgagtgtcgtggttgcagcatgcatcctcttgtcatctctggcaagtctccagccaattgaactttggggttaa

SEQ ID NO: 93311 - DNA, 576 bp, Glycine max
  Peptide Sequence Number=SeqID_210089
atggagaatgtttatgtagtcggacacgaggagggtggtctgtgtgcttataaagataaacttttgaaacctctaacagggagtatattatggataggtgatgtagaaatgaatgtggaggagaacttgcttgaaggcatacctaaagatgttgtgttgaacctatgtaagttatgtgatggtcaaatgattcctttatctgaagaggaacttgtgagttggatttcaccatggagaattatgttggtagttaatgttttgggaaaaagatggaataaaaaatgcaaaagtggcatccatggaagaatttcagaaattgaatggaagaaaaaagttagacaagatgctaccattaaaggaggagtagggacgagattcttgattttacaaaagaaggacaatgtggaaccaatttttggaaatgtttataatggaagtttgatgcttaatgagagtggatcaatcatgattgagtcaaaaagggcaactgttatggaaaataaaggaaatgtttatgtttgtcatttggagggtctaaataaaaatgtgattgctcatgattctagtcccaaatag

SEQ ID NO: 93312 - DNA, 399 bp, Glycine max
  Peptide Sequence Number=SeqID_210090
atgcaaatgatgttctttcacctccaaggtgaacatactgtatatttcaataaacatgaagatttagatgaggtcatcaataaaataagtgtgccaaatcaatgctcacattctcgaatggttgcaaaccaagtatttcctaaagccaaaaatttgaaatatgctcaatttgttttaaacgacaaagatttagaaaccaagaaaaaaaggtcataccattggaaactgatatgggttcctccaagtacagctccattggagcttgtaggcctaggatcttcttcatcaatagattcctttgcttcttggaagatgaatggcagcggaatggagaaggaagagagagaggagacaccacttcaaggagaagatgagtctagaagaagatcaccaccatag

SEQ ID NO: 93313 - DNA, 755 bp, Glycine max
  Peptide Sequence Number=SeqID_210091
atgggttgctcagcctcaagaaccatcaccatagtggccaacaacaataaccaagaggatccatctccttctgcttctcttgcttcttcttcttcttccttctcttcctcttctgcttcacacaaatccatcaactctgcttcttcaccagcagcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttag

SEQ ID NO: 93314 - DNA, 582 bp, Glycine max
  Peptide Sequence Number=SeqID_210092
atgttttcttctgcaatttctccgaagcccttccttcggtccctcgtcattgatcgttacgctcagagcacaactactgcaaccaggtgtgagtgcttggggtttaacaagtcagaaaatttcagtaccaagagagagttgtgtgctgaggggttcaagctgaattgcttggttgaaaatagagagatggatgtggagtcatcatcatcatcatctttggtggatgatgcttccttgagcttaagtgaagaggatttaggggagcctagtatttcaacattggtgatgaatttcgagagtaagttcgatccttttggagcaattagtacccctctttaccaaacggctacttttaagcagccttctgcaatagaaaacggcccctatgactataccagaagtggaaatcctacacgagatgctttagaaagtttactagcaaagcttgataaagcagatagagccctgtgcttcaccagtggaatggctgctttgagtgctgttgttcgtcttgttggaactggtaccttttctttcttcagtgtgaaaaattctgatccttcttcattgttaattatttga

SEQ ID NO: 93315 - DNA, 942 bp, Glycine max
  Peptide Sequence Number=SeqID_210093
atgtgtaggccactgggattcagggaatcagtgagacagcagaagagaaggtcaagagagatggggatgggatttcaaaacctgaaagatgtcagttcaaaactagagatgtgcaatccagattgggacaatgtagcaagattgaaagtttggcaaaagcttgaagaagaaaatgaagaattcttcaaggcttattatgcaaggttggttttgaagcagcaaataatgcaattcaacaaattgctggatcagcaagtgcaattaatgcagttacactcaagtgctgttgcatcactacctatgtctaacgggtcacatatccctgcagtgacatcactacctaactctaatgggtcacatatccctgcaatacctgagaatccagcatgctacacttcagaccgaacccaaacaagtttgaagccagaaaatatgcaacatgctgttgattccagattatctaatgtgtttaataatggcggttcatcattacatacaagtatgcctgctgcagttgatatgtctgttcatggcaataggattaatggccctgctagcgtgctttctgctcaaagcgcaaacatgggtctgatacaaggaatgaatggtggcggaatgatcaaatctgagcctggatattctggttgttctccttatatgtttagtactgaaggaaatgtcctggagacacgcccaactattggtggtgcttcagttacgtcattcactaatgtcgagtccaactcacattctctgaatgaggcagtcctagatccagacacttcttcatttggatttctggggcagattcccagaaattttagcctttcagatctgactgctgatttttctcagagttctgatatactggagacctattctaggtcacccttcctagctacggataatgagaacttccttgacagaggagaacaaggttga

SEQ ID NO: 93316 - DNA, 198 bp, Glycine max
  Peptide Sequence Number=SeqID_210094
atggcactagacgcagcactctggatcgtgaagatgacatggattgctctcagtggctggatttcttcttgtttaactgtcgctgacgaattcgcctcttctctacgctctggcgatattggcccctttcatcgggtggttctgggtgttggaggagaatgtgtttgttgtgagattgattggatttccttgaattga

SEQ ID NO: 93317 - DNA, 453 bp, Glycine max
  Peptide Sequence Number=SeqID_210095
ttagcaataatggtgtttgctttgaagatatggatgctttatttgtatggagcaagtttgatgtgttcaatgaccataagaaccttaagtatccgtttgatcagaagaagctaaacgtgaatgtggtagtagatactcgtggcaggaaagtaatccatatgtctggtttgatggtgaaggcattagaactagtagagaagtttagagatttgaatgtggttttagattgtgattgtgttagatgtggtatgcttaaggtcactaatatttttcttaatatggttaagaagaaacaattgttagatctagagttgtgcaagaaaaagttgttgcgaatagataaagcagttgagtttaggttaggtgatgatgatgttttgaagtttaaaggttgtgtttgtacaccaagagatcaagagattaagaagctacttttggaagaaattcacaaga

SEQ ID NO: 93318 - DNA, 192 bp, Glycine max
  Peptide Sequence Number=SeqID_210096
atggacatggaaacgggtggatggtggaaacgggtggatgaggacggattttgcttactccatccccacatccaactcctcactttctcgcctctatccccaaatgggatgatgaatccgaggcacgtcccacaagttcgaatctcattgccatgcctacaaggagaagaagttgaagaacattgtgcatag

SEQ ID NO: 93319 - DNA, 639 bp, Glycine max
  Peptide Sequence Number=SeqID_210097
atgtacaaaactcgtctccaagactttacttcaaagtcaggcattcaatttcctgtctatcataccattaatgagggacatattccaaagtttagatcgacggtgtgggttgcagagatgcgttacacttccccatccacattttcccaaaaaaaagttgttgaacaggatgtagctagacttgctttggagggtatcctccataggaccagagatgaaggactctctcttgtcgatcagatttctccaattttcaagtctatcatgaatgagtatgctcataaactgcatgtagaacaacctacatacaacaatgataagcaactgctaggaggggtgcttcctgcttttataacttctttggttttcaatggtacaagttacactggtggtccagctggaacaaaaaaggatgttgagcagtcagccgcaaaggctgcaattctttcaattatgagtatcctttcgtgtatgctttattacatatttccagtagattttaggtggcaatgtgcttacctactaaatgactatttaatccagggaagaaggaagggcatgttagattatcctgtctcacaggatgcggatgaaaacatacaagattatttatcgggtttgtgggagaatgttttttaa

SEQ ID NO: 93320 - DNA, 192 bp, Glycine max
  Peptide Sequence Number=SeqID_210098
atgagagtgagattggcgtcgttcttcaccggggctgcagcggcgtcgtttctggggctctacaccctccacaaggattacaaggtcccgcaccaatcctttactcaacagatgtgcatatttcgtcttttgattgatggagtgaggactgtgcagagggaggcagactgcatatcccgatcttgcttttga

SEQ ID NO: 93321 - DNA, 270 bp, Glycine max
  Peptide Sequence Number=SeqID_210099
atgtacgttgcggatgggtgccgctccgctccgcctgacaactatgctacagacataaattacagtaggaaggaggaaggaacgaagcggaagcggaagcgaaatcgctttgtctctatattgagccactttgaatctgtcgccgcaacggtagatcaaatcgagtttcacatgaatgctctttctggatgcgatttaggtttgtctttgcttcctcaaatccgaattccgtgctttacgtgctctcatgttgtgttggtgaagccttaa

SEQ ID NO: 93322 - DNA, 847 bp, Glycine max
  Peptide Sequence Number=SeqID_210100
tgaacaagtgcttggagatgtttctcaggtatttcacttttcacaatccaaaagcttggtacaaggctttaaattgggcagagttttggtacaacacatcatttcacaccagcattggtatgacaccatttaaagcattatatgggagagatccaccagctctgactcgatacaatccacaggcatcagaccctgttactctgcaggaacaattgatcatcagggatagaactttacagcaattgaaacaacatttggaaaaagctcaagtatacatgaagaaccaagctgacaagaagagaactgatgtgtccttcacaattggagatttagttatagtgaagctccaaccatataagcaacactctgtcactttgagaagaaatcagaagttgggaatgatatattttgggccatttcctgttgtggccaaaataggaattccacaagaaaagtgcatgcctttgcctctaaccacaaccgatacaggtccagtaattgccccaattgacattctgcaaactaggtccattaagaaaggctcaaattttataccacaggtgcttgtgcaatgggacaacacgactccacttgaagtcgcatgggaggatgttaatgagatgttagacaacttccctaacttcaaccttgaggacaaggttgccataaatggggatggtattacaatgaagaaaaataggaaaggcgcattctcagccaagtcagctaaaggggacccacatggagacaaagggaataatgttgttagcagtggtccgaaaatgatggggcaaaggaaaggaatgaggaatcgcatgactagcaccaagcaaaccccactttatag

SEQ ID NO: 93323 - DNA, 177 bp, Glycine max
  Peptide Sequence Number=SeqID_210101
gcagtggctgcagcagctcagcagctttggtatgtaaagtttttgcttgttgacaaattgcacaagatcgaacaaattgttgcacatcatgcttcaaatctggctagtgaaactgttgtgtcacatttgtgggtggtggccactcatggattgcctgaaccatactactacccatag

SEQ ID NO: 93324 - DNA, 813 bp, Glycine max
  Peptide Sequence Number=SeqID_210102
atgtattcatacattcacaggattaatgtagcagatgccatttttaagtgcttgaagacgtgggagattgaagaaaaggtgttttcggtgtcagttgccaatgcttcttacaatgactcatgtttgaagaatttgaaagagaacttatcacttagcacaaaattagttatgaatgaagatttgattcatgttagatgtcgtgcacacatattgaacttgttggtacgagatgagcttgtgagtatccaactgctaatttgtatcttgcagaagtttggagggtcaagcaatgatcttcaacaattatatgatgagtatgtggctttaagcaatgaagagtcatcctcaaatgaaaggaatgttggtggcataaactctttaactgtccatgtgcctaatacatctgctatgactaggtttgatcaattaatgagccttatgcatgaaaaggaaataattccaccaatgaaatcagaactagatgcttatcttgagaagaaaaatacttatattcctaataatggaaactcctcttttattgccttggagtggtggaggaataacaacttcaaatataagattttatcaaagatggcaagagatacactagttgttccagtatcaatcgttgcatcagaatctacatttagggctggaggtagagtaattgatgagtatcgttctagattgaatgaagaatctattgaagctctcatatgcggtggggattggatttgctataattacaatttgaagagaaaaacaaaggtggatgatcaaccgcttgaagaaatcaccttgaaaatatcataa

SEQ ID NO: 93325 - DNA, 687 bp, Glycine max
  Peptide Sequence Number=SeqID_210103
atgtggtcgtggcacttctcatggagatggtcgtggttccaatgggaaatgcgcattgtgcaacaattgaaggaggctttggagggttgggagccaaaggtgggcaaagaagatagttggttgtggaagaataatgatgtgaaaaccttcatggttaaagaggtttatgcatcattaattacatatgggttggaggatgttaaagggttgttatggagggtacgacataacaggattcaaactaaagataacttaaggataaggaatgtactacaagatggaactagtcttaactgtgttttctgcaacctaagcatggaatctgcaaaacacttattgtttgaatgttgtttctctcatgaacattggcaaagatgctatgtatggttagggaaaataaaggtgtcacatgcggagtgtaaggagcattactctcaacatttcagaattttacgtggggcaaaggctagacgtgtgtggggggttatgtgcgttgcagtgatatggttgttgtggaatcgtaggaactatatcatcttcaacgaagcaaggctggacgctgagaaggcgttagattctattaaatatcaagcctggagctggtgtaatgcctacgtgaaagactttaagctatcattgtatatacggcacctagatttacccaattgtcatatgcaaattcgttag

SEQ ID NO: 93326 - DNA, 339 bp, Glycine max
  Peptide Sequence Number=SeqID_210104
atgaccgtcgtcatcgggggtggtggtggtgacaacaacgacatcctcaacaataatgatagtggaggtggtgacgataatgatactaatgatggttatgtcgatggaggtggtgataatgatagcactaacatgatcttcaccattgctgccaccaccaccagagatcatgttggtggtgacgacaacaatcaagtggtgatggttgaaataacagtgacaacagtcatgatggtggtggcaattgatgatggttgtagtggtacacatgacagttgtgacaaaaacagtcatgacagtagtgatgattatgatggtgataaatttgagatattttaa

SEQ ID NO: 93327 - DNA, 282 bp, Glycine max
  Peptide Sequence Number=SeqID_210105
atggaacgtttcagtggacaggatcccgataatgatatcttggtctgggactctctgggcatattgtacagtatggatgaaacaccaaagcttgtcggggaatcaaagtctaccaaagcgaccaaaatgggtaaaatcaaaggaaaaagccttgaagaagaattgaaagaattagacagttcactcagtgcacaatctcgcttaacgggcaagttcaagcttaggcatgcaatctcgcttaacgcgcagtctaggcttaatgtgaagaagacccacaaataa

SEQ ID NO: 93328 - DNA, 219 bp, Glycine max
  Peptide Sequence Number=SeqID_210106
atggtggctgcagtagaagtggtggcggcacatctgcggctggctgctgctggccctattaatgggaggccggataagcttggtgggagtaatcgacaacccataaaactggcagaggcccgtgatcaaggctggaaatcccagtgccctgttggacttctccgggtccactgggtgtctggaagacgtgatccctgcaaattgatagatgacatctga

SEQ ID NO: 93329 - DNA, 291 bp, Glycine max
  Peptide Sequence Number=SeqID_210107
atgtatttttttgtttctcaagctgaatttgatattcctgaagcatttgatttgaggaagaagaaaaaaatacttcagaccatagaccacacggagggcgaggatgataaagtacgtgaaaagtacgacataagcaaggagaagtggaactggttttgtcagagctatatagacccttcatgggagtattttactgatccaagaccattggaagcagagagaatgaaggcaatttgcattcaatgggcaagatattatctaaaatttaaaaatgaaacattaagtgtttaa

SEQ ID NO: 93330 - DNA, 204 bp, Glycine max
  Peptide Sequence Number=SeqID_210108
atgggagaggtggtaagcctcttcctcaactcctcaaatgcctatttgcaaggctattcaagcacaaagtctatgtccttttggagaagcttggacaatggcagggagtcgcaacctacccttcgacgggagggcgacacaagggctcacgggtgcgtcttccaagggaggaaggcgcgcggagtcgccaccaatgttggttaa

SEQ ID NO: 93331 - DNA, 297 bp, Glycine max
  Peptide Sequence Number=SeqID_210109
ccatgttgcaagatcgagaattcaatacttgagttgaccgatcctacagagcttgaatctcaatttgtgtctattaccgctgatcatgatcggtcaatgcttggctcaagtgagcctatagagcttgaatctcaatctgtgtctgttatcggggatcatgaccctcttctcaggattccattgacaccaactaagcgcgtatcttctgatgagttggataatgagcgaaaaaactttcagatttcacttgctgaagtttcctcgaacaaattagccaagcattctcagcctgaatga

SEQ ID NO: 93332 - DNA, 363 bp, Glycine max
  Peptide Sequence Number=SeqID_210110
atgaggcgccagcagctacacttcgcggcagttgtcgcggcgattgtcgtcaccgcttgggttgcgcacatgcgcggcggggttggccaatcggaggccaagggttggcagttcgaggccgttccgattgacggcgccgtcggaccggagagcttctccttcgatcctcgcggcgaaggcccttacaccggcgtttctgacggtagaatcatcaaatggcaccaaacgcagaatcgttggctcaacttttccgctattgcttcttcttcacactggtgcgccttctctctctttctctctcttcatttcaaaaattggaaacctactggtgaagttgattgcctgccttatttaaacttgtaa

SEQ ID NO: 93333 - DNA, 468 bp, Glycine max
  Peptide Sequence Number=SeqID_210111
atggaggggaaaaagatggacgaatactcaccgaaacggcatgatattgcccagcttaaatttctgtgtgagaacctgtttgacgaaattatggaatcaatacccaggatcttcaacggtggcaacgttcagcaaaacgcttatttaatctgtttgccgaagagtgcgcttatctccagcaacccagccattccttttagcatcagagtgagaccgaacaagtacgaattacccgatgatgagttagcggtattctactccgcagccgatcaccgtctggccgagctgaccatgaacaagctctatgacaaagtgcccggatctgtctggaagcaggcaaaggagtgccgatacggtgctgtgccgcattgcgcgcagggattttgcatgggcagaaatggtggaggccctgccagctacatcccggcacacgcgtcgcctgctgcggctgcttccttccggacctga

SEQ ID NO: 93334 - DNA, 874 bp, Glycine max
  Peptide Sequence Number=SeqID_210112
ggatgaagagtgtggaggaccatgtgatgagcattccaagaaagagcacgtgtgtgggcgtccactaggcttgtgctttagtacactatcgaatgatctttacattgctgattcttacaagggcttagttgttgttggtccccatggtggcactactagaagactcgtatcaacaatagaaggtgaacccttggcttttactaacggtttggatgttgaccaacgaactggagcagtgtacttcaccagtagtagttcaaaatatccgaggaggaattacatgtcgttgatcctaagcagagataagacggggatgctaatgaaatatgagccacaaagtgaacaagttagcgttctcctaaagaatctctcctatgcaaatggagtagcattaagcaaagatggtgaatatatcctaataattgagaccacaacttgtagagtattaaggtattggctagaaacaccaaaaactggaaccttggaagtctttgctgatctaccaggtttcccagacaacatcaaacggagtccaagaggaggattttgggtgggaatttactcaagaagagaaaaaattatccaatggattctatcatatccttggattggaaaagttttgcttaggcttcctttggacatcccaaaagcttattcatatttggctaagctaaaaaggagtaatggaatggcaattagactaagtgagcagggtgatatattagaaattgttaacgaaaaaaatgggagcatagggaggtctattagtgaagtggaggaaagagatgggatattatgggtgggatccatagatgcaccttttgttgtaaaaaggaaatggatgcgggctttggctatcatattatatatgtga

SEQ ID NO: 93335 - DNA, 231 bp, Glycine max
  Peptide Sequence Number=SeqID_210113
atggatctagaaggaaaaggtagaggaatatgttttggcactatcatcaattttggcaccaacatttgttggctttggaagcgctttgccactcctcaagctcctccaaggaaggtccaaaattgctattcttcacaggttgcacaggaccatacctcaagttcggatgatctctctaaccaagattataggtgttggagtaaggattatattgttgttgttgaagtttga

SEQ ID NO: 93336 - DNA, 471 bp, Glycine max
  Peptide Sequence Number=SeqID_210114
atggcagagttgtatctagtgcctgacgttgtcatccctccgaagttcaaggtgccaaacttcgataggtacaaggggactacttgccccaagaatcaccttaaggtgtactacaggaaaataagagcatatgcgaacgatgaaaaattattgatgcatttcttccaagaaagtcttactggggcagctgtcacctgtgattttgtaaataaatattgttttattgttaaagttgtctctagaatatttccattggatttaatgatgaaatttgtgcaatttcagtgggctaagcacgcatccaccactaagcacagattcagcgtgcttagcgcgacagaagaatctggtagagcatcaatatctaggtcgcatgctaagcatgagattagtgcgctaagcgcaatagttgtcttcagccagactcagcgcacgactggcgctaagctcaaatccacttactcgcgttaa

SEQ ID NO: 93337 - DNA, 393 bp, Glycine max
  Peptide Sequence Number=SeqID_210115
gagaaaatattggcacatcactaagccagcacttgaacctgtttctgattttgtagaacttgaagggattaatgaggagactgaagatgacaaggaagaagagacaccaataaaagagaaagaaaaagaaagaataaaagaagaagaaaaagaaaaagaaaaaaagttgaaaaatgaaaaacaaaaagagaaagttgttgatgatgagatgaggaaaggcaagagtgaggcaaacattgacaagaagaaggatactactccaaatgaaggcaaggaagtaccttatcctttggtaccttcctggaaagagaaagaaagacatttggctagatttcttgatatcttcaagaaactagaaattactttaccctttggagaaacacttcaacagat

SEQ ID NO: 93338 - DNA, 402 bp, Glycine max
  Peptide Sequence Number=SeqID_210116
atggctacaatcgctgccaggattctcggttccaactcaaggccagcggtcgcgctccgccgcttgcggtggccggcgtactcctccgcctccgcggtggtggcggagccggagaccacggaggtgaaggactacgccgattaccgccgctccctgtacggacagatcacgcacaaggcgctcctcgtcgacgccgttggcacgctcgttctcccctcgcagcccatggctcagatatatagaaagattggagagaagtatggagtggagtattcggaagatgagatactgttcagatatagaagagcgtatggtcagccttggggaaaatctcgtctcagaacatgtattgtacgaatatgtttatgccagaagcagtctttaatctttgtcggattataa

SEQ ID NO: 93339 - DNA, 324 bp, Glycine max
  Peptide Sequence Number=SeqID_210117
atgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattttgtcattgatcaagaaggaaatccaaaaggaactcgaatcttttgtgcaatcgcccgggaattga

SEQ ID NO: 93340 - DNA, 891 bp, Glycine max
  Peptide Sequence Number=SeqID_210118
atggttgctttgttttcccctccagtgttctcaaccaagggatggctcttagaagaggatccattaagctatgatgtgtcctctgagtactcatttccctatcaattttattcaccacagacacagattgagcttgaaattgaaaggtccacttctccatcccctgaagaccctgccatggtcaaaaagcttagccacaacgctagtgaacgtgatcgccgcaagaaggtcaatcacttggtttcttcacttcgttcacttcttccagtggctgatcaaacgaaaaaaatgagcattccgactacagtttcgcgagtcataaaatacatacccgagttacaacagcaagtggaagcactatctaagaaaaaagaggatcttttgtgcagaatttctcggcaattgcaaggagatgcagtgaacaaagattctcaaaggagaatttcccaccacaactctgattttgttgtttcaacaagtaggctcaacgattgtgaagctgttgttcacatttcctcttatgaggctcacaaggctccactatccgagatcttgcaatgtttagaaaataatggccttcttctgctaaatgcttcttcctctgaaacctttggaggaagggtcttctacaacttgcatttccaggagttaaagaaagaatgttgtataaacataattgtcttcacgactcatatgatactcgtgacaaaagacatactcagcaacaacttgaggaacattaacaactggctccttaattttggtgcaccagcaagcactgcaacaacctttctgatctttgccatgctctgtgagcaaaggcagtggtcgtgctcacccatgtctagatgcactatgggcatcagtgacatcaatcgctctttgatgtga

SEQ ID NO: 93341 - DNA, 114 bp, Glycine max
  Peptide Sequence Number=SeqID_210119
atggcaaaattgaccttgaatgctggtgtaccaacaaaaccagctaggaaattcaagacctacgagcctatgttgaccacagcggtttgcagcacacttatctcatcttgttga

SEQ ID NO: 93342 - DNA, 2244 bp, Glycine max
  Peptide Sequence Number=SeqID_210120
atgggaggttgtggtcctttggcttcacaagcagagtctccaactttcactcccactaagacaacaagcaagggatgtgtttccagtgaagatgaaagcatcataataaacccccagtttgatgatggcctgaataattggtctggaagaggctgcaagattgcattacatgattctatgggagatgggaaaattcttccgaagactggtaaagtatttgcatctgcaacagaacgtacacaaagctggaacggaattcagcaggagatcactggaagagtgcagcggaagcttgcctacgaggttacggctgtagttcggatattcgggaacaatgtcacaacttctgatgttagggctactttgtatgttcaagcaccagatcttcgggagcagtatataggaattgccaatgtgcaggcaacagataaagattgggttcaaatgcagggaaagttccttctaaatggttctccatcaaaagtagtagtttatttagaaggtcccgctccaggcactgacattcttgtcaatacttttgttataaaacatgcagataaaacaccaccttcaactcccccggattgtgagggtgctgcgtttggtgttaatataattgaaaacagtaatctggccaatggcaccaatgggtggtttccacttggtaattgtactttgagcgttggaactggttcaccgcgtatcattccaccaatggcaagagactctcttggacctcatgaatctttaagtgggcgttacgtccttgtaaccaaccgcacacaaacatggatgggtcctgctcagatgatcactgagaaattgaaactctttttaacttatcaagtatctgcttgggtccgaattggtaatggatcaagtgggcctcaaaatgtgaatgttgcccttagtgttgacaaccagtgggtcaacggaggacaagttgaggttgctgatgacaggtggcatgaaattggtgggtcctttagaattgaaaagcagccatctaaggttatggtttatattcaaggtcctgcttctggtgttgacttaatgcttgctggacttcaaatttttgctgttgatagacatgcaaggtttaaatatttaaggagacagacagacaagatccgtaagcgggagatcatcctaaaattctctggtctggattcaattggaaatcttggaaccctggtgagagttaaacaagtacaaaacgatttccccattggatcgtgcattagtagaagcaacattgacaacgaagattttgttgacttctttgtgaaacattttaactgggctgttttcgggaatgagctgaagtggtattggactgagccacaacaagggaatctgaattacaaggatgccgatgaaatgttagacttatgtcagaagaacaagatagacactcggggtcattgcatcttctgggatgtggacaacaccgttcaacaatggatcaaatcactgaataaaactgatttgatgacagctgtccaaaaccgcttaaatggcttattaactcgctacaagggcaagttcaagcactatgatgttaacaatgaaatgttgcatggttcattttatcaagatagactaggcaaagatataagggcaaacatgttcaagaccgcacaccaaatagatccatctgctaccctttttgtgaatgattatcatgttgaagatggatgtgacacaagatcatcaccagaaaagtacattcaacacattcttgatttgaaagagcaaggtgccccagttagtggaataggaattcaaggtcacatagatagccctgtggggcccattgtttgttctgcccttgataaaatgggaactcttggcataccaatatggttcactgagcttgatgtgtcttccactaatgaatatgtgagagctgatgatcttgaagttatgctgcgggaatctttggcacaccctgctatagatggtgttatgctctggggattttgggagttgtttatgagtagggaaaattcacacttggtgaatgcagaaggggaactcaacgaagctgggaaaagataccttgctcttaaacaagagtggttgtctcacagccatggttatgttgatgagcaagggcaattcagcttcagaggcttcagtggaacatacaacgttgaagttgtgaccttagcaaagaaagttaccaagacattcgttgttgacaagggtgactcatctctcgtggtatcaatcgatttataa

SEQ ID NO: 93343 - DNA, 150 bp, Glycine max
  Peptide Sequence Number=SeqID_210121
atggacggtggaaacggacgaaaggttactcgagttggtagatggagtgctgcgtggaacaatgccattatgccatcgagagtatccatcaacaatcacaatccacacaggaaaggtttcttcaccaagcaatatccgtatttaggatag

SEQ ID NO: 93344 - DNA, 180 bp, Glycine max
  Peptide Sequence Number=SeqID_210122
atgcatctgaatgtccatgcaacatttgataagccacaagcaacaataactgaagatgaatcacctaacgaaggaaccgtagcagatattgaattaccacgcataggtaaggaaatgaaggaacaaggtctacaagaggagagattcgtgcttaattttgaagggtatttgaacgtttaa

SEQ ID NO: 93345 - DNA, 270 bp, Glycine max
  Peptide Sequence Number=SeqID_210123
atgttgggtagtgtggagggtgaaaaggccaagaaaaagagaaccaccaagatgaaaactggaacaaagagaagcaacaagggtggtggcggcagaggaggtaacaccaaaggtagcaacaaaatggacaaagtgagaagagccaaaatcaacaccgaaaggagagaaaaagaaagtagaaaggaagaagagggaatgaagaggggtgatggagaagaggagggattttattggtatagaaagggacaaggatcggtggtcaagtcctag

SEQ ID NO: 93346 - DNA, 249 bp, Glycine max
  Peptide Sequence Number=SeqID_210124
atgcgtgaatttacggagagagagaatgcagagacaaagtatccgaaatctagcaattgtgagtgtaactgttgttacactcacttaagcagttttcgacactctcgcttagcggaccgctgcgctaagcgagccagagagacgtttggctggcttagcgcgaggataagactgcttagcgagaggagcatgtgcttagctgataaggactcgcttagcgctcacattgctgcaaggaattcagcttag

SEQ ID NO: 93347 - DNA, 312 bp, Glycine max
  Peptide Sequence Number=SeqID_210125
atgaacactcatcctcttgctgaatcgctaagcccaggtaactttgacaaattttttgttgatagccgcgcgctaagccgagctttcctgagccaagcagtattcgttgcagcatttgttgagctaagcgagcctcgcttgctaatctcccaatacttagtgaaatttttgaattgtatggttgtcgcaacctatccttcgacgggagggcgacgcggggctcgcgggtgcgtgttccaagaaaggagtacgcgcggaatcgccaccaacgtttatttgaggaaaacgtcggaaaaaccggaaaagacgtga

SEQ ID NO: 93348 - DNA, 777 bp, Glycine max
  Peptide Sequence Number=SeqID_210126
atggctcgaaagaagctctcagccaagaggtccaggaaggatgccactggagagggttctaatgagcatgccatcaatcagtttcttgggcatccactggtcttggaagaaggccagcattgcgagttcagccagagaaggagtcaggctttcgactttgatgaggaggctataagtcattggctatgcgttctgaggcagaactttgcccggagcgtaacggggagacgggtgagtgtccacgtcgcccagctgatctctgattctatttaccagtttgcagggattacgcctctgagacacccagtgaactcgaagaagtccaacagggccctggggtttcctgctctgattacacgcctctgccagttctatggagtggtgatcacccccaccaagctcatctggcctcccattagtagggacttcatcgagaagtactgcatacctaggcaggtgcagggtcaagagccgaagcagccagttgcagatgtgccctcgtcgcctctagaggaggtaccatctctgaggtccatctccgatcacttgtggagaatagaacttcagatgcataggtacatgcaacacgtgacaagccagcaggtagctaatcacaaggggcaggtgcagctgaatgagaaattttaccgttacaacatgcaccagcagaacgagaccgattttgagacatgggtaggactcgtaggggcccctagggatgatggagaagctcaggaggatgacgacatggctgacgtgttggatttcttcacttaa

SEQ ID NO: 93349 - DNA, 165 bp, Glycine max
  Peptide Sequence Number=SeqID_210127
atgtctagaaaaaatttggatagtaacataaatgtagataatgtcatcaggggcaccaagcaggccttgggggtctgccgcatgattgttgatccagtggaggtcgaatatccatttttaaaaagctggtcttatattgagcattttttcaggaaaaatgcataa

SEQ ID NO: 93350 - DNA, 132 bp, Glycine max
  Peptide Sequence Number=SeqID_210128
atggtgcttgggagcaatatcttggactggaacaggatgacagtgctccaaaaaggtcctatgcagtcaactagggtcccaatgtacagtgaagctaaaggttcattccacaagatgttgcaatcaagataa

SEQ ID NO: 93351 - DNA, 753 bp, Glycine max
  Peptide Sequence Number=SeqID_210129
atgcacaagagacccttttcttggggaaaattcttgaactatgtagaatggtcatacaatacctccaaacattcaggcttgggcttaacaccctatgaggtaacatttggtaagaaacctcccaccattatgcaatatgttgttggaaactccaatgttgaagcagttgatgattttctcacaagtcaagaagtagtgtttttggaactgagaaagaaacttcttaaagctcaggaacatatgaagaaatgtgcaaataacaattgtcgggaggttaagtttgaaaatggggattgggtcatggttcgcttaagaccacagagacaaacttcaataattgggtcttctgcagcctatgacaaacttgtgaaaagatactatggtccctaccaagttatgacgcgcattggaggagctacctacaaactacagttaccagtggaagcacaaatccatcctattttccactgttcactactcaaacctttttactccatggataatacttttacttcgttgcctctaccagccaagaccactgaaaatcagctaaccattactactatagttatcttaagcacgcgttgggattctattgagaccgaatctagaatgaaggaagaaggacttatagaagggagaaacaggtctggtaaggttcaaaaggaaaacagctccaccaatgcacttcaaggactacgtgtagttgataacataaagtgtttagctggcttgaaatcttgtctaccatga

SEQ ID NO: 93352 - DNA, 240 bp, Glycine max
  Peptide Sequence Number=SeqID_210130
atggaacaatcaccaccatcaccatccttcaggactaaggttgtgggcttgggtttggtgtggtcgtggatagcgggatgcacggtggcggacaacaggcaacgactcacaggattggggcataggcatagaagttcaagagcgggtttgaagagagagagagggttaagaaattcaacttgcaactatgccaatggtcttgaggatcagcaacatcctcaggatcagggaaagaactag

SEQ ID NO: 93353 - DNA, 1017 bp, Glycine max
  Peptide Sequence Number=SeqID_210131
atgcagagggggtcacaatctcaaccatttgatgtagaaataggagattgcttagaggatatgatttgtgatcttggacaagagtcttttcagcaaacatatgcccctatatatacactgcaaagtgattcgaaaaagcctttgcattcggggtgcaacaagtcattgatgttgttgtcagtggtgttaagtttggttaatgtgaaggctagatatgagtggagtgacaaaagcttcagttcactgcttcagaagattcatgcatgctctaatgattgcatattgtacaaacatgagtttgaagaaatacacaaatgccctaggtgtggggtatcacgatacaaagtgaaggatgatgacgagtgtaatagtgacaaaaactcaaagaaagacccccagcaaaggtgttgtggtatcttccgatcattccaagtggaagaagttgatcatttgtatccggatttcggcaaagaggcaataaatcttaggcttgaacttgccactaatggaatgaatccctatgtcagtttaagcactcaacacagttcgtggcctattttgctagtaatttacaacttgcctccttggttgtgcatgaagcgaaaatacatgatgttgtctatgatgatatcgggcccaagacaaccaggaaatgacatcgatgtttatcgtagtcccttgaatgaagacttggaaaagttgtgggatgaagggttttcgtgtttgatggagcatgaaaatgcgcggataccattaactggtcagcaggttcttaagcaaattgaagacatgaatactatatttggaaagaaccaaaagaaggggaaaaaagtaaaacttgaatatggaagaaaagacatgatgcaagctccattggagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 93354 - DNA, 1032 bp, Glycine max
  Peptide Sequence Number=SeqID_210132
atggctaataaaggccagctgacttcctgggtcattttcctaaacaccttgcaatctcgtttcacaccttctcagtacgatgaccccaccagagcgttagtcacactgactcaacgtggtactatcaattcctacttatcaaagtttgaaatgttggctaatcaaatcgcgggactaccaccgcctttccttctgagctgttttatcttcggcttcacgctgaaaattcatcgtgaggtgcaggctctgcaatccttgactttagctcaagtagttgggctggccaaattacaggaggagaagttcttggaccttcatcgctctcttcatggtcgttccttgttgttttattcatctccgccacctgcaacttcttcaaacccaacctcccttcctttattgcttccatcacctccaaaaccgccacctccacttccagtcaaaaggttaactcttgaaatagcctcacgccaggaacaaggtctttgctttaattgcaatgagaaattttgtcgtggtcaccagtgtgcctctaagatttttctcttgattgtggatgaggaacatgattctgcactggataccccctttctggattcgactattaaacatatggcaaatgtggttctaggcatgcaatggttccaatcgcttggtcctgttcttacgaactataaagctctgaccatgaagttcatacgtgagggtcacaccgttgagttgaagggtgacacaaattcaagcctccatgccatcactccgttccagcttcgttgcttgattatcaccgatgctgtaggtgatttctttcatcttcagattgtccctaaagagcttcctttgacccaaactacatcccctacatttccacctgaaattttatctctcatcaccaaatttgataccctattccagaccttcactcttctcccaccctcgagacccaccaattacaatatttaccttattcccagtgttgacccatcagtgtccgtccttacaggtatccctatttccaaaaacaagaaatag

SEQ ID NO: 93355 - DNA, 675 bp, Glycine max
  Peptide Sequence Number=SeqID_210133
atgacgaggcggaaaatcatagataagattggagtaggtgttgtcaaggtgaacaacgtcaacaacgggaatgtgtcggagcgcgtcgcgaagcacgtgccgagacttggttgctcgctcgtacatggcatcccacctgaactccctggtgtagaggatgcaaccgaagtctgggttcaagagaggttttgggttgggaaagtggttgcggagcaggggctagggcatatgaggagacgcaattatactggtgtacgaagatgggcttacgcaatagctgtcgttgacttattaaccctaattacaaaattgccactaccttacattctaagacggttctttctaaccaccttagaatgtgcgacacctcccttgcaaaagaagcttacagagcttcaaggagcaattcctgggagtgagggaatggacatgcacactttgttccaaagcattgaacaattcatacttcaacttgaagctaaagtgacgatcctaagggtgaagataaggttaacaccattggatgcaagagcagccatgagcagagcaacaattagatgtggggcaccatcacagcttaggatggtgaacctaccggatgaaggcacgacagagagaatgaggaaggacacgacgacggaggtaacgaaaggaggcaacgtcgttaatggatga

SEQ ID NO: 93356 - DNA, 279 bp, Glycine max
  Peptide Sequence Number=SeqID_210134
atgcctgtccttccatggagaaggcagcaagaatccgcccaagggggtcaaatccatcaaatcacggaatctcaagcttcaggcgagggccatggaaagtggaagaaggctatggtgaagttgtcgagtgtgacggaaagtgtaatcggccatgacaacgagagcaccaagttgttaggagcaaaaaccagaatggcaaacacaaccagaaacaaacacagagtcactagcattcgagccctagtgctacctccagaatcaaagagggatagaaagtag

SEQ ID NO: 93357 - DNA, 637 bp, Glycine max
  Peptide Sequence Number=SeqID_210135
tgacggtgtaccatttgagggcaccattgatgaggactggaagtttgatttctccagtcatgatgcccgcaggttggtttgcaccaatcaagcgaatatgaccggtagattacttgtcggatcattggcatttgaatgccgcatcatgcactatctgattgtgcgtatccttcttcctcggtcatctaaccttgctcaggcattgcgatcaaacactcctcttccttatccccatttgatcattctatttttgcatcattttaatgttcctcttgactctgagccctttgttcaagtcaagatatctttttctatcggtgctggtgcggtttcctcttttggataccgcaaaaagagggatggttcttgggtgaagaaggatgctcagccacaagcagcagatgatcgctctccttctcctcctcctcagatggatgactcttcatcccttatgcaaaacattctagacaagttggatggtctccacaccttcgctggtgagcgttttgactccttggacagttgcattgatgccattgatgcacgatttgcaagaatggatacacgcatcactcagcttgaggaggatgtgagtttcagccatcagtgcttcgaccttccaccactaccttcatag

SEQ ID NO: 93358 - DNA, 198 bp, Glycine max
  Peptide Sequence Number=SeqID_210136
atgaagaagatgaatgaggggctagattgtgaaggaggaggaggaggaggggacggagacgacgatgggggtgttgttggcggtgatggcaacgacacttatatatcatggagagtggtggcgtatgaagaagaatgtggttgtgactatggcgatgcaggtggatttgacgataggggagaggagagggttgagtga

SEQ ID NO: 93359 - DNA, 645 bp, Glycine max
  Peptide Sequence Number=SeqID_210137
atgggttcaaggtcaagagaggttgtaggttcaggacaagggaagaaaggtgttgagaagtccgggttagggtcgtcgggctcagaggtagtgttgtccgcgatgaacaagaggacgcggcctttgcaacgatgggtctcgggttggtgttgtggcttggtgttggaggagggagattggcccgatgcgggggacagcagtcacacaacttatcttcttggagtttggcgagggccgttgcttgcagcagggagattggttgaagagccaatacttctcggtggattttcggaaggagcgaatcgggattccaatgcttgcaagaagccagaccaggaggtgatgaacccgttgtggaacatccactgctaccaacttagagcggccccgtcgagtgattatgattgggcgttagtaggtggaagcgatcgagaatcgaatacactttgccggaaagttcagagtactatcggcgaggttgcatggtcggccatggcggcggcggcaggtcgaaccagtgttagggcagaggtggtttctgttgatgcttgctcccttgaagctgttgtcaggtctcgtagtcttgcatgtacccatgtcttgtggttatccttctggacctttctggattggactcttgattag

SEQ ID NO: 93360 - DNA, 426 bp, Glycine max
  Peptide Sequence Number=SeqID_210138
atggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaacttaatgatttggatagaagtctggcaatggctgttagcaacttattggttggccaactcgaaagccttagattattagccaagtggtcaaagcttgctgctctcaaactggataccctaatgggtgtgattattcgattcagcatgtggaaaagaactcagaatagtagccaggataaatgcataccagaaagtagagaaatccatgacatttttgttggaattctaaaaactggagagcatactcatttagtcttttttctaccttaa

SEQ ID NO: 93361 - DNA, 480 bp, Glycine max
  Peptide Sequence Number=SeqID_210139
atggagtcagcaggttgttcatggttgcctgaaaagtggagggcgtattgcataagccgaacgacattacgcgatattcgtagtgcccttgatggtcctaaacgcagtcttctcaacgtcgggttcatgcatggggatttggtggaatccttgtctgaggactggggaggaatatggactcgtactttgttggataaggcatgtggagaggagttcagagactttttttctctatttcagacttttgaaagtgtgggtagcgatatggccgtgttgcaattgggtgagcagggcttcaattacgggaatcgggtggatttgcggtcaaggactgaaccattacccaccaatacgtggagaggggaggtggaggaattgagcgatgcgaggttgaaggaagttgtgggtgctgctgctatcgatgaggatagtgaagcgagcatggttaatgacgttgaagaggagaaagatttcagatga

SEQ ID NO: 93362 - DNA, 810 bp, Glycine max
  Peptide Sequence Number=SeqID_210140
atgagcatcgcctatcacccgcagaccgacggccaaactgaagtcatgaatcgcattttggagcagtacttgcgatcatttgtccactcacaaccagcgaattggttccgttacctcacattagcggaatggtcttacaacacgtcccttcattcgggttctggttttactccatttgagataatctacagcaagctgctactggcaatccctcagtatctacagggaacatccactaacgaagatgttgattcgttgatatcctcccaccaagcaattcaagaggcacttcaacgcaggttgagtaaggcacaggctgccatgaagaaacaggcagacaccaagcgcgaagatgttactttcaacgttggtcaatgggtttatgttaagctttgtcccttccgccagcattctgtcggcgaactggtccacccaaagttgtcaaagagattcttcggacctttccaagttatagattgtgagggacaggtcgcatatcatctccggttaccagacaatgcacgcatccatcccatttttcactgctccctcttacacgcacatcacggaccacttctttctccctcggatgcatggcccctacaaattatcaagcagaaacccgtgccccgtccactttgcttcttggactccaaactcaataattatatgtccccaccaacctgtttagttcttacccagtggttgggacaacccccagaggatacgacctgggagccttggcaggagcttcgtgacacatactaccttgaggacaaggtggtgtttgaggattggaggtattgttag

SEQ ID NO: 93363 - DNA, 879 bp, Glycine max
  Peptide Sequence Number=SeqID_210141
atgaaagaattggaaagcccgcttaacatgcaagacgtgccctgcgcgcattctcgctcagcgtgcaacacacgcttagcgcgaaaaagacccatgaaacacacgcttagtgcgaaagcttacgctaagcttgaagtcagggcagattcattgttgctatcaccagtgcttgagattgagaatcatattgaatctctttcccttggctcactattgttggagttgagagctgagtcaagtttcttgaatagatacattggaagcaaccttactaccttagattcatcttttgctcatgcctccacttcaagatcaaattatcgacatctcaaacatcaatcacaaagcgatatcccactgaagccaccaattcctcaccaacaaacaaagctgcatattccacacccaatctccaccgtccactccaaatccaacgccccacaatcaacctctggagaagtgcacgacttcttcaattttgccgtacatggagaagtgtacaagaagcttgtccatgtggtggtttggtggcacgttgggggtgtagatcttacggatagccaggtcagcgaggcgattgttgaagcgcttgatgagctcatagagggcgagaagcgcaccatcgacgtggcaaaaggtgacgaagccatagcgcttggacttgtcgatggccttgtcaggatgacaacgacctccttgaggttgctaaaggccgtggatgaagagcttacgctgggagacatcggggtccgcaacaacatgcacgacgaaaaggacgtctgggtggtgtgccagcacgtcctggaggatctcaaggagctggttgcgggtgaagcactcaatgagcttgtgggatttggagggagagatcttgagggg

SEQ ID NO: 93364 - DNA, 354 bp, Glycine max
  Peptide Sequence Number=SeqID_210142
atgtttggcaccggttatagcgtaaggccaaggggtcgcacaggttgtttgtcagttccagaaacaaaagccacaaggaaggggcaaaatagtcatttcctagaggtttctgaccctaagcaagctactcaccagggcaagctccagctcgcccacagctcgcccatccaaatgactttttctttaaatagccatgtagggggagagtttaaggggttcagaaaaagaaaacaaaggaaaaaacacagaagaaaaaggagaagagaagtaaagctgaggcgctacagaattgtgatcgtggatcatttcctttgtcatttctcttgttactcttgcgccttacgcaacgattga

SEQ ID NO: 93365 - DNA, 345 bp, Glycine max
  Peptide Sequence Number=SeqID_210143
atggtggatgttcctgcaataatcatccctgaacctcctattaatgatattcctcaatcctctgataatcttaaccattctatctctgaatcagataaagctcatcaactttgtaatcaatatgcttatgatattggtgagattgagtcttcaacagaggaagacaggaccaaaatcattcaagctcgagaaggatttcaaaaggcaaaggaaaacctaatgttgatacaaggtcctatcatgaggttaaaaaatctaaacatgattgggtcaagaaagaggaagatcttttggccaaacttaaaccaatccaagacgaattcaaagttgtttgagagaagctag

SEQ ID NO: 93366 - DNA, 117 bp, Glycine max
  Peptide Sequence Number=SeqID_210144
atggatgtggttttgaccttaggaagagaagacactaattctgttgatgagacaaaaatgactgaagacaccatcgtgactgaagaagccccggagaagcttggaggctgttcttaa

SEQ ID NO: 93367 - DNA, 1253 bp, Glycine max
  Peptide Sequence Number=SeqID_210145
atgaccttgtggtttccattggttagctgcaaattattgatctgtttgtgcaatatttttcccttcatagctggctttgattccagagatcgaagaaaaagtaagtacctgtcttacccatacattggaccaaaacaaaaggatttgccagctgaaacagatgatttgaagacaccatgtccttctcagaaagcaggggcttcaagtgtcactactaatcctttaaatggatcttcttcgtatgctaaattgggtagcaagaggttccgaaatagctggtacaaaaagttcatcagctgtaatactatgtccagccataacaaattcatgaattcatctgcagaagaactactttcaggactttattctactgccgttgattgtatgtttccagttgggaataagagttttgatttagttgagcggttcttttgcagatacagagtatcaaactaccatgatgaggctgaacttgctacttcccaggttaatgcaaaagaagaaaaactggggaaatctgtgtgtaatgatttactggataccaaaagtaagaagagaaagaacaataaaattgaaaatgcagttaggcgtaagagaaaatcactctctggcctatcagatgtgaatgtaagcacttctaatagtgactctcagaagcctgggagaaaactgaaacaaaagaggaaggtggaagaagtaacttcagtgcatcaaccgcaaaatgttgagataaatttaattgggaacagcagcaaatacagctcaactcctcaagcttcacaaaatctgtgttgccttgcttctgaaggaaaggccgtgcataaacagagggaaaagatagaggcacaagagcatcaaagtgctcaaattaattcagagtatgcagatgcaaaaaggcttaactgcagttcactagtaatagatttgcagtttacatccccacctatacctgtcgatattcctgagagaaatagaagtcaaaataaggaagaactggttttattagcttcaaatctggagtcacatgtttcccaagaaggacatgttgggagtattactgatcatagcttgttggtaagtactaaggctgaggttggtactgtcatggtaaataaaacatggttgaagaatagcatggggaaagcaacacgagtgcatctcaatactaaacctgctgttggagtgcctctcaatagcatggggaaagcagcaggagtgcatcttaatactaaacttgctgtagagaaaaaagg

SEQ ID NO: 93368 - DNA, 858 bp, Glycine max
  Peptide Sequence Number=SeqID_210146
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgggcggcgcggccgtgctgttcagcgtcagcaccgccttcgtgctgctggtccgcggcctgcccacgcgcgcccagttgcgcggcgtctcgcgcgtgtacctggtggcctgcggcctgctgttcgcctgctacgagatcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 93369 - DNA, 155 bp, Glycine max
  Peptide Sequence Number=SeqID_210147
atgcctatcaggaagctagacatcctcttataaatgaatttcttcacgagcagttgctagcagagaatgaggttcttgtaaatgaatttcttcacgaccattgttcgcatcctggcacaaataccaaacatcgatgtctcgcgagtttggcctaa

SEQ ID NO: 93370 - DNA, 491 bp, Glycine max
  Peptide Sequence Number=SeqID_210148
atgggagatcgcttagaggatatgattcgtgaccttggacaagagttttttcagcaagcacatgcccctatgtatgatacattgcaaactgattcaaagaagaatttgtatccaaggtgcaacaattcgttgacgttgttgtcagcggtattaagtctagttaatgtcaaggccagatatgggtggagtgacaaaagctttagtacactgcttcaagtagtgcatgatatgcttccaaacggaaatacattgtcaaaaagttactatcaggccaagaagttattgtgtctgatgggtatggagtatcagaagattcatgttttccccaatgattacatactgtatagacatgagtttgaagaaatacacaaatgccctaggtgtggggtatcatggtacaaagtgaaggatgatgacgagtgtagtagtgacgaaaacagtggcaagggccccccagcaaaggtgttgtggtatcttccgatcattccaag

SEQ ID NO: 93371 - DNA, 198 bp, Glycine max
  Peptide Sequence Number=SeqID_210149
atgcttgatgctttaaagcagagggagcaacaatttgggggtttgagggcttttgtgatgaaggagaaggaggaggaactcgcattgtttctggtgatgaagaagcgcgagaaggagcacaatgaccttcttcttaacagctccgaagagttctatgcacctctcggatttgcttctttgcagtgtttagtgtactaa

SEQ ID NO: 93372 - DNA, 1968 bp, Glycine max
  Peptide Sequence Number=SeqID_210150
atggatccaaactttatcataagcggcaacgactttgatgaatcaaaacagtgggatctcaatggacactacaccaaccttctcaatgatcctctttccgatgttggcccacttggtttttctcacaattcaatcttaaactctgaaccctttgtttcatcctctgcttccgccgccgccgcctcctcctccacggcgacggtggcggatccttcacctgaagaagacactgatttctctgaaaccttcaagttcataagtcaaattctcttggaagaaaacttcgaacagaaaccgtgtatgtgttatgaccctctgaccctgcaacacactgagaaatcattctatgaggctttggaattggaaccatcactgcttctttcccctaatcagcacccgcttgagagccctgatgggaattcttctaattccactactgattctgccaattctcatgatttgaagccttcttcacccaatacacctgcttctgatgctttgcattcctcttcccacgcgccctctttggttgttcctccccatgctttgactaaaattaatgatggaaccgtggatttggattcttctgtaaccaagctcttggctgaaaatattttcagtgatgcagactctatgttgcagtttaaaagagggttggaggaggctagtaagtttcttcctcaggggcctcagcttttcactgggttggagagccccacggtgtcttcagagccaaagggaagaggtgtagctctgaagatggagaattcatttggggtgaagaatagaaagaatcatgcccgccaagatgatgaagaagaaagaagcaacaagcagtctgccgtgtctgcggtttgtgttgaggaggagagtgaaatatctgaaatatttgacagggtgttgcttagtgttgaaaatgtgccactgtgtgctgaaaataatggatctgtggcagtgggagatagtaacacaaagctaattgagaaatcgagtttgtctgatggggggaaggttcgatccaagaggcaagggagaaagaaggaaacggtggatttgaggacccttttggttttgtgtgcgcaagctgtgtcttccagtgacaacaggactgctaatgaactgttgaagcagattaggcagcattcttctgctttgggtgatgcctcacagaggttggctcattatgtggccaatgctcttgaggcccgcttggttggtgatggaactgccacccaaatattttatatgagctacaagaagttcactaccactgatttcctgaaagcttaccaagttttgatatctgcttgccctttcaagaaatttgcacatttctttgcaaataagatgattatgaaaacagctgacggggcagaaacgcttcatattattgactttggtatcctgtatggtttccagtggccaattcttatcaagtttttatcaggcagacgtggagggcctcccaagctgcgcatcactggaatagagtatccccaacctggctttcgtccgactgaaagaattgaggagactggttgtcgtctagctaagtattgcaagcgtttcaatgtcccctttgagtacaaggccatagcatcacgaaactgggaaacaattcaaattgaagaccttaaaattgagcgcaatgaagtgcttgctgtgaactgtctggtaaggtttaagaatttgcttgatgagtcaattgaagtgaacagccccagaaaagctgttatgaatttaatcaggaagatgaaaccagatatttttgttcactgcgtagtaaatggaacttataatgcccctttctttctcacacgcttcagggaggcactgttccattattcttcaatgtatgatatgtttgatactctcgtatcccgtgaaaatgaatggaggttgatgcttgagagagaatttttgggtcgggagataatgaatgttgtagcatgtgaagctcttgagagg

SEQ ID NO: 93373 - DNA, 765 bp, Glycine max
  Peptide Sequence Number=SeqID_210151
atggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatgtagtattcaaagaagtggaatatctaagctctgattccgttgataaatcagaaaccaatgaagattcgtatttccaatcaattactactaaattccttaattcattgaacacatccggtttgccaactcattctatcaaacttaaaattggaagtcctataatgctgttaaggaacctcgaccaaaatcaaggtctatgtaatggtattagattagtggtaacaaagatgacaaaacatgtaattgcagctgaaattatctctggtaaaaacattgacctcgccgtttatattccaagaatgtcaatgtcgccttcacaatcaccctggccgtttaaactattgaaaagacaatttccgattatgctatcttatgcaatggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatgtagtattcaaagaagtgttcagaaacattaaaagataa

SEQ ID NO: 93374 - DNA, 1821 bp, Glycine max
  Peptide Sequence Number=SeqID_210152
atggagtttactaagtattcaaatcccatcctcagatacataagcgacatcctcatggacgaggaagacgacttggagtgcaaaccctgcatgttgcaggaatgtttgagactccaggctgctgaaaaatccttccatgatgcccttctccatcaaaacccttctcctttccgtgatgaaaacacttgcatcacggactctgatgaaatttttggtcgcattccaagttttgtgagcagtggcagctgcaccacagataattcatgtgagtctgacttgctcaacggtgtgagtgaatttaattcttctttcctacaactacaaacccctctagttgattccccagaagacggttattttcatgatggaacctggaatctatttcagtctcatacaaagccactgatggtagaagagggtactccagcttcagcactaagagaaaagagaagccatgggatggatggtcatgcttctcatgaaaaggaaggaagaagaggtagcaaggtttcagccatcttttctgacgactcagagccacgagagatcttagatgaggtgctgctttatcaaactggaggaagtcaaccactctatagtgctcctactgagccatcacaaagggttgatttaggaaggtccaatggaaaggcaacacgtctacgttcaaagaaagtgtccaccaacatggagacaactgtggatttatggacccttctgactcaatgtgcacaggcagtggcaaactatgaccaaagaaatgcgaatgaattactcaagcagattaggcaacattcttcaccttttggggatgggcttcagcgtttggctcattactttgccaatggccttgagacaaggttggctgctgggaccccatcatatatgcccctagaagtggcaactgctgctgacatgttgaaagcttacaaactatttgttacatcctctcctttgcagaggttgacaaactatttgacaaccaagacaatcatcagtcttgtgaaaaatgagagcagtgttcatattatggactttggcatttgctatggttttcagtggccttgccttatcaagaagctctcagataggcatggtggtcctccaaggcttcgtataacaggaattgatcttcctcagccgggatttcggcctgcagaaagggtcgaagagaccgggcggcgtttggcaaacttctgcaagaagttcaatgtcccttttgaatacaattgccttgcacagaaatgggaaactataagacttgcagatctcaagatagacaggaatgaactaactgttgttagctgtttctaccggctgaagaacttgcctgatgaaactgtggatgtgaagtgtccaagagatgctgtgttgaagttgataaggaagatcaatccaaacgtgttcatccatggggtggtcaatggcgcttatagtgcaccctttttccttactaggttcagggaagcactttatcacttctcatcactgtttgatgtgtatgaggctaatgtgcctcgtgaagacccgcaaagagtgatgcttgagaaagggttgtttggaagggatgccatcaatgtcgtagcgtgtgaaggggctgagagggttgagagaccggagacctacaagcagtggcaggttaggaacctcagagctgggttcaagcaactccctttggatcctcagttggtgaatgatgccaaagatattgtgaagagggaatatcacaaagattttgtggtggctgagaatgacaagtgggttttgctggggtggaaagggcgtattctgaatgccatttctgcttggactcttgcttaa

SEQ ID NO: 93375 - DNA, 393 bp, Glycine max
  Peptide Sequence Number=SeqID_210153
atgaatctgatgcttgatggcagcgttgctgagcaggatggtgtcattgccgtaagggatttcgtggcaatggccgtgacagtaacaacggtgggcgccaagggaggcggagctaacgtgggtgctgttgttggtggtggtttgggaggagatggagatggagtggatgctgttaaggtctccacaggtggtggtgcgtctattgggaatgagttgggaggaaagggagtgggtatgagagcggataactggtcaaggatgacgtcaagcttggcggtcatcgctagagtcttggtggtcatctccaaagtttgggtggtcatggaggataacttcagggtgaggtggtatacaaccttttcaaggcggtctagggtggtctggtggctgtag

SEQ ID NO: 93376 - DNA, 810 bp, Glycine max
  Peptide Sequence Number=SeqID_210154
atggcatattacagagatgatcgatttgcaacatttgaacagttttatcgttgttaccctgtctccttcattgagaagttatcatgcctccctcagcccttgatcgccttgatgatggaaaatatgctcctccaagagggagacattgtaaaagtgaaaaacaccaaccttgcaaaaggaacgtatgtgaagctgcagcctcacacaaaggattttttggatatctccaatccaaaagccatcttagagactacacttaggagctactcatgtttaacaactggtgacacaataatggttccttataacaacaagaagtattacattgacatagttgaaactaaaccctctcctgcagtcagtataattgaaacagactgtgaagttgattttgctccacctcttgattataaagaacctgagaaacaagcaaaacctgttgtatttgacaggaaacgaccaaaagttgaagatgagccgccaacaaagattgcccggttgactccattcactggttctggaagacgtttggatggtaaaccctcagcaccatcagttgaacaaacatcctctccagagttgaaacagagacaaactgacaaagaaatcaagggttctgattctaagtcatcaaataccgtgtctcgtagacattcaggaaagcttgtgtttgggtcaaatgcaactacatctgacattcaaacaacacctaaggtttctcaagaaaacaccagtcaagagaaatctcagaaggaagaagagccaaaattcaaagccttcacgggaaagaagtattcattaaaaagttga

SEQ ID NO: 93377 - DNA, 1941 bp, Glycine max
  Peptide Sequence Number=SeqID_210155
atgtcttgtaatttcttggtcgagttcaacatgaactctcttgtgcaaaactttagtggtcctatcacggaattttcaaatcagaaccaagtagagaaggggtttgactttgagtttgatgattcatcttcttccctttcttccggcgcaagctcaggtggagaatccacagaggtaaccaaatactccaaccaaatcctcagatacataagcgacatcctcatggacgaggaagacgacctggagcgcaaaccctgcatgttgcaggaatgtttgagactccaggctgctgaaaaatccttccatgatgctcttctccatcaaccttcttctcgtttccgtgatgaaagtgttagcatcacagactctgatgaaaattatggtcgcaatgctagcttcgagagcaacggcagctgcaccactgataattcatgtgagtctgtcttggtcaacggtgttggtgaatttgattcttctttcttacaactacaaacccctctagttgattccccacatgatccatctggggagtcaccaggtgttggcttttttcatgatccatttgtgaagtcacaagctgctggctattttcatgatggaacctggaatctctttcagtctcagagtcagaccaagaagccactgatggtggaagagggtttttcagcttcagcaccaagagaaaagagaagccatgggatggatgattatgcttttcatgaacaagaaggaagaagaggcagcaaggtttcagccgtcttttcggacgagtcagagtcaccagagatcttagatgaggtgctgctttgtcaatctggaagaagtcaatccctcctttgtgctgctgcagaaccatcacaaagtgttaatttaggagggtccaatggaaaggggacacgatcgcgttcgaagaaagtgtccaccaaagccggcacagctgtagatttatggacccttctaactcaatgtgcgcaggccgtggcaagctttgaccaacggaatgcaaatgacttactcagccagattaggcaacactcttcagcttttggggatggactccagcgtttggctcattactttgccaatggccttgagacaaggttggctgctgggaccccatcatacatgcccctagaaggaacaacttccgctgatatgttgaaagcttacaaactatattggccatgccttatcaagaagctctcagaaaggcatggtggtcctccgaggcttcgtataacaggaattgaacttcctcagccgggatttcggcctgcagaaagggtcgaggagactggacgacgtttggcaaactactgcaagaagttcaatgtcccttttgaatacaattgtcttgcacagaaatgggaaactataaaacttgcagatctcaagatagacaggaatgaagtaactgttgttagctgtttctaccggctgaagaacttgcctgatgaaactgtggaagtgaagtctccaagagatgctgtgttgaagttgataaggatgatcaatccaaacatgttcatccatggggtggtcaatggcacttatagtgcaccctttttcctgactcggtttagggaggcactctaccacttctcatcactgtttgatatgtttgaagctaatgtgccacgtgaagacccagaaagagtgatgcttgaaaaagggttgtttggaagggatgccatcaatgtcatagcgtgtgagggggctgagagggttgagagaccggagacctataagcagtggcaggttaggaaccagagagctgggttcaagcaagtccgttttgatcctcagctggtgaatcatgaaaaggaaatggtgaagaaggaatatcacaaagattttgtagtggctgaggatggcaagtgggttttgctggggtggaaagggcgtattctgaatgccatttctgcttggactcctgcttaa

SEQ ID NO: 93378 - DNA, 909 bp, Glycine max
  Peptide Sequence Number=SeqID_210156
atgggaggtttgaggaaaaaaagatcaccattattcaccccacaatcgctttcactcgactccattctacatatatctctttctccgtctccattctctacgatttgcttcttcttgctaacagtttgcaatacattgagcctactagagtctgagatgaaaaacggggatcagttccaggaaatttcaaaggggaaatatgattgtcttttatttgagtacatgcttcaaaagcttgggataccggaggctaaggttcctgagtcgtgcttttcattatacaagacttacgggacaaccatggcaggtctcaaggctattggctatgactttgactatgatgactttcatgcatttattcatgggagattgccatatgatatgctgaaacctgaccctgttctcaggggaattttgctgagcttgcctgttccaaaaattgtttttacaaactcagacaaggtccatgcaagtagagtgcttcataggcttggactagaggattgctttgaaagagttataagctttgagaccctgaattcctccaatgaagatggcaatgaatataaaccaagttccacagggatttttgatttttatgagtacattcgcaggcctgattctgatattttgcttccaaggaccccggttgtgtgcaaaccctttcaagatgcatttgaaaaggttttcgatatggcagatattgaccctcaaagaacattattcttcgatgacagtctccgcaatttacaaacgggaaaatccttgggcctccacacagtcatggtggctgcatcccgtcgtgctacgggagtggatcatgccttagaaagcatccataatatgaaggaggcatttccagaactgtgggaagccaatgagaagcctgaaagtgtcgagtgctcttga

SEQ ID NO: 93379 - DNA, 564 bp, Glycine max
  Peptide Sequence Number=SeqID_210157
atggcgaggcgagagctttcaagcacgttgaagaacttgaagttcatgcaaagggcggctctgagagaggagaaaaccaagaaagaagaagagatcagacctgatgtcagtgttggcacatccactgctgttactagaaagtgtgtggttataatggaaggtgatccccatcctggagcacctaaaggtcgaatgtcatttcaaagtttcaatccttcagttgataaattaaatgaggaagaagcaagactacaccagccagcagctgaaactaccatgtctagaaatcaaaatgcaaatatcaatatcagagaaaatagctcttcagtagaaggtccagaatgtgccaacatggacaaaaagagtgtggaggttaacggcaatgttaaaaggaaacaatctgaagtaatttgtgaagcacaatatcctaacaaatcaccaaagaacgatcatgatgataaacaatcattgccaaacaatagtttgggtactttgaaaaaaccgagtggagataagctggactggaaagttttaagaccatctagtgtcaaacaaagtagatga

SEQ ID NO: 93380 - DNA, 624 bp, Glycine max
  Peptide Sequence Number=SeqID_210158
atggatgatacattcagcctaaaggtgaaaccagggaagacatatcttctccgtttgatcaacgctgcaatgaacactgaactgtttttcagcatagcaaaccactccatgactgttgctgaagccgatgttacttacgttaaactccgacatcatcctcattgggccattgacagaagcttcttcttcttcaccgaaacatgtgaagggcctaataacagaacaaaattgtctgcctccatgaacaacatatctttcgcacttccttcggtggcgattcttcagcaacatttctcagggaagggcaataacggtgtttacaccacggacttcccagctgttcctctgagagcctttaactacacggggactccaccgaagaacaccattgtgaaaagaggaaccaaagtggtggtgataccctttaacacgaggatgcagttggtgtcgcaggacactagcattttaagtgcagagagtcatccgttacatcttcatgacactgcgaaatttaatctagttgaccctgttgagagaaacacctttggtgtgccttctggtggttggtttgctattcgctttctcgctgacaacccaggtgacttcacttcaaagttcaaatga

SEQ ID NO: 93381 - DNA, 881 bp, Glycine max
  Peptide Sequence Number=SeqID_210159
atggttgggcaaaagaggaactctattctggcacgcacaccactcgtggttaagggctcttctgcatggacccctcgtcatcctcacgcaggggtgaaagcagggaagtcatatcttctccgtttgatcaacgctgcagtgaacactggactgtttttcagcatagcaaaccacatcataactgtttttgaagccgatgctacttacattaaacctttcgactccgacatcatcctcattggacaaggacaaactacaaaccgaggccatttttcactggcaagggcaccttcgaacaattccacattggctggcatcctagaatacgatgacgataacgatacccctgcttcaaaccgtcccatgttgaaaccaacccttcctgatatcaacgacacatcctttgtttccaatttgaacactaaatttcgcagtttgaacagtgcaaagcaccctgcgaatgtgcccgaaacagttgacaagagtttcttcttcacgataggtctcgggagcatgctctgcccaagaaaccaaacgtgtgaagggcctaataacagaactaaattctctgcctccatgaacaacatatctttcccacttccttcagtggcgattcttgagaaacatttctcagggcaggagcaggacaataatggtgtttattacaccacggacttcccagttgtttctctgagagcctttaactacacggggactcccccgaataacaccatggtgaaaagtggaaccaaggtgcagagagtcatccgttacatcttcatgggttcaacatgtttcgttgtgagtcaaggttttgggaactttgatcctatcaaagaccctgccaaatttaatctggttggccctgttcagaggaaccg

SEQ ID NO: 93382 - DNA, 1035 bp, Glycine max
  Peptide Sequence Number=SeqID_210160
atgaactcggacacgacgtcgtattggtgctacagttgcacgcgcttcgttcacatccacgaccagaacgacgtcgtgtgcccccgctgccatggcggcttcgtcgaaaaggtcaccgccgggcaatcggcaaggcaggggttccgccgccgccgccgcaacgccgggagccactcgccgttcaacccggtgatcgtgctccgtggaccgggggaggacgaggagagcagctttgagttatactacgacggattcgacggcgaggggctccgcccgctgccgtccaccatgtcggagtttctgctcggatcgggattcgaccggttgctggagcaggtttcgcagatcgagataaacggcttgggaaggccggagaatccgccggcgtcgaaggcggcgatagagtcaatgccgacgttggaaatcaccgagtctcacgtcgcgtcggagacgacctgcgctgtgtgcaaggaggccttcgagctaggcgagttggcgcgtgagatgccgtgcaagcacctctaccactccgattgcattcttccatggctctcgatgcgaaactcgtgtccggtgtgccgccacgagttgccgtcggagcaagccgcgccggaaaccagagtcgccggccagatcgaggaggaggcggtaggcttgaccatatggaggttgccgggcggcggattcgccgtcgggaggttcgccggcgagagccctttgccagtggtgtacacggagatggagagtggcgggaactccaacgaaggttctcgaagaatctctctggctgttggaggcggcagagttagggaaagtcgtggtggatttgggagaattttccgcaatttgtttgggagaattggggctttgactagaagccgtagcctttcaacttcactcttcaatagaagaagaaccgcaaattctttgatgaaaggagatattgatcgttattattccaaaattcagcagaacaaaagggaataccgaatctgtgtgccatattcgcggcattcattctactcttggagctaa

SEQ ID NO: 93383 - DNA, 1029 bp, Glycine max
  Peptide Sequence Number=SeqID_210161
atggtttcatcagtcgcttctttgaaaatgaagaacctcgtatcaactttcctcgttgtgtgcctcttagcctcgctcctctatccaataaaggctcacggaggaggaggaggtggttctgacagcggagatttgtattctcggggtctgatcctggtgaaactatggtgtttgatcatcttgcttgtgaccactttcgctggtggggtgtctccttacttcttccgctggaacgacacttttcttgtgttggggactcagttcgctggtggggttttcttgggaacctccttgatgcatttcttgagcgattccgatgagaccttccgagaactcaccacaaaagcttacccttttgccttcatgctcgcttcatctggataccttctcaccatgtttggtgactgcgttgtgaattttgtcaccagcaatagccagaagaagcccaaagtggtggaactggaaggagggaaagcaccccaagagcaacatgaccaagctagagatcactgtgcagtggagacaacaaacccggcattattgaagacttcttctgtgggagacaccattctactcatccttgcactgtgtttccattcgctttttgagggcattgccgttggagttgcaggtacgaaggcagaagcatggaggaacttatggacaatatccttgcacaagatatttgctgcaattgcaatgggaattgctttgcttaggatgttacccaagagacccttattaacaacggcagtatattcttttgcctttgctgtgtcaagccccattggtgtggggattggcattgccatagatgccacaacacaaggaagcaccgcagattggatgtttgctataacaatgggtgttgcttgtggggttttcatctatgttgccatcaatcatttaatatccaaaggcttcaaacagcaggccgggacgaccagcagtttcgacaccccctggtttaggtttctcgctgtgctttctggtgttgctgttatagcagtagtcatgatctgggactga

SEQ ID NO: 93384 - DNA, 288 bp, Glycine max
  Peptide Sequence Number=SeqID_210162
atggctgggacgccacacccctatttgaaaatcgggatcatttccaagccatgccactatggttccaaactgctcgggggtaggccacaagaaaggattggggtcctagctccgctggtgctgggtgtaccggttgaagctctcattcagttgtacctggcccctgtgattagccgcctgctggctagtcacatgcttgatgttcgtgtgcatctgaagctctatcctccacaggccatgttgatgcggggccggataagcttggcgggagtgactgacaccctatag

SEQ ID NO: 93385 - DNA, 594 bp, Glycine max
  Peptide Sequence Number=SeqID_210163
atgaaaaaccttcctcttttcatcctttataaccttcatcctctattccacctgaaagttctcgaaatcccatttttgaactcgcgactcttccctcatgctgatgatcctcttcttcaagaaacaccgtctgaactcgctgagcatcgatcaggtgtgggcatagagggatacatagaactgcacccccctcattcaggggagcagtcgtcgctacccatcacgcggcggagtgatcaagtctctagcattcgtgttggtgatgccgttgctagttgcaccatcactcaccctaacataagtgtcgtcgcttttgtgggtggcatcactgctaaggaaaggcctcacccttactctggcatgtgtcttattcccgtggaggatgaggccgagtcttctcagctgaatcctcctcaaaatgtcatagacttagactcagaggctatgaccatccaagtgattctgggttacttgatgcaatcctaccccccaagggcattggatagaagactccaagaagattgggcaaaagatgcaagagaaggccctaggattctcatgagccttagggtagatttcgggcccatgggctaa

SEQ ID NO: 93386 - DNA, 303 bp, Glycine max
  Peptide Sequence Number=SeqID_210164
atggcctcttacgcaactgagaggttttgcttctatttcgcggtgggtgatcatgaagcccaaaaacttcccaccaccaaccccaaaggttcattttcaaggttgagacgtgtccaggaagctcaacaattggaacctagatgcacaatcgaccagcttatccatgcttggcaagggatatgcgtctttagggcatgctttattaaggacttctactatgtgtttgtacttgtggctggtgaggtccctgctgagctgagtgcactgcccagattctggtctgtagacaaaggatcaagctga

SEQ ID NO: 93387 - DNA, 1074 bp, Glycine max
  Peptide Sequence Number=SeqID_210165
atgggtgccaagtacctcgaagtagtcaaacgagggtcgcatcccaacaacggatggtccctggacgaaattagggttggacttgttggtgatgacgtgcctcattttgctatcgagcctcctataggagaagagggtcaacatgttactagggttggccttaatgatggtgaagttgttgaggtcactcctaacgtgcctccttttgtcctatctaagaggaatcatgataacggggctactactattgttgctcctgctcctccgacacctccttccttgcctgctcaggaggtatttatctccctatttactgtggttgttgcacaagtccctttggtcgctcctatcatggctcttccatctatcactgttatgcctttgctttgtgctagtgtggcgactgttattacttcggtggtcccacattctttttctttagcttcaccagttccaactccagctttcttgttgtcagtgttgccttcctcctcttcttgctccagtcttccttcagaggagttttgtgattctggaggagaatggatagaggatcccaaggtggtcaatgctactattgtctttgttgaggcacttggtctaaccactggttgtcatccagggtcggcaatgcttttgctaagttgttgcgcactagattggacagtgacgagatgtggagatactgttgcagagaaggaagagcttgctattgagtctgctaaagaggttagtatagagcttgaagaggagttgttgacgttcaagaaggaagctgtggagcggcacgagaagggcttttataaggacgttaggaagctcgagttcttcaccaaaggtcttgagttaggtctttttgacccatttaaggacggctacttacttgagggcagaaggctcaccaaggatagaccttgggtttttcgagccttgaagatttgtcaaggcttaccaaaggaggaccttgggtttgttgagccttggagatttgttgaggctcaccaagggaggaccttgggtttgtcgagccttggagatttgtcgaggctcaccaaggatggaccttgggtttga

SEQ ID NO: 93388 - DNA, 201 bp, Glycine max
  Peptide Sequence Number=SeqID_210166
atggcaccctccaagctttatcccaacagtcgggcgatggtgaaggtcttcgaggtcatgtgtccatttttcaacattcggcctagcatgtccgtgtttctttatttcttccaaatgaagttgacggggaagataggttggatgtcccttaacagtgtgtccaagaagctatttgagtttgacttgaacatttttcattga

SEQ ID NO: 93389 - DNA, 474 bp, Glycine max
  Peptide Sequence Number=SeqID_210167
atgtatcacataccaagggaaagcaacacgagagcagacttgctctccaagttggtcagcatgaaaaggactagacacctcaagaccatcatccaggagacaatccaagcactaaccatagacaccaatgaggtcatggaaggagaagaggaggagtcagactggatggccccctataaaaacttcttaatcgaaaatgttccacgcacccctcccaacaaccaccatagcttgagttccacttggcctatcgccatatggggcatggacatattgaaaccattgccaaaagccctaggagtggtcaagttcttattggtcaccatcgactatttcactaagtggatcgaggcaaggccattacaagaaatctcagttagggaggtagaaaagttcacctggaaacacctcatctacagatatggtctcccttatgccatcatcactggtaatggcactcaattcaaagcttaa

SEQ ID NO: 93390 - DNA, 638 bp, Glycine max
  Peptide Sequence Number=SeqID_210168
atgggagagttgaaattcttccttggactacaaataacgaaaacaagcaatggtatctacatccatcaaaccaagtatgtaaaagaaaagttgaagaaattcaacatgaacaatgcaaaagaaatgaagacacctatgcatccaacaacatatcttggattggaggaagaatcaacaaaggcgaggctcacgggtgcgtcttccaaaggaggaaaatgcgcggagtcgccaccaacgtttatttgtggaaaacgtcggaaaaaccgagggaaaccggtcatgaagaatattccagattcgggagttgtatttacgtttgaggaaggtattagcacctctcacgtcgacaaaagcggggctcttgctcctacgtaccctccatcgaagaggaaatcaaacctacgtagttctttcttaaggatgaatcaagcgatttcttttacttggaatgtgattgcgcaacaaagggtgccaagtacctcgaagcgggcaaccaaaggttgcatgccatcaaacaaagacaaagtcgaaaggaaaagcacaagtgggagttgccatttcattggtgggaacttggttacatggatatgcaagaagaaaggtttaactgcattgtccactattgaagcagaatacat

SEQ ID NO: 93391 - DNA, 495 bp, Glycine max
  Peptide Sequence Number=SeqID_210169
gttgcattaggagagtttaagaataagcatgtcttattgttcatttctggccttgaccacattgacaatgagattcagcttttaaaatcgatcaatgcgaaattgaaggaagaaccaaacgagctggagggttataggaaagaggatttcaagattttgtggatccccatagtgagtgtttgggatgaagagcaaaagaaaaagttagatgttactaaggttgagtggtatgtggtgaaggaattcaatttccaaacaggtattgatctgataaaagaggtattcaattacaaaggtaaccccattatcatgctcataagccctgagggtaaagtggaaaactctgatgcaaagcagattatttccaaatgggggattgatggcttccctttcagaacctcagatcacactcgactcactcagcaatggaactggttttggaatgaaatgatcaccctcagtcctataataagagaattgagagtgccacagtag

SEQ ID NO: 93392 - DNA, 228 bp, Glycine max
  Peptide Sequence Number=SeqID_210170
atgagagcaactgggagggtgttctgcaacacgaatctttggtgtcattggcagcataagcgcaaatatgcaaccctgaccaagaacaagggtggatactgtgaccgtgtggctgggcggtggatacgtgtaactaagaacaagcgtggttgggcggtggcatggtggcagccagcgtcgttgaacgaagcaagcactaccattgaacaaagcaaaagcgtgctatag

SEQ ID NO: 93393 - DNA, 162 bp, Glycine max
  Peptide Sequence Number=SeqID_210171
atggaagagtcaaggtcgccgttatcgcagaggtcattttgcacattttttaagccggttttaaggtacccgtctttaaaaagttacacttatttacgaaaatgccactgctttacttactacatcgattttcatacaaccggtgtaaaatcaacgttgtaa

SEQ ID NO: 93394 - DNA, 477 bp, Glycine max
  Peptide Sequence Number=SeqID_210172
atgagaaagtataaccgtggtgacagctggtgcaagctgttcacgctggaggagtcgcgtgagttgagatcgttcaagtgcgtgaggcccttgggatactcgagcaatgggaataaggttctattgaaacacgaccggaagaggctgtgttggtatgacctgagaaagaaagaggttacccttgttagaattcagggtttgcctaatttgaacgaagccatgatttgtttgggaaccctcgtcacaccgtatttcttacctcgtgaaatttgtaggaagttgcggactttaggatgcgaacatcccagtatatgcaccgataaagattttacattaacatttaattacagactaacgtgtatggtaatggtggagtctaatgatggttcagctacagtagcggcacctggtgaatctgtgacagagtctctgaaaacaaattgtggtcattggatggttgcatgcccccgtaggtga

SEQ ID NO: 93395 - DNA, 507 bp, Glycine max
  Peptide Sequence Number=SeqID_210173
atgcttaaccgtgacttgcgctcccggttatgggggcgagtagtttccttttatcagtgcttgggccgccctctgatcctggaggagcggccaactatgctagcacaaccagagagggagactatcgcacagctactatgcatacccgggcaagatttcacccgtgccgctgcaaagagacgagtgcggatcgtgcgcaccaacatgaccactcttacacagatatgtatgacattgcaacatagcaacattctgcccaacaaccgtaatgccgatctccccctgcggaaggatcgcgcccacaagacacccggaggagcccaacaaggccctagggtttccagctctggttacaggcctctattagtcctggatcgcgcccgcaagacacccagtggacccgaagaagtccaacagggtcttagagttgccaactctgattacgggcctctgtcagttctacggagtgcctgtcgcccccagcaaggtcatcaggccccttactaa

SEQ ID NO: 93396 - DNA, 255 bp, Glycine max
  Peptide Sequence Number=SeqID_210174
atggacctggagaattccaacagggtcctggggtttctagctctgattacaggcctctgtcagttctacaaagtgcttgtcgctcccagcaaggtcatcaggccccccactaaccgagctttcatcaagaagtactgcgcccccaggcaggcgcagggcgagacaccacaacagcctgaggttgaccagcagcgggcaacaggcacaccgccaccacctctagagttcacctcagctcatccacaaaaaggttag

SEQ ID NO: 93397 - DNA, 183 bp, Glycine max
  Peptide Sequence Number=SeqID_210175
atggaagaggtgcattggttcgtaatgccttatgcatatgaaaatagagtagatgatcatggagatgacaaggaagggggaagtggtgctatgggtgcttcagatggtccgtggtgtcgatgggcagcagcggcggaggaagtggatgagccctttctctttttcgatgattcagccatttga

SEQ ID NO: 93398 - DNA, 303 bp, Glycine max
  Peptide Sequence Number=SeqID_210176
atgcccttgcggggtaggattgcatcaccactcattcaagggttacaggttgtaccatctatggtaaggctcatgaaacaggccaatgtatttccaccgaagaaaacactcaagaaattcattttatggggaatcaacaacggcaagggtatactcaaggaggattttcaggcttttagcagagtccctataatcaacaaggacagtataggacacaccctggtaaccaattcaacaaagaccaaaatggaccttcgaataggccaatccaacaagggcccaacattttccagaggacgatga

SEQ ID NO: 93399 - DNA, 252 bp, Glycine max
  Peptide Sequence Number=SeqID_210177
atggactcctctaaggacaatagcatcatttcttgcactgaattgttgggagttggaagccatcttctcaatcaaattcctagcctcaacaagagtcatatcaccaagagttccaccactagcagtatcaatcatactcctcaccatgttgctaagtccctcatagaaatattgaagaaggagttgctcagaaatctagtgatgaggacagcttcctctccatgttgctatagtaaatggattattttttaa

SEQ ID NO: 93400 - DNA, 180 bp, Glycine max
  Peptide Sequence Number=SeqID_210178
atggggttgacatttaccaagctttttagccggcttttcgccaagaaggaaatgcgaattctaatggttggtcttgatgccgctggtaagaccaccatcctgtacaagctcaaacttggagagatcgttaccacaattcccaccattgtgacaacttgtagaactatattagttaaataa

SEQ ID NO: 93401 - DNA, 167 bp, Glycine max
  Peptide Sequence Number=SeqID_210179
atggcgcagcctaaaccaagtgctggccttaaggggaaacctcaccagcatgctctcactttcatgccttcttgcatttcaaaaaaacaaaggcttgggccccctaggccaaagtcatgttttggcatttatcctaactttcgcaagctgtccgcatcccaaaaatg

SEQ ID NO: 93402 - DNA, 404 bp, Glycine max
  Peptide Sequence Number=SeqID_210180
tcccaaaagtgacagattaagcttagctcatcagtgggctaagcgcgcatccatcgctaagcgcgctgaagctacgcttagcgcgacagaagaatctggtagggcatcaacatcaagggcgcacactaagcacgagatcaatgcactaagcgcagcagattctagagcacaccgtagtgtctacttcgggaaaagagctctggaggcagcaagaggagcaacttttgcaaagatacctaggattcacaatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagttgcaggatccacgat

SEQ ID NO: 93403 - DNA, 153 bp, Glycine max
  Peptide Sequence Number=SeqID_210181
atgcatgaaagagcaaaggtgataggcgattctcatgttcagagaagtgccactgagtttgaaaagctctctccaaaaagaactgatgaagattggatcacggttggagacaaggttgcgaggtattccatggagtttgcaaaccatgtctag

SEQ ID NO: 93404 - DNA, 601 bp, Glycine max
  Peptide Sequence Number=SeqID_210182
tgactctttgtcgtcacatcttcaccatctggagcttattttccatgttctattgcaagggatattttaccttaagtgttctaaatgcttatttgcccaacatcaattggagtacttggatcacattatctctagcaaaggagttgaacctgagcaatccaagatcaaggttatgttagattggcctgtcccttccaatcaaaaggatttacgtagattccttggcctcccttgcatctaccgcaaattcataaaggggcttgctatgggtgtagtacttatgcaacaagggcatcccatcgcatttttcaataagctatttggccctcgtatgaaaagcacattcacctatatctgcaaaccgcacaccaataccaccgttgttagaaaatggcgacaatacttacttggccaccaatttactatcccaaccaaccacaagagccttaaggacctaatgtcttgggtaatccaaacccccgagcaacaattctatctcaccaagttgtttggatacgattacctaatccagtataagtctggcaaatccaatgtcatggcagatgctctttctcgcattgaaccaatcttagctaactag

SEQ ID NO: 93405 - DNA, 315 bp, Glycine max
  Peptide Sequence Number=SeqID_210183
atgctggaaatcccaaaaggatcactaagcgatatgcttgactggaagatgctgcctagctgttacttggctgccttgaagaatctagttgcaacctacaagaaggtggtgaagataggtgagggaacatatgacattgtttccaaggctcgcgaaggcatcaccaatgttaccattgctctcaagaagattcgcctcgagcaaaaggatgaaggggttcccaacaccaccattgtgagatttctctcctcaaagagatgtaacattggaactttgttagaaatattatctaaagaaacaaatctaaaatggtag

SEQ ID NO: 93406 - DNA, 552 bp, Glycine max
  Peptide Sequence Number=SeqID_210184
atggagttcgtctctaccacttatcgattgaggtcgaagaaaactaggaaaggaaagagtcccggaaagggtactccagggcgttgttcttctttctccttctgcctgagttcgtctttgtcgcaaactgggctgcgcttccgtgactgcaacgacattgtggagttcgtctttgtggagttcgtgtctgccacttatcgattgaggtcgaagaaaactaggaaaggaaagagtcccggaaagggtgggaatcgattttggaagtccattgtgcttggctttaagactcccagagaagccatcgaaggttacaaccactggaatatctcaacctctatgagcgtcagaagacaagaagcaatcaaggttttcaatgtgatggaacaagaaaatctgccagaaagtgaagtaatattcttaagatggctaaccaaagaggaaatgggttttgatgacgtgtcttgtggagggacatttgctgtatgtgaattttggaagtctgtattgctgttgattctggtattgggtctattgagtgggaatttggtgtaa

SEQ ID NO: 93407 - DNA, 492 bp, Glycine max
  Peptide Sequence Number=SeqID_210185
atgagtttcattaatgttgaatttttgcaagatgtgcggaaaaaggcgcaagccatccagaagcaaaacactgccccccacatgttgtctcgtgggggttatgaatatttagaaaagacgctgatggctgagaagacaaagaaaaaactggaggaagctgctcaatcgggaagcattgaaacggtgattgatcctccatctcccatcagacaacatgtcaaatggaagatggcccgcacgaagaaaattggccagatgacatctaaggcagcaaaggaaattactaagaagattgagcagccatcacaaggttcctttgtcgcccatggacgtcaagatgtactaactgatgccattgggcaacaagaacacctcggtcgtgtgtgtggaagcaatgccttccaaggttattttgatgatgccaaagaatcaagagttaagcaaattccaaagattcaagaatcaagtttcaagaatcaagagaagacttaa

SEQ ID NO: 93408 - DNA, 1158 bp, Glycine max
  Peptide Sequence Number=SeqID_210186
atggagactctctgctctgcattggtgttcccatctttcagaatcacaacttcagctttctccaaatgtggcatcagggcttccattgccgttgagcaacaaacttcgcagactaaggttgctctcctcaaaattggtaccagaggaagtccactagctctggctcaggcatatgagaccagagacaagctcatggcatcacatccagagctagcggaagaaggggctattcagattgtgataataaaaacaactggtgacaaaatactatcacagccacttgcagacatcggcgggaagggcctgttcacaaaagaaatagacgaggcactcataaacggtgacattgacatcgccgtccactcaatgaaagatgtacccacttacttacctgataaaacaattctaccatgcaaccttccacgtgaggacgtaagagatgcatttatatccttgagtgcagcttcactggctgatctaccctctggaagtgttgttggtactgcttcactcagacgaaagtcacagatactgcacagatatccatctctaaatgtggaggaaaatttccgtggcaatgtccaaacaaggcttcgaaaactcagtgagggcattgtccaagctaccctattggcattagctggactcaaacgattaaatatgacagaaaatgtgtcttcgatcctatcaattgatgatatgcttccagctgttgcccaaggtgcaattggaatagcctgtagaagtaacgatgataaaatggtacatgtatggtttttggctgttgtcaatcaagtgagagctatatcagagataaaaacttgtgttaattcattggcaagtgtaccaattcgtccaagtaataaagcagaataccttgcttcattgaatcatgaagaaacaagactagcagtttcctgtgaaagagccttccttgaaaagttagaaggatcttgccgcactcctattgcaggctatgctagcagaaacgaggatggcaattgcttgtttagaggattagttgcttcccctgatggaacccgcgtgctcgaaacttccagaattggttcatatgctttcgaagatatgataaagatgggtaaggatgctggagaggagcttctttctcgagctggacctggctttttcagtcgttaa

SEQ ID NO: 93409 - DNA, 984 bp, Glycine max
  Peptide Sequence Number=SeqID_210187
atgagcaaatctttgattataatagtgaaaattaaagttgcacaatccataggagtttgctatggagtactcggtaataatctaccatcaaggcaagaagttgtggacttgtataaaacaaatgggataggtagaatgcgtatatactatccagatgaagaagcactccaagcccttagaggttcaggcattgagttgattatggacgtggctaaggaaacccttcaatcaatgacagaccccaatgctgctacagattgggtcaataagtatgttacagcctactcgcaagacgtcaatttcaagtacatcgctgttggaaatgaaattcaccccaataccaatgaggcacagtacattctatctgccatgaccaacattcagaatgcaatttcatcagccaatttacaaatcaaggtgtcaacagcaatagactctactttcattgctccgccctcctatccacccaatgatgctgttttcactagcgatgcagagccatatgtaaaacccataatagacttcctagtgagaaatgaggcgccacttcttgccaatgtgtacccttactttgcttatgcgaatgatcaacaaaacagtattcctcttgcctatgctctttttacccaacaaggaaacaacgacgctgggtaccaaaacctcttcgatgctatgttggattcaatatacgctgcagtggagaaagtgggagcatccaatttgcagatagtggtttctgagagtgggtggccatctgaaggtggtggaactggagcatcaatcgataatgcaggcacttacaatgctaatttgattagtcatgcctcgggtgggagtggaactccaaagaggcctggtgggtctatagagacttacttgtttgccatgtttgacgaaaaccagaagcaagatgctgaaactgagcgtcattttggtctcttcaggcctgataaatcacccaaataccaactcaatttcaattaa

SEQ ID NO: 93410 - DNA, 2197 bp, Glycine max
  Peptide Sequence Number=SeqID_210188
atggcgattgcgtggttacggaatctgcaaaacctatggccattcagagtggacgagttaagagattcgaagcaattggtgaagaaactgagcatcccccaagacacgaagcaattcgtattcgcgctgcgtgatccccagacccaatccatcatttacattctctcctctctgaatttatcggagcgatcagcttccgatgccacgtgtctcatcaaggagatcaaacccgacgccgttttggtgcaagctggcgtttcccccttctccgagcttcagtccgaagaagactccgttccggtcccgacctcttctttcggggtaatcaaacgctgttttcttgataaaattggtagggacatgtatgagaatgtagcaggtaactttgtgttgagggagatctttggaaccagttttcatggtcccttgttggctgctaagagggctgctgaggatgttggatcttcgtttcttgttatagagtctccttcttgttggggtaatagtaatagtgatagtaatagtaataatagtgatagtcatagtgatagggatagtcattttcggagtcttgttaatagtttggttcctaagcagcatgctgcttcttgggctccttcggctttgaagaggttttctcttgataaggaacttaggatgatgttggctaaggctttatctggttctttggatccacttttgcttagtagtgccaatgcaagttctgttttggagaagggtaatgaggaaactcagccatcaagttgttatgagaccccgggttttgccaggtctatttatcctttgcttgaggatttgtatagtatattcggtgatcttccatcgcttgggaaggcgctggcacatgtgcagaagatgctgttggatgtgaatagaggggaggttcttgacaagagaactgtttctgaggtctatactttcaggattgctgttgaggggcttagaattgctctgaataataagggcttgaggccgattaacaggaaaagtgctgcaaagtcagataagattgagttctcggagcttccggttgatgacaagtcgcacgcactctttgcgcaggccatccggagtcagactgataagtttaagaccattgtggcagtggtagatgctagtgccttggctggtcttaggaaacactgggatactcctcttcctgttgaagtcaaagagttggttggagaactgatcacaaattctgagggtaaaggggttacgttgaatcatagtgagaagaagcggttattaacagataaacctatggtggcagtaggggctggagcaacagcagttttaggagcttcatcactgaccaaagtagtccctgcatcaacactagtgaaggttgtcactttcaaaattcccacttcactcaaaatcggtctcagccagatgcagaaggtgctggcttttgccttcggcccttctaaagttgcggctccagggattgcgacttcaggagtcaaaacgtctggcatcatgaaggcagcagcatctgctgaaaagattcgagctgttgctcacggtgttatagcctcagctgagaaaaccagtatttcggtcatgagaacagctttctatgaaataatgaggaagcggaaggtgcgacctgttgggttcttgccttgggctacatttgcaggcagtattggaacttgtacaagcctgcttttgtatggtgatgggatcgagtgtgctgttgagtctctccctgctgccccctccattgctagtttgggtcgtgggattcagcatctacatgaggcatctcaagcagatgtaagagatgcatttatatttttgagtgcggtttcactggctgatctaccctctggaactgttgttggtactgccttcactcagatgaaagtgacagatactccacagatatccatctctaaatgtaagcttgatggtcatacaatggtagctttggtatgtggacagaacggaatggcagtgttctgttctattctgctttttctggttccactcttgcatgcagaatacattgcttcactgagtcagaagaaacgttggaagggtcttgccgcactcctattgcaggctatgctagcagaaacgaggatggcaattgctttgcttgaagcttccagaattggttattatgctgttgaagatatgatgaagatgggtaaagatgctgggaggg

SEQ ID NO: 93411 - DNA, 723 bp, Glycine max
  Peptide Sequence Number=SeqID_210189
atgtctgccatattgctgcttgttgaaatattatcgtacattacagggaaagaagttgtggatttatacaaaacaaatggcataggtagaatgcgtatatactatgaaaaagccctccaagcccttagaggttcaggcattgagttgatcatggacgttgctaaggatacccttcaatctctgacaaacgctaatgcagccagagactgggtcaataagtacgtgacaccctactcacgagacgtcaattttaagtacatcgttgttggaaacgaaattggccccaataccaatgaggtcggtccaatacattctacctgctatgaccaacattcaaaaagcaatttcattagccaatttgcatggccgactcaaggaatcgacaacgctgggtaccaaaacctctttgatgctatgttggattcaatatatgctgctgttgagaaagtgggagcacctaatttgaagatagttgtttctgagagtggctggccctctgaaggtggagatggagcctctattgaaaatgcacgcacttattacagtaatttgattgatcatgtctcaagtgggaatggaactccgaaaaggcgtgggcctatagagacttacttgtttgccatgttcgatgaaaaccagaagtcgggtaaggaaactgagcgacattttggtctctacaggcctgataaatcatccaaataccaacttcgtttcaacaattga

SEQ ID NO: 93412 - DNA, 3105 bp, Glycine max
  Peptide Sequence Number=SeqID_210190
atggaaaacgccagtgacaatattaataggttttcgaatccaaacgcaaacgcgaacgcaaccgcaacgacctcgacctcaggtttcacgttcagtaccccttccgtttcgggcctgtcccggcccagattcgtgaaggtccgcaagcccaacaacgcccccgccttcaatccatctcgcaacggcgctgctgcggccgccaacgtcaatgccgcattcgccaccaccgatttcgcctcacgaatcgccgatccattcaggaatctcaaaatcgacgccaaaggtgagttcgcctttgccactaatgattcctcacgtgttgatgaaaattcggtatctgaacagatcaacaatttgaagattgttaccgataacgacgattcggacgacctacggaatgagctcaagaagaaattgagcattaaagaaggaggaggtagtaatgctgcagttgctgagaactcagcgaatgaagtattatatcaaatgaagaaactgaatatgaatgacgctattagtagtagtaatgttcataatagtgcaggtcatgttgaacctagtttggaaaatgtgacaacttttcgaaatcgtgaaacggaagctgcagaagatttgttgaggaaatttgataagttaaacatagttaaggagaagaaggaggattgtgataaaccgaacttgtgtaatccttttgtggagggaatccacccaagagttgcaagtggtggtgctcaagttgcttcggaagactttggaatgtcacaaggtgctgcttcagctttggcctctgtttctgtgttctttcagcctgctggagttggcaagagggaggaatttgtgtttactggtaaacaagatatttcaggttcatcttttgttgagtttaaaacacctgcaccacaaattggcaaagaaggaaaacttaaggaaaaagggagtaaagtgagaatgaataagagtagagaaaagccaaagcattatagctcggccccgccgtggcatggacaaagttttgttttgaaagaaagtgttccccaggacgaactgcagggttcaccaatggacgtgtcacagtatcaggaaaaactggctgaaaatgaaaggtcgagggaaaattctttgacatccaatgagtcatttagtgttgataacaacaatacagttaatgattcagaaccaacatcttctattgatcctattgatgaagatctaattggcgcggcagagagcttgaatataaatgggggtgatgttgcacacagagacacaaaggaggaaagttcagaggatcaaatgtgtgaaaatagttatgttgaagacccaaaggacgagtcagtttccggggttgaaactgaaagctttaagtctgccaatgatgaagtggacataactagtgatgcatctggtgtatcagcagaaacagaagcccatgatagtgatagaatgttgcatcttgacagtgctttgagttcaagaaatgtaaatgtgtctggcttcacatttgctgctgcttcttcagctgaagctcaatcaagtagcccaaaacgtcttcacaaaaagaaaaatgttggccacgatccttacaactacacaccaaacataaaggttccttattcatcatcgtctgtggcattttctccattttctgggacttcatctcttttcacatcagggcaaagtttaaaacccgaggtgtcctctcctccgcccaaaacaagtgattctgatgagaatcaggagaaggggataaaggaggctcaggaaggctgtgaaaggtggaggctccgcaaccttgctgccacacacatgtctcttggtaggatgagagatgcactagaagattgtaagatggctgctgaaatagatcaaaatttcctcaaggtgcaacttagagcagcaaattgttaccttgctctgggggaagttgaaggtgcatcacaatattttaaaaggtgcttgcaatcaggaactgatgtttgtgtggatcgaaaaattgctgtggaagcctctgatggcttacaaaaggcacagaaagtatcagatctcatcaatcattctgctcagcttttgcaaagaagaacggcctctgatgcagagagagcattagaacatattaataaggcgttaataataagttcatactctgaaaaattgcttgaaatgaaagcagaggctctcctaatggtgattcagctgtgtggcaagacccttgattctgctgagaagaatgcctgtcctttggatgctggttgcaaagtcacggatctggataattcacaactctcaaaaggtttctacttcagaatatggcgatgctcaatgatgcttaaagcatacattcacctaggaaaatttgaagagggtctttctttgctggagaaacaagaggaaaagatgtctgccataaacaagagtggaagcaaggttttggattcactcatacctctagctgccatcatacgtgagcccttgcaccataaggctggaaggcatgcagaagctgttgaatactatacatctgctttgtcatgtaatgtggagtcccgtccatttgcagctgtctgttattgtaatcgtgctgctgcatataaagctttaggtcaaataactgatgctattgcagattgcagtctagctatagctcttgatggaaattatttgaaggcactttctagacgtgcaactctgtttgagatgattagagattatgcacaagcagccagtgatcttaggaggcttgtctctcttctcagtaagggggtggaggacaatgccaatcagcttggaatatctgataaatcaattcattatacaaatgatttgaaacatagtcgtgttcgtcttttggaaatggaagaggaagccagaaaggagatccctcttgatatgggagttgaaccatctgtttcgatatctgaaatcaagaaggcctatcggaaagctgcactgagacaccacccggacaaggccggccagtctttgaccaaaagtgacaatggagatgatcagatatggaaggttattgctgaagaagtacacagagatgctgatcggcttttcaaaataattggggaggcatatgccgtgctatcagaccctgccaag

SEQ ID NO: 93413 - DNA, 1278 bp, Glycine max
  Peptide Sequence Number=SeqID_210191
atgtctgccatattgctgcttcttggaatattatcttccactggagtagaatttacgggggcacaatctgttggtgtgtgttatggaggaaatggaaacaatctaccaacaaagcaagcagtggtggatctttacaaatcaaacagaataggcaaaatccgtttatactatccagacgaaggagtccttcaagccctcagaggttcaaacatagaggtgatcctcggtgtccctaatgaccaacttcaatctctcaccaacgctggagctgccacaaattgggtcaacaagtacgtgaaagcatactcacaaaacgtgaaattcaagtacattgcagttggtaacgaaattcaccctggtgactctttagcagggtctgtacttccagcacttgaaaacattcagaaagcaatttctgccgccaatttacaaggccaaatgaaggtgtcaacagcaatagacaccactttacttggcaactcttacccaccaaaagatggcgttttcagcagtagtgcaagttcatacataagaccaattgtaaactttttagcaagaaatggagccccacttctcgcaaacgtgtacccttacttcgcctatgttaacaaccaacaaagcattggtcttgactatgccttgtttactaaacatggtaacaacgaggttgggtaccaaaacctgtttgatgcattgttggattctctatacgctgctcttgagaaagtaggggcaccaaatgtgaaggttgttgtgtctgagagtggttggccatctgaaggtggagttggagcaactgttcaaaacgcaggaacctattaccgcaatttgattaatcatgccaaaggtggaacccccaagaggcctagtggacccatagagacttacctctttgccatgtttgatgaaaaccagaaggatggtcctgaaatcgaacgacactttgtgaacaatgggggaccccttcttgtcaacgtgtacctttactacacttatgttaacgacaaagacattagtcttgattatgttctttttagacaacaaggaaccgacgataatgggttgccatcttatgatgcagatggagcctcaaccgacaatgctgacacttactatggtaatttgattagtcatgcatcggtgggagtggaactccaaagagaaggcttgttttgtcagacagagacttatggagagttaagggaagtggatttccatggcattatcggaaaacaaaataaaatggagtgtattagcaacaagggagagtgcaaatag

SEQ ID NO: 93414 - DNA, 747 bp, Glycine max
  Peptide Sequence Number=SeqID_210192
atgcaagcagtggtggatttatacaaatcaaaccgaattgacaaaatccgtttataccatccagacgaaggagcccttcaagccctcagagggtctgtacttccagcacttgaaaacattcagaacgcaatttctgccgccaatttacaatgccaagtcaaggtgtcaacagcaatagacaccactttacttggctactcttacccaccaaacgttgccgttttcagcagtagtgcaagttcatacataagaccaattgtaaactttttagctagaaatggagctccacttctcgcaaacgtgtacccttacttcgcctatgttaacgaccaacaaagcattagtcttgactatgccttgtttactgaacatggtaacaacgaggctgggtaccaaaacctgtttgatgcattgttggattctctatacgctgctcttgagaaagtaggggcacccaatgtgacggttgttgtgtctgagagtgggtggccatctgaaggtggagcagtagcagccactgttcaaaacgcaggaacctattaccgcaacttgattagccatgccaagggtggaaccccaaagaggcctaatggtcccatagagatttatctctatgccatgtttgatgaaaaccagaagcagggtcaagaaattcagcaacacttcggtctcttcagacttgacaaatcacctgtgccgactttcgaaattatgaggcccaaccccaaatttaagcttaatttttaa

SEQ ID NO: 93415 - DNA, 502 bp, Glycine max
  Peptide Sequence Number=SeqID_210193
atggtgcttaatctcaccgccatcactatgccattaggacactgttgttgcgacgatgtggaagtctatgtcttccgtcagccatccacagaaatcatacctcctattgagcctaaggttgctccttctggtgctcttgtcaacataaagggaagttgtgttgatccctcggggcaagacccaaacatgcgtgggttgtatgttgatgacgatcctcctcgcttggtttcccttggaagaatttatgagggatcgacaatcgtgcaccacgtccctttgggtaatgatttggtgaaggataaacaggtaccaaagggatcaatgaagcctattaataggctggaacctgatgacgatctcatataccaaatgacattgatgatcccacaacttttcctcaaacctatgcaggagttgtgggatgcaactatgtttggggtgtacaatgataatgtctccttgtacataaagcatgaagatcttagggaaatagcacacggtg

SEQ ID NO: 93416 - DNA, 630 bp, Glycine max
  Peptide Sequence Number=SeqID_210194
atggctttatctcacttaaccattcaccacgaatcccttccctccaaacactctaacctcgcctctaaggttaagaccttcctggactacctcaaccacctcaccattgtttccatgaccccaactctgccccttccttccccacgtcctcacatcaaactcgaagttctaaggtttgatggccacgaccccttggtgatgcaatcctaccccgcaagggcattggatagaagaatccaagtagattgggccaaagatgcaagagaaggccctagggttctcatgagccttaggagtacaaaatttcgtgctcttctcttcctctcccttcattcatcttcttcttcctccaagctcttatccatggcctcctatggtgaagcaaaggaatccattgatgaagaagatcctaggcctacaagctccaatggagcttacatcacttgggatggatctttaagatctcccaattctttgagtaccagggaacacccgagtaggagtgcattatcgtcatgctgttctacatggatggtccttccctcaattggtttcaatggtcatatcggaacggctttatcacctcgtggcctggatttctttaggcgttggaatcacgatttgctctaa

SEQ ID NO: 93417 - DNA, 174 bp, Glycine max
  Peptide Sequence Number=SeqID_210195
atggactgctccagcacgtccttgatattctaccctgctgaagttggtaaaaagtattgtttgatcatcacatcgactccaacagcatggacacgaccaaaggtgctctggtcgctcaatggcagcaatcagtacatcctaatgtccatgggctacaaggctaccttgcactga

SEQ ID NO: 93418 - DNA, 1152 bp, Glycine max
  Peptide Sequence Number=SeqID_210196
atggatttcattactgggctacctccctcttttggctacactacaataatggtggtaattgatagattgacaaaatttgctcactttgttccacttaaaagtgattacagcagtaaaacagttgcagaggctttcatgaattatatagtgaagttgcatggaattccaaagtctatagtttcagacagagacaaggtattcactagcgatttctggaaaagattatttgagatacagggtacaacattggccatgagttctgcatatcacccacagtcagatggacaatctgaaattctcaacaagtgtttagagatgtttttgagatgtttcacttttgagaatcctaaggcttggtataaagctttaacttgggctgaatactggtacaatacagctcaccatacaagcattggcatgacaccctttaaagcactctatgggagggaccctccagctttaactcgctataggcctcaaccaaatgaccctattacggtgcaagagcagctgggagaaagagacagaactctacaacagctcaaaagtaacttggaaagagcacaagtttatatgaaaaatcaagctgacaagaaaaggagagatcttgagctgcaggttggagattgggtgctggtaggtgttgtagcctacaagctccaattaccagaagaagcaaagattcactcagttttccatgtgtcacaattgaagcccttcaaaggagggaccactgaacaatacatgccacttcccttgacaatgactgatattgggcctattgtactacctgctaaggtactagctgcacgtgtgattcaacaaggagagttgaagattccacaggttcttatccaatggacaaacatgccaccagatgaatccacatgggaagggttggaagatatgaaagccaattatcctagcttcaaccttgaggacaaggttgtcttaaatggggatggtattgtaataagacaaattaaggagaaggaaatagatgttgctgagtcatcaattcaagtgtgtaagggcccacatggaatgcaagaggataattctgttatgcaggatccggaattacagggaatgcgcaaaagcaccagagcacgcaaggccaacaaccaattgaaggatttcgttacttcttga

SEQ ID NO: 93419 - DNA, 3484 bp, Glycine max
  Peptide Sequence Number=SeqID_210197
tggctctatctatgagaggttttggaatggattagaatgggtgtttgcccctcatgacttgccaatatcagcaggacatgcagttgctgtttttatcatcaatcagatgattcttgctctatccgaatcaggaaatctgtatgagatgcatctgcaacttggtgaaacttcacagccagtttgggttgaattctcatatacactcaatcaaatcacagataatgatcaggagaaaaattctttgatattgatgaagtctggtgtggtgtcagatgatgggacaagaggttatttctgtacaaagaatggaacactggtagaacttgatgcggttgagtctccaagatggacaaatcatggccaaccagctggagcaaatgttgcagctatagctgttgttgcttctaaacgagaagtagtatacacgataagttctgccggagatctttatgaatatgatagaaaatcaaaaccatcgtggaagaagcacatatggcaagaaaaaacggcaaaagtttcacctttgttaccatctaaagggtgcattttacatggattaagtggtgatcattctgaatctctgtttcttttgaccaaggaaggtactttggtggagagaagattacatcaaaggaagtggaaatgggtagtccatggaagtcctgaacatcaaactttgacatcgattacactagcgctgcaagatgaatcaagcgaaacattcatttctttattctttcctacttcaactggatctgtttttgagtatcaaatgccaaaacagttaggaactgttccaaacaatcagtttccaggagcatggggaagtcatgagcatcccttacatgcaaaagcagcaagaggtatagctggcttaccattacaagttgggaggatactgtttgcactagatgatggtagacttgcagaattgcatctagcaggactaggtggtgaaacttcaggaccatctgtaccacaaaactttcgaaggaaagcatcaactaaatatgtttggactatattagatgtgccagagagtgaaggatggaatgcagaatattgcacagaagaacgtggcccccggaattgcatggcaggaacaaaagatgagtcaaatgattcaggaataagttcagtaacaggtaggagaaagcaaagccaagcacagaattattacttgcttctaggcacaagtggtgaaccgaataaatcttcagaagaatacaatctgccagatgactggattagaagtaacttccggttaagattgttgtatgaaggcaagtcattcttcttaataacaaacgatggtttggttttcgaatacgtttgtatcgagaatgtatgggtatggttgaggcatgatagctcctcaactatgaatggtatagtggggagctacaatggaagtttattcatggctgatacatttgggagtttgttccttagagaatggagtgataatgagatagcatggaggaattgcactgctatgaggaaaggaagaagtattgttggaggacaaccatgggatagattaccaggtaaagcaaggagggctacaactgaagattcaatcttctttgtgagcaaaaatggaagattactgcagttcatggtttacatgagggaatttaaatggaaagactgcaaaaatcctcaaaatgttaaagttgcaagtatagttgaccaagaattgttcagggaaaatatagtctttgtcactggaagaaatggtcgcctatatcagtacaacaaagtgactgatctgtggcatgagcattaccaatctcaacatttgattctatcagagtttcctggaacagttataagcccatcaacaaaatcactatcaggctctcttttcatgctttcaagagaaggtggtcttgttgagtaccagtggaatacatggtacggatggaactgggtagaacatggaacaccttataaaggtgtaatactggttggttcacctggtcctagctttgaaggaaatcaactacttttgattggttcagatggaaatgtacacctgagatacatggacaaaaatgcatggaagtggaaggattgtggtttcccctctatgggaaataaaattggtgaagcacatattggaggtggagtccatgaggagaaaccagttcggatcgatgaaaattgtgcatctggcttgaacaaggaccaagataaccttgctgaccttaacttaaattgtgaaccaaaggtggcatccaccagaccaattccattttctgaaggttctgtcatatttgagctcagagatggcaggccttcccacgcgcctgcgaatccctacttcaccgtcgtcgttcccaaacacttctccaccaaccgcggcggcggcaacaacgacggcgatggcaaggacccgttttcctcccgcgtgtggaaggatttccgggagaccgaggagaagctcgacgcgttcttcgaggaggaggaggaggaggagagcggaagcctcgtcagaatgaacgacgacggcggaagcagtggtgggaggagaagggatgaacgggggtggctgcaagaggaggaacaagggtggttgcaacagaagggtttggacgatgcagatgaagatgctatatttaaagggatcgacgaggaaagcggaggagaagccggtggtggtggttttgatgagagcaattttggagttggagcaggggaggacttcaaaccttggagcatgaaggaggaggaggacaaagaggatgtgtttgatttcaaagatgatgtggggcatgcaggagacatcactgctttggatattaagcctaaagttgatgttgaacagcttgagaaggaagagcaagctctcactgctattgtcaaaggcccaaaacgtgcatttggtgatttgattgctgcttctggaatcacggatgagatgcttgatagtttgattgcgttgaaagactttgatggggttcatgggttgccccctcttagtgtaattgaagacatgcggtatgagaagaatactagaaaatcgactagaggtgaaatggagcgtctgaagcaagaggaagctgccaaagctagagtgaagcaggttgatgataaaggacgtgcttatggaacaggaagaagaaaatgcagtgttgcccgtgtctgggttcagcctggtaatggccaatttgttgtcaatgataaagagtttgatgtctattttcctatgcttgagcatcgtgctactctccttcgacctttctctgagacaaagactttggggctctgggacgtcagttgtactgtgaaaggaggtggtgtttcagggcaagttggagctatacgattggggatcagcaaggctttgcaaaactgggaaccagatttgcggccagcacttagaaatgctgggttcctgacaagagactcacgagtggtagaaaggaaaaagccaggaaaggccaaagcaagaaaaagtttccaatgggtcaagcgttga

SEQ ID NO: 93420 - DNA, 3261 bp, Glycine max
  Peptide Sequence Number=SeqID_210198
atggacgacgtttgcgaaggcaaggacttcacgtttccgaagcaggaggagaagattctggacttctggtcccaaatcgacgcattccacactcagctatctctgacgcaagacaagccggagtacatcttctacgatggccctcccttcgccaccggcctccctcactacggtcacatcctcgccggcacaatcaaggacatcgtcacgcgctaccagtccatgaccggccatcacgtcacgcgccgcttcggctgggattgccacggcctccccgtcgagaacgagatcgacaagaagcttggcatcaaaaagcgcgaggacatcctcaagctcggaatcgacaagtacaacgaggagtgccgcgccatcgtcacgcgctacgtctctgagtgggagaccgtcatcacgcgcaccggaaggtggatcgactttaagaaagattacaaaaccatggacctcaacttcatggagtccgtctggtgggttttcgcccagctgttcaagaaaaaacttgtctataaaggtttcaaggtcatgccgtatagcactggctgcaaaacgccgctctctaattttgaggctggtcagaattataaggatgtatctgatcctgaagtatttatcacgtttccagtcgtgggtgatcaggatgatgcatcttttgtagcatggacaacgactccatggactcttcctagcaatcttgcactgtgcatcaatgccaattttacctatgtgaaggttcgcaataagtactctggtaaagtttatattgttgctgaatctcgtctgtctgcaatccataaccctaaggagaagcccaaagaagctgttgttaatagttcaaataatgttcctaaaaatataaatgcaaagaccaagggagcttcaggtggaaaaactgaaaatgtgttggattcttttgaagtgctggagaaattctcaggggcaacattagtggggacaaagtatgaaccattatttgattacttcaaggagttatctgatacagcttttagaattgttgccgacaattatgttaccgacgatagtggtactggtgttgtccattgtgcccctgcttttggtgaagatgatttccgtgtttgcattgataatcaaattcttagcaaggataaattaactgtagctgttgatgatgatggctgctttactgaaaaaatcactgactttagtgggtgctacatcaaacatgctgacaaagatatcattgaagctgtaaaggataagcgatttcacaattggctggaaaatgcaagagattgggcaattagtcgtagtagattttgggggacccctctccctatatggattagtgaggatgaggaggaagtagttgtcatagattctgttgcaaaacttgaagagctttcaggtgtaaaggtgtttgaccttcatcgtcacaacattgatcatattacaattaaatctgacagtggccgtgtacttcgacgtgttgatgatgtctttgactgctggtttgagagtggatccatgccgtatgcgtatatccattatccttttgaaaatgttgagctttttgagaagaatttccctggccattttattgctgaagggctggatcaaacacgtggttgggaagggggaacccccacttattacaaagttggtggtcactatgcttctaattacatgttttatacccttatggtgctggctactgctttatttggcaagcctgcatttaggaatctaatctgcaatggactagtcctggccgaagatgggaaaaagatgagtaaaagcttgaaaaattatccttcaccgacggaagttattaatgattatggagcggatgccttgcgattgtaccttatcaactcacctgttgtgcgtgctgagccacttcgtttcaagaaagaaggagtttatggtgttgttagggatgttttcctcccttggtataatgcatatcggttccttgttcaaaatgcaaagagggttgaagttgaaggtctagcaccttttgttccctttgatcaggccacacttctgaactcaacgaatgttcttgatcaatggattaactcagccacccaaagccttattcattttgtccgacaagaaatggatggttatcgcctttacacagtcagtagtgcttctgctgaacgaattgagcagagtgtttcaaggatgatgacaataattgatctagccagaaacattcgtgagcgtcacaacaagcctcttaagactccactaagggagatggttatagttcatcccgatgcagacttccttgatgacataaatggaaaattgaaggagtatgtgctggaggaactcaatgtacgatcccttgtaccatgtaatgatactttaaaatatgccactttacgcgccgagcctgaatttagtgttttaggcaaaagacttggaaaatcaatgggcattgttgccaaagaaatcaaagcaatgtcacaggaaaacattttggcttttgagaatgctggagaagtcgtcattgcaaatcaatgtttgaagctgactgatattaagtgtggagatgagggaagtcttattgaacttaatgaagttttagtattctcagagctaggagtctgtgatgatggtatgggtcttgttctccgtgattttaaacgacctgatggtatgactgagaaggaggttgatgctgctggagatggtgatgttctagtgatattggacttgcgtcctgatgagtcattgtttgaggctggtgctgctcgagagattgttaataggattcagaagttacggaagaaagttgctcttgacccaactgacatggtggaggtttactttgaatcattagatgatgacaaatcggtctctcagagagttttgcattcacaggaatcctacatcagagatgctattggtagtcagttgcttccaaattctctaatgcctgcacatgcagttgtccttggcgaagagaggttccatgggatagccagcatgtcatttggtatcactttgacaagacctgcattgatgtttaaccaaaaagccattctttcactgtttacaggtgatgcaaaaagtgcatataagttgcaaacttatctgctatcaagagatcatttgaagttgaagtctgagtttcaagatggaaatggaaagaaaattgtcgattcaattgaacagctacctgctgtggaagtggttcttggtcagcatgtctttttcactgtgggggactattcccttgctggaaaatctgactga

SEQ ID NO: 93421 - DNA, 1436 bp, Glycine max
  Peptide Sequence Number=SeqID_210199
atggcagaatgcattgtggggactgggtcatttggaattgtcttcctggctaaatgcttggaaactggcgagccagtggccattaagaaggttttactggacaaaagatataagaatcgtgagctacagttaatgcgcttgatggatcatccaaatgtgatctctctgaagcatcgtttcttttccactacaagtgcagatgaactttttcttaatttggtgatggaatatgttccagagtctatgtatcgagtctcaaagttctatagtaatactaatcagagcatgccacttatttatgtaaaactttacatgcaccagattttcagggggctggcttatatccacactgttcctggagtttgccacagagatttgaagcctcaaaatatactggttgaccctcttacacaccaggttaagatatgtgattttggaagtgcaaaagtgctggcagttttggtttttgatattgctttgtttagggccttttgggtaatccatccattgttgtgtgttttggaggtcaaaggtgaagctaatatatcacatatatgttcacttttctaccgggcaccagaacttatgtttggtgccactgagtatactacttcaattgatatttggtcagctggctgtgtccttgctgagctgcttttgggccagcccttatttcctggcgaaaatgcactggaccagcttgttgagattatcaaggttcttggcacacctgctcaggaggaagtttcttgtacgaatccaacctacaatgatttcaagtttccacagctagaagcatgtgcacacccattctttgatgaactccgtgaacccaatgctcacttgccagatggtcgtccatttccccctctattcaactttaaacaagagttatctggagcatctccagagctcattgacaagttgatacctgaccatgtgaagcggcagatagggatacaacatgcccatttgactggatttctggaacatgatgttaagctcagcaaagaccaagacttgggttctggattgctgcagttgatccatcactccagccagcatctatatagcacgggtactccaaaattagagccatacacgtaccggatgagacacaggggcgcgccagaggaaccaccgcaacccaaaccttcatttcctcaccagaaaaagaagcgcaagtgtagagccactgccaccgccaccgtcggttccacttccgtttcctctgaaaccagccacaccaatggccccaaccagctcaacactcacattcatgatgttgctgttgcgtgcgagaagagtaaagccattgtcgtcggcgacgattttcgttttggtgagctaaggcaaaacgagagtgggtgggtcgagaacgtgtggctcgagaggagtgaacaatgtctcttgagaggaaagaccgagagcgagga

SEQ ID NO: 93422 - DNA, 159 bp, Glycine max
  Peptide Sequence Number=SeqID_210200
atgtcggttgaaaaatatcagtcagggctatttaaggaccgatgtcaggaaatgttcgatcggcgtcatccggtgattctttttattttagacatcgatcggtcatctttcctggccgacgtcaactatcatttgttttttatcaatatcggtgaataa

SEQ ID NO: 93423 - DNA, 2499 bp, Glycine max
  Peptide Sequence Number=SeqID_210201
atgcagaaagctggaaagaagataattactgatacaggaggaagtgccaggatgatttcttggaacattaggggactaaataaggttggtaagacgatagagatcagttcccgtctcaagagtctcaaccccactattattgttcttcttgaaactcgagtaagaaagaataaagctcttactgttagaaataaactcaatctgaatatgaagtatctggataactatgataagcatgaaaatgggagaatctggtttatttgggatgatagcaaagttatgatcaagcacatttgtagtacttctcagctgattcactgtggtgtctataatcccaatggtgatttcttgcattggtgcacggctatttatgctcttaatcacttagatgatagaaggaagctttggaaagatatcgaagatctcagagttcagcaggctgatccttggtgtcttttgggcgatttcaacaatgttctaaaggctgaagatagaattggtggcagagatgtaactgagtctgaatatgttgatttgagagagatgatgtctagagttggtttgtatgaaatggatacttgtggagatttctttacttggaccaataaacaagctgataataccatatactctaggattgatagatttttgggtaatctcaattggctgcaaatgcatattgattccactttacaaattttgactcctagtatttcagaccatgcccttatgtttctcagttgtaaagatcaaagtagcaggctcaggggtagatttaagtacagaaacagtctggctaggttgaatggtttccatgatgaagttaagaagaattggaacttgggtgtacatggtaatcctatgtataaactttggactaagctcagtagacttcaatctgttctgaaaaacctcagcagtcctctaaatggcctaagggagaaaattgatgaagctagaagaaacttgcagcaagctcatgaagatctatgcagagatagattcaatgtggataacattaacagggtaaaggacaggacttctgagcttcttcaactcaatgagttggaggacagtgatttgagacaaaaggctaaaattaattggattcgtcagggggatggtaataacagctactttcatgctactatcaaaggtagatataagcataatgctatcagatctctgattaaagaggatgggagctgcataacttctcatgaggatatcgaggaagaagttttaaagttctacagtgctcttttgggttctagtgagagcaatctggctggtctgaacattcctgccattaggaatggcaatactctaaatcaatttcaaagagatatgctcattggccctgtttcgaatgctgagattgatacagctataaaaggtatggatgtgaataaaactccaggaattgatggctatggtgtgggttttttcaaagatgcttggagcatagttggtagtgatgtgagagaagctatcctagactttttccttcgtaataggcttcataaaggtttcaatagttctgtggtggctcttattcccaagcataaggaagctaagatgattaaagattttaggcctatttcttgttgttctactgtttacaagattatttctaaagtgttaactaatagattgagtaaagttattgacactttagtgggaaagaatcaagctgcctttgttccaggtcagcaacttcatgatcatgttctgctggcttttgagcttcttaggggctatgagaggaaacatggtactcctaaatgtatgttgcagattgatattcaaaaggcgtatgatacggtgcattgggatgctttggagcatatcttgagagagcttggttttcctgatcagtttatcaagtggatcatgatcgcagtcagatctgtcacctatgtctttaatatcaatggcaggttcactagaagattagaggctaggagaggaattagacaaggggatcctatctcccccttgctgttcatcctggttatggagtatctcaacagaattctaagccaactggataaaattcctaactttaattatcattctaaatgtgagaagatgaaaataactaatttgtgttttgcggatgaccttctccttttttccaggggtgatatcggttcagtgcagattatgcttgacaagttcaacactttcctccgttctatgggccttcatgtgaatccttcaaagtgcaacatatactgcggatctgttgatattaatgtcaaagagcaattattgttgatttctggttttaaagaaggaaaaatgccctttaggtatcttggtattcctttatccagcaagaaactcaacataaagcattatcaagttcttatagataaaattgttggtcggattactcattggagtgctggtcttctctcttatgctgcaacatttctaggaagtctccaattgcttgggaaaaagtctgcagtccaaagattaatggtggtttga

SEQ ID NO: 93424 - DNA, 495 bp, Glycine max
  Peptide Sequence Number=SeqID_210202
atggatgggtcacgggttgcacaaagcctagactctctctggttctacaccaacatcttgacctgcagagatgagcctgaagcctctttggttgaatctgcacctttaatccaagccaaagagtgtcccaagagggatttgcagaaacccattaccccgttgcaacatgagtctcagaatgtggagaatttgagtccaaggtgtcacaaatttgaagaagtgatgaagaccatggtaccaagtagggaaacaaagaagagagagacgagaaaaagaaggaagtggcacaaattggggctatatgaaaccaatgtggttcatggagggcttgatttgaggtttgattttgatgtgtttgatgtggagtcatgggaatatcagattcagatgcttaacattcagcggcaaactaagatgcctccgtttgataatgatgtggcaatgaaacaacatctcaagtcatgggcttatgcagttgcctgcactgtcagataa

SEQ ID NO: 93425 - DNA, 213 bp, Glycine max
  Peptide Sequence Number=SeqID_210203
atggctgtagacaatgatgaaggtattgctgcgattgtagtggacggaggtgacgatcatggagtgggcattgaatacgtgttagattggatgttgaagtttagacaaaagacaaattggttgtggccgtacgtaaaggatcttgatgtagttgcctattgtggcgtcccatattcgaagggtacaatcattagaggcaaagcaaatatatag

SEQ ID NO: 93426 - DNA, 1128 bp, Glycine max
  Peptide Sequence Number=SeqID_210204
atggctgagaaggatgcgacgaagcttaagctgaagcctcgaagactcaagggtcacgacgacagcacaacctgctgcattgcctcacgtgaacgctctcatctcatcgtcacttccggcgatgatggtcgtgtttgctggtttgacttgcgatgccctgatgagccgagactggttatggatgttagcgtggagccagtttcctccctttgtttcaagtcagggatggaagatatgatttatgtctcctcaggaaaggaaatcaagtgttttgatgtgcgattggctgccgcccaatggaagccattggagaattataattataacaaagaagagataaacaaggttgtatgcaactcaaagtcctcatttcttgctgcagcagatgataatggcgaggtgaagatatgtagcactgtggaattccttccttggagatcctgggaagtcattagtggaggtcttgattcaatgctcatgttgtgggacttctccaaagggcgcccctacaaagtagtggattttgctacatttgatgtgagtagtggcattgctggccggtgtgtcaatcctgcttttgttcatgcaatagctattccagaagtcgacatgctagataaattagacaaaatatgtgctgttgcaaggggagatggagctattgatgtgattaatatagaaacagaaatggctgctacaaaatcaaaaagctcttcaaattcacgaaaaggatcacactcaagatcaaaagatggtagttcatctagcaatacagatgcagatcaaaatggaaaaaagaggttgcatttggattacactttgggtggtcacactgcagctgtttccagcctggcattttcattgtttggggaaagagggaaattcttgatatctggaggaaatgataagttggtgaaggtatggaatttgtcctgttatccagatgctgggttaagtgacgacaacaacaacaatatcctacatttgaacattgaagtacctcgaaaagtcaattggctgtgtaccacctcagctgatacagacaaccttgttgtgtgtgacacatctaaagtagtaaagatcgctctcctgacaggaaatgtgctaatggcccaaggcttagcctag

SEQ ID NO: 93427 - DNA, 1011 bp, Glycine max
  Peptide Sequence Number=SeqID_210205
atgaagaattgtgatgaatggaaacctttcctagtaatgatagcaatagatttttctttaaccatggtgaacattctgcttaagaaagtccttcaagaaggaatgaaccatttggtttttatcacatatcgtctgtcagttgctactatatttttggcccccatcggctactttaaggagagggcatccgtcacacaatacttcttccttctggggatccaatacacctcagctacctttgcttgtgcctttgttaatatggtcccggtgatcacattcattatggcattaccatttggattagaaactgtgaacattaaatgcaaaggtgggaaagcgaagattcttggtacatttgtgtgcataggaggggcattgttgttgacactttacaaaggaaaggccttgtttgatggctctcaccatcaatctgcagtagccatgagatctgcaatggaccaagcttcttctactactagaacaacacagaaatggaccattggtgtaatagctttgattatgggaacccttttttggtctttttggtttattttacagtcaaagatagggaagagatatccttgccagtattctagcacagccatcatgaccttctttggagccatgcaagcagctattcttggtttctccactggcagcagcaacttgtcctcgtgggttctcaaggataagatacaaataatcaccgttctttattcagggatagttgggtcaagtgtgtgctatgtgggcatgtcatggtgcgtaaagaagaggggtccggtctttaccgctgcattcagccctcttgttcagataatgtccggcatgattgatatccccttcttgcacgagcagcttcatcttggaagtgtggtgggatccatgttggtgatgatcgggttgtacattcttctctggggcaaaagcaaagatatgatgcagaataatggcgctactaagttcgctcaagaagttgaagaaaccaaagaacaagagccacaagtataa

SEQ ID NO: 93428 - DNA, 2220 bp, Glycine max
  Peptide Sequence Number=SeqID_210206
atggatataccacttgtggatggctctaatgctaagtttaggcccacagaggctgctgctgctgcaccactttcagtagttattccaatgtcaaaatccaaaattgcaccgtacagaactgtgataatcatgcgactgataatattgggacttttcttccattatcgagtcacaaaccctgttgaaagtgcttttcctctttggttgacttctatcatctgtgagatctggtttgcattttcctgggtgctagatcagttccctaaatggagtcctatcaataggcaaacttttattgacaatctgtctgcaaggtttgaaagagagggtgaacccaatgaacttgctgctgttgatttctttgtcagtacagtggatcctttgaaagagccaccattgatcacagctaatacagtgctttctatccttgcggttgactatccagtggataaagtatcctgttatgtgtcagatgatggtgctgcaatgctcacatttgaatctcttgtggagactgctgactttgcaaggaagtgggtgccattttgcaagaagttttcaattgaaccaagagcacctgagttttacttctctcagaagattgattacctgaaggacaaggtgcaaccttctttcgtgaaggagcctagagcaatgagagactatgaagagtataaagtacgagttaatgccatggtagctaaggctcagaaaacaccagaagaaggatggactatgcaagatggtacaccttggccaggaaataactcacgtgatcaccctggcatgattcaggtttttcttggacacactggagcccgtgacatagaaggaaatgaacttcccaggctggtttatgtttccagagagaaaagaccaggttaccaacatcacaagaaagctggtgctgaaaatgcactggtgagagtgtctgcagttctcacaaatgctcccttcattctcaatcttgattgtgatcattatgttaacaacagcaaggccgttcgggaagcaatgtgttttctcatggatcctgaagttggtagagatgtgtgttatgttcagttcccccagagatttgatggtattgatcgcagtgatcgatatgccaatcgcaacacagttttctttgatgttaacatgaaaggacttgatggcattcaaggaccagtatatgtggggactggatgtgttttcaatagacaagcactttatggctatagccctccttctatgcccagcttaccaagatcttcatgctgttgcttcccctcaaagaagtccaccaatgatgtctcagactttcaaaggaatgcaaagagggaagaacttgaggccgccatttttaatctcaaggaacttgacaattacgatgagcatgagaggtcaatgcttatttcacaaatgagctttgaaaaaacttttggcttgtctactgttttcattgaatctacactaatggagaatggaggagtgcctgaagctgcagatccctcgatgctgatcaaggaggccattcatgtaattagctgtggatatgaagaaaagactttatggggaaaagagattggttggatttatggttccgtcactgaggatatcttatcggggttcaagatgcaatgtcgaggatggaagtcaatttactgcatgcccttgaggcctgcattcaaagggtctgcacctatcaacttgtctgatagattgcaccaagtccttcgatgggcccttggatcaattgaaattttcttaagtaggcactgccccctctggtatggattttctggaggccgtctcaaatggctacaaagaatggcttatataaacaccattgtctaccctttcacatcccttcctctcgttgcttactgttctctgcctgcaatttgcctcctcacaggaaaatttatcataccaacgctttccaacgttgcaagtgttctctttcttggacttttcctctcaattataataaccagtgtgctcgagctgcgatggagtggggttagtatagaagatttgtggcgtaatgagcagttctgggttattggaggtgtttcagcccatctgtttgccgtgttccaaggacttcttaagatgttggctggtgttgacaccaacttcaccgtcactgctaaggctgcagaggacagtgagtttggggaacttagtaaagtggactactctcttgattcctccaacaactcttatcattgttaa

SEQ ID NO: 93429 - DNA, 636 bp, Glycine max
  Peptide Sequence Number=SeqID_210207
atgttggaaaatctccaagttttaaatctctcttccaatggcctcaagggtgagataccctcttccattggagacttgatttccctcaaaaacctctccttggctttcaattcgttctcgggcgatgtccctgattcgttatctgccatacccggtttgcttcacttggatctcagctccaaccagctcaacgggactattcccacgttcatttccgaaatgaggaacctcaaacacttgaacctcgccaacaacctccttcatggggttgtgcctttcaactcaagttttatcgacaagttggaggtgttgaaggtgggtgggaatgggaacttgtgttataaccgttccgttttgtcttccaagtttatcatgaagcttgagattgctccttgtgataagtttgggaggccggtgtctcctccaccttcgaagcgttctaattctgcggatgatggcagtgatggagattatgattatgatgatggtgatggtggtggtggtggtggcagtgtccgtcacatgaaggagcatcatcatgggcccaacaaggtggttcttggtgtggccatagcgctttcttccattgtctttctcgttgttttcctaatactgtgctccaagtgctgtcgctga

SEQ ID NO: 93430 - DNA, 1068 bp, Glycine max
  Peptide Sequence Number=SeqID_210208
gatatgattttgtggactgttatgatagctggatatggcatgcatgggtttggaaaggaagcaatttccacatttgataagattaggattgcaggtattgagcctgaagagtcctccttcacttccatcctttatgcttgcactcattctgaatttctgagagagggatggaaattctttgattccacgagaagcgaatgcaacatcgagcccaagttagaacactatgcgtatatggtggatctccttatccgctctggaaatctatccaggacgtacaagttcattgaaacaatgccaattaaaccagatgctgcaatttggggtgccttgctttctgggtgcaggatacatcatgatgtggagctagcagaaaaagtgccagagcatatttttgagcttgagccagagaagacaaggtattatgttcttctagcgaatgtctatgcaaaggccaaaaagtgggaagaagtgaaaaagttacaaagaaggataagtaagtgtggattgaaaaaggatcaaggctgtagttggatagaggtccaaggaaagtttaataactttgttgctggggatacttcacacccccaggccaaaaggatagactcattgctgagaaaattgagaatgaaaatgaatagggaaggttactctaataagatgaggactgttagagtaaccaagaatctaagagtatgtggggattgtcatgagatggggaagttcatgtccaagacaaccgggagggaaattttgttgcgagattcaaaccggtttcaccatttcaaggatggtttatgttcttgcagaggtttctggacgcattatagattaggatacaaagtcatggccaaaaaagtgtatgtagaagtgatagccatagtgtctgtagaatcagtgattgaggctaccgtttttgtagttacgtcagaggcaactttatgtcctaacttcgtctgtgaagtgatgttattcatggatgacttatctaaacatctatatttggattggaaaaacattgcagcagagatctgtaaatggggttcagatgtaacattttttctctga

SEQ ID NO: 93431 - DNA, 876 bp, Glycine max
  Peptide Sequence Number=SeqID_210209
atgctctgtactcagcgtaagtctttggaagatggaaagagggttcattccattatcacttccgatggcatggcaattgatgaggttttgggggcaaaactagtctttatgtatgtgaattgtggtgatttgattaaagggagacgaatatttgatgggatcctcaatgataaggttttcctctggaatcttttgatgtctgaatatgcaaagattggtaattacagggaaactgtgggtctttttgagaaattgcagaagttgggagttagaggggattcttatacatttacttgtatcttgaagtgttttgctgcattggcaaaggtgatggagtgtaaaagggttcatgggtatgttttaaaactgggttttggttcttataatgctgttgttaactctctaattgcagcttattttaaatgtggtgaagctgagagtgcacgcattttgtttgatgaattgagtgacagagatgttgtttcctggaattccatgattagtggaattcttcatgcttatggagtgaaagttggttttagtggggatgccatgtttaacaacaccttactagacatgtattctaaatgtggtaaattaaatggtgcaaatgaagtttttgtgaagatgggtgaaacaactatagtttcttggacttcaatcatagctgctcatgttcgagaaggtctacatgatgaggctcttagattatttgacaaaatgcaaagcaaaggtcttagcccagatatttatgctgtcacaagcgttgttcatgcttgtgcttgtagcaactccttggataaaggaagggaggtacacaattacattaaaaagaacaacatgggatcaagtttgcctgtctctaatctctcatga

SEQ ID NO: 93432 - DNA, 513 bp, Glycine max
  Peptide Sequence Number=SeqID_210210
atgaaaaatcatattgaggtggtgaatgatgaagcaaatgttgctttgctaatgggttgcagttcccatgagctaatggaagtattatctacccatagaatccaagctagcaaggataccattaccaagacattgaccttggagcgggtaattgatgcaagagatgcattagcaaaatttatctatgcaagcttgtttgattggcttgtaaaacaagttaacaagtcacttgaagtgggtaaatgccgcaatgggagatccatatgtatcctttatatttatgggtttaagtcattccagaagcctttggggctactccctttgttgaacaaggaatcgaatttccccaaggccagtgatccaacacttgcaaacaaacttaaacagcaactgcacgataatccttgctttaaaggggaaagaggcagggcttttagtgtttgtcattatgtagaggagctaatcccacttagtgagaaaaggcttggtcaagctggtgcacaatgcctatga

SEQ ID NO: 93433 - DNA, 666 bp, Glycine max
  Peptide Sequence Number=SeqID_210211
atggctcctgatttctctgcttcattcattctggaaactaacacttccaacactaccatgggagcaatactggtgcaacaaggcaagcctatttctttcttcagccaccctttcaccattctcatgaaccaccggagtttaaaggacctcatgactctggttattcagttcaatgattacaacacttttattcctgctctgttgactgagttccacaccacaccacgttgtggacatcttggtgtggccaagaccattcatcgcatccaagctagcttcatttgggaccacttagagcgtgatgtcaaatccttcatccagaaatgcccaacatgccagcaaatcaagcataaaggggtgcattttggcaccctccctctgcacttcacaacctttaaagacgctactatgtttcttgatatggtctataaacaacatggaaaacccccagcagaggtgacttacaacaaaccctcaccctccatacctgggtatatcctagattcttctcccaatgaagattccaaacactggcatgacaacttcgaggttggccgatgggtgtatgtgaaacttcgtccttaccgccaagtcttggtcttgagttcaatggctaggactctcacccgaagagacttcataggaagcatggaagacagtgtgtga

SEQ ID NO: 93434 - DNA, 310 bp, Glycine max
  Peptide Sequence Number=SeqID_210212
atggtcccagattgtaatgacattgagagcacgataatctacacacatttgccaacaaccgtatttcttcttcaccaaaagcacgggggaagagaaagggctatggacattgatagggctggtggagggggaaagagagatatggtggactatatgtcgaggtgggggaatggtcgtgggggtgaggaagatgggggaaaatttggtaatgaggtcttggatttcgggtatggggtgaggcagttctgggcacgggtttgggttgttagtgggttggagggcaaaatggaagagggaggacgtggaggac

SEQ ID NO: 93435 - DNA, 228 bp, Glycine max
  Peptide Sequence Number=SeqID_210213
atgttgaccaatgatgcttttcaggagacatcggtgttgtggaactccaagatgttctatatgattcttgatggaagaataagttatgaggaatttgccgcgatgatgaaggcaggcacagattggaggaaagcatcaaggcagtattcaagagagaggttctctagcctaagtcagaaattgatcaaggacgggtctttgaaactaaacaatgatgacggtagatga

SEQ ID NO: 93436 - DNA, 129 bp, Glycine max
  Peptide Sequence Number=SeqID_210214
atggctttggaacaagaaaaaattggattggtatgccctcaggattcaattggccagttggagtttggtaccacatgccaaagcaatagtaaataccatgccctcttaagagtgaaagcaagacattga

SEQ ID NO: 93437 - DNA, 810 bp, Glycine max
  Peptide Sequence Number=SeqID_210215
atggagatagagctagccactaccaatgaaaagggtgttaccgactatggtgatactgtttcagaaaataataataatactaataataataggagagggatgtatctcgtgtgggaagatttaactgttgtagttccaaattttgggaatggacacacaagaagattgcttgatgggttgagtggatatgctgaacctaacagaatcatggctatcatgggtccttctggctctggaaaatctactcttcttgatgctttagcaggtagactctctagaaacgttatcatgtctggaaatgtgcttttaaatggaaagaagaggagattagactatggagttgtagcttatgtgactcaagaagacataatgttgggaacactaacagtgagagagacaatatcttactcagctaatctaaggcttccatcaaccatgaccaaagaagaggttaatgatatcatagagggaacaattatggagatgggtcttcaagactgtgctgatcggctagtagggaattggcacttgagaggcataagcggtggagaaaagaaaaggctaagcatagcacttgaaatcctcacaaggccaagcctcttgttccttgatgaacccaccagtggtctagatagtgcttcagcatattttgttgcccaaactttgagaaatttaggtcatgatggcaagagtactgttatctcttctatacatcaaccaagtagtgaggtttttgcactctttgacgatctctttcttctttctggcggtcaaacaatttattttggaccagcccaaaaggcagttgag

SEQ ID NO: 93438 - DNA, 1335 bp, Glycine max
  Peptide Sequence Number=SeqID_210216
atgactcttcctccatccttatcggagccaccctcactttccgattcattctcaccgttaaacccaaccctagccatggatagtctccaagccacttacaaagacgaagaagaagatgacgaagacgacccacagccgcaaccaccaccaaccaccgacgccgattcactggaagcccctcccgccaccaccagcaccccatccgacaccccaaccgaacccccgaacgacgcccgatcggagcccgacccctctgacgacctctccgaagatgaggccgcctccgacggctccaagaagtccccgaaatccggccgcgaagaaggcgacggctccgacgaggacccgccgccgaagaagcagaagcagctctcctctctcacggcggatacaaaggaggaggatggaaccaacaatgcggcggcgaccgctacgccggcaacgaacggctcggcaccgaagaaatcgaagaagaagagcaacaacgtgtgggcgacgaagtcgacgcggaaggggaagaagaagacaaatcgcaacaacaacaacaacaacagcaacaacaacaacaaccaccaccaccacgcgaacggcgaggacaacgtgcttataacgccggtgccgcggttcccggacaagagcgacgacacggaggagatgaagatatgcctctcaaaggtgtacaaagcggagaaggtggaattgagcgaggacagaatgagcgcggggagcaccaagggttacagaatggtgagggccacgcgcggggtggtggaaggcgcgtggtacttcgagattagggttgtgaagttgggggagagtgggcacacgcgccttgggtgggtcgaccgagaaggggatattgatgggagtaagattcatgaggcgctaagggagaagtatggagaggaagggtacaaggaaggggatgttattggtttctatatcaatttgcctgatggggaacagtatgcccccaaatcatctcaattggtttggtataagggccagagatatgtttatgcacaagattctacgcaagatccacccaaactagtgcctggaagtgagatatcattctttaaaaatggcatatgccaaggtgtagcttttaaggatctccaaggtggtcgttactatcctgctgcttcaatgtttactctccccaatgaaccaaactgcacggtcaagttcaactttggtcccgactttgaatgttttcctgaggatttcaatgaacggccaattcccaggccaatgagtgaagttccttatcttggttttgacaataaagttgaaaatgaagagtctaatgagaagaaatcccagaaagagtga

SEQ ID NO: 93439 - DNA, 483 bp, Glycine max
  Peptide Sequence Number=SeqID_210217
atgaagaaggaaaacacttgttctgatgaggaggatgctcaaaacaaggatgagaagaagaaaagtttaaaggttagggctagtagaagccttcagtccaagtttgaggaggtaaaggaaacctcagaaaggaaggcaaaagagaaggaagtttcctatccttttgttgaaatatttatctcagagaaagtgatctctaaacatattgagaagtcttctacggaagaaaagagcataagccttatgaagaccattataaggatgctcataatgagaaatacaaggaagtgccccctcagaaaatggaaaaagaatataaggaggatctttctaaggaagagaaggatcattactaatgtgttggccaagctgaggacggctgattccagagtggagaaagaaagcattgagaagagagaagacaagcaagaagagccttctaagaaggcaaaaaaggttgaagttgctgctaaaactatttag

SEQ ID NO: 93440 - DNA, 420 bp, Glycine max
  Peptide Sequence Number=SeqID_210218
atgaatatctaccagtcattcatatgttcatgcaatcatgcttttaaaacaaaggacaaccaaagtccaaatatatccactgcttcacagggcagagtttcacatatctcttgttgtctgtcttccgttacgcaacagggaaatacaagtatgccatgttcacagggtgagaatggttttgtcagttccttttctctcttccctgagaaggtggtgcaagagcttcttcaatctccagtccaggggtcggatgaccatcttattgagttctctgaagctttaagaactgttgcgaaggctctcaggctagttgctgaagggaaagcttctgctcaagctgaggctactgaatggaaacgtaaatatgagttggagagggatcggaatctgaagtttgaacatgcaggttctaataattga

SEQ ID NO: 93441 - DNA, 171 bp, Glycine max
  Peptide Sequence Number=SeqID_210219
atggatacactcattagtcatttatctggtgtgggagcagaaccagtgaagagaaggctctacatcaaagggatcccaattcattcttcatcttcctcttcttcactatcttttatggctcctaacaagctcaattcctcagtaattatattcccatcttccatattttga

SEQ ID NO: 93442 - DNA, 768 bp, Glycine max
  Peptide Sequence Number=SeqID_210220
atggatcaggcaaaaagcaaaggcagtggtgagattttggatcatgtcgatgaaagggtggatgaggattttaaccaattggttgaaggaaatgcaattgatgcaggaggtggacatagcttgggtgaaggagttaatgtaagtggggaagatgggacttcagaagagatgtgcaatgatcttcgattgaatagggagctaaaggaggggtctcaagaagttaatgatcagaacatgggtgacccacaagaaattaatgatacattgcatggggttgatcaaggaactagttatagttcaagaaatttggttagttgggaagtacccgagacttgtgttgtagtagatccttctactcagattgagtgtgtcaatggagataataggaaattggaagcaaaacctaatgaatcagggttgaacaaggtgtccatgaaagtcacaaatggggtgtctgagacagataaaaattcatgtgtgattgatataaactgtcacagctgtgatgggtttagtgagaatttggaaggtgaaatgatttgtaggatttgccatctggcctctgggcaaccattggaagcagcagatgttggcactgcaagtagtgctactactaatacagatttgattcagctcggttgtgcatgtaaagatgagctagggattgtgcatagtcattgtgcagaggcatggttcaagcttaaaggaaacaggacccttaagaatttgaaagctgttggatgggggtgggggaagctctaccagtaa

SEQ ID NO: 93443 - DNA, 753 bp, Glycine max
  Peptide Sequence Number=SeqID_210221
atggcactgtcctatggggtctcttggctttatgacccctttctgtatcctccaacatgtgttcatgcatattatcttttttattataatatctgtttccatttctacttggaagctgaacttaaccatccttcagatagggaacaatacaaagaatgccttgaatcaattttaaagggacccattagtatcacattacggcatcgtttgcaatgtcatgttatacgagatgcagctaaaaatgaatatgaaactgaagaacctatccttgttctaaatgaggttacaattgaccgtggaatatcttctttcctcaccaatttagaatgttactgtgacaattcctttgtcacgtgtgtgcaaggggatggattaatcttatctactacatctggcagtacagcatattctttagcagctggaggatcaatggtccatccacaggttccaggtattttattcactccaatttgcccacattcgctatcttttaggccattgatatttccagagcatgtgactttgagggtgcaagtaccattcaacagcagaagccctgcatgggcatcatttgatggcaaggacaggaagcagttagcacctggagatgcactagtgtgcagcatggctccatggcctgttcctacggcttgtttggatgattctactaatgacttcttgcgcagtattcatgagggcctacattggaatttgagaaagacacaatcatttgatggcccccgggaaacatga

SEQ ID NO: 93444 - DNA, 105 bp, Glycine max
  Peptide Sequence Number=SeqID_210222
atggcagattcgcagtatacctcagatgaggaacattctcattcaatggatgtaacaataacacttggccatattttttacaaaggcgctgttgaaagttttcat

SEQ ID NO: 93445 - DNA, 285 bp, Glycine max
  Peptide Sequence Number=SeqID_210223
atggcttccatcatcgtggtcatttgctctttcatggcctctgtcgcaacctacccttcagcgaaggtgcgaaaaggccaaatctataggccgaagcgtttgtctccaagggagaaaatgagtagagtcgccaccaacatttatttgaggaaaacactagaaaaaccaaaaagacgaaggtctgtggattttaaaaacgagggttcaggagttgtttatgcacatggaagggtgcccttgctcctacatatcctcaggtgctatgaggaattcagacctacatag

SEQ ID NO: 93446 - DNA, 906 bp, Glycine max
  Peptide Sequence Number=SeqID_210224
atgggtgaaactgaaaagatgcaaaagcagataaaggccaacttggaggccatgaaagatcaaatggccacaatgattgtagccatgatgagcatgaagaagataatggaggtcaatacggctgtagtcgccgctaccagtgtcgttgctaaggtggacctgactcctacatttggcctcaaccaaataaatcatgtcatctcggatatggtagggcagagaggcatagaattaggaagtacgggcggcccccattttgtgcatgttcaaaacaagcattctttcccaccatatggcttggctcccaaccatacaccgcctaatgttgcacacactcccaatgaagatgtcgacaactctacacccatacccattgagagccaacaaccccaagttgatcatgcacatgtctctcaatccacgggggagacacatgaaatatcccaccataatctaaccgacttcgagcctcgcctcggatatgccactaaagggcaagcagtcggtggtgtgcccctgcccaacactttggagggccctcagtttcttctacaaccacaaccacaacccttgcattttacgatgggaagaatccttcttgctatggcggagaaggtaaagttggataatatagaggaaaggcttggagccattaaaggggatggaagttatgcttttgctgacatggcggaattatgcttagtgcctgacatcgctatccctccaaagttcaaggtgcccgacttcaataagtacaaggggactactttccctaagaaccacctgaaggtgtactgcaagaaaatgagagcatacacaaaagatgaaaagctgttgatgcatttcttccagggaagacttactggggcaactgtcacctggtacactaatctggaaccttcctaa

SEQ ID NO: 93447 - DNA, 333 bp, Glycine max
  Peptide Sequence Number=SeqID_210225
atggcggaagatatagctagcttggaagagaagcaattccttgctgaatctgtgtttgcttttcatcatttaggcttctctcacaagcctttctttgcaaatactacttactacccacacccacacactttctctcctttggctaaaatacaaatgcccaaggctggcaaaattataatactgtttcttaattgcacagtgcacgctaattttgtcattctttcttgctttggactttcaattaagcagcttcgtcttaaacggttctccgatcctacctggactccaaggctccaagtgtacgttttaggtgctgacaatcttgatggttaa

SEQ ID NO: 93448 - DNA, 360 bp, Glycine max
  Peptide Sequence Number=SeqID_210226
atggatggatttctggatgatcagttcaatcagcttcagaaactgcaagatgagagtagtccatattttgtgatggaggttaaagggaatgttaattatctgtatgacctatgtagagaacaaaaacctgtggatttcaaaagtgtagattctaatgtccatcagttcaaaggaagcagtgccagtgttggtgttgcgagagttaaagatgtctgcactaacttcagaaatatttgcgaggctcagaacctggaagggcgagttgtgcaaagtgaaaactcattttctattacattctctcctctccccttcttgaacatgcactttattgccttaaaatgtgtatatcgtatcctgtga

SEQ ID NO: 93449 - DNA, 321 bp, Glycine max
  Peptide Sequence Number=SeqID_210227
atgttgaaaccaataccaaccatgtttaccattcacgggttatggcctcaaaataatttgcctaaacccccacccatatcgatctattcctcctgccttgagatctcaaccctcaatggaattaatggctcatttttttggcacttgatgattatcggttttggaagtatgagtgaagcaaacatggaacgtgttcatcaaaacaagttccagcaaaatgcttatctcaacctaaaactgacatacaagagaaagattgatctagatctagtggccatccttgcaagagcgtatattgtcccgcataccataatgacttga

SEQ ID NO: 93450 - DNA, 1176 bp, Glycine max
  Peptide Sequence Number=SeqID_210228
atggacgacgtcgctttttactctctgcttttcctgtgcttctttcaatcggtgcgagggattttggaccccaacgatttcctcgctctgcaatcaattcggaaatcccttcacgatgttcccggttccaattttttctcctcctgggacttcaccgccgacccctgcaacttcgccggcgttttctgcgccgacgacaaagtcatcgcgctcaacctcggcgatcctagagccggttctcccggtctcaccggaaaacttgacccttccatttccaaactctccgctctcgcagacttcaccgtcgttccgggaagaatctacggtcctctccctcagtctctctctcagttaaaaaacctccgcttcctcggcctcagccgcaacttcatctccggccagattccttcaggtttaggtcagctccggaatctcagaacaatcgatctcagctacaaccaactcactggaacaatccctccctccatcggagcaatgccggagctaacaaacttattcctctgccacaaccgtctctccggttctgttccctcgttcgcttcctcttattccctaacccggctcgaactcaaacacaacactctctccggttcgttcgcagaggattctctccctccttccctacagtacctctctttatcatggaaccggtttactggaccggtggaccggctattaacccggctcaaccggctcaacttcctggaccttagtttaaaccagttcacaggcccaatcccggcccaactattcacattccctctcacaaacctccaactcgaaagaaaccagttctcgggtccaatccaaccggttaatgaggtgacgatccagaccgtcgatctcagctacaaccggttatccggtgaggtgtcgcccatgctagcaagcgtgcagaacctgtacctgaacaacaacggcttcacagggcaggttccgggtagcttcgtggagcggttactggcggcgggcattcagatattgtatttgcagcacaattttttgaccggaatcgcgataagcccgacggcggagattccggtgagcagcaccctgtgtttgcagtataactgcatggtgccgccggttcagacggcgtgccccttcaacgccggcaaaaggaaaataagaccagcgcagcagtgcaaccgctaa

SEQ ID NO: 93451 - DNA, 1437 bp, Glycine max
  Peptide Sequence Number=SeqID_210229
atggattctcaaaccccaaaaccactccctcttgggccacggcgcttatctcatcatcgcaatctcaattccgtgccatacgcatgctctgacctcattcccttgttcactgccaagtcttgctcttcagccaaagaggatctcatcaacaaggcctccattctgaagaacgagctcatacgagaatccagcgactctgctagggttctgagcattttggacgataattccgacactttgattcagcgtcaccccgatggatctgtgttgctcaggcttatgaatcaattgaattcaaatccttcccttgccctccaggtgtttagttggagaagaaagagatcaaatgttgaaaaccctatggatgcgtatgagtactcaaagggtataaaagctgcaggtagatctgggaatgttgatttagctgttaagctctttaaggaggctgctgtcaaaggtatcaagacgaccagcacttacaatgcgcttatgggtgcttgtatgtccaatggtcttgctgataactgccagtccttgttttgtgatttgaagagggatccgacttgtgatccttctattgccacgtacaatattcttctatctgtttttggtcgcttgatgctggttgatcacatggaagcaacatttagggagatacaaaagttaaccttcaccatgaacatctgcacttacaatcacatgattgctggatatatcacggcttggatgtgggatgatatggaaaatgtgtttcaaatgttgaagaggagccccgttgagcctaacatgaaaacctacatgctaatgcttcgtgggtatgcaaattcaggtaatctggaaaagatggaagagatatattcctttataacggatcgtgttgatataaaggaaatttcattaatcagatgtatgatatgtgcctattctagaagttctgatgcagatagacttaagaagatagaattattgttgaagtttattccaggaaaagagtacaggccatggttaaatgttttattgattaaactctatgccaaggaagactggttagagaaaatggagaatgctataaatgaggcatttgagcatgggacttctataacaaccaagggtattttgagatgcatagttgcaacttattatcgatacaatgcagtagaaaagctagaaaattttgtgagacgtgctgaaatctctgggtggagtatctgccgatccgcatatcattgtaagctagtcatgtatgggtcacagctgcccttaatgcataatgtccttgaggagatggaaatggtcaaccttgaatgcacaaagaaaacattatggataatgtacaaagcttacatgagaaatggccagagttccatggttttaaaaacattgggacaaatgttcaagcatggttatgaagttcctttgagtgcatttccatcatga

SEQ ID NO: 93452 - DNA, 2283 bp, Glycine max
  Peptide Sequence Number=SeqID_210230
atgaagacaggaaaggggaagaacaacggcttgttgccgaattcgttgaggattgtctctctatgcctcaaaactgtgtcaacgaatgccaccaccgttgcttccaccgtgcgctccgccggcgcctccctcgcagcttctatttcctcgtcttcggaggatcacaaagatcaggtaacctgggctggttttgatacactggagcttgattcatctaacctcaaacgtgttcttttacttggttatctgaatggatttcaagttcttgatgttgaggatgcctctggcttcagtgaactggtctcaaagcgcgatggtccagtttcttttttacagatgcagcccttggctgtaggttgtgatggtcaggagggattcagaaagtcacaccctttactgttggctgtttgtggggatgacactagcaaggtaaaccacaaaagtaccagtttgagtggtgtaggaagggatggtaatgttgaaacccaaacgaggaacaatgtcaattcttcaaccgttgttcagttttactccttgaagtctcactcttatgttcatgttctgaggttccgttcaactgtgtgtatgatcagatgcagttcaaggatagtagcggttggtcttgcaacacaaatacactgctttgatgcttcgactcttgagaataagttaagtgttctcacttatcctgttactcagttagctggacaaggaacaactggtgttaatgttggttatggtccaatggctctgggtcgaaggtggttggcatatgcttctaacagccccctgccctctaatttaggttgcttaagcccacaaaacttcagtgcttctccgggaattagtccatcaacttctccaagcagtggtagtttagtggctcggtatgcaatggagtctagtagacatttagctgccggaataatcaaatactgtcaagagctgcttcctgatggttcctcttctcccgtgtcatcaaattcaggtgtgaaagtcgatagggttacaggaattgatgcagataatgcgggaatggtagttgtccaggattttgtttctagaagtatcatatcacaattcaaagctcacactagtcctatatctgcactatgttttgaccctagtgggacccttctggtcactgcatcagtatatgggaataacattaatatatttcggataatgccatcattcacatgcaagagttcagccactccaagctccaactggaactcttctcatgtgcatctttataaacttcatcgcggaataacaccagctatgattcaggacatttgtttcagtaattttagtcagtggattgcaattgtctcatccaagggtacttgtcatctttttgttttgtcaccctttgggggtgatactggctttcaaattattagttctcagggtgaagaaccgtccctactccctgttgtttctctgccttggtggtatactccggcttccattccttaccagccatctttgcctcctccagcacctgctgttctttctgtggctagccggataaaatatagtagttttggatggcttaatactgttcacaactcttctacaaatgtgactgaaaaagtttttgtgccatctggtgccattgctgccatctttcacaattccttgtctcactcgcaacagcctgttaactcaaaggcaaaacccttagaacatatattggtatatacaccttcaggtcatgtagttcaacatgaacttctgccatctgttggtttaggaacaactgatagtggtttgagaaaccagtcaacttcagtcttgcatatgcaggaggatgagttcagagtcaaagttgaacctattcaatggtgggatgtatgtagaaggtcagaatggccagaaagaggggattcttgctgcagtacctttgatagacaaggaggtattgagggagttcaagagaaaataagttatagtgacttccatggattggattttgtgggctcaagagatgaggcaggggaaaagatggtaaaatcgtccagtgagaatatgcaagacaggttccattggtatctgtctaatgcggaggtgcaagggaattttggaaggttacccatatggcaaaagtctaagatttgtttctattcaatgagttgtgcaggagctagtttcagtggtactggggagtttgaaattgaaaaggtccctgctaatgaagttgaaataaggcgaaaggagctgcttcctgtttttgaccattttcatagcatcagatcaagctggaatgagaggtggtga

SEQ ID NO: 93453 - DNA, 528 bp, Glycine max
  Peptide Sequence Number=SeqID_210231
atgtacaattatcatgagaaaggaagagctcctgatcttgaaagtgtattggcagacttcatgacatatcaagctagctctaaagattatcaatgggagtcagaatggcaaccttattatcacaatgaagcagaaggggtgtctaatctggatgacctgttaatgcaattcaagggtacagtagattcaatgcaacaagcatttaaaagagctgagactcagattggtcagttggtggacaacatgattaaagttgtggtcagaatagaagaagagtatgcaaagattgaaacacatcaagaaagcattcttcaagttaacacaatacatcatcaattgatcaccaaagaagaaaaggatgaagtctccattattccagaatatccatgcatagcaactactggatatgttgtaggcaaagataaaggtcgattggaactcagtgtagaggatcagaaaatctcctttgacctctttgaagcaatgaagcacccagatataagtgatgcctgttttgaagaagaagag

SEQ ID NO: 93454 - DNA, 222 bp, Glycine max
  Peptide Sequence Number=SeqID_210232
atggcgatcaaagaagatgtggagggtggcacacagaacggaatcagagagccagccactttttgtggttcttatgaatttggggctagtatatttcctgtcaatattaaagggctggcaggaagtgtggccacattaacgaactggtttgttgcatggttatgctcccatactttcaacttcctcatgagctggtaccttcatcttttatgcagcaattaa

SEQ ID NO: 93455 - DNA, 1419 bp, Glycine max
  Peptide Sequence Number=SeqID_210233
atgttatcctacttaaccggaacaaccgtaggtaacgtcaccgattgcagagcctatactcaaatctacgccgcttctctttctgatcaatacggagcctctgatcctggaacagctaagtgcctcttcggtctcgatttttcctcctccggctccggtggtaagcgacgaaaaatccttattgcggtcgtttccgttttctgtgtgttggctttggctgtgtttgctgggctttgggcttacttgagattcaagaagaggaaggaggttgctggaacaactgagctgggtttgggttctgggttggattcaatgaaccagagcaccactttgattaggttcacttttgatgacattaaaaaggctaccaggaacttctccagggataacataatcggaagtggtggttacgggaatgtttacaaagggatgttattggatggtagccaagttgcttttaaaaggtttaagaattgttctgttgctggggatgctagcttcactcatgaagttgaggttattgcgagtgtgaggcatgtgaatcttgttaccttgagaggttattgtactgctaccaccaatttggaaggccaccagaggattattgtcactgatttgatggaaaacgggagtctttatgatcatttattcggttctgctaagaagaatctcagttggccaattcgtcaaaagattgctctggggaccgctagggggttggcttatttgcactacggagctcaaccttccataatccatagggatattaaggctagtaacattcttctggaccaccattttgaagccaaggttgcggatttcgggttggccaagtttaaccccgagggaatgactcatatgagtactagagtggctgggactatggggtatgttgctcctgagtatgccttgtatggacaattgacagatagaagtgatgtgttcagctttggggttgtgcttcttgagctcttgagtgggagaaaggcccttcagacggacaatgatggccaacccgctgcactcactgactttgcttggtcgttagttaggaatggtagtgctttggatgttgttgaagatggtgttccagaacctggtccaccagaagttcttgagaagtatgtgttggttgctgtgctgtgttctcatccacagctatatgctaggcctacaatggatcaggttgttaaaatgcttgagacagatgaatctgtgccctcattgatggaaaggccaattccttttattgctgggaggcttgatattgagaaatctgcgctgagtaactcgggtcacctatgcagtccaactggttatcaagcttatacattacaagctcgacgaaaatctaattctaaggaggaagaagaagaagaagaaggaagttcggtggctgagactgttacaacagattga

SEQ ID NO: 93456 - DNA, 1731 bp, Glycine max
  Peptide Sequence Number=SeqID_210234
atgccactctttgtgttcctagccaccatcttcctcactctcccaaccctctccctctctgtcacatcatgtctcctcaacaccaccctcctccgttcaagaccctcctcctccgtcgactccgccacgcgctgtcgttacattctccaaaccattcgtgttctccaatccgattacctccaccgcaccggtttcttcttccctccttctagttcttccttctcgtgctggaacactctccaatcttccatcaaccaatacgacattcgctcctcctgcaacctcccttcctcttccatttccctctcctgcaacaacatcaccaccaaatcccagttcgaaaattctcttccaaactcggctcttaaacccgtgtggagcacttgtaaccaatctcttaagagttccttagcttgttctcaatgcaataaaactttgtccaagttggattcttttctcacggaaccgtccactggggaactcgttgattgcaaggccattgcttctatctatgctgcttccttctccgatccgcaggactccggcaccgccaactgtttgttcaacttcggtttttcctcttcggtttccagtggtaagcgtcgaaacattcctgttgtggttttttctgtgttggccttttttttgttggtctttggtgctttatgggcttactttagattcaagcaaaagcagaagaaaaaagatattggtaaaattgagatgggtttgggttctgggttggattctgggtttgattctttgaaccaaagtaccactttgattaggttcacttttgatgagattaaaaaggctagtaggaatttcgccggtgacaacataattgggaaggggggttatgggaatgtttataaaggggtgctttttgatgggactcgagttgcattgaagagattcaagaattgttctgttgctggggatgctagcttcactcatgaggttgaggtaattgcaagtgttaggcatgtgaaccttgttgccctcagaggttattgcactgccacaactaatttagagggtcaccagaggattattgtcactgatttgatggaaaatgggagtctttgtgatcatttatttggttctgccaagaagaaactcagttggtcaattcgtcaaaagattgctttcgggaccgctagggggttggcttatttgcactatggagctcaaccttccatcatccatagggatattaaatctagtaacatacttctggaccacaattttgaagccaaggttgcggattttggattagcaaagtttaatcctgagggaatgactcatatgagcactagagtggctggaactaagggctatgttgctcctgagtatgccttgtatggacagttgacagagagaagtgatgttttcagttttggtgttgtgcttcttgagctcttaagtgggaaaaaggctcttcatgtggacaatgatggccaaccctctgcactcactgactttgcttggtcattggttaggaatggtaaagctttggatgttattgaagatggtatgccagaacttggtccaattgaagttcttgagaagtatgtgttggttgctgtactatgttgtcatccacaattatatgctaggccaacaatggatcaggttgttaaaatgctggagacagaagaattggaacagccaatctcttctattgctgggaggattgatgttgatgagaaatcagtcagtagtaactag

SEQ ID NO: 93457 - DNA, 216 bp, Glycine max
  Peptide Sequence Number=SeqID_210235
atggaaattgctgacatgttccagcggcctcctggaccaattccttcttcaatgctgggtttggagactgttacaggaagtgttgatcactttggttttgaggattgtctaaatgacccccgtgagtcagagactttccggccattagacatgcatcatgggatggaagttcgccttggtctatctaagggaccagtgtacccaagtattatataa

SEQ ID NO: 93458 - DNA, 279 bp, Glycine max
  Peptide Sequence Number=SeqID_210236
atgactaagacaataatgaagattaacagaaaaccagagaaaatgttcaacattgttcatatcaaggatcaaccttatgatgaagtgaataggtcctttgttgtaagattgaaggatcaactaaaacatacttggtatctgctaaacagtaatgaccacatgcaccttgttacatacaatcaagatttggtgaacccaactatactagttggatggacaaaactcaaagatttctatggactcacaggaaatcatcaagtgatcatgacctatttttga

SEQ ID NO: 93459 - DNA, 990 bp, Glycine max
  Peptide Sequence Number=SeqID_210237
atgaaaccgaaattgatcccctactttgattcaagcctttccaaggctgcctccttcattggtcacagaggaagtgttgctgttcgtcaaaggctatttcctccaaggccagaagtgagcaagatcctatggtttctctatgctgagaacattactaccactaaatgtggcttgaaagtcatgactgcctctacataccctttgcaaagtgtgattcttggaactcatgttgagcatcaaatgtactgccaccttctatatggccttaggaatcttgaccttatagatggaattacaaccccttatgccataggcttgattaaagcatttggttttctggagtccaaacataatgcaaccctccgagacaacacggtttgtgatgcttccaacttttgcctacttgagtttcttccatttaacatgaaagaggacaaagatgttagcaagggaactatggactatagcagtgtagaggttgggaagatgtatgaagtggttgttactacttaccgaggatattaccgataccgtatgggcgatatagtgagagttgttggtttctacaactcacctccactagtagagtatgtgatgagagcacctaaaaatcctgccgagattgtgactgagaaggacttgatttcagcagaatcaatgccgaagcagttgaaggtatttgtggaagttcaagaggaatctaatttcctggacgataagctagaggaatcagttaaagttttgagaagttgtatctcttctctctcgagtggcttgggagctatatacaaagtgcagagggataaaggtcaactaaggaacttactgatattcatcataaggcctggagcttttgatcagttatcagaattagccattaagaatggaacatcagctagtcaatataaaccacccaagatcataaggaatcatgaagttgtcaaactcttggaaaaattagcctttgtgacagtattattcgatggctaa

SEQ ID NO: 93460 - DNA, 618 bp, Glycine max
  Peptide Sequence Number=SeqID_210238
atggagagaaaggttctgatattgtgctctgttgtggccttcttggggctgttgtcggctgcaactagcttcggtgcagaagcgacaaggattaaggtttctcaggttcattttgttacaccaaaccagtgcacaaaaaatttgcaaatccctgattccaattggaaggtggcactggcctgctttgttttatcctgccaattagatggttgtcctaatacggtgaaacctaaaaactggtatcaccttggctttacacaaagcagacctgaattgtggagtatatgccattggttcacatttgtaattggttttctcctgttgctgactggcgccgcgctgaatgatcaacgcggtgaagagagtgtgtactttggctactactactgctatgttgtgaaacctggagtgttcgcggggggtgcgattttatcggttgcaagtgctgcatttggaattttgtattacatttctttaactgaaaaaaataatggtatccaatacccatatcctaatcaaggggtcatagccatggcacaaccacaaatcccatctcagactagtcaagaacctgtattcgtgcatgaagacacatacatcagacgacagttcacatga

SEQ ID NO: 93461 - DNA, 1587 bp, Glycine max
  Peptide Sequence Number=SeqID_210239
atgcacagatacacagacttgaatcagaagaatatccgaatggaagaagaagcagattacaggctgattgtgataactgcttcagtagggtttctcctcttgtttctgtatgttttgaaatcgatactactaaagagtaaaaacctgccaccaagcccaccttatgctttgccactcataggtcatctccatctgataaaagaaccccttcacctaagtctccacaaactcacagacaaatatggccccatcatatttctctgccttggcacacgcaaggtcctcgttgtgtcctcaccttcagcagtagaagagtgcttcacaaagaacgatatcacttttgcaaaccgtcctcaaacgcttgcggccaagcatctcaattacaacaaaaccaccataggggttgcttcctatggccactattggcgaaacctacggcgtttaaccaccgtggagctattttctaccactcgccttgccatgctcactagcgttcgagtagaagaggtgcagttgatggtgaagcaactgtttgaagaatgcaaaggacgtcaacaaataatgatagacctcagagcaagacttttagaggtttctttcaatattatgctgaggatgatatctgggaaacgctattatggtaagcatgcgattgcccaagaagggaaggagtttcagattctgatgaaggagtttgtggagcttctaggaagtggaaatttgaatgacttcttccccttactgcagtgggttgattttggaggggttgaaaagaagatggtgaagttgatgaagaagatggatagcttccttcagaagctccttgacgagcactgcacacgcaggaatgtgatgagtgaagaagaaaaggaacgaaggaagagtatgacgctgattgatgtcatgttggacctacaacaaaccgagccagaattctacacccatgaaactgtcaaaggagttattctggcaatgcttgtagctggttctgaaacttcagctactaccatggaatgggctttctcccttctcctcaaccatccaaaaaaaatgaataaggttaaggaagagatagacacttatgtaggtcaagatcaaatgctgaatggattggacactacaaaactgaagtacttgcaaaatgtaattactgagacacttcgcctgtatcctgtggctccactacttctacctcacgagtcctcaaatgattgcaaagtctgtggttttgacatcccgcgaggaacaatgttacttgtgaatctatggaccttgcatagggacgctaacctgtgggtagatccagcaatgtttgttccagaaagatttgagggagaggaagctgatgaagtttacaatatgattccattcggtataggaaggagagcttgcccaggagctgttttggcaaaacgtgtcatgggacatgcattgggaaccttgattcagtgttttgagtgggagagaatcgggcaccaagaaattgacatgacagagggaattgggcttacgatgcctaaactcgaacctttggttgccttatgcagaccacgtcaaagtatgataaaggttctgtcaaatatataa

SEQ ID NO: 93462 - DNA, 138 bp, Glycine max
  Peptide Sequence Number=SeqID_210240
atggaccccactacagctatcaagagtatggaaacggagtcaacattgagaatggcttcagggactacgttggcagtagataaccagattacactgtctgtcaaatcaaatttactcttcggcgacaaggaagggtag

SEQ ID NO: 93463 - DNA, 390 bp, Glycine max
  Peptide Sequence Number=SeqID_210241
atgggaaagccaacaccgaaggttgaagtgatgaaacatctcaagagcagacactacacggatgctaaggacttttcaggggaatgtgagcctgttgtcatgattgccaaaggacaaagtgtccaagggacatgtaagtatggaactagggttgattacatattatcttcctcagattctccatataaattcgttactggatcctacttagtcctttcttccaaagggacttcagatcatcacatagtgaaagttgatgtggtaaaagtaaatagtaatcctcaggaaaatctgacaaagaagcagggacaaccaagacagaaagttgcaagaataaaaccaagtccatcgaaatgtatatggaaaacacacaccggagatatagattga

SEQ ID NO: 93464 - DNA, 324 bp, Glycine max
  Peptide Sequence Number=SeqID_210242
atgactagagttgaactaaatcatgacgatgatttcagtcatgccaaggtagcaccactgcttgccaggtccaacttgctaattacaagagatatcgagtgggcaaatcttgtactaggctttgaacagcctgtaggttttattcgtgaacagagcaacatcattaccagacagttgcttcgtcttaggcggccttttgttgcatacataactgatgccttggggaacaagctctttagggtttgcagacccttttggtggataacaagctcaatttatgcagaaattgatggtaaggaagttggagtagttcacaggcgatga

SEQ ID NO: 93465 - DNA, 2151 bp, Glycine max
  Peptide Sequence Number=SeqID_210243
atggatttccacaccctctcaaggaagcagctccaggccctctgcaagaagaacaagattcccgctaacatcaccaacgttgccatggctgacgctctcgctgctctcaaccaagttgaaggattggatgatttttttaatccaagtgagggtgatgttggaaccccaagtgttaatcaccgtacggttgtcagaacctcaactcaaaggaaagcagcgatagaagaagcagaaggtttgaaggtgaagacctcgacccggcgggttagagttgcagaagaagtagttgagcaggagaacaaggatgccaatgccccaccaatcactcctgctgccagtaggagaagggctactgcggtttctactcgcagaaagaaagaagttgagatggtagaagaagatgctggtgttcaaggaaaccctaaaacacctgctgcagtagctcccgtgagtaggagaagagctactagccgttcagtttgcaccaccaagattgagacccccggtgcccatggtacttcagtgtataacacgaggagatccgttagattgttggagaaggacttgtctaagatgagcttgctcgacactgaagacactactggacttgtcaagattgatggtgatgtttctcaagattcgagtaatgtctctcaccaactagaagaagactcgtctggtaatgaaaagggggatagtttgcagatggaatcaactgtggtttcgggggatactcgggagttggaagtttgctctcttgagaaaaacactgaatatgaatgccaatcacgtgatttagattcagatgtgaaattagtttctgtgacagaaatagatatgctggttgagccacatggtcctaatgaagctggatcggagaaagttaattgcttggagttggaggctgaaccaaatgcttcggatgaagcaggatctgagtccttacctgtacttgaggaatcctatgattcttctgagctggaaactcaaaataattttcctttggaggcatccgaagatgcttttccggaggttactatcggccaagatattgctgctgtgactgttgtggtacctgatgacgtttcagaggatgttactcatcaaaaggttgctgcctcgcttcctatgcaatctgagtgcattgtggatgataaagtcagctacgagggtgatgttaaagaagacaagaacaatgagccacgagaagaggatgaaccatatgattcaaatttgaaactggaaggaagtatcgacacatgtgacaaatctgatgatgcagatgctcctatggaggttgcccaccaagatactgttgtggtggctgatgatgtttttgatcaagatgttgctggcacccttcctatgtcacctgttaatgatgctctaaaggaatttgttgagtgcaacactgatgatgatcaaggcatcaataagggtgatgacaaccaagatatgaacagtgaaactgaaaatttgaatctggctgatggcaacatggcacatgaagattaccagcatccttttaatgatgatgaaaaatctgctgatgaacgtgactctatgacaggttctgaagggggttttgttgagctcgagtcaatttctcattctgctgctatcgaggtctgcactgaatcttcattgccagatgtagaagcagaggagaatacttcggaaaacttggaagctgaagaatctgaggaacctgtagctggagaggatgttatgttggaagctggtgatgcattttctagtcctcgaatccctcttgttcatcagcaggtttcagttgaatctattggaaattacatagtttcctgtcctttagatgttgagctgagttgcaagtccaacacaatggtggatggtgatgttgtttcagaagataatgccattacaaacaaggaggaacctcgtctctctatggattctatcacagaaaattcaatccaggagcagttgaaggtagatgtgcacaacactaaaatgatgaaggaaaacgtgacctctgacgatctaaataataagagtcttggggagctgaagaggatgctgaggcagttaacgctaaatgaaaaaccaaaatccaagactaatgatgtcaaggttaggccgattccgctccccaattaccactgtattttttag

SEQ ID NO: 93466 - DNA, 2274 bp, Glycine max
  Peptide Sequence Number=SeqID_210244
atggattgcggcgttggatccatcgtgtgggtgcgtcggagaaacgggtcgtggtggccgggtcaaatcctcggccacgacgacctctccgccgctcacctcacctcgcctcgatccggaacccccgtcaagctcctcggcagagaagacgccagcgtggattggtacaatttggagaaatctaagcgtgtgaaggcattccggtgtggcgagtttgatgattgtattgaaaaggctgaagccgctcagggagggccgttgaagaaaagagagaagtatgcgcgccgagaagacgccattctccatgctcttgagcttgagaaacagattttgaagaagccagggaagtcaggtgctagatcattgaatgctgttaataaaggtgcggttgcatcgccacaggaaacactgggaaatgattatgaaaaccatgcaaatttgaatgtgtattgtgaaaatgagactggtggaggtacctttgcttccgaggttgccaaggatgggaatcaactgcgtgtggaagtagattattctgaaacgacgactcctcggatgagagacttgcaggattttgggctcagaattgcccccgtgaaaaagaagctgtcatcttctgttgatccatacatttctcagaagcggattgttgacaatggtgctcgggttcttgcaagtggtggtggtattcgtacggggagtgcacttctcatgaatggagctggacaaataggagcttcccgagcaaaaaggagcagatatgggcattttccggctgagtttagtgattctcttgaatacagagagactctaccccgtgttgagatgtcaccttcccaacacagaagggagtttccttatcatggttctttggttcaagatgctgaatatacttttatggatgatgttgaatctgattcttcagaaacagcttctacagattctgattctgattcttctgagacagaggcagacatggatgaagagatgactattttttcagctttctttcacatcatccttcatggctttactcaggatgttcctataactgcagaaactggtcatgatgctgaagaacacgaaagcactagcagtgaggagcttgatgaattaccaatttccagtgacatgcctcacctttatcctcgtgacttaataacatgtagtgatgctgtgtctaaatggcaacttaaagggaaaaggaataatcggaatcttgtaaagaggtccgttggtgcttctgatggaaaatgtattatgtatggagcaggagcagatgttgaaggaaggaatggtcatttaaggcacaatagaaagggtccaagtttgcactgctacaaatttgattttggtgatactttggatgatgatgatcaaatttttggactggaagatgaatattctctaataacttatagatctatatcaaaaagtcaaaataaaattcatcatggtgtagcttggaatgatttggcctgggatgatcatcttgcttcaaaaggacattgggatgtgaaagcatattctccagtatatggtgatcgttgtgattttggtgggagggtgaggccgatgctggttgatgtagatttgaaggttcaagcaagctatcggaaagagcatgtacctttcatttctctaatgagtaaattagatgggagggcaatagtagggcacccaattcaggttgaggctctcaaggacggttcatctgatattctatttcctgcaactgatgacttcggtaatgatgggattgctattgagggaagtagcgtgcttccaccagcatggaggactgcaaggagaaccgcaaattttcgtgtcccacgcccccatgtgccatcatccaatggtgctgaagttgctgcagagcttccctcttcagatcaagaacaaaacttcgaatatagaagtttaaatgctggaagttccagtcaccaggttagccttcaaaagaagagtggccttaaaagtcatcggtcttcagctgacaaagagtcctcaaaaaaggtgccaaagaaatcgggcttgtcatctagccaaaaaactcgaactctgtcctcattatctactgaacataatcttaatagaaaaccattacatgatagcagtagttatcaaacagatagattgactaaaccagaaatctctgggccgaccacagtagcttgcataccagtccagttagtatttagtagattactagagaagattaataggcctccgttgaaaacagctagtaatgcggctttgctgaatactggtgtgtag

SEQ ID NO: 93467 - DNA, 1632 bp, Glycine max
  Peptide Sequence Number=SeqID_210245
atggtccaaaccttttctcttccggctccaatctctcaatggcctcaaggacaaggttttgcttctggccttgtaaaccttggtgaaatacaagtttccaaagtcacaaggtttgagtttatttcgagcagcagtgttatgctagacacaaaaaaagctgttacattctttaggcctgtgggagtaccagaaagtttccatatccttggtcactattgtcaacccagtggcaagcctttgcatggttttgtacttgttgccaaaatttgctctcctcaaaatgctgatacgatacctcctctgaagaatccccttgattttaagctagtttggagtcataatgcagcaagtatggaaattccaggtgtatacttttggctacctgaacctcctgaaggttacaaggcccttggctatttggttactaacaaacatgacaagcctttgttggatgaaatgtgttgtgttcgtgctgacctcaccgataaatgtgaaccttaccgccaaatactcgctgctggttctagaattccagagttttcatttcaggtatggagtttaagaccttgtgaccgtggcatgttagggaaaggtgtttctgttggtacttttttctgcagcaatggctggaccatgggagaagagctactacctgttgcatgcttgaagaacctgaatcctgtgctaccagcaatgccagatttgcaacaaatacatgcacttattaagcattatggccctactgttttttttcatcctcaggaaaaatacttgccatcttctgtggattggtttttcaacaatggagccatgctgcacaaaaagggtgtgtctaaaggagagggaattgatgcaagtggctcaaacttaccaagtggaggaacaaatgatggccagttttggatagacttgccaagtgatcatgatagaaagaattttgtcaaacgtggagacttgaagagttcaaggctttatgttcatgtgaaaccagctcttggtggaacttttactgacattgcaatgtgggtgttttgtcctttcaatggaccagccactctgaaaattggaattaagagcattcctctgagcaaggttggagagcatgttggtgactgggagcattttacacttcgtatatgcaacttcagtggagaactctatagtatatacttttctcagcacagtggtggtgaatgggttgatgcctatgacttggattatattaaaggttacaataaagctactgtttactcatcaaaatgtggacatgcaagttaccctcatccagggacctatatgcaaggttcttcaaaacttgggattggcattaggaatgatgctgctcgcagtaatttgtatgtggattctagtgttcactatgagcttgttgcagctgagtatcttgaaaatgatgtcactgagcctcaatggttgcagtttatgagagagtgggggcccaaaattgtttatgatacaaaaactgagttggataaggtaatcaatgctcttcctcgcatgcttagatattcggtgaggaacttatttaacaagtttccagtggaactttatggtgaggaaggtcccactgggccaaaagagaaaaataattggatacaggatgaaagatggtaa

SEQ ID NO: 93468 - DNA, 948 bp, Glycine max
  Peptide Sequence Number=SeqID_210246
atggagacgcaatcgcatgaagatttacagcaaccgccgccggttacttcaaatgaagctcacagtgatgatgcgtccgaccacagagacgctgagcaaaagcaagatattttgagtactgaagaagttgtgcagattctacaagttgttgcatctacggggaggttctgtccaagacaagggtgtgcgcacttgatggggtttttaactttgagcactttgaggccaaagcactatagtgtggtcacaggcttattaggcctctatagggtgttgagattgcagctgtctcagcagcaaatcacaactggaattgcagccatcctggctgctccagtgaacagcactacagcagccacctctctatatccactgcaccctgcagtgcttcttggggttggttgtgctgcatggcatgactgggataagttgaagagtatgctatcgtttcagctaaagcaggtactgtcagagtatcctgaggcaaaaatgacaagtgagcagcagtatgcatcattgggtgaatcctacattgagttggtcaacaaattggatgaagcactcacttgtttcattgaaggccctccattcacgttgcaaaggctttgtgagatcctattggatgcaaaaggcatttatccaaatctttcaaagcttgctttagctcttgaaaagaacttgttagttacttctacattgacaatctgcactgatccatacccacaagctacagaaaaagagccagatgaccaagagaaggcaagtgaaaagcagcagcagcagcaacaatctgatagtgcacaaaatggcattgagcctttggtgtctgacaatgacgaagtaatgcccgaggctgatgtaggtgatgacatgaccattgacatggaagcttttgaaggcgttaaatcatcagaaataaattccgagcctaatgctaataatgcataa

SEQ ID NO: 93469 - DNA, 557 bp, Glycine max
  Peptide Sequence Number=SeqID_210247
agtggtacctggagatatgtcgcgggggtcaggagaccttggggacgtcaggcgagctcctggcagtcaaccaataaaagaacaaagaccacaaagcaaggaggcttgtgtggtggctggccagctatggatcttgagtgatatctggaatatggcctctggttatcgattaccaaggattgcgatggcagcgcaattaatccatgatcacgtggagatggagtgcctagagggagtttgggagaccctcgaaggcaatgcgaggtgccgattccgtggcacaatccgactcactgctacttcattggtacatccagaggaacccgcacgcacacttcagcgaactgtggagtggatactacctacacctactccatatcaactagtggagccagtccaagtgatagaggagttacctcccgagcctgctgtggatgctcttgactttccagagggtgatgaggacccactccctgatgtggattctccagaggatgtcatgccagcatctgaggcagactctacaaagaagagcggccctggagggacaacgacta

SEQ ID NO: 93470 - DNA, 222 bp, Glycine max
  Peptide Sequence Number=SeqID_210248
atgggccttcctgagggttccaaaagaaggcggtgccttctagtggaagtaaccctgctcgcctcggcgagctgggtgacaaccacctcccttttttctcctataaataggggaaagagggaagagcaaaaatgttcagcccttctggtattgagaaatctctcgaaattaatgagaaaaattgtttccgtgaaaaaaatccaagctgaggtgcttccgtaa

SEQ ID NO: 93471 - DNA, 765 bp, Glycine max
  Peptide Sequence Number=SeqID_210249
atgaataatccattttggaaactgatggaagaaatcatatataacacctaccctattcagagactctatctatctagagaaagaaacacgctccatcagaaccctccactgctctttgtcctccatactctccctcctcaccgacccgggccccccaatgaccgccgcgattcgccgcccgagaagaagactctccacctgaaacctctccggcgagtccgcggccaaattaggctccagagactcaaacacagcagagaagtacttaaacgcagtcttgaagcggttgacaaagccgaaacgtgtgacgcttgcttcgtactcgccaagggtgacaattttggggttcaaagacttggccaacctgagcgcagtgtcaacagcggtgggaggctcgtcgaggaggttatacaactggagcatgaagttaacagccaaggcttcgttagtgtcgtcaatgcagaagctgttgcggtcgagttggtgaatgggagtgagaataggagtgaagtggaagttcaagtcgagaagcttggcgaagtcggagaggcggtgggcggtggcggagagagaggggccgggagaggaaccaagggagagggcggggatgccggagattctgatcttattgggctttccagaaggacgagtggcgaaagcttgcaagagtgcggcccattgaatcccttggacgataccgaagtcgacgatgtggatgttggaggcggtttgggtggcttcaaggatggcttggttggcggttaa

SEQ ID NO: 93472 - DNA, 1704 bp, Glycine max
  Peptide Sequence Number=SeqID_210250
atggtcattcgcgatttattaaacctatgtgaaatcacaaagggaaaagataacaaagctgttattgcaagtaatatcatgtatgttgttgggcagtatccacggtttttaagagctcattggaagttccttaaaactgttgtgaataaattgtttgagtttatgcatgagacacatcctggagttcaggatatggcctgtgacacatttctgaaaatagtccagaagtgcaagcgtaaatttgtaatcacccaggtgggcgaaaacgagccatttgtgtctgagcttctgacaggtcttcccatcactattgcagatcttgaaccccatcagatacattccttctatgaatctgttggtcacatgattcaggcagagtctgatgcacagaagagagatgaatatcttcagcggttgatggagctcccaaatcagaaatggatggaaattattgggcaggcacatcaaaatgttgattttttgaaggatcaggatgtaatccggacagtgcttaatatattgcagacgaatacaagtgttgcaacttctttagggacatatttcttgccccaaatctcattgatctttttggacatgttgaacgtgtacagaatgtacagtgagcttatttcaaaaagtattacagaaggtggaccttttgcatctagaacatcctacgtcaaacttctacgttcggttaagagggagacacttaagctgattgagacattcttggataaggcagaagaccagccacaaattggtaaacaatttgtgccgccaatgatggatcctgttcttggagattatgccaggaatgttcctgatgcaagggaatcagaggttttgtcactttttgcaacaattgtaaacaaatataaagctgcaatgattgaagatgtacctcgcatatttgaagctgtttttcagtgcacacttgagatgattacaagaaattttgaagattacccagagcatcggctcaagttcttctctctactccgtgccatagccactcattgttttcctgcattaatctgcttgtcaagtcagcaactgaagcttgttatggactcaatcatatgggcatttcggcatacagaaaggaatattgctgaaactgggcttaacctgttgttggagatgctgaagaagtttcagggctcagagttctgtaatcagttttaccggacatactttttgacaattgaacaagagatattcgctgtcttgactgacacttttcataaacctgggttcaaattacatgtcttggtgctacagcatttgttctgtttggtacgaaataaaaataataatgagttccacctttttcagctagaaactggtgccctaactgaacctctttgggatgttgctacaagtcaatattcatactcaagtaatgcagtgtttgtacgtgagtttaccataaaacttctaagcacttcatttcccaacatgacatcagccgaggttacccaatttgttaatggactctttgagtccaccaatgatctctccacatttaaaaatcacatacgagattttcttattcagtcaaaagaattttcagctcaggataacaaagatctatatgctgaagaggctgcagctcagagagagagagaacgacaaagaatgctttctattccagggcttattgccccaagcgaattgcaagatgaaatggtggactcatag

SEQ ID NO: 93473 - DNA, 1016 bp, Glycine max
  Peptide Sequence Number=SeqID_210251
ccctgaacgacgcctgcccttactccaagttcgctcacttaaccgccaaccaagccatccttgaagccacccaaaccgcctccaacatccacatcgtcgacttcggtatcgtccaagggattcaatgggccgcactcttgcaagctttcgccactcgtccttctggaaagcccaataagatcagaatctccggcatccccgccctctcccttggttcctctcccggcccctctctctccgccaccgcccaccgcctctccgacttcgccaagcttctcgacttgaacttccacttcactcctattctcactcccattcaccaactcgaccgcaacagcttctgcattgacgacactaacgaagccttggctgttaacttcatgctccagttgtataacctcctcgacgagcctcccaccgctgttgacactgcgctcaggttggccaagtctttgaaccccaaaattgtcacccttggcgagtacgaagcaagcgtcacacgtttcggctttgtcaaccgcttcaagactgcgtttaagtacttctctgctgtgtttgagtctctggagcctaatttggccgcggactcgccggagaggtttcaggtggagagtcttcttctcgggcggcgaatcgcggcggtcattggggggcccgggtcggtgaggagggagagtatggaggacaaagagcagtggagggttctgatggagcgtgctggttttgaatcattctctgttttcgctggtggaatctacaccaccggggtttttgtctctggcttggaaggatgttcctctcttgaccgtctcctcttggcgttagttaatgggttcgacttggttgattgttattggaaagggtttccacctggtccttttttccctgctccttccttgtcttcctggcacagcacagcagagacggggaagatgagtccagagcgtgacaagggagactgccactgctgtttctggacttgtgtgattgcgacaagtcaaggtcgtgacttgtga

SEQ ID NO: 93474 - DNA, 1572 bp, Glycine max
  Peptide Sequence Number=SeqID_210252
atggccgccgagaagctccgagatttgagccagccgattgacgtccccttgctcgacgccactgtcgccgccttctatggcaccggatctaaggaggagagaaatgccgccgatcagattctgcgggagttgcaaaataatcccgatatgtggcttcaagtcatgcatattttgcaaaaaactcaaaatttgaataccaagttcttcgccttacaggttctagaaggtgtaattaagtatagatggaatgcattacctgttgagcagcgagatggaatgaaaaatttcatctctgatgttattgtacagctttctagcaacgatgcttcatttcgagcggaaaggttgtatgtcaacaaactcaacattatattagttcagattttgaagcatgagtggccagcaagatggcgaagctttattcctgaccttgtctcagctgctaaaactagtgaaacaatttgtgagaattgtatggctatattgaaacttttgagtgaagaggtttttgatttttcaagaggagaaatgactcagcagaagataaaagagcttaaacaatcattgaacagtgagtttcaactcatacatgagttatgcttatatgtgttatcggcatcccaaaggactgaactcatacgagctactctatctacattgcatgccttcttatcatggattcccttgggttatatatttgaatcacccctgcttgagacactcctgaaatttttccctgtcccagcatatcggaacctcacattgcaatgtttaactgaggtggcagcccttcaatttgggaattattatgatgtgcagtatgtcaagatgtataacatattcatggtccagttgcagggcatgctcccaccaactacaaatatacctgaggcatatgcacaaggttcaggtgatgaacaagttcacattcgtatcttggaatccactcaagagaatatagctgctttgctattgggccttgaatatcttaccaacatttcttatgtggatgatactgaggttttcaaggtctgtttggactactggaattccttggtatcggagctgtttgaaccacaccgaagtttggacaatcctgcagcttctgcaaccatgatgggacttcaggtaccggcaatgctccctggtatggttgatgggcatggttctcagctccttcagcgccgacagctttatgctggtcccatgtcaaagttgagaatgcttatgatctgtcgaatggctaagcctgaagaggtgctcatagttgaagatgaaaatgggaacattgtccgtgaaaccttgaaggacaatgatgttcttgttcaatataagattatgagggagactcttatttacttgtcacatcttgatcatgatgatactgaaaagcagatgttgaggaaattaagtaaacaactgagtggtgaggattggacatggaacaatttgaatacactctgctgggcaattggttctatatcaggttccatgatggaagaacagggattgagaagttccttgaatgacattaagtatcctattgtcaatttgacttttaatagcggataa

SEQ ID NO: 93475 - DNA, 618 bp, Glycine max
  Peptide Sequence Number=SeqID_210253
atgggtcaagcttttcggaagctcttcgacaccttcttcggcaataccgagatgcgggttgtgatgcttggtctagatgctgctggcaaaacaactatactgtacaagctccacattggagaagttttatctactgttcctacaataggttttaatgtggagaaggttcagtataagaatgttgttttcacggtttgggatgttggagggcaagagaaattaagggcactttggaggcactattttaacaatactgatggtttgatatatgttgttgatagtctggaccgcgaaaggatagggaaagcaaagcaggaatttcagattttgaatagatctatggattacttgcagacaatcataaatgatccatttatgctccacagtatcatcttggtgtttgccaacaaacaggacctgaaaggagcaatgtcaccaagggaaatatgtgaaggattaggtctctttgatctcaagaatagaaagtggcacatacaaggcacttgtgctcttcggggagatggtctttatgagggtttggactggttgtccacaactttgaaggagagacgagctgctggatactcttcaataggactaggaacttcatccttctaa

SEQ ID NO: 93476 - DNA, 510 bp, Glycine max
  Peptide Sequence Number=SeqID_210254
atggaatgtgttgatagcatttgtcgtagtggaaatgcaatcaatgttaagctagtcgctctgtctcccatcggtaattggcactcatggattctcagccaaaaagagaaaagtcgatccttgaagaagaagggtttggatacttacaggtggctggatgagatgtccaagatacgagagaagcaggtagatagccatggcacttatttccgtggccaattcacaatatcattaattcattatcacctccaaattgcccacaccggcgaacacacatattatctcgggttaatgatttggtatcgaatggatggtggtaatcatgccaccagttcctcatttgtgtgcaaatcgactcgcaatgtttcccaaactttcttctttgagttgaagagttcatcaggattagctaccttcataccctgggaatgtaattctttctcctggttgagccgaactgggaggctcaaccaactcaaactggagggagcacagcaatcagatatttag

SEQ ID NO: 93477 - DNA, 297 bp, Glycine max
  Peptide Sequence Number=SeqID_210255
atgggaaactcgcatgctaaaaagcgtgacactcaattttccagaaacgttgttaaagggagagttccctctccaaaagacaaaaccttatcatcattacagtcaccatcatcaccatcacaatcaccatcaccgtcgctagaaccaccgcgagaaccaccaccaccggttatgttttttaatacgggttcgggaaaactatctgccaaagagaaatatgctctaattcctgataacttcactacccttgaacagactttgaagcgtgaattaggctcaaattgcggcgttgactaa

SEQ ID NO: 93478 - DNA, 315 bp, Glycine max
  Peptide Sequence Number=SeqID_210256
atggatttcttctcaagagtgaagaaagttttaaggagagggacatctagtgagagggaaaggtttcctaccaagaatcgtggtggttctatggtgagatgtcttcccttccaggaattgaattactttgtggccaagaccaggtgtggtgaggagatgttgaaagtccaacaggtggttggcaaggaaagtctagccgagggttggcaaggaaagtccatcaaggatgttggaagttgtaaaaattcagtagttggctggtccaacatgttcgtagtatttgtgaaaaatctcatcttgaaaagtaaggactag

SEQ ID NO: 93479 - DNA, 246 bp, Glycine max
  Peptide Sequence Number=SeqID_210257
atgtatttatatctcaagattctaggaagtactaagggtttgggagatggcgtcgagtgtgttgaagagcctcctcctgagattttcctcatcgaggaacacgacgaccaccagaagtttcagcctcgttacccctcaaatcagcaaccacaccgccaagtggatgcaggtttttctggctggcatatcgtggatatccactatataaatttctcttgtgccttatcaacgcctgtctggaattag

SEQ ID NO: 93480 - DNA, 321 bp, Glycine max
  Peptide Sequence Number=SeqID_210258
atgaagaagactcagaaactgaggcaacaagatctttctggaatcttcggtggtcatcctggcaaaggtagtggtgatctgttcggagcattgggtggcccacaacaacgtccgacgtccggcggttgcagatcgacggtggcatggcggtatccaacagttgcaaaggatgagcggtcgaagctcaaatgggaatctcttgtttcactaagctttcccgaaaagcttggagcttggaatccatggaagaagtatcagtcgcatatgcagatggcaggacctaagctcaggcaaaggcaaccaatagtgagaccagcataa

SEQ ID NO: 93481 - DNA, 312 bp, Glycine max
  Peptide Sequence Number=SeqID_210259
atggactgccaatgcatccatgttgttattgaaggaagtgtctcattcaacaataaaagccttcatgctattggaagtaccgctaacccctatgagaaagccatctctattattggcaagactcttgctccctttgatgatgataacttgattccatgttttggctttggggatgcgaccactcatgatcaagaagtgtttagctttcacagtgatcattcaccttgccatggttttgaggaagttttggcttgctatcaaaaagttgttccaaatttgagactgtctggtaattttcatcttagcttatag

SEQ ID NO: 93482 - DNA, 489 bp, Glycine max
  Peptide Sequence Number=SeqID_210260
atgtctgatgataacaccaaagcttggaatcagatattgttgctgacaattgtgcttgcaatttggtggctactgtgtcatttagcagaggatagagaaaccaatcccattgacaatgaggttgatgatgagctgggggagatattagagcaccccaatggtgaactagaccattattttgatgaggatggtcatcaccgggccgctgagcctggtggcgatgccaatgggagacacggtggttgttccatctgtggaaattttagcaccacaaggtgtgctagctgcaaggctgctagatactgtagggggttgcttttaaaaacaatttacggaagagggtctcttttaaaacaaattggggtgccgctattcgtagcagcgagtgaggggatatcgccattggtgctggcgggacgtgccaacgtgaacagtcccgccattggcacctgcgggacactgatttcgctaaaagcatgccgccaataa

SEQ ID NO: 93483 - DNA, 355 bp, Glycine max
  Peptide Sequence Number=SeqID_210261
ctcagcgaaatgccaaattattcattggaggtcggggcataaatatgaatgttctgaatcagagattacagcagatgaagcaagaccaactcatgatcatggaacctccaagcttgtcgagaagtctgaaatggccattcttttaccaaagacgaaccccaacctcacaaatgtgacctattctggcgatgaggtcgtcgtcgatgacagtgcctttgttagccacccttctctaggtgatagatccatcttaggagaaaggtgtaggaactttaagaagagggtgatggggacaatttggaatcgggatgccacttcgaagactggtgtaagcaatttaagaagaaggcgatga

SEQ ID NO: 93484 - DNA, 602 bp, Glycine max
  Peptide Sequence Number=SeqID_210262
atgaaaaattctgcaactgggtctcctacattctccactcagcgaagttgtccttccttgtcaatggttttgagtcgtggtataagcaagctagtgactttgaataagctctctctcaataatggccctagtaattcaatccacccctctaatgccttgtttgtcaatgatgtccttgttttctgcaaggggacctcaggcaacctcaataacttagtcaatctgctcaatcactatggatcaaatttgggtcagattctcaaccttcacaagtgcaagttctactcttcccctctatcatcggccaggctatgtgcaatcaaatccattctcaggttccaacaaggaaactttccttttgactgccttggaatccctttcctccaagtcaagtcggttatctcagggatgcttgcttacaactttaatgtttatcgttggccaaagtgtggaagcaaagcttccaagtttattttgatgatgccaaagactcaagataagaatcaagattcaagcaagtttcaagaatcaaagagtcattcaatcaagattcaagtaaagattcaagagaagactcaagatatgcaagaacttcaagaaaa

SEQ ID NO: 93485 - DNA, 615 bp, Glycine max
  Peptide Sequence Number=SeqID_210263
atgggtgttaagtacctcgaagcggttaagcaaaggttgcaggctatcaaagaatggtccccgaacgaaattagggtggctccaaagaaacttgccatgagagccaagaagaccgctgcaggagaaggatctagcacaactccacctggcaagtatactaagttcacaatagagatcactaggagaaactggagacaacttgcagaaccaatgcccaaatatgaccctgaagttgtcttagaattctatgctaatgcttggcttaatgaggaggggcaacaatgtgaatacacttcatggagaggcaagactataagttttgatgaagaggcaatagaacctcctaggcacccagtggacccaagcaaatccaacaaagcattgggttttcctgctttaatcataggtctctgccaattctatggaatgtcagccacaccagccaaacacattcgatctcccattaatagatcattcattgacaaatattgcatgccaaggaaggaggaggcatgtcctgtagtttcccaagaagtttcccaaggagatggaggaagagcagaggaagataaagacatggtagatcttgttgattattgcattggaggaaactaa

SEQ ID NO: 93486 - DNA, 300 bp, Glycine max
  Peptide Sequence Number=SeqID_210264
atggtgcagatagtgtacacaagtggaaaagagcgatctacggggagtgttggatgccagagatggagtagtggtttctattattgcatggatgctaaagagaaaggaaaaagagagaatcatggagaggatcgattagattacaaggtagggactgcgaagaatgaagttgatcaaaatcaggttgaggactttgaagttactcgtctagagatcggttgcaagataaagactattgaagcgagtcgaacggggaatttatcagctaatttggaaatcgtggagttagtgacaagctag

SEQ ID NO: 93487 - DNA, 1206 bp, Glycine max
  Peptide Sequence Number=SeqID_210265
atggcgaaaacgtacgcagcgggattgttgtctgccatagctgccgccactgcagctgcatctctgaatcagaacaatgcttatgcagatgggattttaccaccgaatccttctgaaattgaaccttccccggcgccgccgccgcctaaggttcgaaacgatcatccaaggaccacttctgctgggttcgatccagaggccctcgagagaggggtcaaggctctcagggaaatttctaaatcaccccatggcaaaaaggtctttgaagttatcaaaaagcaagaggagacaaaacaaactgaactttctgcaaaggttgctgagtttaggcaaatgaaagcacagcatgagactgaaagacaaaggattatatatgatgaacaaaaaaagctagcgcagcatcaggcacaaacaaaatcccaaatggccaaatatgaggatgagttggcgaggaagaggatgcaggcagaaaatgaataccatcgggccaggaaccaagaactagtgaaactgcaagaggaatcatcaatcagacaggagcaagctcgacgtgcaacagaagaacaaattcaagctcaaagaaggcaaactgaaagagagaaggctgagattgaacgcgaaacaatcagagtaagggctatggcagaagcagaaggaagagcacacgaagcaaagctagcagaagatgttaacaggcgaatgttggttgatcgtgctaatgctgaacgagaaaaatgggttgctgccataaatactacttttgaacatatcggagggggattaagagccattctaacagatcaaaataagttggttgtagcagttggtggagtgactgctctggcagcaggggtctacactacaagggaaggtgcacgggtaatttggggatatattgatagaatattgggacaaccatcattgatccgagagtcatccagagggaaatacccatggtctggcatgttttctcgcaccatgagctccctatcacgacatactaatccaggatctgctttgaaaaatggaaatggttttggtgatgtgattttgcatccttctcttcaaaaaagaattcagcagttgtcttctgctacggcaaatacaaaagcacatcaagcgccattcagaaacatgcttttttatggccctcctggaacaggaaagacaatggctgctagggagttagctcgtaaatctgtatga

SEQ ID NO: 93488 - DNA, 306 bp, Glycine max
  Peptide Sequence Number=SeqID_210266
atgccagcgtctgatggagcttcccctagctccatagaggttcaagcagacctagagcagttgtcggtaattcctatgatggcaaaacaatgtagtccaagacctaaggcaacacccatacctgagcttggatctgtgagtctaggtggaccatatcaggagtataatcttgtcaaagatagagatcgttgcaccattaaacatattgttcgatatgggtttgaagaattgactaaactgattgcttttgcacttctcactagcgttggagatccttcttcctttcaagaaactatgaatagctag

SEQ ID NO: 93489 - DNA, 339 bp, Glycine max
  Peptide Sequence Number=SeqID_210267
atgcatcacagttcatgctatcatcaagaagctagcatcaaacacaaggacaagcttccaccaggaccttaccctcttcgatcccatcattggaaatctccatcaactcactcctctgccaagcttgccatgattcgaaaatatgcaacaatcagttattcgcccacaaaacccttgatgcaagccaagatcatcttcgacgtaaaaagtgcaacaagtccggccaacattgttttctcaaaggatttggttcagtcttcgggtaaagtactggaacaattcaaggagctagtggccaatatcgtgaaagagggtggaaaaccaaacttggcagattaa

SEQ ID NO: 93490 - DNA, 987 bp, Glycine max
  Peptide Sequence Number=SeqID_210268
atggagggagagaacccgaacgtgtacctgaaggaagaggacgttgtgctgtgcgtgcttcccttgtttcacatattctccatgcacagtgtcatgatgtgcgcgctcagagcggggagtgccattttgttgatcgaaaagtttgagataagggcgctgctggaggagattgagaggcacagggtcaccgtggcgatggtggtgccgcctctcgtggtggcgctggcgaagaaccccgcggtggaggagtatgatttgagctccatacggttggtcatgtccggggctgcgccgctggggcaccagttggaagaggttctacggaataggttgcccaacgcaattctgggacagggatacgggatgacagaggctggaccggtgttggcgatgtgtttagggtttgcaaagtatccattcccgacaaagacaggctcttgcggaacagtagtcagaaatgctgagttgaaggtcattcaccctcttactgccctttctcttccccctaaccaccctggcgaaatttgcatccgtggccaacagatcatgaaaggttacctgaatgacgagaaggctactgcagcaactattgacgtagatggttggcttcatacaggcgatattggctatgtcgatgatgatgatgagattttcctgattgacagggccaaggagctcatcaaatttaaaggcttccaggtgccaccagcagaacttgaagaccttcttatgagccacccttccattgcagatgcggccgttgtcccgcaaaacgacgatgctgcaggtgaagttccagtggctttcgtggtgggctttgatcttacagaagaggcagtcaaggattttatagcgaaacaggtagtgttttacaaaagactacacaaagtgtattttgttcctgcaattccaaagtctccaaccggaaagatattaagaaaagaactcagagcaaagctcgcgagcattattattcagaggacctag

SEQ ID NO: 93491 - DNA, 921 bp, Glycine max
  Peptide Sequence Number=SeqID_210269
atggactggaaatggcataaagatcactgcattgcaagagtcgtggattcaactccaatagaaagaccttgtagagatgttggattgctcaagaattcatatgaagaggaagagaatattccttcatctggtcccctttctttggtgtttcatccagaaggaaccacaagcttcaattctctagttccagtatcacattcaaagggttctaccaacaatgtgttatatcttgaggacgaagtagccaagtctagtcagaacttaacgagtggaagaatcgagcgaattttgctagagaaaaattccaaagtgatgtgtcctataagaattgagggttgtccaattgcttgtgttgaagaatatgaaaaggaatcaatagcagaggctgaaactagagcttgtaatgtgattcacagtttacatgaaaggctaacccacttgcagaatgtagtgcaagaaaacattgcagagaagagaaagctagaagaagatttacaaaatttagagagtgaatgttctgacttgaagaaacaactgcaagaagagcataaatgtgctcaacgtcttacaattgaatttgacaagcgtcgtgaggctgcacaaattgccatgagagaagttgaagctgtaagacaagtgttacaagaagagcgagaacatactcaacgagttaaggagaattttcgtagagatgttatatttgttgaagccagagctacctttgctgaggaaaaactcagtgatctttataggaaaatcagaatgtcatattataaggtttgttctatatgcctctccaatgaaaaggacttggtctttggttgtggacacatgacttgtagagactgtggatcgaagttatcgaagtgtcctatatgccgtgaacagatcacaaaccatattaagctatttcctgggtga

SEQ ID NO: 93492 - DNA, 1104 bp, Glycine max
  Peptide Sequence Number=SeqID_210270
atgttgaaagaactcccagaggaagagtttggctctggagtagatattagggagtactcaatacttgataatccctccctcccctcagaggtgaagatgtcatggcttgatgttcagctctgtaaggatggaacccaagattgttttgcatcaaataataccactgttgggggagtactcaaatttccaaggcatagcaatgaagaaacgtacatgaaagtatttttatcattcaaggatataaaagtcattcagttctcttcaatgcaagatgctttctcaggtttcagtgacaaggcaaggactactacactcatttcttttgaagaaagggaagatagattcagaaaacgtgttaaacggtacacgggtatatggtgctgcgtgctggatcacactcctggccacatttattacgatatgtactgggatgagaaacctgaatggaagccaatccctcctcaaacttctgcagatgatcatccaccttggataggtgctctagctcccctccccacttcaacatctctactcactgattattccaagggtttgtttgacgagatttacaatagagatgtgcttgattggaatgctattgtttcagtatctcttgaaaataactgctataaaacagcaattgacttaaagaaaatgatcaaggcccaaactgggtttgattccactactctattgcttatggtttcagcttcgtttcatgtgaaaaactttgatcaaggacaggaaattcattgtatgagcataaaatctgggatgcttgtggatatcagtttaggcaatgctcttattgacataggaagtctttacaatagtgttccaaagaaagcattgtattacttcaaaaggaagacttcttctgaagaaacagcagatcatgtcagtctatcttgcgccatttcagcatctacaagtttgggagagctggcttttggtcagtccattcatgggctgggaatcaagctaggctacaagtcacatatttcagttgccaactctctcatttcattatattcacaatgtgaatacctcaaggctgctgaaacagtattcagagaaatagcacttaaagatattgtttcctag

SEQ ID NO: 93493 - DNA, 783 bp, Glycine max
  Peptide Sequence Number=SeqID_210271
atggcgtgggatgggagtatctgtgaatatttgattggcaatcctgtccttattagtcaagttttagaatacaaagaagcttcaatggccaagaaaccaggaccaagatccagtaaattgtcagtgtacctttacattcctaatataattggtggctttgtatgtgatgctgttgatggctggtgtgcccgcaaatttaatcaagcttccttctgttttgtgagaacagcggcaaatttagatgaaaacataaagcatccaccaaatgtggattcatcttgtgctgattgccaagtgtcaacctttggagctgtgctggacatggtaacagacagaattagcactgcttgtctacttgtagtcctttcccaactgtacaagcctggccttagcttcttgtcattgctcgctttagatattgccagccactggctgcaaatgtacagcactttcttgacgggaaagactagtcataaagatgtaaaagacagcagcagctggcttttcagggcatactatggaaataggatgtttatggcttactgctgtgtctcatgtgaggcaagtgttctttacttaatcctgttttatcttgccgagaatcaaacagagaaactggtagacgttatatcaagtaatttacaaaagatatcattcctttctcttctaatgggtactagtttatttggatgggcagtcaagcaaattataaatgttatccagatgaagacagcagcagatgcgtgtgtgctttatgacatcgaaaaagaacacaagaactga

SEQ ID NO: 93494 - DNA, 1368 bp, Glycine max
  Peptide Sequence Number=SeqID_210272
atggcgtgtgaggaagtggctcattcgaggcctctgttcctcacgatctacactattgtcatcgttggcatcgtcttttcctcactctacgtcttctccgccattcgccacccctccgccattccttctacttggtccctttcaaatgaggatgttcgtcttacagaacaaacactcaacggttctcagtcggaaactgtgcatattgtgccttctgttcctcaggaggcacgaaaaatgaggacaaggcctattttgagtgttcctccacgcaataaaaagatgccatctttgaatgcattcagattgaccaaagaattggttcagcaaagggtgaaagataatattataattttgacctttggtaactatgcgtttatggactttattctgacttgggttgaacagttgaatgatctgggagtttctaattatcttgttggtgcaatggatatcaagttattggaggcgctttattggaaagggataccggtttttgacatgggcagccatatgagtacagatgatgttggctggggttctccaacatttcataaaatggggagagaaaaagttcttctgatcaacttgatattgccttttggttatgagctattgatgtgtgacactgacatggtttggttgaagaacccacttccatatcttgctcgttatcccgaagcagatgttttaacatccagtgatcaagttgttccaacagtggttgatgatagtctggaaatttggcaagaagttggtgctgcttacaacataggaattttccattggagacctacagagtctgcgaaaaaattagcaaaggaatggaaggaactgcttctagctgatgataagatatgggatcagaatggttttaatgatattgtacacagacaattaggaccgtcagttgatgaggacagtggacttgtttatgcttatgatggaaatctaaagctgggaattttgccttcgagcatcttctgtagtggacatacatattttgtccaggcaatgtatcagcaactcagattggagccatatgcagtgcacacaacatttcaatatgcaggcactgaaggaaagcgccaccgactgcgagaagccatggttttccgtgatccacctgaatactataatcctcctgggggcttcttgtcatttaagccatctattccaaaaagcttgttgctaagtgggaatcataccattgaatcgcattttagacttgttaattaccaaataaaacagattaggacagcacttgcaattgcttcccttttgaacaggacactggtgagaactattttctgggatcataatgttgaattgcaaatatctcatatcagtaatctcaagcactgttaa

SEQ ID NO: 93495 - DNA, 294 bp, Glycine max
  Peptide Sequence Number=SeqID_210273
atgtcaaagagggaggcttcttccttgttcccttgggatacatttgttatgaagtcaaagaaaatttacagcaatgagcactcaacaaaagggaaaagcataaagaaaaacaaacctcttgttgagagctccttggtgttgaggttttttgtgggttggaaaggggacatcaccgtctctcttcaacaaatatgggcttcgtccaaatctgcgcttcaagagttccaccatcatcccatcattctagatctaagtttcctcgatgacaatgtcattggcaatgaacgggagtaa

SEQ ID NO: 93496 - DNA, 864 bp, Glycine max
  Peptide Sequence Number=SeqID_210274
atgtccattcaagctcagtggtatccaaataataattctgcttctccattctgcaacaatggttattgcgctggtgggcttattgactcccatatcaatttccaagcgaaaaatcattttcaacagcaacaacagctatcagaacagcatttgagagagttatataatgggagtcaaggaattgttgatccaaatcttcatgtttataattcagaagccgtgaattctcctgtgtttgctgttcagcttgagaagcaatgggaagagattgatcagtacatgaaatccgaggatgagaaattgagatatatgataggagagcatgggaaacaacaagtgatagcattgttgaaaaaactggaatctcgttcactcaatgtcttaagggaaaaagatgaagaaattgcgcaagctataaagaaaagggtagagttggaagactatttaaggaagctagaggcagaaaatatgaagtggcaaaaagtggcccaagagaaggaaatcatggcattgtccctctataaaacattggaggaaatgacagaaagtggcaattttttgaacaacggggtggtgccaaatgatgcagtgtccttttgtggcgaaactggggggaaagaagaagagatgggagaagaagcaacatcagagaaagagaaaaaacgtatagaatgttgtggtgagtttgaacagaatacgagaggaagaggagtaatggtttgtaaaagctgtcattctaggagctcgagctttctgtttctcccatgcagacacctttcttgctgcaaagtttgcaacgctttcctcgaggcttgccccgtttgcagaacaccaaagaaggctaccattgagttgagactttga

SEQ ID NO: 93497 - DNA, 573 bp, Glycine max
  Peptide Sequence Number=SeqID_210275
atgggaggtggcaaggacaaacacaatgaagaagagaaaggagttttctcacatctggctcatggagtagctcaagctgctcatggttaccctccaggggcataccctccacctcctggggcataccctccttaccaagggtacccacctgctcatggctaccctccacaaggtggctatcctccggctggttatccccctgctggctatcctcctgctgctggtggttacccccctgctggttaccctccacatggttatcctggatcatctgctccacatgtaacatggttgaaaggatctaacttaagtgatttgtcattaggatctcatgcgcctgggcacggcggtatgggggcattgcttgctggtggtgctgctgcggcagcagctgcgtatggggctcaccatgtttcccatggccaccatggatatggtgcatatggaggatatggacacatgccccatgggaaattcaaacatcatggcaagttcaagcatggaaagttcggcaagcatgggaaatttaagcatgggaagtttggcaagggtatgttcaagaagtggaagtga

SEQ ID NO: 93498 - DNA, 387 bp, Glycine max
  Peptide Sequence Number=SeqID_210276
atgactctttccgatgacgaagacgagaatctagctcaatttctggaatcagaagtcctctcggaggtctctgacaagattagggttttgaaagaaaaggaagaggaaaatgtggaggaaccgaaagcaaagagaaagcgcgtggaggaggatgagattactaagcaaaaacaaagttctgattcatcatctgcgcccaagaacattgttgtcagtaatggggtggtgctgagaaggattgagactggttatttcagtcaaatcccacctgagcttttcaatcatatccttaaatttttgtcctccgaggaccttgtttcttgttccttagtttgtaggtttttgaattatgctgcatcggatgaggcattatggcgtcgcttgtaa

SEQ ID NO: 93499 - DNA, 486 bp, Glycine max
  Peptide Sequence Number=SeqID_210277
atggtatggaatggttctaggattgataattttagtcctactcgtggtttaaggaaaggagaccctcgctctcacttatttgtcatgtgtatggagaaaatctccttttatatccaaaagcttgtcgatgatggtatttggaatcctatcaatgtttctagaggtggtccttgtatttcccacctctttgtagatggcattcgcttattttgcaagtctaatgattctcatataagactaatccgtgatactttggagagacctagatcacaactgtcagagggagagttactaaggaaaccttccgtaatatcattgataaagtccataaccatttgtcatcttggaacattgccatttgtcatctcagaaggctcatctcttgcttctattgatgtttatcctatgcaaagctttctccttcccaaaggtctttttgaggaaattgacaagttttcaaggaactctctatggtcttctagtgag

SEQ ID NO: 93500 - DNA, 351 bp, Glycine max
  Peptide Sequence Number=SeqID_210278
atggtttttaggctggaaacaggagctcctgccagggtgaaaccttttggaattgaagttcgtaatgtaaaatgcttaagatgtgggaactatggtcaccaaagtggtgatcgcgaatgtcccttgaaggatgctataatgcctaatgaggaaagcagattgaaaagagatgatcccttgaatgctatccttgcccacacagaacctactgagaatgctctaaccatgtgggatcgacacaggcttataggagcactcaaatcgagtgtatttaccctcaaggcctacactccgaagagtccgtcagagcttcttcctcctgattcgggtccaatccagaaaacattttag

SEQ ID NO: 93501 - DNA, 1089 bp, Glycine max
  Peptide Sequence Number=SeqID_210279
atgatgcagcccctaaaatgggagctcaagcaaaggccaggaatcagtccccctcgaggagggttcaaaccagatgatccaaaccagcagatagttgctgaggaggacatatttgatgagtatggaggttttcttggtatggataatatccccgagttattaaccaacttttctaaaaaaccgaagaagtccaaaaggagcaagcacaaaaagcagcaacaaataaattcagatggtgaagcatcattggatgatggagagcggaggtctaagaaaaaaaaggttaaggtaaacaaaaagaagcgagatcgtgcaaggtcaagctcatcagaaacttcagtctctgaagaaggtcatggaaagagcagacagaagagttcccattcatcagaagattcggacagttacaggaatgatcgaagtaggactaaacgagagcattccttttcgtccagagtttctgaccgttctaggcatggtctgagtaagcatagcagaagaaagcatgcttattcatctgaagattctgacagtcagagggatgatcaaagtagaaagaatatacaaaagcacaagagcaaagatagcaaaaaaagacattcatattcatatgaggattctggtcctgcctgtgatcatgctgataacaggagcagggatgcactttcttattcatctgacgattctaatcatcaaagacagcccaaggttaagaggagcaaccataagcactcatcaacagcccattgtgattctcaaaagtatgacagaatttatggttttgatcgctaccaaggaaatcagagcagagctgtgcattcttgttcatctgaagattctgatatccacaaggatgatcaaaatagaagaatcaaacaaaagtattgtgatacgcccaagggttctgagtatcctgagagtgatatgaataaacagaacagaaaaaggcagtggtattcatcgaaggattctagtgctgatggatatcatagaagtgaaaaaagtagatatgagcattcttattcatctgattattctgatcatcgtgagaaacatcataagtcaagaaggagcagctacaagcattga

SEQ ID NO: 93502 - DNA, 1983 bp, Glycine max
  Peptide Sequence Number=SeqID_210280
atgccccagaactgcatagcaccaaaaccagaatactgcaatagtactcatcactctgtggaagaaccaccagagatgaccgagccacatgactcaactgttatttcctatcccatgcaaaccaatgaacaacaacaacaaccgttcccaaaactcattatgtaccccataactctgaagtttgaagagttggtgtacaaagttaaactagagcagaaaggagggtgctggggaagtacatggacttgcaaggagaagaccatactgaatggaatcactggtgtggtgtgtccaggagaaatactagccatgttggggccatcaggcagtggcaaaaccacacttcttacagcactcggaggccggctcagtggaaaactatccggtaagatcacgtacaacggccagcctttctcaggtgccatgaagagaagaacaggctttgtggctcaggatgatgtactataccctcacctaaccgtcaccgaaacactagtgttcactgcactcctaaggcttccaaacagcttgtgccgagacgaaaaggttcagcatgttgagagagtgatcactgagctaggactgactcgttgcaggagcagcatgataggaggaccactttttagaggaatatcaggtggagagaaaaagagagtgagcataggccaagaaatgctcatcaacccaagcctcttgctgctggatgagcctacttctggcttggattccaccacagcacaaaggatcctcaacacgatcaaacacctcgccagcggtggcagaactgttgtcacaaccattcaccaaccctctagtaggctctactacatgtttgataaggtggtgttgctctctgaaggctgccccatctattatggtcctgcttcaactgccttggactacttctcatcagttggattttccacatgtgtgactgtcaatccagctgatctcttgcttgatcttgccaacgggattgccccggactccaagcatgcaactgaacaaagtgagggactagaacaggagagaaagcaggtgagagaatctctcatctctgcttatgagaagaatatagctacaaggctgaaatctgaggtttgcagtctggaagctaacaactacaatatcacaaaagatgcttgtgcaagaaattcgataaagccagaacaatggtgcacgagctggtggcatcagttcaaagtactattgcaaaggggagtgagggagcgaaggtatgaagccttcaacaggctgagaatattccaagttgtaagtgttgcttttcttggtggactattgtggtggcatactccagagtcacacattgaagatcgggttgccttgctctttttcttttctgttttctggggattctaccctctctacaatgcagttttcacattccctcaagagaggagaatgctgatcaaggaacggtcgtctggaatgtaccgcctttcttcctactttctagctagaacaataggagacttgcccctggagcttgcacttccaactgcatttgtcttcataatctattggatgggagggcttaaacctgatcctgtgacatttatcctttcacttcttgtggtgctttacagtgttgttgtctctcaaagccttggcttagcatttggtgctattttgatggaggttaaacaagcaactactctagcttctgtgacaacccttgtgtttctcattgctggagggtactatatacaacagattcctccattcatagtgtggctcaagtacttgagctacagctactactgttacaagctgcttttaggtgtccagtacaatgaaaatgactattatcaatgctcaacgggggagctgtgcaaagttgcagactttcctcctatcaaatcaatgggcttgaatcatttgtgggttgatgtgtgcattatggccatgatgttggtgggttatcgactagttgcttatttagcactgcatagagttaggtag

SEQ ID NO: 93503 - DNA, 123 bp, Glycine max
  Peptide Sequence Number=SeqID_210281
atggctcaacaaattggtgccactcaaggaagatgcttcaagggattgaagtttttacttcttggccatgatggtgtgaaggcttcagataggaaaattgagagtgaaagggttgaaggagag

SEQ ID NO: 93504 - DNA, 477 bp, Glycine max
  Peptide Sequence Number=SeqID_210282
ggccttatgatgatagttgcaagcattgtccccaactttctaacgggtatcataaccggtgctggaattcaaggaatcatgattttaggtgctgggttctttaggttaccaaatgatcttcctaagccattttggaaataccctatgttctatattgcattccatagatatgtctatcaaggaatgttcaaaaacgagtttgaaggactaagatttgctacgaataatgttggcggtggctacattagtggtgaagagattctaagagatgtgtggcaagtgaacacgagttactcaaaatgggttgatcttggaatcgtgctagggatgattattgtgtatcgtgttctctttttgattaacatcaaaactactgagaagctaaagccaatcattgtatcattcatgtcatcatggtcttctcctaagcgaacaatacttatcatgcagaatcccaacgccactcctttgcaagaa

SEQ ID NO: 93505 - DNA, 366 bp, Glycine max
  Peptide Sequence Number=SeqID_210283
atggcgtcccttctctcatctaattcacctgctcttagtcattatgaaattaaccctagctcaagatttgaggctactactttggagatagaagaaacatgtagtgctccaaaaccaaaagggaccaaaggaggagaaacttcaggtagttggaataataatgagagagaagagatgggtatgtgcttgacatggaaggatgtatgggtgactgcttctgtgggaaagaatgagatgagcaaatcaattcttgagggtctaactggttatgccaagccagggcaactcttggccataatgggtccttctggctgtggaaaatctgcacttcttgataccttagcaggtatgcatatatcaaagtga

SEQ ID NO: 93506 - DNA, 498 bp, Glycine max
  Peptide Sequence Number=SeqID_210284
atggatgaattcctttctagcatttggaactctgatgataacaaccaagttaacccaccactacccacccttgatgaagctgcaaagggtaaaagtatccacaaaagccaaccacactacaatgaagctaacaatagccttgccatgaatgagccactactcaaaaggcagcaaacacatggggaaatgactttcgaggatttcctagtaaaagctgtggtggttcagccgtttaagcatgtaatagggacaggatctagtgtgtcttgtaatgggcttgaaacacaaacatgttggcacataataacaaatgggaagggtaataggaagaggatcattgatggccctcgtgaagtgggctttcaacaagtgagggctgtcaagtttcaatcttttgcgatgacgaggaccagtagtccaacatggaaacacggccacacgacagcgatgacaaggatcaccacgatgcgagtagctcaccacccaaaccaaacttga

SEQ ID NO: 93507 - DNA, 1146 bp, Glycine max
  Peptide Sequence Number=SeqID_210285
atgacggacgcgttttgctacaaatttccatttaccgttttttcctacaaatttccattttcggccaaacagattcattattacaaaggaatcatatggagactaggttccaacacaaggcaaacgggggagattctgatcaacgggaggaaacaagcactggcatatggaacctcagcatatgtcacacaagatgatacattactgacaaccttaactgttggagaagcagtgcactattcagcccaactccaattaccagataccatgtccaaagaagagaagaaagagagagcagatttcacaatcagagaaatgggtcttcaagatgccattaacacaagaattggagggtggggtgttaaaggaatcagtgggggccagaagaggagagtgagcatttgcattgagattctaacacgaccaggacttctcttccttgatgaaccaactagtggacttgatagtgcagcttcctattatgtcatgaaaagaattgctacccttgataaaaaagatgatgttcacagaactgttattgcctcaatccatcaacctagtagtgaagtttttcaacttttcgacaacctttgtcttctgtcttcaggtagaactgtttactttggacctgcttccgctgcaaaagagttttttgcttcaaatgattttccttgtcctcctctcatgaatccatctgatcatttactgaaaaccataaacaaggattttgatcaggacactgagttgaatttacaaggaacagaaacaatacccaccgaagaagcaattcgcatccttgtaaattcatacaagtcatctgaaatgaaccaagaagttcagaaacaagtggcaatactaactgaaaagagcaccagttcaacaaacaagagaaggcatgctggcttccttaatcagtgctttgctctaaccaaaagatcttgcgttaacatgtatcgtgatctaggctattactggtttcgccttgccatttatattgcattggctataagtttagccactattttctgtgatctgggttcaagttatcgctcaattcaggaaagaggttcatttcttatgtttgtgtcttcattcatgactttcatgaccattggtggattcccttcctttgtggaggatatgaag

SEQ ID NO: 93508 - DNA, 468 bp, Glycine max
  Peptide Sequence Number=SeqID_210286
atgggcatagaaaaagtgaacttgctcagatatgaaggtgtggcaaaggttggaggaacgcttatttgtgtttcaggtgccatattaatggttttctatcgtggtccagctttgataggagatacagaaatggatcaagttgcacaaattaaaataagtgctagaggccagccagaggcttctcgatggttaatcaatggtttacttgatcttggatttgacaattttcagcttggggttattttcttgatagggaactgcatctgtatggctgcttttctagccattcaggcaccattattaaaagagtatcctgcaaatctgtctgtcacagcatattcattcttctttggagttgcactgatggtggttgcatcattattcatggttaatgagccaactgactggattttgacacaatcagaaatactagccgttgtatatgctttgacaatatctcagacatga

SEQ ID NO: 93509 - DNA, 591 bp, Glycine max
  Peptide Sequence Number=SeqID_210287
atgctgccctgtagacggactagaccacccattaccaagaagctactgatgtcattcttctttcttggattgacagggatatttggcaaccagcttttgtttcttattggtttaagttatactaatccaacttatgctgctgctgcacagccagctattccagtctttacatttctgttaactgtgatgatgggcatagaaagagtgaacttgctcagatatgaaggtctggcaaaggttggaggaactcttatctgtgtttctggtgctatgttgatggttttgtatcgtggtccagctttgataggagataaagaaatggatcatgttctacaaattaaaagaggtgccagagcttggggttatgtccttgatagcaaactgctgctgcatgactgcttttctagctattcagaacaaaaacatttggaacacactcttcataaactcagtcacttatgctctcattctactggtgctggtgctggtgctggaattagcgttattgtcagtactaatgttggtcgtgatgctggtgctcattctagtgctaatggtagtactggtgctgttgacaatgctcacacatga

SEQ ID NO: 93510 - DNA, 659 bp, Glycine max
  Peptide Sequence Number=SeqID_210288
tgatcatcatggacgctgcatcaggggcagcgcctgcggcgttggcggctccccaatcagagggatcaccggctgcgccgagccgctacgagtcgcagaagcgacgcgactggaacacgttcttgcagtacctgaggaaccacaagccaccattgacgctggcgcggtgcagtggcgcgcacgtgatcgagtttttgaagtacctcgaccagttcgggaagactaaggtacacatcttggggtgcccgtatttcggacaccccaacccacctgccccttgtgcctgtcctcttaaacaggcttggggcagtctggacgccctaattggacgactcagggcggccttcgaagaaaatggaggccgtcctgagtctaatccatttgcaactagggctgtccgaatttacctcagagagataagagaaggtcaggccaaggcaagaggaatcccctacgagaagaagaaacgcaagagaactattgtcaccactactgtcaccgccgcagccaccgttatgtctaccataacgggtagtagtcctaataatactattacaaacggtgctggtagtagcactggtaacactactaacggagctggtgttagtgaaccttctgctgctgctactgctacacctaatgttactactgctgctgcc

SEQ ID NO: 93511 - DNA, 801 bp, Glycine max
  Peptide Sequence Number=SeqID_210289
atggcagcagtgacagtggcagtgggaggagacatatggaaggcccatgtagccatggcgtttgttcagctattcaatggaggttaccatgtcatcaccaaagtggcccttaatgttggcatcaaccagttagtcttctgtgtcttccgtgatctccttgccctttccatcctcgcacccctcgcttatgtccgtgaaaagatatttggcaaccagcttttgtttcttattggtttaagctatactaatccaacttatgcggctgccatacagccatccattccagtctttacctttctgttggctgtaatgatgggtacagaaagagtgaacttactcagatatgatggtctggcaaaagttggaggaactattatctgtgtctctggtgccatatttatggttttgtatcgtggtccagctttgataggatatgccgaactcggtcatgtaacacaaaatgaaataagtgccagaggtcagccagagccatctggatggttaattggtggcttacagaaccttgggtttgacaattttcatcttggagttttgtgcttgatagggaactgcatttgcatggctgcatttctagccattcaggcatcggtattaaaaaaatatcctgcaaacctatctgtcacagcgtgttcatacttctttggagctttactgatggtgacagtatcattattcatgactactgagtcaactgactggagtttaacgtcatcagaaatacttgctgttatttatgctgaaagcattctcactttgttgaagtgggagtcaatgtcgtaa

SEQ ID NO: 93512 - DNA, 2088 bp, Glycine max
  Peptide Sequence Number=SeqID_210290
atggtctttgccaaaatcgcatcactcgtcgcccccaattcacattccctcccccaccctctctctctccaggatctctcctcctactgccacctcgaaccacccctccacggcggagccaccaccattacctcctcttcacgccacaaatgcctcagactctcactctacctcgccaccttcctcttcctaacctacctcctcttcctcctcctctactcctactggaaccacggctccgccaagtactacgttgtcctcgactgcggcagtaccggcacccgcgtctacgtctaccgcgcctccgtccgcttcaaccgccacaccactctcccaatcgccgtcacctcattgagaaatgcctcgcccaagaataataagaagaagccgcctaccggccgcgcctatgatcgaatcgaaaccgaacccggaatcgataaactagtaaacaacgtgtctggtttgaacaatgcattgaaacctttgctgaggtgggccaagaagcagataccagtgcgtgctcacaggtccacttttttgttcctttatgccactgctggtgttaggaggcttcctgttagtgattctcggtggctgcttgataatgcttggtctgtgcttaaagactctccctttgtgtgtcaaagggattgggttaagattatttctggtcctgaagaggcttattttgggtggatagctcttaattatgatggtggcattttgggggttaggcctaggaaggctacttatggtgctcttgacttgggtggctcttccctgcaggtcacgtttgagagtgatcagcagcttaatagtgagactagtttgtatgttaggattggatctgtgagccatcatcttaccgcatattcgctaccagggtatggactcaacgaggcatttgggaagtctgtggtgtatctatttaggaaggagtttggatcgggtaatgtggatgtgggtagtggtgggaatgttgagttgaaacatccttgcttgcaggatgggtatagggaggaatactcatgttctcgttgttcgtctagtaagaaaggtgggaatggagggttgggaggaactcaattggtgcttgttggtgctcccaattggggggagtgcagcgccctcgctaaagttgctgtgaatttgtctgaatggactgatcttggtgccgggcttgattgtggagcgcagccttgcgctttgggtgataatctgcctcacccgtatggacacttttatgtgatttctgggttttatgttgtgtataggtttttcaacttgacttctgaggccacgcttgatgatgtgctggcaaagggtaagggtttttgtgagaagaggtgggatgttgcaaagagaagtgttgctccgcagccctttattgagcagtactgcttcagggcaccctatattgcctctctgctgagggagggtttgcacattaatgataaccagataactgttggctctggaaatatcacttggacacttggtgttgccttgttggaagctggaaaggcgttttccactagatttgggcttcgtgacttggagtttttccagatgaagataaatcctcttgttcttgtgcccattttgttgctttcttttattctacttctttgtgctttatcatgtgttggcaattggatgccaaggtttttccggaggcaatatcttcccatttccaggcataacagtgttactggtgcttctgttcttaacataccatctccttttcggttccagcgatggagtccaatgtactctggggatggaagactaaagatgcctctgagcccaaaaattgcaagttcacaacaaagccaatttggtctagggcatagtcttgatgacaacagtggtggcatcgagcttatggagtcttcattgtacccatcagctaataatgtctctcatagttattcctcaaacagtttagggcagatgcagtatgacagtggcaacatgggtgctttctggtccccacatagaagtcagatgtgtctgcagagtaggagatcacagtctcgagaagacctgaattcctcattggctgaagttcatctgatgaagccgtga

SEQ ID NO: 93513 - DNA, 565 bp, Glycine max
  Peptide Sequence Number=SeqID_210291
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacag

SEQ ID NO: 93514 - DNA, 366 bp, Glycine max
  Peptide Sequence Number=SeqID_210292
atggatgatgaccaaaagaatgaaggaaatgagcctagaagttatgaggaagttgataataacaagcaatctaaaaattggattgctggtatgaatgaagaattgagttcctttcataagaatgtcgcttggattttggttgacaaggcaaaagggactaaattagtcagatgcaagtggatattcaacccgaaagaggaaatcctaggggttgaaaaggctagattcaaagtaccattggtggcaaaagggtttacacaaagagagggcattgattataatgaggtgttctctcctactgtgaaacactcctcaatcaaaatggtattagccttggctgttcaagaggacatagaattggagtaa

SEQ ID NO: 93515 - DNA, 1914 bp, Glycine max
  Peptide Sequence Number=SeqID_210293
atgcctgactcctctaatgtccctacttccttggaagatgccgttctcaagctcgcggctcaacatttgtccatgggtgagactttgcaaacagtaacattccagttgaatgagattttgcttcgtcttcctcccacgctccccacccctgttccacctgcatctacccccacgtcttcttcttcacctgcacaacaacacagaatcaaaattgatgttcctcgtttcgatgggagtgacccatctgggtggatctttaagatcacccagtattttgagtatcatgctactcctgaggcagagaggcttaccattgctgcgttctacatggacggccgcgccttggcctggttccaatggatgaacgacaatggtcaatttacatcttggcctgcctttcttcaagcgattcagactcggttcgcgccttctcagtacgaggacccgaccggtgtcctgttcaagctcacccaaaagggtacggtgacccagtacctcgccgaatttgaggagttggcgaaccgcatcatcggcctccctccaccgttcctgctcagctgctttgtgtcggggttggcgtcggatattcgccgtgaggtccaggcccaccagcctttgaccctcgtgcaggtggcaggcctcgctcgacttcaggaggagaaaatcttcgacggccgccccacctcacgcaatcgtccccaccaacccacccagatgtaccccccacctccatcaaccactttcgtccctgtttcccctacccagaaccccaattccaccatccctctacgccccattcccaccccacctctgttactaccacccacgagccccaacccctctcaggtgaaacgcctctctctggaagaaattgcttctcgccgggagagaaggctttgcttcacatgtgacgagaaataccacagagggcatcgctgcacctctagggcatttctcctggtcgctgaggaagacgaaaccctcccaggccttataaaccccccttacccgcaacccgatccagttccccctgacccgactgacccatacccggcccagatcagttttaactcgctggcaggacaagtggcgctcgaaacgctacgtttcatgggcttcatcggagaccgccaggtgatcttgttggtggacggtgggagtacccacaacttcatccagcttcagctggtctcggagttgggcctcaccactcgtgataccactcctttgcgcatcatggttggcaatggccaacaactggagtgcacgcgtgtctgtgaggacgtcaccgtggtcattcagaatacgagcctatacttccatgtcacgatattaccagagcccccttccatccaagatgatcctactctctctccccacattcaaactatccttgaccgttaccaccccttgttccaatcacccaatacacttccaccccaacgagagacagaccaccgtatccatcttcttccccaagctacacccgtcaatgtctgcccctataggtacccccatttccagaagcaggaaattgaacaacaagttgaaataatgctgcaaacgggtctgatacaacccagtaatagccccttttcttccccgatcttgcttgtcaagaagcacgatggaacctggagattctgcgtagactatagggcactcaatgctctcaccattaaagacaggtttccgatacccacggttgatgaattattggatgaattaggcggggctcactatttttcgaagctcgatttgcttcaagggtatcatcaaatacatatgtcccctgaagacatttcgaaaacgtcttttcgaacccatcacggacattacgaatttcgtgtaatgccgtttgggtcatgcaatgccccttcatcgtttcaggcgacgatgaacgcgatattctag

SEQ ID NO: 93516 - DNA, 857 bp, Glycine max
  Peptide Sequence Number=SeqID_210294
atgggctgcacttgcaagcccttctccgcctccctcttcacttctcttccacttcgcctccgccttcctccgccgccgccactacatttcgccgccgcggtcccctttcgttccaaacaacaaaccccttctcacacctttcgcctttcagccctcccactattatcccatggcagcggcaacaacaacaacaacaacggtggtagttggggcaacaacccctttgactccttcgattcgaattcaaattcccatcacacccttttcctctccatgctctgctcctccgccctctgtttcttcggccacctcctccttgccaaactcgcaaaggccaaaactttgtcttcttcctcctcctccgacacctcacttttctccgaacctgtttatgaagtcaaaggcggcaagtggaccaaactcgttcctgaccccaccgacgacgtctttgtctccgcacaacagggattcttgtcggagctatcatctctcaaaccttcacagctggcaaccttcgtgtggctcaagtgcagcgacatcttcacgcgcttgatgcttccagaagggttccccgagagcgtgacgagcgattacttggagtattctctctggagagcagttcagggcgtggcgtgtcaggttagtggcgtgctcgcaacgcagtcgttgctttacgccgttggattgggaaaaggggctattcccactgctgctgcgatcaattgggtgctcaaggatggaattgggtaccttagtaagatcatgttgtctaactttggtcgccattttgatgttaaccctaaaggatggagattgttcgctgatcttcttgagaatgctgcctttggcttggagat

SEQ ID NO: 93517 - DNA, 459 bp, Glycine max
  Peptide Sequence Number=SeqID_210295
atgggagaccttaagattagaggtgacatagttgaagagcaattatggccacagaaacccactctaattaagcctattcctcaaagagctcaagctaatgtacctataggcgttggtccatcctttcaacaaaggcaaaaaccctctaagccacttcctaagcttgccaccattccagaaaatgacaatctttctacagaggaaaacactactaatgaaggtggcgcagcttttgttgatgctaataatcaaaacatttccaatgaagcccaagcaaacactgagcaagaaatggagaggaagtttaggcgaaccatatcaaaccgattttctgcacggagatcaagattgaagaaacttgcttacatggcggagttggagagcaaagcgaaatctttcgaggtggtaaaaggatttaataattcacagagaaaaaaaatatcgttaatgaaaacttag

SEQ ID NO: 93518 - DNA, 1566 bp, Glycine max
  Peptide Sequence Number=SeqID_210296
atggcagagcatcttaatcacctcgaaatcacttttcagggggtgaaaccagtggcgtccaaggttgaggccattcttcaatggccaattccgcattcaattaaagcagttaggagttttttaggccttgccgacttctataggcgcttcatcaggggttatgcaaccattgctgcccctttggttcatatcaccaccaaggcccatttcatgtgtacagacttagcccaagacgcatttgagaaacttaagcaagctgtatcaacggcccctgtgctttccctgccggatttcgagcaacccttcaccgccgaggctgacgcgtccggtttagggatgggagcggttctatctcagcagggacaccccctggcgttcttcagcgagccttttccaccaaaactcttgagtgcttccacctatgtaagggagttgtttgcggtgacagcgacggtaatacaaaccccagagcaacacacttatttagcaagattgacggggtatgattaccaaataattcaccgttctggagctttgaatcaagctgctgatgccttgtcacgtatcccaaagcataattcgtctttaatgaccctgtcggtaccctgccttacctttatggaggagctccgccgtcaattggaggcttcatcagagtatgtgtcacagaggaatgcaattggtcaatcccctgccacatttccgggctactccattgttaacaatcttatcttgcatcagaaacgcatatggcttccccaaggcctgccattaatacccacattgcttactgaatttcacttaactccaactggggggcatatgagagtggctaaaaccttagctcgagtctcagaaaacttcagctggcctggtcttcgaagggatgtaaccaaatttgtgacacagtgtgttgattgccagcttactaaatacgaaactaagaaaagtgcagggctactttgtcccttaccagtgccacaaagaccatgggaagacctttctctagatttcataatgggtcttcctccttttcagggacattccgtaattctcgtggtagttgatcgcttctcgaaggggatacacttgggcaccttaccggcttcacacacagctcacatggtggcagtgttgttcatggagattgtcaggaaaattcatggaattccccgaagtttagtctctgatagagaccccctatttcttagcaacttctggcgtgaactcttccaattgagcgggacgcaactccggatgagttttgcttatcaccctcagacagatgggcagactgagtggtcccataatacttcctggaacattgcaacagggaccacaccttatgagattacctttggacgaaagcccttcaactttccagactacatcacagggacatcgaaattggatgcagtcgaggagatgctcaaggacagggatgagaccttccaatgcatcaggaagaaacttattaaggctcaaattaagatgaagaagttcgcatatatgaagaggagggagatgtcttatcagccgggagattgggttttactcaaactctga

SEQ ID NO: 93519 - DNA, 417 bp, Glycine max
  Peptide Sequence Number=SeqID_210297
atgggcaatgtgaccaaagacgaagagctgtaccaggagatgtgtcgggtggtagggaaagtcgttctggagatgcgtgacttagggcaggagcccaagcatatcgtgattgccggggtactgcgtacggcgctggcgaaccagcgcgtaaaacggagcgagttaaccacccaggcgatggagacagtggtgaaggcgctggccgggcgtgttttactgaagtcaggtaaagcgagaggggtaaagacgatgaaaaagtggataagcacgttacggcggttttttgcgacccggcccgcgaatgcggagaacagtgcgcaacgtgttcttgagtcgatactgcctgtcgccagtctgtatggcgtggacgtggccaacatagacccggagtggttccatgataaaacgccacgctga

SEQ ID NO: 93520 - DNA, 1269 bp, Glycine max
  misc_feature (1264)..(1264): n is a, c, g, or t
  Peptide Sequence Number=SeqID_210298
atggagataatgatgaaacggaccaccttaaccacggctctttcagcccctgcgttacttctcgccatgcatgcggcacatgctgcgccacaggctcatgtcgtctgcggctactcccatacccttggcgatgatgccattatgatgtttggcagacccaacgaggccatgctgcatgacttcttcggcaacacgcacaccgatgccagctcgaccagggaaaccctgcgcacgctggaagaaaccacctgcgataataaagcggatagctcggcatactgggcaccttcgctgcggctgcctgatggcactatcgtaaaacccgcgtatcaaaaaacctattatcaggcctcgaatgtggaaacctggccgctgcagcctttcccggcggggctatcactgctggcgggggatcaccatggatctgcgcctaacccgcatatcacgttcttatgtgctaacggcaaaggttacacgacaaaaacaggcgaagtgtgcgggctacgcaaggcgggagacgcggtgcagtttaatatcggtattcagtttcccaactgctgggatggcgtcaacctgaagccgagccacggtcacagcaacgccgcctatgatgtcaacggtgcctgcccggcagactatccggtaaaaatcccgacggttaatatgaatatcgcctacgtgctgccgcagattaaatcactggacacggcgaaaattgagctgtcgatggacccggttatgaagggcgataaacgtgaagagaagtggggcagtatctatactgcccatgctgatttcatgaacggctggacggtcgagggcgcgcacttcatgaccgaacactgtatgaatgaaggcatggattgcgggaccaacgtgccttatagcttctcgctggcggaagaaaacgcggtggtcgagagcgcgcagccgaatgttaacttcggggcgcctggagcgctgcagatttccgataactggaagaacggtggccgtaccagcaacccggaaaccctgaccctggtgaagtttaaaatcccggtgctgccgaaagatcaggatgcgtcgctgtttaaatatcgcctgcgtctgtacggcggcaaagtggaaactaacggcgcggatcagatcttcttctacccggccagtaatgactggagcgcggcgagcgtgacctggaagcatcgcccgacctgcagctacaactctgatggtcaactgtatctcaattcatctcgtgagtatcggatggtggatatcgatnaagcg

SEQ ID NO: 93521 - DNA, 1908 bp, Glycine max
  Peptide Sequence Number=SeqID_210299
atgttctactaccttgctttccttccaaactcttccatccgaatgcatcctcagtggggggtggtcttgaatttaaaagacctttgtcttgaaggaacactagcaccagaaattggaaagctggctcacataagatcaatcattttgcgcaacaattccttctttggagaaattcccaaggagatactacacttagaggagttggaagtgcttgacttgggatataacaactttagtggatcaattccatttgatcatggcaatatttcatccctgaccactcttttattggacaacaattactatctagccaacttaactacagagctgtataagctcaagatgaattctgaatttcatgccaatgaagaacagctaactggtgccacctctagagaactatttgtcggcagatgtaatttacggcgcattagccaacatggggatagatcatacaggaggcaacttctcaaggtagcaaatgctgctaatacacccaaaatccaaggggatgttaaccaagggacacttaaacaatcagcatcacatttccgtttttcattaccaccagattttgagcctttctcatcatcaccatcagaaagtcctttatattcaccaggatcagctccattatcatattcgccatcgccatctccatcaccctccagtatttttttcgctccttcacctgtagtgttaccaactccagacatcccacccccagtaaacacgcctgtcactgtgtctacaccacccgagtttaattgggcgcctagcccttcatcattttctaaccaagggaacacaaatagttccaatcaaatacatcattcagtgataatctggtctgcagttgggggcttctccttattgattttattgtcagccattatttttgcttgcttccaaagtaggaaggttgtggctgttaaaccttggtccacagggttgagtggccagctgcagaaagcttttataaaaggtgtgccaagtctcaaacgaggagaaattgaagcagcttctgaatatttcagtaacattattggttctcttcctgatggaattgtgtataaggggactctctccagtggagttgagatagctgtagcatcctctgcagtgaccacagctcaaaactggtcaaaaagtatggaagctcaattccgaaagaagattgcgtcattatctagagtgaaccacaagaattttgtgaatcttattgggtattgtgaagagaataagccattctcaagaatgatggtgtttgagtacgctccaaatggaacactctttgagcatctgcacattagagaaggagaagaactaaattggacaatgagaatgaggatagctatgggaatagcctactgcctagagtatatgcatgagttgaaaccacccattgcccatagaaacctgcaatcttcctttatataccttactgaagattatgctgctaaagtatcagatcttagtttatggaatgacatgtgtgctacaaagaatgggtctgcaaccacacaactcttggaaacatcgtcagcagataccaaggacaatgtttacagctttggaataatattgtttgagttgattacagggagaattccccttgctgggaacagtgaacttctggcagattgggcagcagaatatgtaaggtgggggaaatccttaagagatgttgtggatctaagactgaagtctttgcaggaagaagagattgaggaatggtctgaagtaataagaaactgtgtacaaccagatccagagaaaaggccaactatgaaagaaattacatctagactcaaggaactcacagctatggggcctgatggagcaaatccaaaagcatcaccactttggtgggcagaaatggcaattacatccactgattcaagttga

SEQ ID NO: 93522 - DNA, 2799 bp, Glycine max
  Peptide Sequence Number=SeqID_210300
atgcgtggcctgaagctagttgaacgcttcaagagcatccaagttcatgccctcaactcagaagcaactagcagaagaaacaaggccacaggggaagccagagccatcacaatcagatcattggtgtcaaagtccaaatccaacaccaccaccaccaccaccaccaccacaacaacaacaaattcagcaattgcaaacctcgttgttcctcttcagctcccttctgctgacactctcgaaccttccatagagccttaccttaaacccaccaacctcgtggaggctttggcggaactttaccacaggctagaatgttgctgccttcagtctgagaaaaaaacatcactgtgtgtggagcagttcacgcttctgcgcagcctcggagaccagaagcttctgaggaggtgtctcaggactgcgcggcaaaacgctgaggatgtgctttccaaggttgtgctttcggcatggttgaggtttgagaggagggaggatgagcttgagggtgtgtcttctatggattgtggtggttgtgttcttgaatgtccgaaggtgaatttggtgaagggctttagtccttgttcaatcaatgataggtgccagtgtccacaagggactaaagaggaaactagcaatgaagaaagtgtgtttttgtgtttgccagatgaggaaaaaaaggatgtttctttttgcattgggagtgaggaaattgattgtgttaagtggagaattgctgccctttctgacccttttaaggcaatgctttatggtggctttgctgagtccaagatgaggaagattgatttcagcaaaaatggtataagctcaaagggtatgagggcagtggagttgtacagcagggctaagaggttggactttttctgtgccatgactgttttggagcttctttcctttgccaatagtttctgttgtgaggagatgaaggctgcttgtgatgctcatttggcttcatttgttggaagtgttgatgatgcattgatacttattgactatggattggaagagagagcaccccttcttgtggcttcctgcttacaagtgttgctcagggagctaccaaattctttgcataattcaaaagtgatgaatgtattttgtagttctgagggaatgaaaaggttggccatggtggggtatgattctttcttgctatactatttcctgagccaggtggctatggaggaaatcatggtgtcagaaactacacttatgttactagaaaggttgggagagtgtgctactgaaaggtggcagaaagcccttgcattccatcaattgggttgtgtgctgcttgaaaggaaacaatataaagaggctcagcatagttttgaggtagcagctgaagcaggtcatgtgtattctgtggctggtgtggccagaaccaagtacaagcagggtcaaccatattcggcctataagttaattagttctctcatatttgagcacaaacctgctgggtggatgtatcaggagcgcgctctttacaacatggggagggaaaaaagttttgatttggatgttgcaactgaattggacccctccctttcatttccatataagtatagagccctggcaaaggtggaggagaagcatataaaagctggaattttagagcttgataagattattggattcaagctctctcctgattgcttagaagtgcgggcgaggatgtttattgctcttaaggattatggcagtgccataaaagatatcagggcattgttaactttggaaccaaattatataacttcaaatgaaaagatctcagggaaatacttggttcatctccttagccatgtggtacagcaaaagagtcaggctgaatgctggatgcaattatacgaacaatggtcttctgtagatgatgttggttctttggctattatacatcagatgctggagaatgagcctggaaagagcctgctggagtttcgtcagtctctactccttttgaggttaaactgtcaaaaggctgcaatgcgcagtttgaggatggccagaaaccattctagctcactgcaagaaagattaatttatgaaggatggattctatatgatactggctatcgggatgaagcgctggctagggttgataggtcaattacaattcagagatcatttgaagcctattttctaaaagcatatgtgttagcagatacaagtatggatccggaatctgcttcttatgttattgaacttctggaagaagcacttaaatgtccttcagatggtcttcgcaaaggacaagcactaaataacttggggagtatttatgtagattgtggtaatcttgatcttgcagaggcatgctatgagaatgcccttgcaattaggcacacaagagctcatcaaggtctagcacgggtttatcatcagaaaaatcaacgaaaagctgcatatgatgagatgaccaagctaattgaaaaggcagagagcaatgcctcagcatatgagaaacgatcagaatactgtgaccgtgagatggcaaaggttgaccttgatgtagcaacccaactggatcctttgaaaacatatccgtatagatacagggcagcagtgatgatggatgagcaaaaggaatctgaagctgttgatgagctcaccaaggccataaatttcaaacctgacttgcaaatgcttcatctccgagcagcattttatgaggcaataggggaactatcatcagctcttcaagattgtcaggcagctctatgcttagaccctaaccatacagacacacttgatctgtatcaaagggcacggaaactaagcttttaa

SEQ ID NO: 93523 - DNA, 243 bp, Glycine max
  Peptide Sequence Number=SeqID_210301
atggcaccattcactccgttgaagttgccgctgctgctaacgctgtttttcgcgttgagccagaaacagagtctctgttccacgctcaagagcgaagaaggcttggcgctgctggcgttgagggagagagtggtgagtgacccgcaggggactttatcaagttggagtggcgcagatggagacgttgatccttgctcgtggttcggtgtggagtgttttcatggttatgttgtgaccttgtaa

SEQ ID NO: 93524 - DNA, 180 bp, Glycine max
  Peptide Sequence Number=SeqID_210302
atgcagaaggtaatgaagggcaaagacagagaaccccagaaaccgaaatgcttcaacattaaactagacaagatgggcaaaagtcagaagcttgagcatttccaaagagagacagagatctggggtgaagtcaatgagagtggatttttggttgtaaatgaaagaaaggagtgtttttga

SEQ ID NO: 93525 - DNA, 909 bp, Glycine max
  Peptide Sequence Number=SeqID_210303
atgtggcgaccgtggggcaaatcaacggttcgaattcacagcgcgtcttcatcaccctcttccacattctcttgttcttccttcaaagacattcagaccctttgcctcgacgaacccccccaacaccaccaccaccaactaccctctccttcccccactagaaaaccctccgttttccaccgagtccgactcgccaactcgctcctccgaacctggtcaactcacctccacccccaacctcccaaactcccccgaaccctctcccaccccgatccccccgaatccgaacctgatgttgttgtttcaaaacccgaacctgatgttgttgtctcaaaacccgaacaacaacaacaacaacaacctgcgatttattatttcccaggcgcggaacagcgcgtggtggtgtactacacgagcctgcgcgtggtgaggcccacgttcgaggcgtgcaagagcgtgctctccatcctacgcggcttccgcgtccaaatcgacgagcgtgacgtgtccatggactcgggcttcaccgccgaactcaaccgcatcatgggccgccccgagctcggcccaggcccatccctgccgcgcgtgttcatcgctggcaggtacgttggtggggccgaggagctgcgacagctcaacgaggtcggcgagcttaagaagatcctcctggacctgcccgcagtggatcccaccgctgagtgccacgtgtgcgcgggtcacaggttcgttctgtgcgacgagtgtaacggtagcaggaaggtctacaccgaaaagaccggcttcaaaacgtgtaacgcgtgcaatgaaaacggtctcgttaagtgcccctcttgtttaccttctacttctccaccacccattttatcatcaacaacatccaaatttaacaatgaaatccaaaattga

SEQ ID NO: 93526 - DNA, 2319 bp, Glycine max
  Peptide Sequence Number=SeqID_210304
atgacaattgatgtgccaccatccagtggccaaagtgtgaggacaaatagatcttcctttagttctagcaatggcaatgaggctacccccgttcacaactatgcatctgttagcaatggtgatggctatgatagtgaaggctccaatttcgcgccacctacaccaaccactctatcaatggctattccatcagaactcgctggtgctgtacccttgattgatagattccaggatccaatacctacatcattgcttaagctgaatggtgacttggcaagccgagcaacaaaattatttcaaataattttgaaatatattggagttgattcatctgatcatgtaactccaataagcttagaagaacgagttgagcttgttggtaaactatacaagcaaagtttgaagcgttcagagctccgagatgaactctttctccaattatcaaaacaaacgagaaacagccctgagagggaatacttgattaaagcatgggagctaatgtatttatgtgcttcatccatgcctcctagcaaagacattggagcttatctatcagagtatgttcataatatggcatatggtgtgactgctgatcctgagatccgagcccttgcattaaatacattaaatgctttgaagcactctgtcaaggctggtcctagacatataatacctgggcctgttgagatcgaaactctgttgacagggaaaaagcttacaactatagtgttcttcctggatgaaacatttgaagaaattacatatgacatgtcaacaacagttgctgatgctgtcgaggagtacgttgggttagacgacaacaaatatattggggatctcctggcagaatttaaggcagtgaaggatcgaagtaagggagaaatattgcactgcaaactaattttcaagaaaaagttatttcgtgaatcagatgaagctgtgacagatccaatgtttttgcagttgtcctatgtacaattgcagcatgactatattttgggtaattaccctattggaaggaatgatgcagcccagctttctgcattgcaaatcttggctgagattggatttgttagaagacctgaatcatgcgcgttagtgattttcgatgttcatcttgcgcatgtgacgaaagatgatgctagacaacaatttcttcatatattgagaacacttccctatgggttttccgttttcttcaatgttcgcaaaattgatgatcctattggactattgcctgggcgaataatattaggaatcaacaagagaggggtccattttttccgtcccgttccaaaggaatatatgcactctgctgaattgagagacataatgcaatttggaagcagcaatactgcagtattttttaaaatgcgggttgcaggtgttcttcacatattccagtttgaaacaaagcagggagaagaaatttgtgtagctcttcagacacacataaatgacgtaatgttgcgacgctattccaaagctcgatctgctgtgggtgaatctttgaatgaagacacttctaatgattttaagccttctaatttggaactatctgaaaaacgtcttcaagagttatcaaaacttgttgaagaatctcaaacgaatgctgatcaattgctggataaattgcgtgagaagcaaaaacaagaagaggacatgctacaagaattagagggcttacaaagatctttaagagctgacaagcagagtcttgcagaagttacaaatgaccgtgacaaacttaggtcattatgtgaagaaaaagataaggcacttcaggctgaaattctagagaaaagaaacatggaagcaaagatggcagagttgagtaatctggttacagagaacactaccaaaaaggaccacactcaaacaaataaccaagtgtcacagaaactcgaagatgacctaaaactatgtaaaggtgagttgcgtgtagctgaagaaactatcaaaaacctgagaagtaataagttgattttggaacagaagctatctgagcttgagaagaagagtgctgaagaggctagttctcttcaatggaaacttgagcaagaaggcaaaactctgaactctaaagtatatgaccttgaacgaaaactggatgcgtttagacaagaattaagtgtggctgagtctacagtctcggtcaaagactctgaattggctgcattgaagaacaatttagatgaactagaagaattgagagaaatgaaagaggacattgacagaaagaatgagcaaacagctgccatactgaagatgcaagcagttcaactagctgaaatggaattgctttataaggaagagcag

SEQ ID NO: 93527 - DNA, 237 bp, Glycine max
  Peptide Sequence Number=SeqID_210305
atggagaccatagaacactgcattgctatctctaaaagaggttatactgttgaggctgatgaccttatcaaggatatggcaattactgctgaatacattggcgatgtggattaccttgacaaccaggaacgtgatgattctgacagtattatgtcccttcttagagcagaaagttctcaaagtgttgttagctgtgctgataaacgtggaaacatcgctcatccgctccctttatga

SEQ ID NO: 93528 - DNA, 174 bp, Glycine max
  Peptide Sequence Number=SeqID_210306
atgggagaggaaggattggtgaagctcattgagtccttgagtgaggaagttgtagaagctattgacagaagattgtggagtcaacctatgcaaaagtacctacttcgaaggtatggaaccgatatgtgctcatgttgtacaacaatgctaccgcaacatcattgtgagctttag

SEQ ID NO: 93529 - DNA, 249 bp, Glycine max
  Peptide Sequence Number=SeqID_210307
atgaaaaagttaaagacattgaaagtagaagctcatgttgaagtgttgttgggttgtgatgttgtgctatctttcccaactcaagaagttggagtgcaactagtgtttgaacgacaaccaccaccaatacttcgaataagaacaacaatgaccaccaacaccaacaaccaccatagattgtgcgtaatcctcttttggatgacaactatcagtaacaccgacaatcatcatgcaacttctaaatggtga

SEQ ID NO: 93530 - DNA, 2115 bp, Glycine max
  Peptide Sequence Number=SeqID_210308
atggattgtcatggtggtatttcccaaagctctccaaacagggagtatgaaggccttaatggaccggttttcttacatggtgacttggatctgttgataatagaagccaagtctcttccaaatttagatttatccagtgaaacaattagaaaatgcatcactatgggcaacatgtgccaccctccatttataaaaggactaaagacacactctggaaaagacaagatgataactagtgacccttatgtttctgtatgcattgctggggctaccatagctcagactagagtgattgctaactgtgagaaccctttgtgggatgagcagtttattgtgcctgttgctcaccctgctcaaaaacttgagttccttgtgaaggacaatgatattcttggggctgaactcattggagtggtggagatacctgttcagaagataattgcaggaaatactgttaatgattggtttcccatcattggtcagtacggaaactgcttaaaaccttatcctgaattgcatatttctgttcagtataggcaaattggagtgaaccgttcagaaagtattagtagtggggatggaaaagccttaggagttcctaaaacatatttccctctcaggaaaggagggagtgtgactctatatcaagatgcacatttacctgatggtatgctacctgaaattacacttgagggtggaaaagtgtttcagcataataaatgttgggaggacatatgccatgcaattttggaagctcatcacctgatatacattataggatggtcagtttaccacccagtgaggctggtcagagaggcaacaaaaccattgccttctgggggagagctttcacttggagagctgttgaagtacaagtcacaagaagggctccgagtggatggtgtcatgcagactcatgatgaagaaactaagaagtttttcaaacattctactgttgtgggaaccctctttacgcatcaccagaaatgtgttcttgtagacagtctaggttctgggaataataggaaaataacagctttcattggtggtttggatctatgtgatggtagatatgatacaccggagcatcggctttttcgtgatctagatacagtctttcataatgattttcataatcctacatttcaattacattcgaattcatgtgcaccaaggcagccatggcatgacttacattgcaaaattgaaggtccagcagcatatgatatattgaccaattttgaacaaagatggaggaaggccaaaaaatggcgcgacttcaggctcaaaaaggtgaccaattggcatgatgacgctttgctaaggctagaccggatttcatggattgtcaaaccttctccttcttccaacggcgataaatctgttcatgtaaccgatgaaaatgatcccgagagttggaatgtgcagatatttaggtccatagattcaggatctgtgaagggatttcctaaggatgttgacaaagctaaggctcaggtgagaacaaggttgtacgtgatgcccctttatactacgagttcttgtgctaaccacttggttcccatggagttggctttgaaaattgctggtaagatcggtgcaaatgaacgtttttgtgtatatatagttataccaatgtggccagagggtgttccaacaagtgctgctgttcaagaaatattgttctggcagggacagacaatgtctatgatgtacaagattgtagctgatgcccttgaaaaagcaggactttcttatcagtatcatccacaagattatctcaatttttactgccttggaaagagagaaccacaatccacaaatatttcaccaacaccaaatccatctgaaaaccgcgctttgctcttcacggtcgcgctcgtcgttggtgacgaacaagctgcggagaatggatcgaacgacgggacaatcgtcgtaggtgatggcgcggtcggagtctgtcggaggctcgacgacggaggtggcgacgctggttcagattggaggatgatttggatggctaagagcacggcttcgcatccggcctggggattctggtcggcgacgagggagaggttgttgtcgccggcgccggaggaaggaggagatgtgtga

SEQ ID NO: 93531 - DNA, 1755 bp, Glycine max
  Peptide Sequence Number=SeqID_210309
atgttcttcgaatcccgatccctcctcttcccgctccttttctctctcttccttgcttccgccttcgcttcagagtcagatcacaagtatcaacatgatgaacaagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaacttgaaattaagttccaaagaaatgtggataagactgtcttttgccagatagatctcgatgaagcaaaggtgaaacagttcaaggatgcaatagagaataattactggtttgaattcttcatgggatatgttggtgagttacatcctgataagaacagtgataatggcaagcatgtcatttacacacacaaaaacattattgttaaatacaacaatgatcagattattcatgttaatctcactcaggatatcccaaagcctttggaagtaggaaaacatttggacatgacatattctgtcaaatgggattctaccaatgtcactttcgggcgtcgctttgatgtctacctggaccatcctttctttgagcatcagattcattggttctccatttttaactctttcatgatggtcatcttccttactggtttggtgtcaatgatattgatgcgaactctgagaaatgactatgcaaagtatgctcgggaagatgatgatttggaaagtctggagagagatgttagtgaagaatctggctggaaacttgtgcatggtgatgtttttcggcctcctcgcaacttagttattctttcagctgttgttggcactggtgctcaacttgcgttgctggttcttcttgtcgtcttgttggctattgttgggatgttgtatgttgggcgaggagccattgtcactactttcattgtgtgttatgctctcacatctttcatttctggttatgtgagtggggggatgtactcacgaaatgggggtaaacactggattaaatccatgatccttacagcttctctgttcccattcatgtgctttggaattggatttatattaaacacaatcgctatattctatgggtctctagcagcaattccatttggcacaatggtggttgtatttgtcatttgggctttcatctctttccccctagcacttcttggcacagttgttggaagaaactggagtggtgctctgaataatccctgtcgtgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttctgattcttatcatcgttaccgtttgtgtgacaattgtggggacatactttttgttaaatgctgagaactaccactggcaatggacttctttcttttcagctgcctcaacagctgtttatgtgtatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaacatcaagtgcgattaa

SEQ ID NO: 93532 - DNA, 201 bp, Glycine max
  Peptide Sequence Number=SeqID_210310
atgactcttgagttttggattatggtgccggacaaactaggattacttgagaggaaggctgggacaaagctttctagaatgcttctgagggaagaaattgatgagaactcaacagtttacagggaggaaaacaatggaggaattgttcatgcccgtggcagtaaagaagatgatgatagagatggtgaaatggaaggatga

SEQ ID NO: 93533 - DNA, 297 bp, Glycine max
  Peptide Sequence Number=SeqID_210311
gttcgtgatatcacccacttgccatttgctgagcgagaattgatgctaataaagattgctgtaaatgctgctgcacggcgtgatgtccttgatattgctagcattttccgggctaaagctgtcgatgtatctgatcacacaataactctggagcttactggagatttggacaagatggttgcattacagagattgttagaaccatatggcatttgtgagaatattcatactggaggaaagaactcagttttgctagtcttggctaagatgtacttgttttcttttgaagctctgtag

SEQ ID NO: 93534 - DNA, 552 bp, Glycine max
  Peptide Sequence Number=SeqID_210312
atggaggatacttttccagtgattgatgcggagaagattaattgtgaggaaggggaatgcaagaagctaagagaagcatgtgaaagatggggttgtttcatggctgacatgaagaaggtcgttgaagctctggtggttacgtgggacaaaatgcattcagcactttatatgaggccttgggtctctatgacttgtgttcctcacaagctatgcagattttctgttctcaacttgatgactcgctccaccagagtgaacataggacaaaagatggctgaatctcttggcctagttgttgctgatttcgaggactgtgatgaacggttctggctcatttctgccaatccttcctttccccgggaccttcaatgcaaggaagggagcaaacgtctttcaattgctacatttatgttgaggcaacaggcgaattggtggaccatgatcacccacgtctgtatcaagcttttaattatgaagattataaggaaactcagagttagcaacaaggggatgcccactaatgaagccctggagttgttccgcttggcctaa

SEQ ID NO: 93535 - DNA, 948 bp, Glycine max
  Peptide Sequence Number=SeqID_210313
atgcagtacttagtgcaatctgctgtagatggttataatgtttgcatatttgcttacggtcaaactggttctgggaagacttttacaatctatggagctgaaaacaatcttggacttacccctcgtggtactgcagaactttttagaattttaaggagagatagtaacaagtattctttctcgttgaaggcatatatgttggaattatatcaagatacacttgtagatcttctgttaccgaagaatgcaaagcgtttaaaattggatattaagaaggattccaagggaatggtagcagtagaaaacgtaacaattgtgccaatttccaccgtggaggagttaaatagcatgatacagagggggtctgagcagcgacatacatcagggacacaaatgaacgacgagagttcaagatctcatctcatactatcaattgtcattgaaagtaccaaccttcaaagccaatcaactgcaaggggaaagttaagttttgtggatcttgctggctcagaaagagtaaaaaagtctggttcttcaggtagtcaacttaaagaagctcaaagtatcaacaaatcattatcagcactaggagatgttattagtgctttgtcttctggtggtcaacacataccttacagaaaccacaagttaactatgttgatgagtgattcacttgggggtaatgccaaaaccctcatgtttgtgaatgtatctccagtagaatcaagcttggatgaaacacataactctctaatgtatgcgtcacgagtgagatcaattgtgaacgatccgagcaaaaatgtttcttccaaagagatagctcgactaaagaaaatgattgcatattggaaggagcaagcaggtaggagaggagacgatgaagatttggaagaaatccaagaagaaagacaaactaaagagaggactgatggtaggcattctatgtag

SEQ ID NO: 93536 - DNA, 2023 bp, Glycine max
  Peptide Sequence Number=SeqID_210314
caaccaccccatgtgcgctttctccgccgtcaccgccatcctcctcctgttcccggcggcgacttcccaggcccagattctcaaaaaggaaacctactttttcggtcccttcaaccagtccgacttcaccaccttgacggtgctgcccagcgccgccatcaacctcggcgccctccaagtaactccggacagcaccggtaacgtctccctcgccaaccactccggcagaatcttcttcaacaaccccttcaccctctgggataacgacgacaacttaaacggaaaactcgtttccttcaacacctcctttctcatcaacgttttccgtccccaaaacaaccctcccggcgaaggcatcaccttcctcatcacggcttctaccaccgtccctaacaacagccacggccagttcctcggcctcaccaacgccgccaccgacggtaacgccacaaacaaattcgtcgccgtcgaacttgacaccgtgaagcaggacttcgaccccgacgacaaccacatcgggttagacattaacagcgtcaggtccaacgttagtgtttctctgactcccttggggttcgagatcgcgcctaacgtcacgcgcttccacgtgctgtgggtggattacgacggtgaccggaaggagattgacgtgtacatcgcggagcagcctgataaggatgctcccatagttgcgaaaccggctaagccggttttgagttcccctctagatcttaaacaagttgttaacaaggtttcttattttgggttctctgcttccaccggtgacaacgttgaactaaactgcgtgctgaggtggaacattaccattgaggtttttcctaaaaagaatggaattggaaaagcgttgaagattggtttaagtgtagggttgactatggtggttcttattgtggcgggtgttgttgggtgggtttgttggttgaaaaagaagaaaaggggaaatgagtctcagattttgggaactctcaagagtctacctggaactcccagagagtttaggtatcaggaactgaagaaagcgactaataagttcgatgagaagcataagcttggacagggtggatacggcgtcgtttacagagggacacttcccaaggagaatttggaagtggcggttaagatgttctccagagataagatgaaaagcactgatgatttcttggctgaactcaccattatcaatcgcctccgtcacaaaaaccttgttcgcttactggtatacgattacatgcctaatggtagtttggacaaccacattttctgtgaggaaggtagcagcacaaccccactaagttggcctctaaggtacaagatcataacaggggtggcttctgcattgaactacctacacaatgagtatgatcagaaagtggtccacagagacctcaaggccagcaacatcatgctggattcggacttcaatgcccggttaggcgacttcggcttggcgcgggcattggagaacgacaaaacatcctatgcagagatggaaggagtgcatggcacaatggggtacattgcgcccgagtgctttcacacggggagggcgacaagggaatcagatgtttatggttttggagcagtgcttcttgaggtggtgtgtggtcagagaccatggacaaagaatgaggggtatgagtgcttggtggattgggtatggcacctgcatcgtgagcaaaggatactggatgcagtggatccgagacttgggaatggttgtgtggttgaagaggcagagagggttctgaaattgggactggcatgctctcaccccattgcaagtgagagaccaaagatgcaaacaattgttcagatcatatctggttcagtgaatgtgcctcatgtcccacctttcaagccagcttttgtgtggccagctatggatctttcaagccctgcaagtgacctcacaacaccaactacaacaactgagtacacacccatgagcagtgacacacattctatgcatgttcaattctctgatagcaactctctgatctaa

SEQ ID NO: 93537 - DNA, 432 bp, Glycine max
  Peptide Sequence Number=SeqID_210315
atgcatgtcttacagaagctaattgcttatgttgctcttccgattttagtatcagagactattcaaagacctgtgctcgtgcgctccagatattatgatgaagcaaaaccgtggaatgaaaggtgtgatgttgcatttgcttatgcttcacagaatgaaattgatcaatctgatgccattaatttggttaattcaggttgtcgtatactagtagaaggttcaaacatgccttttacccctgaggcagttcagattctgaggaaagctagtgttctcattgcttctgcaatggctgccggggttgaatggatgagatttttactttacttttcctatgttgtggctggagaacttgaactgaatcacgaatgcagtttgatgcactggtcaccagaggactttgaatctaaattgcaagaagcaatggagtag

SEQ ID NO: 93538 - DNA, 297 bp, Glycine max
  Peptide Sequence Number=SeqID_210316
atgaggctgagaagagagttagttataagtagcagtagttgttggggagggagtgataagagagaagagttggtcgagatcaggggggtggaagtagccattcatgggcgggtctcttttccttccaaacgaaaacggcttcttctttgggggcggcgggggagccaacgccggggggatacggcgattcggcgtggaacaacggccacaagcgccgccgttgatctcttcttcctctacagcgttcatgttcatcatgcaataagtaacaagtctagagagatgcgagttatttaa

SEQ ID NO: 93539 - DNA, 522 bp, Glycine max
  Peptide Sequence Number=SeqID_210317
aaattgcacaacccccttacctatgatgaaactctaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagactgtgatgataacatctcctcctgggaggcaactattacggatctgctgtttcatgtcgatgatctaaggcagaaaattgtgacagagcaggccaaacgcaaggaactccaggagaaggccgctaactcgatccagaaactggttgatgaaaaagggagggaaggcctgaaggcctttagcgcatctcaggctgtagcagatgaggcaaaggttttggagaatgctgaccaggtcttaactaaagagatgacctccttgaaaaaactgtatggggatttggtcaagaatttgtag

SEQ ID NO: 93540 - DNA, 2046 bp, Glycine max
  Peptide Sequence Number=SeqID_210318
atgccaggggtggtatctgtttttcccaatgctaaaagaaagcttcacaccactcattcatgggatttcataggacttttgggcaatgaatcaatggagattcatgggcactccaccaaaaaccaagaaaatataatcattggtttcattgatacgggaatttggcctgaatcctcaagttttagtgacaccgacatgcccccggtgccccggggatggaaaggccattgtcaattaggagaagcattcaatgcttcatcatgcaacaggaaagtgataggagcaagatactacatcagtggacatgaagcagaagaagagtcagacagagaagtctctttcatatctgccagagatagctcaggtcatggtagccacacagcttccacggccgcaggacgctacgtggcaaacatgaattacaagggtctagcagctggaggagcaaggggaggtgcaccaaaggctagaattgcggtgtacaaagtatgctgggactcaggttgctatgatgtggacttgttagctgcatttgatgatgccataagagatggtgttcacattatatctttgtctcttggtcctgaatctccccaaggtgactatttcagtgatgccgtatctgtggcatcattccatgctgctaaacatagagtgctggtggtagcatcagttggaaatcaaggaaatcctggttctgcgacgaacgttgcaccgtggattatcacagttgctgctagctcaatagataggaacttcacctctgatatcacactagggaatggtgttaacatcacgggtgagagtctcagcctcttaggaatggatgcatctagaagattgattgatgcatctgaagccttttctggatatttcactccttatcaatccagttactgtgtggatagttccctgaataagaccaaggccaaagggaaggttcttgtgtgtcgacatgcagagtattcaggggagtcaaagttggaaaagagtaagatagtgaagaaggcaggtggtgttgggatgatactcattgatgaagcaaatcaaggtgtttccaccccatttgtgataccttcagctgttgttggaacaaaaacaggagaacgaattctatcctatatcaatagcacacgtatgcctatgtcaaggatttccaaagccaagacagtgctaggagtccagccggcaccccgtgtagcagcattttcttcgaaaggacccaatgcattaaccccagaaattttgaagcctgatgttacagctcccggattaaacatccttgcagcatggtctccagcctcagctggaatgaagttcaatattatatcaggaacttctatgtcttgtcctcacataactggaattgcaaccttggtcaaagctgtgcatccttcatggtctccgtctgctatcaaatctgccatcatgacaactgcaacaattttggataagcaccaccaacccattagagcggatcctgatagaagacgggctaatgcttttgattatggatcagggtttgtgaacccttcaagagttctggatcctggtctcgtctacgattcacatccagaagattttgttgcattcttatgttcacttggttatgacgagaggtcactccaccttgtcacaggagacaacagcacatgtgatagggcattcaaaacaccatctgacctcaactatccatctattgcagtgccaaatcttgaagacaacttttcagtaactcgagttgtgactaatgtcggaaaagcaagaagtatatataaagctgtagtggtgtctcctgctggagttaatgttactgttgtgccaaatcggttagttttcacaagaataggagagaagatcaagttcactgtgaatttcaaagttgttgctccctcaaaggattatgcatttgggttcttgtcatggaagaatggaagaacacaggtcacgagtcctttagtgatcaaggttgcaccagcaagtcatgggttgcttaggagatgtgagatccctgtagtcactaagactagaacaaccctgtcttag

SEQ ID NO: 93541 - DNA, 1188 bp, Glycine max
  Peptide Sequence Number=SeqID_210319
atgtctgtttctgcgtcacaaaccgaagaacaagtctcaactaggaaaccaacaacactgtgtgaagaatgcaaatcaaacccatcgaaatacacgtgccctggttgctccttacactcgtgcagtcttccatgcgtgaagtctcacaaagaccgaactgggtgtagtggcaagaggaaccagacccagtttcttcctctttccaagttcgatgacaatgtcctattatctgactataagttgctggaggaggtgaagagggtggctgaatctgctcagagaatgagaaataaattgggcatttatgcatattttaggttacctcgttaccttagaagcctaaagaatgctgctgggagcaggagaaccaaactgttgtttctccctaacggaatgtcgagaagagagaagaatcggtctcaatatgaccagcgagttgatgaaaatacaagcttttactccattctagagaagcacctcaagcctggtccttggaagaatcagctaaggcaattttgtgaagtccagctggattgtctaaagcttttcattcgtaaatacccgaaaggtcccaagtcatctttcaaggagttagatataaaagcgccaatcagacagcaattagcaaatatagtcattttggagtttcctgttgtttttgttttcttgccatctcacagaatcaattttgaagttattaaggatgtcaataccagcaaacataaatcactgcagaaagattgtgaagacaaccaattccctcaaggtttatcttttagggaggaagtgatagaagatgacaacaactctgcagatcctcaggtttttgatctcatgaagcaagtggaatcaagtttatcacatgaagtgatgacccaaaatatgagttctgagaaagcaccaaatgattccccagagaagtctctgtttgaaggagcttctgggggtaatctttcacattctttgacggaaaccaatgaactaaaattctctgaagatatgacatttgactttgatcaggatttgatggatttctatactgatatcttggatcaaacaaatcctggtgatctttttgattttgatggtgaattttcaaagaaaacagaaaatgaaatagatttaattggtactagtgatttattccctatgccagaggaattggaggaaggggaaattttagaataa

SEQ ID NO: 93542 - DNA, 855 bp, Glycine max
  Peptide Sequence Number=SeqID_210320
atggaagaagagttcgaggtgatcgaggttgaatacgcgcctctttgcgagggtcatgagattgatgttgattacgagttcgatgcacctcagttcttcaatttcaaacgccaattagaaactttttgggatgctactgaagtagagcaatggtttgaatttgccccaagttacccaccttcaccgtttctcttgaagacgaaatggggaaattgtggtcctagcatagagaccgaacaagtttcaaatattgaggagaataatagcacaggactcgagtattgtaatgaaacaatacaagatacactaaatggtaacacaaagcctcttagcaagtcaagttcatcaaaggctaaagaattctcttttatgaaaccaacaaccagtcatttagccaaacaaaagaacccttcagaagttcagaaccctcaacatttaaggtttcaaagacaaaattcttctcccatagatggccaattaaccaaaaggcaaaagcttggatctggttacttacgcaaggttgctcgtttgaagcatcacattatttttacacataagaagactaaggaggttgatcataatgatgccaatttagcatctaaatcaaatgttaccattgctaaagaacctaatttgatgacagctcttagggcacatagacacaaacctacacaatcaagttctcaggtgcttaaagcaaaatccttaaataaaaaaattttggagggtccaacaaaaatcttctccgagatgaaaacaccacaaccaacacagtttcaagtgttccacttgagaacatcacaaagggcaatgcaaaacacgtataatagcgttagtcacttaaatttgctttag

SEQ ID NO: 93543 - DNA, 288 bp, Glycine max
  Peptide Sequence Number=SeqID_210321
atgaaacgaggaagcaaatgtgaacgtggagtagtagtggatacaaaggttaatagtagtgggcaaaggttgagacttgagatgatgacagatagagaaaaaagggacagttgcttttgtagcatgacaaagcaaccgcaaaatctctcatatttctgtgaggccgttaaaagcaatgtattatatataacacactcaatcaaccttagtggatggagatttagatgctgtacatgtgaagaacaaataaacaaactgttcaaagagtcaagtcagaagaagaggtga

SEQ ID NO: 93544 - DNA, 192 bp, Glycine max
  Peptide Sequence Number=SeqID_210322
atggttcaagttgaaggagtggggggacattgtcatgaaattggtggagtggcctatgggatatggatcaagttgaagaagtcagagaccttaatatgggtggtctttgtagagtgtcctaagcctatggttcaagttgaaaaagtggggaccttgatatggatttggtggagtagccagcgatttgtctag

SEQ ID NO: 93545 - DNA, 408 bp, Glycine max
  Peptide Sequence Number=SeqID_210323
atggaactcatgaggctaaatcaacatgaggaaaataacaagaaaaggaaaggaatcgcacttaaagcttcatcttcaattcaagaaggaagtgataaagaagatttgaatgacatagaggaagatgatgattttagtttcttcgtaaagaggttcaataaattcctaagaaacaaaggaaatcaaagaagatcaaacttcaaacccaagaaaagaggaaaagattcatcctctcttctaaagtgttatgaatataatcaaccaggacatctgagagttgattgcctaaatttcaagaaaagaatagaaagatctaaaaataaaaccttcaatgataagaaagcaaagaaagcttacatcacttgggaagacagcgatatggattcattcgaagactcaaaaaaatga

SEQ ID NO: 93546 - DNA, 228 bp, Glycine max
  Peptide Sequence Number=SeqID_210324
atggagtgttggtgttgtgatcacagtggatccaaacaaaatgtcatggcttcttcactcaatagtgatgattgtgatggggaggaacgagtcaagagtggtgtagtgtgtggttggttatgttatgcgagtgtagacagtggaaatgaagctcagggagccaaggaaaaagaagcttataagcattttgaaaatagcccttgcattttgaacgattgtttgcattga

SEQ ID NO: 93547 - DNA, 936 bp, Glycine max
  Peptide Sequence Number=SeqID_210325
atgtctttcggtgggttaagtattgctttaagtcttgtatttgggtgtcttctgctggctctgtgtgctcagctttactacttcttatggtggaagaagagaaggacacagatggatattgagatggatgcaaaaggggtgttttattgggggtgctggaaggccaccccttgtgccatgatgcatggtggcaacaacactggaagagggggtgtgaatagcagggacatagaaagcacaacaagaagtcatcatgaaccagatatggagttggatttgctgcacaagtcctttggagaagagagtactgtggagtcagagttgatgaggctgcacaatctggctggcccaccaaggtttctcttcccaatcaaagaggaaactaaagaagatttggagtctgaagataggagcagaaaggggtcaagaacaaggagtttgagtgatctcatgttgacaattgacaccccttttcttacccctgtggcttcctcgcctttgaagtgttgttctctgcctgtggaccctcttcattcttataagcatcaaggattcaaccctctctttgaatcctcgactgaattagactacaacaggtttagatcctcgccacctccgaaattcaagttcatgagggacgcggaagagaagttgcataggaaattgatggaagaggcggcgaggagaaaggctgtggataatgtccaagaatgttgtgggcttattaaagattcttgttctaatgaaacattggccacggattttagtgacggctcctttcttaagttcattcagaacaacaaagacacaacaacagaacgcaaacagcttcaacaatatctaccacagtttccttcaggttcatctcagattctcccgttggcatcttctcctacaacattcagaccacttgaaaaggcatccgttgtgcattag

SEQ ID NO: 93548 - DNA, 594 bp, Glycine max
  Peptide Sequence Number=SeqID_210326
atggaagaagaggttgatattcttcgagacaaagtatcccagcagctaactccagttaaggaagatataatcatttatggtgcccgtgtgagcacaaaggggagtagtgctgagactattgtgaatctctcaaggaaggagccttactcagatatcatccctacaatggggttatatgttgatgatgactattctacctgtctggtggcactaggaaaagtatatgaggaggtatcaaccatacaccacgtgtatttgaccaatgatgtggtcaaggtggttgttgaagaagttcgagatgctgacgctcaagtcccttttcctgctttagaggattcacaaagatgtccaaagaagcaggtaggatatgttcataggtcaaatcccattagtgatcccttagctgatttgattaagaatttgtttgacctttacacgaagcctcttcaagtgtcatgggacacaactacatttggggttcacaatgaggattttcccttattcgtaatgttaactgatgtaaatgaaataatcttagcaacaatgtttgatcatctctatgttatagttgtggacaatgtttatcatgaatga

SEQ ID NO: 93549 - DNA, 1032 bp, Glycine max
  Peptide Sequence Number=SeqID_210327
atgactgacacagaaatgatatcatttactttacgtcggctgaaatattctttgttgttcttggctgcttttccttcactcctaagaaaatacattaaggtggtccttcatttctggggtactggtggaggtgcccttccggttgtttcgtttctatttatgagagatttatgtatccgtattggatctggctgcatagatgaatgcttcaaaggaatatataaagcttatgttttgaattgccactttgtaaatgctgtgaaacttaaacatatccgttttcttggaaattgtgtcattgaacttcttggcgtggatcttccaactgcatatcaacatgccttcacttacatccggcaactggctacaattttaagggaggcacttaatacaaagactaaggaatcttttcggaaggtttatgaatggaaattcataaactgccttgaactttggactggggctatctgtgcctacagttcagagtctgactttaagcaacttgcatatccattgacccaaataatttctggggtagcccgtctagttcccacggccagatattttccccttaggttgagatgtgtaagaatgctgaaccagattgcagcttctacacattcttttataccagtgtctatgcttcttttggacatgctggagatgaaagaattgaatagaccccctacaggaggtgttggcaaagctgttgacttacacagtatactgaaggttagcaagctgaccctaaagacacgagcatttcaagaggcatgtgttatttctgtggttgaagagcttgctgaacacttggcacagtggagttattctgttgcattcttggagttgtcttttattccacttgtgaggttgcgtagcttttgcaaatcgaccaaagttgagaggtttcgaaaagaaatgaggcagcttatacgccagattgaggctagttctgactatgtgaatggaaagcgcctgtcaatttccttttttcctaatgaccctgcagcagcatctttccttgaggtttga

SEQ ID NO: 93550 - DNA, 156 bp, Glycine max
  Peptide Sequence Number=SeqID_210328
atggttttgagcaggagtaaatatatgatgccatgcacattgcatagtgccttattagatgacctcgggaacgtaggacagagaagagctattgcgccattggaagggaaaggtgagatcgaggaccagctagctaagctatgctttgggaattga

SEQ ID NO: 93551 - DNA, 600 bp, Glycine max
  Peptide Sequence Number=SeqID_210329
atggcgtcacaagcaagcctcctccttcagaagcagctcaaagatctttgcaagaaccccgtcgatggcttttccgccggtttggtcgacgaaaccaacatttttgaatggagtgtgactataattggacctcccgatactctttatgaggggggatttttcaatgccattatgagctttccacccaactacccaaatagtccaccatcagtgaaatttacctcagagttatggcatcccaatgtgtatcctgatgggcgagtttgcatatcaattcttcatcctcctggtgacgacccaaatggttatgagcttgcaagtgagcgctggacgcctgttcatacagtagagagtatagtattaagtatcatatcgatgctttctagtcctaatgatgaatctcctgcaaatgttgaagctgcgcaacctttccctcagtcctatcttatggctactatttgcatcctagaaaagaaaaggtatttgatatgtggagaaattctgactagtccaagatttgtgaagcacagaaacaaagaaaagcatgggaatgcttcttttagtacaatttcagcaggcttggcaatggaatggggctag

SEQ ID NO: 93552 - DNA, 381 bp, Glycine max
  Peptide Sequence Number=SeqID_210330
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctccaaaagagctctaaaatctgaaataattggacccaaccttggcccatgggctcagaaatctaccctaaggttcatgagaaccctagggccttcttcaacagctctagcccaatcttcttggagcctcttgctcatggttctagtgattggtcccttcctagggaggattgcatcagtggtcctcacactccttctctacacagtagtgtgtcttgtataa

SEQ ID NO: 93553 - DNA, 1305 bp, Glycine max
  Peptide Sequence Number=SeqID_210331
atggaatttagctggagaattgttgttggaaccttgattggaatcttgggagcagcatttggaagtgtagggggagttggtggtggtggcatctttgtgccaatgctaatcctcattattgggtttgatccaaaatcagcagttgctatttcaaagtgtaagcatttctctatctctgtcagcattttctgtccagaaatgatgctgacattactaattattggatttcctgggaagaaactacttgttgataaactagttagggcctgttttggtatggtcacaggtgcagccatctcagcagtattcttctgcatgaagcaaaggcatcccacacttgatgaacccgttatcgactacgatttgatgttgctaatacaaccaaccctcatgcttggaatcagcataggagttattttgagtgtaatatttgctgattggatggtcacaattcttctaattattctatgtatagtgacatcaatcagggcattcttcatgggtgctgacacatggaaaaaggaaaccaaaatgaaagaggaatctcaggagactatcaagctttcagagtctactgctacttgcagtgaggaagaaggatacaagtatcttccaggttgttcagatgaagggtacgaaaaggatactagaaaacctgagttattatatgccataaaggaatgcaactatccatgcagggattcactattgacagaactatacagtttcctgttcagtcacatactggatacttattttgtcacaggattttatttgtaccaagcaagagccctatatcaggggagagctgcaggatctcaacacacacattggccattgcaccatctatttctagctagcatttgttctctgttagctggaattgttggtggacttcttggtacaggttctggatttgttatgggtcctttatttctagaagtgggaattgctccacaggtagcaagtgccacagccacttttggaatgatgtattcatcatctttatctgtcatacaatattacctgttgaatcgttttcctgttccttatgctctcttccttactcttgtggctgcaattgcagcattcctaggacagtatctcattgacaagcttagtgaaggctatgtcttattagatttttcgtttttatttagaagcttatccgaacaaagttcttgttctgcttcctttgcattgccttgtgagaatctgcagcattctaacattgctttcacttctatgcctgtctataggtggagtcggcatatcaaacatgatcttgaagattcaaaggaatga

SEQ ID NO: 93554 - DNA, 615 bp, Glycine max
  Peptide Sequence Number=SeqID_210332
atggctgatatatctctctgctgtcaggtcctatcaagaccattgctagccctttcaattgcaacattatttcctgatctatcaaaatgtagtgatggcaagtcagattgtagtactgattcacaagatgcagttgcatactcagaattatctcctttacaggttgatttgaatacaagccagtgtttgacagatcctaaaattttagaatctgagaaatggttgactcaactctatcaagagcttgaaaatcaagggcttagtttaccagaaagcctatatgatggacacatgtatattcatatttgtttgtatgaaaaactttttggaacactaagcaacacttctgactttatattgtgcattttgagtcaggtactaaaatcagggccaggaattgtcttttcagttagcaatagcatgtttactgcatatttcttggtttctcctgttgcaacagaccatgatttagtaggtttttatgcagaatcaatgatgatgagcttcggagattttatgcagcttctaataatgatttttcatgcttccttacctcaatcaagaagaccatacgatggcgagagacttacagaattctttcagaagaagaactga

SEQ ID NO: 93555 - DNA, 243 bp, Glycine max
  Peptide Sequence Number=SeqID_210333
atgaattcaagaagaaggttagccgatgtgtgcggaagtcacaagaaatgttgtgatttacagcttggattctcatcttccttttgtgaacagaaggatatacaacttaatgtgtggattggttcacctgttactgttgaaccgagtatagtgccatttgtcttggaaaaaccaactgcacttctttacctgtatatggctgttttccctagcgcttcagtactttgtttacttggatggtag

SEQ ID NO: 93556 - DNA, 1284 bp, Glycine max
  Peptide Sequence Number=SeqID_210334
atgagactgatgaatatgccaccattgtggcgagagtgcctctcatctgcgttccgaaccgccctagcgtgcaccatagtgggttgtgtgaccctctatggtccttcttccatttgcaccctcgtagcattccctgcattctcatacgtcacagccattctcatcatcataaacgacgccgctttgggagacgccttgcgtggatgttggctcgcactctatgccacctttcagagcatgggccccgccatgttgagcttgtgggctgtcggaccaggacggttctctaaagccaccagcgctgcggcggtggcgctggccgcatttgtggtggttcttccctggcctcagagcacgcatttgatagctaaacgtgtatcgttgggtcagatagtgctggtgtacgtggtggcttatgcaaatggtgttcacactgatcctatcatgcaccctataagcttggctgctagcactgccttaggtgttcttgcttgcgttgtggcattgctgcttccttatccgcgtcttgcttcctcccagatgaatcaaagctacaagcgattaaccaaaaatatcttgaagagattgaagcttcttgtaaaagtgatatgcgaggaggacaagattactgcggtcggattaatgtctcatgccaagtctttagtaactaagcgaaccaagctcctttctatcatcattcgctacaatgagggcatgcaatgggagagacttccaattaaaattttcagatcacattgcttgagcctaatagagagacttcaagaggtagataccaatctaagagggatggagttggctttagcttgcaccaattcattcccaatcaacattctcgaccaagactttaaacatggtcttaatagccttgaggagcatgttaccctgaccataaaacaagctaaacaaagcttacgtgacggttcactaactgtccccgaatctaatgcaaaaaccacaacccattttctccaatcccttcacaccattccaacaacttaccaagaattatccatttgcttcttcttattttgcgccaaactcctccacaagaaatcattgaccgaacctccaacttgtactcaagacctactcgttaagaaaaatggaaattctccgaaagaaaagttggctaatttgatagcaacgttaagaaatacaaatcttatgccagcaattaaattctctctctctttgggcctctcagtgttcatgggcttaatatacagcaaagaaaatgggttctgggctgggcttccagtggcc

SEQ ID NO: 93557 - DNA, 600 bp, Glycine max
  Peptide Sequence Number=SeqID_210335
atggcacagagagagttaattgagttaaaccaccaggattgggctaaactgatgcaacaggacaagttctctatgacaactatttacaggctgcttttgaaggaagagatttatgttccatggaggtttttgatgcataacaatcatgcaagaccgctagcaaaactgaccctctggatggtctgtcatggtagactccctactatggacaggctgcatagatttggtatgatccaggaaacaatttgcaaactgtgcaaagaaaagaatgaatctctaactcacttgttctttgagtgtggtatgacaaaaactgtttgggaccaggtgctccattggctaaacttgaatcataggattaaaggttggaatgaagaacttgattggattatctcccaaacaggaaaaaagggttggcgggctagtattctgaaactcgctttcacggaggcagtctacgggatttggcaccacaggaatgggactgtttttgggcatacagtatctaataacttagttaatgatattattgataatatagtttacagggggtggtatacaaataagctgaggaagcatattgctaatctgttattatag

SEQ ID NO: 93558 - DNA, 591 bp, Glycine max
  Peptide Sequence Number=SeqID_210336
atgtcagaacaacattgggttgctgtcaaaagaatcctcaggcatctaaatggcacacttcattttgggctggaactggaacccattttttctacaaagcactactctgttcatgccttttgtgatgctgactgggcttcagatcctgatgatcgaaggtctacctcaggtgctgctgcgttcttaggcccaaatcttgtctcttggtggtccaaaaatcaatctattgtggctaggtccagtaccgaggcagagtataggagtttggctttggcaacagctgaagtaacttggattcagtccctgctgacagagctcaaagttcctcatgctccaccagttattttctgtgataatatgagtactgtgtcccttgttcataaccctgttctacactcttgcaccaaacatattgagctggatttgttctttgtcagagagaaggttctcggcaaacagcttcaggttgtccatgttccagcagcagaccagagagctgacatccttaccagagctgtatctccctccaattttctaataaataggagcaaactcagagtggttgaaaagcattctgccaaccactgctga

SEQ ID NO: 93559 - DNA, 1011 bp, Glycine max
  Peptide Sequence Number=SeqID_210337
atgggcgcacagaagaaaagggtttcagaggaccccgacgaactggtgcgggttccgttgcaggccattctcttggctgatagtttcaccaccaagttcagacctatcacactcgaacgccccaaagtgctgctgccgctcgtgaatgttccgatgataaattacacgctcacttggctcgaatccgctggcgtcgaagatgttttcgttttctgttgttctcattccaagcaggtcattagctacctcgagaaatctgagtggctctctcaacctaattttacggtgacgactgtagagtcgcagaattctgtcagcgctggagatgcgctacgtgtaatttacgagcgcaatgtgatacatggagactttgtccttatcagtggagatactgtaagcaatatgtctcttactcaagcacttctagagcataaagaaaggaagaagaaagatagtaatgctgtaatgactatggtcattaaacggtcaaaacctaatccagctatccatcagtctcgacttggtactgatgagcttttcatggccattgatcctaataccaagcaacttctgtattatgaggataaggcagaccaatcaaaaggaaaactacatcttgacaagtcattgctttttgataatccttcactctctctgcatcatgacaagcaggattgttacattgacatctgctcacctgaagtccttagcctatttacagacaattttgattaccaacatctacggcgtcattttgtcaagggattgcttgttgatgatataatggggtacaaaatttttgttcatgaaatccactcggattatgctgcaaggatcgataatttccgaggctacgacaccgtcagcaaggatataattcatcgatggacatatccactagtgccagatgtaatgaattttggaaacacagctactaaactcgaacggcaaggaatgtaccgtgcttcgggtatggatgaaatttttagtttctattgggcatgctggtga

SEQ ID NO: 93560 - DNA, 1707 bp, Glycine max
  Peptide Sequence Number=SeqID_210338
atgaaaccatcccctaagattctcattggttacaagaattcaactttgcttgcaagatgtcaccattctcttgccatgtctatgtctaactactctaacccttgtagcatcaatcttgatcacaacaccatgcagtgcccttttcatacgcgcgaatttggacgcataatgcatggtaaccaacaagtttttgggttaccctcttcgagttttggccaatcaaggtcccttagtttaagtgcaacaagaaccgcaaaacggggtgcctctgccattgcccgagttgacttcaacttcaaggctcgtgacttctcgggctcggtcgggacacgcgccagtggcaacaatggtgaaatggcttacgttaagggcggcatgaatgtgaagccaatagtggtggaaagtgttgataatgttgaggaagagtctcggttagaagttggtgaggaagacgagaacacagagaatttgggtggtgtaaagaatgcagatgacgaggctgagaacgtagaagaggaaacagaagtggagaaagaggcatggaggttactgcaggaagcacttgtgacatattttgactcccccgtggggacagtggcagcaaatgattcagatagtgagcaatctttgaattatgatcaggttttcattcgggattttatcccttcggctcttgctttcttgctcaagggagaaaaggagattgtcaagaactttctccttcacaccttgcaactccagggtcttgtttgttgtcttgggatgcatttcatgaagatgaagttgcttgttcttgttattggtcatggatttatatcacaaagttgggagaaaacagtggactgctatagcccagggcagggcttgatgcctgctagtttcaaagttaaaacagtggaacttgatcaaggaaaaacagaagaagttttagatcccgattttggggaatcagctattggtcgtgttgctcctgtagattcaggattgtggtggataacgctgctgcgggcttatggaaagattactggggactacagcttgcaagaaaggttggatgttcaaacaggcttaagaatgatcattaacttgtgtttaacggatggcttcgacatgtttccttccctgttagttactgacgggtcttgcatgatagacaggaggatgggtattcatggtcaccctcttgagattcaagctttattttactcagctcttcgctcggcccgtgagatggttactgaagatgaaaaatccaataatctggttggagaaattaacaacagactcagtgcactattattccacatcagagaatactattggttggatatgcgaaagttaaatgagatatacaggtacaaaacagaagagtactcattggatgccacaaacaagttcaacatctatccagatcaaatccctaagtggctaatggattggatcccagaggaaggaggatatctgctagggaatctgcaaccagctcacatggatttcaggtttttcatgctaggaaatctttggtctgttgtttcctctttgggcaccccaagacagaataatgctattttgaatctgatagaaacaaaatggggtgatctcgttggggaaatgcctcttaagatatgttatcctgctttggagcatcatgaatggcgaataattacgggcagcgacccaaagaatacgtataaactcttcccttga

SEQ ID NO: 93561 - DNA, 288 bp, Glycine max
  Peptide Sequence Number=SeqID_210339
atggaagctgcagagagtaacttggctgttgataaagagaatcatgctaaagcttttgcagttccaaggaggaaagcaatgtcattgatcttatcaagttacgttctatcagaggttggtttagcattggctcaacagtctcctgtgttccgtgaatacatagacgcattcgatggttgttcattccagtacccggggagttggattcaagtccgaggtgccggggctgacatattcttcagggacccttttgttcttgatgaaaatctatctgttgaaatttcgtga

SEQ ID NO: 93562 - DNA, 318 bp, Glycine max
  Peptide Sequence Number=SeqID_210340
atgttgactccccttcttatgccgatcgcgattccatgtcccgcacctaggcaacaaagccccacacccatctcgactccgcttcccatggctggaaaaggagatggtcctgctatcggaatcgattccagcaccacctacttccccgtcagagtgtggcagcaccaccgtgtcgacatcaacctccacctacttctccaccttcacttttgttttgattgtccaaccttgaggacaaggttggcttttccagcagagggtaataatagcaatactgatggaaataacaacacaaaaagcctcataccactaccttag

SEQ ID NO: 93563 - DNA, 987 bp, Glycine max
  Peptide Sequence Number=SeqID_210341
atggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgggttgtctttgatgccaattttattcctcctcttgttcaaattcttcaacattctgagtttgacgtcaagaaggcggctgccagggccatcttctacgtgacttctgaaggatctcaagaccatatcaggtacctggcatatgaagaaggttgcattaagggactatgtgatctgttgagctgtccagacccaatggtagtgtcaacttgtcttgaggggctggagaacattttgagggtcggagacgctgacaaggaaatgggtgtcaatgtttttgttcaaagggttcataaatatgaaggatgggataagattgaaatttttatgaatcattggaacaatgagatttctctgagagctgtgaggattgtggaagaaatgaagaatgatgctagtccctaa

SEQ ID NO: 93564 - DNA, 1572 bp, Glycine max
  Peptide Sequence Number=SeqID_210342
atgtctcttggacctggttctggttctggttctggttctgagacgagaaagaaaggctataagactgcaattgtggcggaagagggtaggagaaggagggaagaggacctcatcggcatcagaaaaaataaacgtcgagacgctctcctcaacaaacgaagggtgactcatgctgtcccttcctacgatacgcttttggaattggaagctattcccgtgatgttacaacgtctatgttctcagtaccctgactcacaattggagataacttctcacttaaatactctgttagcacttgttgatcaacgccctcctattgataagatccttacggaaggtattctccctctctttgtggagttattgtcaaggcacgatgcaccccaattgcagtttgaagctctatcggttctaacaaatttagcttccggaacatctgaatacaaaagagttattgttgaacttggtgttgttcccaccttggtgaatcttctcagcagctctagtagcaataatgatatcagagaagagacaatatgcgctttagggaacattgctggtgattccccaagctatagggattttgttcttagccatggcgctctatcgccattattatctcagttggaaccagagtcattacttcagttggaaccacattcagcatgggctatgttgaggcttgctacgtggtgtttatctatcttggtctgtggataccctccggtgaagtctgccttgcctgtccttcggcgactcatccactcgaccgatgaagaggttgtagcagatgcatgctgggctctctcttacctttcagatgtcccaattaacaatattcaagatattattgaagcaggagtttgcccaaaactcgtggagcttctgctgtatccatcagatgcagttattgaacctgcacttaggactctaagaaatattgtttatggtgatgatgctcagactcagcatgtaattgatagccaactgctcccgtgtcttcaccaacttcttacacaagaacacaaaaaaaacatcattaaagaagcttgttggacaatctcaaatatcgcagctgggaatagagctcagatacaggccgtcattgatgccaatattattcctcctcttgttggttttcttcttcgtgctgagtttgacatcaaggaggacgttgcctgggcgatcttcaatgtcacttctagaggatctcatgacaatatcaggtaccttgcagctcaaggttgcattaaggcactatgtgatctgttaagctatccagacccaatgattaattcaatttgtctggaggggctggagaacattttaagtgttggaaaagctgacaaggaaatgggactgcatggtaaaggcaatatttttgctctaagggttgatgaatgtgaaggatgggataagattgaaaatttgctgactcatcagaacaatcagatttctgagagagctgcgatgattgtggataaattttggcgagagaatgatttggaagatatgaatgttgacaagaatgatggggatggtagtgatcaagatttatcttttgatttttaa

SEQ ID NO: 93565 - DNA, 1647 bp, Glycine max
  Peptide Sequence Number=SeqID_210343
atgtctgagcgaactggttctggttctggttctgacaggacgaagagaagcaatacgagtggagttgagccacacgagagtcggagaaggaaagaagagaacctgatcggcgtcagaagacaaaaacgtgcccgtttacgctatccgactttgacagctattcccaagttgctacaatctctatgttctgagtaccctgccttagaatcgcagataacttctcacttaaatactctgttagcacttgatgatcaaatccctctgattgatgatgtccttaaggatgttgttctccctcgctttgtcaagttcttggatgacgagaaagaaccccaatttcagttagaagctctatgggttctaaccaattttgcggaagcatcatccaaacacacaaaagttgtccttgaagttggtgtcattccccgcattgtgagcattctcaagtataacagcgaagtagaaatcctagaacaggcgatatacgctttagggctcattgccgattattccccgagctatagggatcgtgctcttagcaatggttctcttcgaccactattatctctggtggaatcacttccaggatcgtctatgttgattgcaaggacactttgtagtttggtccaaggaaagcctccggtaaagaatgccttgcctgtccttcagaaactcatccacacggccaatgaagaagttgtatcagatgcatgctgggctctctatcacctttcggaaggcccagaagaccaaattcaagctattattgaggcaggagtatgcccaaaacttgtggagcttctacagcattcatcagttgcagtaatttcacctgcgcttcagactctaggaaatattgttactggtgacaatgctcagaaacagattgtagttgataaccaagtgctcccgggtctttaccaacttcttatgcgtggaaacagaaaaagcatccgtatagaagcttgtttggcaatctcaaatatcacttctgggaacgaagctcaaatagaggctgtccttaaggccaatattatacctcaactggttcaaattcttcaacaagatgagttagacatcaagtcggaggctgcctgggcgatctataatgccactgctggaggatctcacgacaatatcaggttgctggcggatcaaggttgcattaaggcactatgtgatatcttgacctgtccagacctaacggttgtatcagttagtctggaggggctggagaacattttgaaggtcgtgggagaagctgccaaggaaatggtttgtggatgtgaaggattggataagattcaaaatttgctgacactgacaatggaatgcgatgagaacgaagatgatgagaacgaagatgagaacgagcacgaagagaagctagaggtttttgagatagcacataggattttgaagacgttttggccagagcttggtttggaagaaaatgaactcgagaatccgttggatggtagtctacctttcgagccatgcatggctcaggattatttttttgtcttgaaaatgtgggatacttgtttggcatattaccaaaagttgttaaccggttacatgataatacagtcagttttacttgttaaatgtcttgcctttaacgggcacagctccatgaaatgttaa

SEQ ID NO: 93566 - DNA, 201 bp, Glycine max
  Peptide Sequence Number=SeqID_210344
atggatgaactgaaggatttgatcaaacaagttgcgcctcgtgggattcccccttatggtgttgatgaaacacaaatggacgtgatgaaggtgctcattgagtctaactactggaaaaagattgggccaatagaaattttagctgttttcagtaaacttgtatcgcaaatggaagatgagttgcccttgtcgcaaaattag

SEQ ID NO: 93567 - DNA, 420 bp, Glycine max
  Peptide Sequence Number=SeqID_210345
atgggttcggttcggatcccaaagaccggcccaacagcgtcggatccacggcatagtgcttcgtattgtgaaatgaaagcagctaagcccttaggcggcggagatggatggattatcattcctcaatacatgacaagaatgtttgttatcattattcattattacgatctactcttgcctcttggagtatataggaaacccagaccggaagcgagtccacccgtgtccgagttcgaatcgccgaacacgaacaccaccggtgccttatcgcacccagtcccagccaatgctattgctgtaaaacaagacacaaacactggcagccacactgagaatgcaccgccacaacccatcatatcatttctgctgtgtcggttaccacttcccacttacttatctttgtcctatccttctatataa

SEQ ID NO: 93568 - DNA, 810 bp, Glycine max
  Peptide Sequence Number=SeqID_210346
atggagcaaactttgcagtggtggggtcctctactctcccaaaatatgttcctttctccctcaatatacaggtcatgcagttccggcgtttcaaagctcgttcccttgaacttgttaccacaggaactgattgcactgcaaacttacaaaggtacaagaaatttgatcaatgatgaaggcttccacggtgcactctacttgattgatattgggcaaaacgaccttgctgattcatttgccaaaaatctgtcatatgtgcaagtcatcaagaagatcccagtagttataactgaaattgagaatgctgttaagagtttatataatgaaggtgccaggaaattttgggttcacaatactgggccgttgggctgtcttccaaaagtacttgcactggctcagaagaaggatctagattcattgggatgtctttctagttataactctgcagccagattgtttaatgaagccctgcttcattcaagtcagaaactaagatctgaacttaaggatgctactttagtctatgttgatatttatgccattaagtatgatctcatcacaaatgccgcgaaatatggtttctcaaatccgttgatggtatgttgcggttatggaggaccaccttacaattttgatgtaagggtgacatgtggtcaacctggttatcaggtttgtgatgaaggggctcggtatgtgagctgggatggaattcatcaaactgaggctgcaaatacattgatagcttctaagatactttccatggcttattccacaccacggattccttttgatttcttctgccaccactga

SEQ ID NO: 93569 - DNA, 195 bp, Glycine max
  Peptide Sequence Number=SeqID_210347
gttgactgccaaggatgtcaagggatggctgaggatttaggaacgattgctgaggatttggagcgggtcatcaacctcaggatgatcactaaaggcactgacttatatgacatcatgactcgttgtctgaggagagctagaggtgacgccgcagatggaagtcttaggctgcgacaaagatgccgcatagattag

SEQ ID NO: 93570 - DNA, 375 bp, Glycine max
  Peptide Sequence Number=SeqID_210348
atggagtctccatctttgctgcagacaggtttgtctggtgctcccatggatgttagcagaaagccctctctttgtattgcagtcataggggccactggcgagctggcaaagaggaagattttccctgctttatttgccctctactacagtggcttccttcccgagaatgtaggcatttttggttattcaaggaaggatataactgatgaagacctgcaatctattatagcttcaacgttaacatgccgagttgatcatcagtatgattttcttaccagttcccaaattgttaccttctatgtattgcttcctgttcatggacaaatctttagcactgaagtttacactcagaacttgggaaactgcattgcctga

SEQ ID NO: 93571 - DNA, 555 bp, Glycine max
  Peptide Sequence Number=SeqID_210349
atggtgtacataaaggcaaccgatgagaagagtgcggagatggtgaccgacgaaggtataggatatgatgtgttcgagtttgtgagcctcaattttgctgttgttttagtgagtctctctactttcggttattctcttgtcttattggatttctctttcaatattggcatcctctctgtctttggtcatttggaagacaattatagagatcagcttaaggaaaactactgcatagtggagaaagggtacaattctttccctaacaggatacccggaactgcatactccaaagcactcttgagggatctattaggccactttctgaactacaaggatgaaaaaggacaaatgctaagcggtgaccaaattgctaataatgtaattggggcagagcaaatggcagtatatgaagctaatgaaggagggaagatgccattgacatggggtcagaccagaaatatgccaattactcatagggaaaagaaacgaaatatgttaggtaaacttctatgctatttgctaatttctactgctattgctataagaatatactga

SEQ ID NO: 93572 - DNA, 321 bp, Glycine max
  Peptide Sequence Number=SeqID_210350
atgcttgtgttgcttaattacaacaaagacactaagctcattgattttcgccattattccataagattacaacctgtaggtgtttcacgcagaataagaaaacttgtgcagagccatcaggttcaaatattaggttcccctggaaagcaaggtagctgcttaagtggactattcttgttggtcctcctaaacattccacatgctagacagatacaggcacaaattcaaacctctggcaatggcaagcaagctcttcagggaccaatttcaccaaaaattataatttcggaaactaaaggagattttgtacaagaaatgtga

SEQ ID NO: 93573 - DNA, 222 bp, Glycine max
  Peptide Sequence Number=SeqID_210351
atggttttgaacggtgtacttcttggaaacaattatggggtggcagctcgcgtggctagtgatatgatgggttctggcatatctcatggtggcggtggcagatcttggtggtggtgcgagagatcaccgacgacgacggtggttgtcggagagtggtggaggtgccgtgagagactccgggaaggagagtacaaagaagaaagaaggaaggcaaagttttga

SEQ ID NO: 93574 - DNA, 238 bp, Glycine max
  Peptide Sequence Number=SeqID_210352
agctttggattctgccattggaaattatgagaacttggagggtgaaaatggaataccagcaagaactaagcaaggtagtggggctttcctaggctgtgaactaggcgctaaggcaaggccaactggccaagcacttggaccagtacgtgaagaaatactaaagcaaactagaagatttaggaatcaggctgtgcatttgatttgctttttctgttcactggagagtggctctctctag

SEQ ID NO: 93575 - DNA, 243 bp, Glycine max
  Peptide Sequence Number=SeqID_210353
atgcggtgcttgatgcagacattcttaaggaattcctctagccgtttttcaacgaacttctttctgttgtcagatatcattgtatttgggatgttgaagagacatatgattcttttggaattcctccagccctttttcaatgcaaacctgcgcttaagcgaggagaggacatcgattaggcaagagtatcttgaaagagcaatattgttagtttcacttaagcaagaacaagttcaagcttag

SEQ ID NO: 93576 - DNA, 438 bp, Glycine max
  Peptide Sequence Number=SeqID_210354
atggctcttatcaccagctggtccatcctttgccaagccaaaagcaaaaagttttgcattgtaattctgtcatcaacaaaaaggaatgttagaaaagccaatatgactagcctacaaaagaaaccaaggatgtttcacctcttcagtaggacaaatgaaaagaactctatagctagaagatacatttcattgggttttagtggtcagctgatcgaggtaggaggtttgtttgctacgtcatcagtctctttgctggacttggtagacgtaatcttgcagatactgaggtacgatttcatcgaggtacgagttgatgaagacgaagaaggttaccaactcgataactactccattcaaccgttactcaagatctcccctaaggatgtggtgggtccttacattgtcaacctgtctgagctcctaaaccgtacagtataa

SEQ ID NO: 93577 - DNA, 354 bp, Glycine max
  Peptide Sequence Number=SeqID_210355
atgttggacttatatattttaaaatttcagaacccgagccctacactttcctcgcgctctctgttcttcactcttgcttcttcttcgcttcttgttcgcttcttctttgtgactgagttggtttgtggaagtcatggtagctcgaaggagttggtttgtcatcattgtcgtgggctgtttggggtgctgactttgcattccgtttggggtgctcactcgtgctcgcaaggtgtccttttcagtgagtgtgctttgtttttgttgcatttttcacttctaaaagacctagaagggtttatggggctcatgtatggggttgtgggtgtggtttgtcctattgagccaggtgcttga

SEQ ID NO: 93578 - DNA, 1695 bp, Glycine max
  Peptide Sequence Number=SeqID_210356
atggaggatgccaatggaggggaagccggggagaacgaaagccaacacggaggagaagaagccagacgagaagaaacgaagggcgcggaggaagaagatgccagacggaaagcaaatttgaaatggaagattggtaatattggtacttcattgaattgctgggtgcacctagcaacgcccaataaacaagctaggcttttaatctgcccgcgtccacactacttaactctcaagagtgggacaatcgactatgctacttactttctcaatcacacctttgcatcaaccaagaatatggaagttgaaataatctccactcagtgcatcaaaccctcttgcacaacaccaaatcacccaaatacatataatctctcaatcttagaccagttcatgccttctatatacataccaatggttcttttctactcttttgctcagagttctcaagccaatattgacagtactataactcaacaaagattgaaacaattaaaggaatcattatcacaagtcttgactcatttttacccattcgctggaagggttaaggacaagtttaccatcgattgcaatgatgaaggggttcactacaccgaggccaaagtaagttgcactctagctgaatttttcaaccaacctaatttctcgtcgcttatccataaacttgttccaaatcaaccaattatggaattagcgaccgaagggtacacagccatggtacaagtgaattgttttgcatgtggtggcatggtgataggtaccttgatatctcacatgatagcggatggagcaggtgcaagtttctttttaaatagttggggttctaattctaacttttctcatcaagatgcatttgatcaatttccaaactttgatacccctttccctcagaataataataattatgcatgcccacatgacacaaatgtgatgaatttgtgtggccaatttttgaacgagggtagggttgctatgaggaggtttttatttgatgctgaagctatttcgaggttaagggctcaagggtctagtttaaccgtgcaaaaccctactcgagtggaggtagtaacatcccttctatgcaaatgtactgcaaaagttttcaatgcaaactttggtttagagaggcctactttgataactcatgcggtaaatatgcgtagaagggcatctcctatgtttccaaaatcgtgtatgggtaattttgcatggttggctttggctttaataatgagttcaaaggacaacaaggtaataatggagttattacctgacttggttgttaaattgagggaagcagtgtcaagtatcaactcagattttgtgaaaggcttcgaaggtgatgaagggtatgctaaatattgtgaagtttcaaaagagttaattgagaaagcatcgagttttgctgcaacgaccacaagtggggttaattacgttcattttacgagttggtgcaactttggactttatgacgttgattatggatggggaaaaccaatttgggtgtcttgtgtggctgattcagttgacgattctatgttttttaacgcggtcatactaatggatacaccttcaggaaatggaattgaatgttgggtttacttgaatgaagatgaaatggccatattgcaacaagacaaggagctccttgctttttcaaccttagatccaaatcctcagcaactaaaggattaa

SEQ ID NO: 93579 - DNA, 1617 bp, Glycine max
  Peptide Sequence Number=SeqID_210357
atgatgcaccactccacggtcacttcggaacacaattgtttaccaccccaaaattctagacataattacctactgattttctctccacagaccacaacgctgttggtttttaagcttatgccaatggttaaggaatggctaaagctcaacaatgtagttaagcccagtttaggttcttacgatgatgcttttgctattgttggtgcgaaaactgttgtatttagtttcttcaatgtgctgaacctgagaagaattactcttttcttaattttcatcacatgtttgttctttcccacaattcgtggcaaacttcacagtcatgcaaacgggaagcaatggcttccaatgtcacgtatttggttaccaccttctccttcacctgaggttgttagcccaaatgccaatggaccttttgttttcaatgtaaaatcctttggtgctgttggggatggtgtctctgatgatacagaagcatttaagttggcctgggatgcagcatgtcacgccgaagaatcaggaactctttttgttccaaagggtcatatcttcatgatacaatcaactacattcacaggaccttgtaattctaaactcacttttaaggttgatggtactatttggcccccggatggaccggattcatggccattgagtagcagaaagagacaatggctggttttctatagaataaatggaatgctaatgcagggaagtggtcttattgatggaagaggagagaaatggtggaatctctcttacaaatcacacaaaggagctaatggggcaaaacagcttggaccaggtgatcgtccagtggccatcaggttctttgagagctccaatttgagagtggaaggactgaaaatcaagaacagtcctaaattccatttccgatttgatgaatgtcaaaatgtccatgtggaaaagcttatcataaagtcacctgctctaagtcccaacaccgatggaattcacattgaaaacacaactaatgtcaatattcacaattcagtcatttcaaatggtgatgactgtgtgtccgttggtgccggttgttacaatgtggacataaggaatataacatgcggtccaagtcatggaataagcattggcagcctaggaaattacaattcgcgagcttgcgtttccaacataacagtgagtgattcaattattaagcattctgataatggggttcggatcaaaacatggcagggtggaagaggagcagtgtctaaggtagtcttcaacaatattcaaatggacactgtccgcaacccaatcatcatagaccaatactactgcccctccaagaactgccacaaccaaagctatgcggtttcagtttccaatgtttcatactcaaacataaagggtacttatgatgcgaggtccccacctatgcgttttgcttgcagtgattctgttccatgcacaaacctcacgctatctgaagtggaactgcttccagctgcgcactcacagggcaagattttgaccaacccgttttgttggaaggtttatggaactgtgcagacactcacaacaccacacgttttatgcctcttagagggaaatcaattaaccttaaagcctcgagatgttgtttggtgttag

SEQ ID NO: 93580 - DNA, 738 bp, Glycine max
  Peptide Sequence Number=SeqID_210358
atgactgttaggcagcaactacttactgaaagtgtttctatgcaggttaatccacatactcaccaggtcaaaatatgcgactttggaagtgcaaaagtcttggtaaaaggcgaaccaaatatatcgtacatatgctctagatattatagagcacctgagcttatatttggagcaactgaatatactacagctattgacgtttggtcagttggttgtgtattggctgagcttatgcttggacagcccttgttccccggtgagagtggagttgatcagcttgttgagatcatcaagggatcatttgaaagaaatttcatgttttcccatgcattagcacaggttctgggaactccaacaagggaagagataaagtgcatgaatcctaactatacagaatttaaattcccacagattaaagcacatccatggcacaagatctttcacaagcgcatgcctccagaagctgttgatttagtatcaagactactacaatactcccctaacttgcggtgcacagctttagatgccttgacccatcctttctttgatgaacttcgtgacccaaacactcgcttgccaaatggtcgtttccttccaccattgttcaattttaaatctcatgttctggctgatgttcttgctgcctgtgtaccagaattgaagggagtcccagttgagattttgctgaaattgattccagaacatgcaaggaagcagtgcccgtttcttggcttgtga

SEQ ID NO: 93581 - DNA, 546 bp, Glycine max
  Peptide Sequence Number=SeqID_210359
atgtcgccaaggatcatattctgcagtgcggtttccctagcaacaatagcagttattctgttggctgtgctatcacctgtgtcccacaacaagagccattcaaagccatggttggatctatcattgtacatccaacaacctcaaatagcaacatcaaatacccacctcgtacctagggaagatgctggggctttcatctttcgccgtgttcttacggaggggccagagaagacttcacgtgtggtagggagagcacagggctttgtgatccccacggagcagtttcagcaatctgagttcaatgttatgtatctgagctttgacaccccagattgttcgggtagcctcagcgtgcaggctcttaaagacaaacaagaattcaaggtgataggagggactggttcctttgcatttgctcgtggtgtcgcacttttcactaaaactcatgattattcacaacaaagtcaagtggctgctgctgccacttaccatgtaaaacttcagcttgagttcccaaaccattccaccaagttactaaaaaggtga

SEQ ID NO: 93582 - DNA, 198 bp, Glycine max
  Peptide Sequence Number=SeqID_210360
atgtattattttatttttccaacaactgattggccaaggaaagatatgttagagtttcagcactggcatattcatttacccaaagctccaaaccttagagaagaaggcagaaagaggcaaagagcttcgaacatgacagaggcagaggtttggtcttcctcggaagaaactcttacggtgttcttcattgcagactaa

SEQ ID NO: 93583 - DNA, 942 bp, Glycine max
  Peptide Sequence Number=SeqID_210361
tcccttgtcagggtgcttgaatcttcttctggaaacactccctgctactctttggttttatttcaagacctgctagtgtccacaagtctatctcctgatgacaccataaatttattcacatatgctgtgctaaggttgactccccatgctctatcttctggaacaagttcctggtcctacttacggaaaggaagttctgcatccaatgttgccactgagtctaacatggcccatccaagctctttgtctgaaagtttttatggctcatctgatatatcctctggtgaagataaccactatcatgttgtgaggcccttacagagtgacaaatggtctaaaggaaaagatggttatcttgtcactgatttatggggtgcagaagttggtacgtgggtgtttgcctctccaacagtttggcttcaacatacaggagagaaaatgtatctttgtgtttatcagcatagaagccttactttgatgcttctgattcctgtatcatccattcctaacggggagcaaggtgtgtcggcagtgaggcagcaagttgttgaaaatgcatcacttaaaatattgaaagttgaagagaaactatcgaaaggatggggtggagataatgcttatcacgttagtgggtaccgctacttacttgtagatggtgatagaaatgtatccagggcttctccagcaacaaaagttacaactttaacaaaggagtccttacttgctatgaataagcttaggcaagaggtggagttagagaagagtagagcaaaactggatagccgtaattgtgaaaaagacttagaggagctttacatggttctagagaaagctaatgaaacccttctatatgcttcagatgctgttgagaagtttagcgacagcttaaactgttatccttcttgtcgcaagaatgatgcagagaattggggtggagggtga

SEQ ID NO: 93584 - DNA, 2283 bp, Glycine max
  Peptide Sequence Number=SeqID_210362
atggggaccgaaaatcctggtcgtccaaccttccctccttcaagacctgcttcatcgccttttgccgctgcacagacagtatcacctttttcgtcaagcggtcccgttgctggatcagagcctccttcttttcggcctagtcctccagctcctccgccgcaagccgccacgccgttttcgtcggctggacctgctgcagttagacctggggcacccagttttagacctgcaccaccagggaggttcaatgatccatcggtaccgcttcccgtgcgaccatcaaatgcctcaccggctgctgggccttttcagcagtttccgccggcaccgtcctttcccccaacaatgcaaccacgtggtcctccgctgccaatgggaccaccatcaattcaatctccacctagtcaagcacagccttttcccacgtctcttccagctcagccacagatgccttctgttccaatgggctctcccccgccacaaagtgctgctcctgcacatttaggttcaaattttcctccgccacctacaattcagccatcttttcctgggtacccgagtaagcaggctggtcctgaaatgcaagctccacctatgcattcctcattccctgctaatcaaggaaattttgggcctgtcccacctgcagcggcttctccttttttgtctcatccaggaggctatgttccaccgcctccaatggctcccccgctaggtatccagccaatgcagcagccaggatctgtgcccccaatgggtgctgttcagggcttggcagaagacttcaacgcactcacattgcaaactcgtcctggaacaatggatccgttatttgatgccaaggaacttccacggccattagaaggtgatattgaaccaaagaatttggttgacatgtatcccatgaactgcaatccccggtatctacgactcacaaccagtgcagttcctagctctcagtccttggcttcaaggtggcatcttcctcttggagcagttgtatgtccgcttgctgagcctcctgatggggttagtgcttctttaccctgtttgatgagcagaaacatactaggtcatgaagaggtgcctatagttaattttgctccagctagtgttgtccgctgcagaagatgtcgcacatatgtgaatccttatatgacatttacggaagctggaagaaagtttcgttgcaacgtctgtaccttgcttaatgatgtgcctagtgagtattatgcacaattagatgcaactggaaaaagagttgacataaatcaacgacctgaacttacaaaggggactgtagaatttgttgcccctgctgagtacatggtgcggcctcctatgccaccagtgtatttcttcctcatcgatgtttccatatctgctgttagaagtggcatgattgaggttgtggccaatacaattaagtcatgcttagatgagctgcccggctttccacgtacgcaaatagggtttgcaacttttgacagcacaatacatttttataacatgaagtcttccttgactcaaccacagatgttggtagtgtcagatcttgatgatatatttattccactgccagatgatcttcttgttaacttgtctgaatcaagaagtgtggtagaaaccttcctagatagtttgccaaccatgtttcaggacaatgttaacttggaatcagcttttggtcctgctctcaaggctgcgtttatggttatgagtcaacttggaggaaaattgttaatatttcaaaacacactcccatctcttggtgttggccgcttgaagttacgtggagatgattctcgtgtttacgggacagacaaagagcatggactgagactgcctgaagatccattctataaacaaatggctgctgagttttccaagtaccaaatctcaacaaatgtgtatgcattcagtgataagtacactgacatagcctccttaggaactctggcaaagtatactgctggtcaagtgtattactatccagctttccaatcagccattcacggggagaaattgagacatgaattgaggagagaccttaccagagaaactgcatgggaagctgtaatgcgcattagatgtgcaaaaggtgttcgcttcacaacttatcatggaaacttcatgctgaggtccaccgatttgttagcacttcctgctgtagattgtgataaagcctttgccatgcagttatcacttgaagagacattgttgacaactcagacaatgtatttacaagtagcattgctgtatcctttctttgataacttttga

SEQ ID NO: 93585 - DNA, 1260 bp, Glycine max
  Peptide Sequence Number=SeqID_210363
atgggattccaaaacttggtgttgatggcttttatgatgacattgattgttattggtcaatacgaacattgcatggctactggtcgtcttcattttcatcatcactcacacaaaaacttaaccaccaaaaaacttcatggtggtttcattgaacgaagtaacacccatttttatctcaatggaaaaccacactacttaaatggattcaattcgtattggttaatgaatgtagcatccgatccatctacaagttctaaggtcagtataacttttcaagaagcttcccaacatggtttgaatgtagcaagaacttgggcattcaacgatggaggttacaatgcccttcaaatttctcctggttcttacaacgagaatgtcttcaagggattggattttgtaatttcagaagcaggaaaaaatggggtacgactgatactaagtctagtaaataactggaatgattatggtggaaagagtcagtatgttcaatgggcaagagaacgtggtcaatatgtaaacaacgacgatgacttcttctcacaccccattgttaaggaatactacaaaaatcacgtcaagactatgctgacaagaaagaatactataactggattgacatatcagaatgatccaacaatttttgcatgggaacttatgaatgaacctcgttcccaaaatgactattctggaaaatcaattcaggattgggtgagggagatggctgcctatgtgaagtctattgataacaatcatttacttgaagtaggacttgaaggattttatggtgaatcaatgccggataagaaacaattcaatcctggatatcaagtaggaactgatttcatttctaacaaccaagttcctgaaatcgatttcaccaccatccatctctaccctgatcaatgggtatcaaactctaatgaaagtgctaaagatgattttgttagcaaatgggtccaagcccatatccaggactcaaacgacattttaggaaaacccattctttttactgagtttggaaagtcttcaaagtcttcaggatacagtgttgataaaagggacaattactttgaaaaaatatacaatttcatattcaacagtgctagcaatgggggaccatgtgcaggtggacttttttggcaactaatgacacagggaatggatgacttgcatgatggcaatgaaatcatctgtgatgagaatccttcaactgccaatgtcatcactcaacaatctaaaaagatgtcaaatctaggataa

SEQ ID NO: 93586 - DNA, 606 bp, Glycine max
  Peptide Sequence Number=SeqID_210364
atgcccaccattgacgagttgttggatgatctaggccaaacctcttggttttcgaagctcgacttatgccagggcttctatcaaattcgtattgttgaggacgatattcacaagactgcctttcgcacgcaccaggggcactacgagtttaacgtgatgatgccctttagcctttgcaatgcaccctcaactttccaggccactatgaatgatgcacttcaaccattcctcgggaagcatgtggcggtattttttgaggatattctcgtctacagcctcactttgtcttctcacacagagcaccttgaatctattttcgaaggaacgaattgggccaatagcatatcgcttacagttgccagcatcttcaagaattcattcggtattccacatctttcttttgaagccacatcaggggcccttgtcggacagtcccgccatatttttcccttctgcctcgaaccaccacccagtggtccaaccactttttatattggactggaagtgggactccttgttaacaccgccaaccaaactcgttctcgttcaatgggagggcttggccccggaggacactacttgggaacagtgggacaccttgtgtag

SEQ ID NO: 93587 - DNA, 225 bp, Glycine max
  Peptide Sequence Number=SeqID_210365
atggctaggctgaatttgtcccaccgtgagcatagtggttacctgtttcttgatttcggccttttggaaatggggatatctatagggcttgatgttgataggggtgtggtgtggaagaagaaaactagggttgggcttggattagtgtcaaatggaagaaagctgaaatgctctgtgtgtgggcaaagcgcttcaattgttgggctgagtctggtgaaggtgtga

SEQ ID NO: 93588 - DNA, 1488 bp, Glycine max
  Peptide Sequence Number=SeqID_210366
atgcctgtgagggatgttgtttcgtggaacactgttattgctgggaatgcacagaatgggatgtacgaagaggcattgaacatggttaaggaaatggggaaggaaaacttgagacctgattccttcactttgtccagcattcttcctatttttacggagcacgctaatgttaccaaaggaaaggaaattcatggctacgccattagacacgggtttgataaggatgttttcattggaaacgccatttcgtggaactccatcattgctggctgtgtgcagaatgggagattcgatcaagggctcggcttctttcgtcgaatgttgaaggaaaaagtgaagccaatgcaggtctcgttctcgagtgttataccagcttgtgctcacttgacggccttgaatttggggaagcagcttcatgcatacataattaggcttgggtttgatgataacaagtttatagccagctctctgttggacatgtatgccaaatgtgggaacattaagatggctaggtatattttcaacaaaatcgagatgtgtgaccgtgacatggtttcttggactgccatcattatgggatgtgcaatgcacgggcatgcccttgatgcagtttccttgtttgaggagatgttagttgatggagtgaagccctgctatgtggcatttatggctgttttaactgcctgtagtcatgctgggttggtagatgaaggttggaagtattttaacagtatgcaacgggattttggtgttgctcctggcctggagcactatgctgctgtggcggacctgcttggtagagctggaagattggaggaagcatatgactttatttctaacatgggagaggaaccaacaggaagtgtgtggtcaaccttgttggctgcttgtagggctcataagaatattgaattggctgaaaaggttgtgaacaagatacttttggttgaccctggaaacatgggtgcacatgttataatgtcaaacatctactcagccgcccaaagatggagagatgctgcaaaattgagagtccgcatgaggaaaacgggcttgaagaagactccagcatgcagctggattgagatggagaaagaaggttatgtccttgacacaaatgaggtgctccatgatgttgatgaggaacataaacgcgacttattacgcacccacagtgagagacttgccatagcatttggcatcattagcactacatctggcacaaccatccgtgtaataaagaacattcgggtaatgggtcttgttcctgtggagattactggtgaaataactggaaagtggaaaccaagcatgaaagtcatgcagtcaaaattgcttttggagataaagcccatgtgctctcagcttggtgaagagagggcttgggagatccaatatccaggtcttggtggatcagcaatccctcatttgtccggtgaacttggaggatgcagatttaagagtcaagaggtaaatcttggtgtttag

SEQ ID NO: 93589 - DNA, 420 bp, Glycine max
  Peptide Sequence Number=SeqID_210367
atggcgcgcttggggaaattcgtggagtggggaaagatgagggtggaatttggagtacatgttcatcaaagcgttggcggtgtacaagtcgaagtggaaaccgaggcgaatgacggcggcgtggagggactgagcgagattgaagtgtttgaaaagcgtggatgctctgaggagggaagggaacaagtggcgatcgggggagatgccgaaagagcgcaagaggttgaaggaggcgagggagtggcggaggaggccgtgagaggcgtagcatttgatgatgcaaatccaagccagggagtgcggtgttgctttggtggtcttcacgatttgggcgtggagctgtttcacgtggcacgtgggaaccaccgtgttggggttccggaggaggcttctcatcacattttggctggaactcattga

SEQ ID NO: 93590 - DNA, 789 bp, Glycine max
  Peptide Sequence Number=SeqID_210368
atggctgccaccgaacacagactaagcttggaacctgagaaaaagaaccttctcagacaccacaccgagaagcacttcacagccggcgaaatcgtccgcgacatcatcatcggcgtttccgacggcctcaccgtccccttcgccctcgctgccggactctccggtgccaatgccacctcctccattgttctcaccgccggcatagccgaagttgccgccggcgccatctccatgggtctcggcggaaaatttaattacggagcaaaaggggctaatgtttcactgtgcagttatttggcagcaaaaagtgaaactgatcactacgccagagagttgaaaagagagcaagaagaaatcatcgccgtgccagatactgaagcggcagaggtagcagaaacactggctcagtacggaatagaggcacatgaatatgcacctgtggtgaatgctctcagaaaaaaccctcaagcatggcttgattttatgatgaaatttgagctgggactagagaagccagatccaaggagagcattgcatagtgcaatgacgattgccattgcttacatattaggtggggttgttcctctcgttccttacatgttcattcaaaaggcagcagaggcagttgtgttttcagttgtggttaccttggttgcattgctgatttttggctatgcaaaggggcacttcacgggcaataaaccattcaggagtgctttggaaacagctctaattggtgccatcgcctctgcagctgcttttggtttggcaaaggctttcaatccatag

SEQ ID NO: 93591 - DNA, 783 bp, Glycine max
  Peptide Sequence Number=SeqID_210369
atgaaagaattatggaaaggggcgatggccagtattggccacaccgcacctcacgccagtggcagtattcacactcctttcctatgtgtacgttttcttcggaaaatgataagagcttcgattgaaacaacttcgtaccctaattttaccctaaattcgcactttgcgctcaccaacacacacagagtttctaaagttgctctcgctgcattcttttacaaaaccacgttctgccagaagcaatgctgtccaagcttcttcagttttggtcaaccttgtttaactttcagtttcaagaggatgacttggtcagttagaagcagcttaaatgacagcagttttagtccttctacttcaaatagcactaatggaaggactcgcataattagagtgattcaagagtttcagaccaagttaggttctaagattcaggaggtaaagaaaaatcttccattgaagctgtttttcttcttggttggattttactgtgcaacggcctttgccactgttattggacaaactggtgactgggatattctatctgctgccttggctgtggctgttgtggaaggcattggggctctcattaatctgtcactactacatttgatatatgcagaagcagaagttacacttcactgcacgaaagttggagcttgttcaagttctaagaggaaactcgactgcttcctgaccggtgacatcaaaactaagtttgatacaaataatgcaaattggcagaaaggtaatcttagtaaggagattgtggatcatcatttttga

SEQ ID NO: 93592 - DNA, 771 bp, Glycine max
  Peptide Sequence Number=SeqID_210370
atgaaattgataattttactggtacctgaaggcacgttccccgtacttccaagcctcgcgccagaaaacagaggacaacccaacaaggaacgaattgggaggaaaaaacttggggaaaaacccagatgggatttcagctctgagctccaaagaatgctcctttggggcataatgagcgacaaaagcggaatcggacacaccgggtatgggtggtgcaacgacgtaggcctcggtggggtgcaggttgccgctgctgggattaaccctaagggaccaggtggagaagcccgtggatttccacgcggagagggagagggagtcgaagaggagctgggagagggtggatttggaaacggggggaagagggaggagaggggaagagagatacctgcggaatgggttgggctggttggcccagtcgaggttgtggggcccgcgggcgtagttggtgaagctgtgcttgatgatgatgtggaaggagagggtgaagatgatgaagagaaggaggccatggcttgggattggaatgaagggggagtgaatgagggaatgagggggggtgcagggaggaaatggaggaggagtggtgatggtggtagggtggtggtggtgatgaagattgcaagattgtttccaggattaggcaaagatcgtcgtggacatggattcaagcatctcgatctccagcagtgtgagaaatttaaggaatttggagcacctgagtttcatcatgactgcgcgaaggaactcgaaattcatagtgagttcaaa

SEQ ID NO: 93593 - DNA, 195 bp, Glycine max
  Peptide Sequence Number=SeqID_210371
atgccacctcctccatcgttctcaccgccggtgcaatctccatgggtctcggcggcaaaaagtgaagccgatcattacgccagagaattgaaaagggagcaagaagaaatcatagccgtggcagaaactgaagcggcagaggtagcagaaatactggccgggtacggggtagaggcgcatgacttgatttcatga

SEQ ID NO: 93594 - DNA, 931 bp, Glycine max
  Peptide Sequence Number=SeqID_210372
atgggtgaaggcatagttgagagagcgctgaacagcttaggaaagggcttcgacttggcctcagatttcaggctcaagttctgcaaaggcgaagagcgtttggttcttctcaacgaaacagagaaacgagagctcatggtgccaggtttcagacccatcagagatgtctccgttgacatcaaatgcgacaagggcgatcgcacccgctaccaatccgacatcctcaccttcacccaaatgtcagagctcttcaaccagaaaagttcaatccctgggagaattccatctgggtatttcaacaccgtgtttggatttgacgagggttcatgggcaactgatgcagctaacacaaagtgtttgggtattgatggctactttatcaaactcttcaatgctcatattgatcggtaccctcttgttctgtctcaacaagtccttgaagccgttccttcttcctgggatcctcctgcacttgcaagattcatcgagaacttcgggacacacatccttgtggggcttagcattggtggcaaagacttagtgttggtcaagcaagacgtgtcttccaacttggagccatcagagctcaagaagcacttggatgagcttggaaatcaattattcaatgggacatgcaatttccttccaaaatccaaagaacaaaaatataaggcaccgcaagcttttgatgtcttcggtccacaaattgttgccttcaatagctctacatccgtttgtgcaaaagatggaattacggtgatatgtgcaaaaaggggaggagatacccaagtgagcgaccatagtgaatggcttctgacagttctaaagaagccagatgctgttgattttagcttcattcctatcacttctcttcttaaaggtgctccaggcaaaggcttcctatcccatgccatcaacctctaccttcgat

SEQ ID NO: 93595 - DNA, 435 bp, Glycine max
  Peptide Sequence Number=SeqID_210373
gagatcgaagatttcgctcgtccacagctcaccacaactcgtgagaactttgccacaactcaaccggaagtcgaccacaactcaccggaagtcggccacaacttagtcgaaactcattggaacttagcaggaacatttggagcccaccgtaggattgagaaaaaaatttccttcgactataagatggtaataacaaggaaaagcgatcccaggttgtctgcatgttccacccgggcaaagacatcaacaatgcaagaaattaaagcacagatggaacaattatgcaagaaaattaaggccgacttagaggcctcgaggcaaaagcacgaagcgaacatgttgcagttaagggaggagaatgcaaaccccagagcaaggcttgctatccatcatccacctccaccaccaaccccaccacattctccatcctattaa

SEQ ID NO: 93596 - DNA, 213 bp, Glycine max
  Peptide Sequence Number=SeqID_210374
atggtaacgacaacaacctatgatcatgatagtagtgatgatggtggcgatcatagaatgatggtgttgacaaaggtgataacactagttgtaagtgataacaatcatggtagtagtgacgatgatagcaacaatagtggtggtagcaatgaccatttaatctcatccgtgtattgtaatctaatgggtcatattaatagttctcatttctaa

SEQ ID NO: 93597 - DNA, 1674 bp, Glycine max
  Peptide Sequence Number=SeqID_210375
atggatagtgataattattcaaaagagaaggaggggatggtgttgaacatagctatcatggtggtatccatgatcgccattgcaatggtcaccgtttctgttgttgcacacatagacggttccaaacaagatgcagggaagaatgtgaagacccttctctccgtttgcaccaaaacggaggaaccagaaatctgtttccgcgtgttgaaacacgttggtgagacagccacggttttgaattacgtgaaagctgctattaatgcaaccctcacggaattgttgtttgtgattaggccaaaacctcgtcttgaaaggagcctcacgcttctgcagcaagagtcatataaagattgtttggaactgttgagtttgggaaaggaagaattagaatctttgtatttgatggcaaatttttatgtagatttgagcgaactaaacttagatgatctgttgaatagcctaagtgctgtcatttcgtaccaacacgcttgtactgatgaattgattcgaataaatagctatggggttttggggtattccttgcaagttccaattcttctcacaaggatagccttagccattgttgataatttctctgagaggcctaatagcagagaaccacgacggctagaagaatttgcaaggtggttctcagaaagagagagaaaaatgatagagtccaatcaaggagataatggtggtgaacaatggccaataaatgtggttgtggctcaagatggtagtggccatttctcaaccatagctgactcactcaatgcatgcccaaagaataaaacgattgcatgtgttatttatgtgaaaagaggtaaatatgaagagagagtcgtgattcctaagggtgtaaaagtgttcatgtatggtgatggacctgcgcataccattgtcagtggtaccaacacaagagaccccaggatagtcacaacctcctttcgagcagctactttcgtggtaatggggaaaggattcatctgcaaagacatgggtttcactgccccagctgacattacaggagcaccagcactcctagtcctttctgatcacgcagcattcttcaactgcaaaattgatggtaacgaaggaaccttgtacgctgtagctcaacgccaattctaccgagactgtgagattcttggcagtgtggacatcatcaaaggagactcagcaactgtaattcaaaactcacaaatcatactgaagcctcgaaactcctctgatttggttttaagaagaaatgtcatgagtgctcaatccaggttagacaagtatcagacaactgggctagtgattcaaaactgcaccatcacagcacagaaagaaagcatgaatactcttaatgctaccacttacttgggctccccgtatagtgaatactcaagaacaatcataatggaatcctttttaggagatgtgatacatccaaaaggttggtgtaaatggagtgacaactatggcatcgaaacagcaacattctgggagtttgataatagagggcctggggcaagaactgacaagagggtcaagtggaatggctacagtacaatttttgagagaaaccaaatggttagttacacagttggtcggtttctccaagctgaccaatggttgctaaatagaggcattccatacgaatctgggtttgttgtactgaaatag

SEQ ID NO: 93598 - DNA, 204 bp, Glycine max
  Peptide Sequence Number=SeqID_210376
atgatgagctatattgggttgtgcagtgacatacctatggcacaatatatcatcaacatgaatgcttcattgcctgcatctgacaagttcattatacatatcttggataatacccatatgtttgttcaacctcatgttgagcaaatgatacgaagtcaaattgccaagtttagagaggacaatacatatgtcaagcctaattga

SEQ ID NO: 93599 - DNA, 1497 bp, Glycine max
  Peptide Sequence Number=SeqID_210377
atggcttccacaatattcagaagcctccaagttcacccctttctgctttatccaacaacattcctcagacgaagaaatgaggtttttcatttggcgtccaaagccacacaatcccaaacagacacccaacagaccaaggttacaacaagcagcacacagtccaaaaagctcgacaaaatccccaaagactatgaagccatcattgggattgaaacacatgttcagctctccactctgaccaaagccttttgtggttgcccttacagttatgggtctccacccaacagcagcatttgccccatttgcatgggcttgcctggtgctttgcctgttttgaactccaagatcattgattttgctgtcaagttgggccttgctcttaattgcaacttggctttcaactccaagtttgacaggaagcagtatttctaccctgaccttccgaaagggtatcagatttctcagtttgatgtgccaattgccactgctggttttcttgatgtggatattcctgttgagtttggtgggggccacaagaggtttggcattacaagggttcacatggaagaggatgcagggaagctcctacatgcagagaatggaaattactcacaggttgatctaaatagggcaggggtacctttgcttgagatagtttctgagcctgacatgagaaatggtattgaagcagcagaatatgcggcagaattacagaggttggtgcggtatttgggagtgagcaatggcaatatgcaagaaggttctcttcgttgtgatgtaaatgtatcaatacgacctattgggcaatcaaagtttgggacaaaggtgcaactccatagtcaaggccgggaagatcagatagtacaagaaactcgtttatgggaagaaggctctcaggctagtgctatagtaacaattacaatgaggaaaaaggaagggcttgctgattatcgatattttccagaaccagaccttccagcagtaatcctttctcaagaatatgttgatggtataaaaaattctttaccagagcttccagaaattaagcggagaagatatgagcagatgggcttaagcatgcaagatgttcttttcctggctaatgataaaaatattgcagatttttttgatgcaactcttgcaaaaggtgctgacccaaagctggttgccaactggataatgagtgatattgctgccttcatgaaaaatgaaaagttgaccataaatgagataaagcttacacctgaagagttgtctgagttgatagcttccattaaaggtggaaccattagtagcaagattgggaaggagatactatttgagctattagccaagggtggaactgtgaaggaactcatagaaaaaaaggacttggttcagatagcagatcccgttgagattgaaaaaatggtggacaaaattattgcggacaatccaaaacaggtagagcaatatcgaggaggcaaaactaagctacaaggtttttttgctggccag

SEQ ID NO: 93600 - DNA, 171 bp, Glycine max
  Peptide Sequence Number=SeqID_210378
atgaaggtgcaagggtggttttgcgacaggcacaagactggagtcgggagtgacgttgggattgttgagttcaactttggttgggatggggcatgcacggtggttttggtatttgtgagtggtagtggggacattatcaactccctttatatattttgggttgtagtatga

SEQ ID NO: 93601 - DNA, 711 bp, Glycine max
  Peptide Sequence Number=SeqID_210379
atggccaaaattccaactcaggagaaggttcccaatcaatgtcctgtcgttcttaaggtccttgtcattgatcatgattcaaatgttcttgaaaacgttaagcaaatgtgcaatggatgccattatgaagttatcacatactctaatgctctacttgcattgaatcatgtacggagaaacaaagaagggattgatctgatactcattgatgttggtatgccaaacttggatgactatgaattggtcaaggaaatccgcaaagaaattgacgttccttttatcgtgatgtcatttgatgattctaggagcagtaggatggagtctattaaacagggggcttgtgattattggaaaaagccttttcatgaggatcaagttaggaatatgtgggtgcatgttgctaggaaagcctggaatgataataaagtagatataaaatgtggcagattggaagataatgataagagaaaacgggaggaaaatgattctaaagcaacaagaggaggagtcaagaggggcagggagccaaaaagggtcaatgcaggcacatcatcaaagaggcaacgtatagtatggacagacgaactgcataacaaatttctcgatgctgtcagccaacttggggacattaacactgctgtgccaaaaagaattcttgaactgatgaatgtccccggtttgacaagagagcaagttgctagtcatttgcag

SEQ ID NO: 93602 - DNA, 996 bp, Glycine max
  Peptide Sequence Number=SeqID_210380
atggttgctattcagcctgccattagttcctctgtagcagctacactaagccgcttcactgaagtggcctctatagtggccagggggattgtcaatttggtgaaagggatggcattgttgctccgaatggcagcaggtagaagaagctctcaggattgtttcaagtcttcatggaactctcacaaatcagtgcatctgaaggcaaaactatcctcacctggcacacaaaattcagactcacttggtgatggttggttatattgtttgaagagagggcaggctcgaacaccaaagcttcctcactttgattggactggaccactgcaaccatatcccatttctagtaaacggatagtcccagatcaaattgataaacctgattgggctgatgatggaacccccaaaattgagcccaatagtagtctacagcatactgttgaggtcaaaactccagatcaaattgagagaatgagggaaacttgtcggattgcaagggaagtgttggatgcagctgctcggattattcagcctggtgtgacgactgatgagattgacagagttgttcatgaggcaactattgctgcaggaggatatccatcacctctcaattaccttttcttccctaaatcttgctgcacgtcagttaatgaagtaatctgccatggaattcctgatgcaaggaagcttgaggatggtgacattgtaaatgttgatgtcactgtgtactataaaggtgttcatggtgatctcaatgaaacatactttgtgggaaatgttgatgaagagtctcgccaactagtaaaatgcacatatgagtgcctggagaaggcaatatccattggaaataaagcagttggtgtgatgaaggccggacagacctttacaattgaacctatgatcaatgccggtgtctggcgggatcgaatgtggcctgatggatggactgctgttacagcagatggtaaacgaagtgctcaatttgagcagactcttttg

SEQ ID NO: 93603 - DNA, 692 bp, Glycine max
  Peptide Sequence Number=SeqID_210381
atgtatcaggggatggattctgggccagagacatgacatttgagaacagtgctggcccagagaagcaccaagcagtggcactcaaggtaagttcagacttatcagtgttctacaggtgcagcttcagagcctaccaagacactctctacgtgcactcaaatcgtcaattctaccgcgactgctatgtatacggcaccattgatttcatctttggggatgcaacagtggtgctgcagaactgtgacatctttgtgaggaagccaatgagccaccaatccaacttcatcacagcacaaggaagagatgaccccaacaagaacacaggaatttcaatccaaagctgcagggttaggccagattctgagtttctcacactcaaggaatctttcaagacatttcttggtaggccttggaggaagtactcaaggactgtgtttctgaaaactgatttggatggtttggttcaccctagagggtggggtgaatggagtggagaatttgcactctcaactttgtactatggagagtacttgaacacaggttatggtgcctctacacagaatagggtgaattggcctggttttcatgtgctgaggagtgctagtgaggccacacccttcactgtgaaccagtttctgcaaggggaaaggtggattcctgctacaggggtgccattctcttctggaatttaa

SEQ ID NO: 93604 - DNA, 504 bp, Glycine max
  Peptide Sequence Number=SeqID_210382
atgaatgtagatgaagaatctggatatagagtatggtctccatctgctaatacaatgagacaactgagtattcaggataacaatgcgctgacgatggtggatacattgcacttgcagcatcggcagcaaagacaggagccacttataatgcatcctccttcagtgaacttgcatccatcttgcatcctgcaggtgtctgaagactcccccattttccacggctatactactccagcaccagcaccagcaccagcaccagcaccaccagcttttcatgctgctgcaaatacacttgttccctatgtctctggatccagtgattcactctatcagcagcctcctcttgtgaattttggatatgatgacaaacaaatgtacattccagggacacctcggggacatcaaattaaagaatctgcaggcgacgaggatcacgatactcttgtagacatatatatgtccaccaatacaggtggcgacgacgttgatgaagcagccgcataa

SEQ ID NO: 93605 - DNA, 276 bp, Glycine max
  Peptide Sequence Number=SeqID_210383
atgggtggcaaaaacaggcaaatgaaatcttcttttctttcagttttcaacattttcaaatccaacaagcagcaaagagggggaagcaattacaacacttattatgatgaagggccaaaggtgtctggaaccaaaacatggcctagtgatgaggacaaaggtcgttggggggtggctgatcctgtcattgacatgagagccacagcttacattgctcaatacaagaagcgcgtttcagaatctgaaattcattgccaagctcaatcccagcactag

SEQ ID NO: 93606 - DNA, 1155 bp, Glycine max
  Peptide Sequence Number=SeqID_210384
atggggcgtaatccagggtcgcaaggagaactcgtttcgcgagtaatcatcttcgattacctcaagtgtttgggaatcatccccgaccaactgcacgacctcgagcttccctccaccgtcgacgtcatgcgcgagcgcgtcgagtttctccaaaaattaggtctcaccgtcgacgacattaacaattaccctcttatgttggggtgcagtgtcagaaaaaacatgatccccgtgttggggtacttggaaaaaatagggattgcaaggcccaagcttggtggattcgttaagaattacccgcaggtgttgcatgccagtgtcatagttgagcttgctcctgttgttaagttccttagagggcttgatgtggagaaagatgatattgtggcttatcttgttagtattggtgtgaaccctagagatattggtccaatggttttggcgaggatgttggagaagagagcttatgttcttggctatgatcttgaggagactatgaaatctaatgtggaatgtttgactagttttggtgtgaagagggagtgtttggcttcgattattgctcaatatccgcagattctcgggctgcctcttaaggctaagttgtccacgcagcagtactttttcagtttgaagcttaaggttgatcctgaagggtttgcacgtgtggtagagaacatgccacaggtggttagcctccaccaacatatggttatgaagccggtagagttcctccttggaaggatgatacacgcgcaggacgtggcaagtatggtgatcaagtgtcctcagttggtggcactgagagttgagctcatgaagaacaactattacctcttcaagagtgagatggggaggcccttgcaagagcttgtggaattcccggagtactttacttatggtttggagtccaggatcaaacccagataccagaggctgaagagtaaagggataaggtgttccttgaattggatgctgaactgtactgaccagaggtttgaagagaggttgcagggtcattacattgaaactgaaagtgtaggccccagattctgcatgggagggaaattagagctaccagggaatggcatagtgtcagatgaggaagaggagagtgatgatgaagtattatacagacgaactgtttctctttag

SEQ ID NO: 93607 - DNA, 489 bp, Glycine max
  Peptide Sequence Number=SeqID_210385
atggtcacttatgtcgtcaccaccaccttgttcctcttccttgccatggccatcaccaccctttgcctccaagaaattgaggtgctccaaatggcccaaaaccatgtttctcaagccaagaatttgattggaaactctttgagattgcatggcttgggaagcctaagtctttctgatcaaacaagtgctacaatagcccttagtgattgtgccaaactctatgaggagagtgagtctcggctctctcacatgatggctcaagagagttactacgccaaagaagatgcactcacatggatgagtgctgtgatgacaaatcataggacttgtttggatggattgaaagaaaaagggtatattgaagctcaggttttggataggaacttgaccatgttgcttaagcaagctcttgttgtgtattcaaagaataataaaggcaaagggaaagaaactacatgtttcgaacttatctccacctatatttcttaa

SEQ ID NO: 93608 - DNA, 1866 bp, Glycine max
  Peptide Sequence Number=SeqID_210386
atggcggaggtttccggcgagggagtagcggaggcgacggtgtccacgccggcgccgccgttggcggtgtctggatctttcaaggaagggaagagctcttcgcggaggcgcgcgcattcgatgaggccgagcctcgacgcggacgagttcatgaacctgttgcacggttcggatccggtgaaggtggagcttaatcgcttggagaatgaagtgagagataaggacagagaattatcagaagcgcaggcagagatcaaagccttgaggctctccgaacgactcagagaaaaggccgttgaagagcttactgaagaattgtcaagggttgaggggaagctgaaattaacagaatctcttctagaaagcaaaaatcttgaaataaagaaaatcaatgatgaaaaaaaagcatcgatggcagctcagtttgcagctgaagccactcttcgaagggtccatgctgctcagaaggacgatgacatgcctcctatagaggccattcttgctcctctggaggctgaacttaagcttgcacggcaagagattgctaaacttcaagatgataacaaagctttagatcgtcttaccaaatctaaagaagcagcacttattgaagctgagaagactgtacagattgccttggctaaagcctccatggtggatgatctccaaaataaaaatcaagagctaattaaacagattgagatttgccaggtatttgcaatttcgtatggtgtttccctctccaagtatgccagccttaataatgtggcagaggttgaaaagcttacccaaaccgtgagagaactagaagaggctgtccttgcaggtggtgcagctgccaatgctgtgagagattatcaacggaaagttcaagaaatgaatgaagaaagaaaaactcttgaccgagagttagctcgtgccaaggtaacagcaaacagagtagctgtagtggttgcaaatgaatggaaagatgctaatgacaaagtgatgcctgtgaaacaatggcttgaagaacgacgatttttgcagggagagatgcaacaacttcgggacaagcttgctataactgagcgcactgcaaagtctgaagcacagttaaaagaaaaatatcaattaaggcttaaagtgctacaggatagtttgagagaaacttctaacagtattaatcgcggcacctcagagggaagatgtgttagcaatgggccttctcgacgtcaatccctagggggatctgataacatctcaaaactagcatctaatgggtttttgaagagatcaccgtccactcaaattaggtcttctgtgtcttcaagcacagttttgaagcatgccaaaggcacatctaaatcatttgatggtggcacaaggtcattagaaaggagtaaaattcttctaaatggaaagcctccaagttactcattcaatcagtcttctgaaggaaccaaagacggggaggaaaatgataaatggaaaggaaattccgatgataaaccaaatgacttacctacagttgatacagaggatagtgttccgggagttttgtatgatttgctgcagaaagaggtcttagccttgaggaaagctggtcatgagaaagatcaaagcctaaaagataaagatgatgccattgaaatgctggcaaagaaagtagatacattgaccaaagccatggaagttgaggcaaagaagatgagaagagaagtagcttccatggagaaggaggtagctgcgatgcgtgtggaaaaagaacaagagagcagagcaaagcgtttcagcaatgtaaagggcactgtgaacagtgctcagcatcagcttgtttctggaaggtatatttcattaagtgtttctgttcaaggttacttgtga

SEQ ID NO: 93609 - DNA, 1422 bp, Glycine max
  Peptide Sequence Number=SeqID_210387
atggcgacgatgacaagcttgatcggtctcatcaataagatccaacgagcctgcaccgttttgggcgatcacggtggcgagggcttgtcgctttgggaggctcttccctccgtcgccgtcgtcggtggacagagctcagggaaatcgtcggtgctagaaagtgtggtcggaagagattttctgcctcgtggatctggtattgttacacggaggccactagtgctgcaacttcacaagacggaagatgggacacaggagtatgctgagtttcttcacataccaagaaggagattcaccgactttgctgctgtgaggaaggaaatatcggatgaaacagatcgtataactgggaagacaaagcaaatttctaatattccaattcacctcagcatttattctccaaatgttgtgaacttaaccctcatagatcttcctgggttaacaaaggttgcagtagagggacaacaggagagtattgttcaagatattgaaaatatggtccgttcttatgttgagaagattaccttcttgatgtttcttctgaatgatctaactgagttctctttgattgtgaagccaaactgcattatcttagctatctctcctgcaaatcaagatattgctacttctgatgccataaaaatcgcaagagaagttgacccttcaggtgaaagaacatttggtgttgttaccaaacttgatcttatggataaaggaactaatgcagttgacgttctcgagggaaggcaatacaggctgcagcatccatgggttggaattgtgaaccgttcacaagctgatattaatagaaatgtagacatgattgctgctcgtaggaaggagcgtgaatattttgagacaagtcctgaatatggacatttggcacataaaatgggctcagaatatcttgctaagcttctatcccagcatttggagcaagttatcaggcagaagatacctagtatcattgccttaataaataagactattgacgagcttaatgcagagttggaccgtattggcaggccaattgctgtggactcaggggcccaactttacactattttagagatgtgtcgtgcatttgacaaagtgtttagagaacacctggacggaggacgtcctggtggggaccggatatatggagtttttgatcaccaattaccggctgctttaaaaaagctccctttcgatcgccatctttccttaaaaaatgtccagagagttgtcactgaagctgatgggtatcagccccatctgattgctccagagcagggttatagaagactcattgaagggtctattggctatttcaaaggcccagctgaagcctctgtggatgctgtaatcttcttgactttattacattttgttttaatctggcatcctattcctcggtctgatgaaattaccagatattga

SEQ ID NO: 93610 - DNA, 171 bp, Glycine max
  Peptide Sequence Number=SeqID_210388
atggaagatatgtctgagagggctctgaaggctgcaaaccccaatgcctcagcagagattgcaaaacacattctctcccttctttgcttgtgggccaacaacaccgatagaaatttcaagaagaaagttgcactgctcttacaacttgatagcatattgctaggaatgtga

SEQ ID NO: 93611 - DNA, 982 bp, Glycine max
  Peptide Sequence Number=SeqID_210389
attgtcacttgatctgggtagtatgaaggtaagggaaaatgccaatcagcagcagcgtcctactagtcatgagcttgaggatgagcttcgacttgcagaagagaagtatgaagaagctgaatcaagagttaggcaactagaacaacaggctgctctgagaaatgcatcaaagaatcatggaggttttcaagcagcgcttcaggcggatgctgagactgcaagggaggagaccgagtctgctttcgaaaaactacggcttatgactcaacgaatgatactcaccccggaagaaatggaagaggttgttttaaagaggtgttggctagctcggtattggggtttatgtgttcggcatggtattcatgctgatattgcggaagcaaaatacaaatactggtctatgttggccccgaatccgattgaagttgtattagcagcagcagagaaagctaaagaggaaacagacctcgatgtagaggatacagaaggtcaacgtgacctgaaggaactttctggagagggaaatattgaaaacatgctttttgttgagcaaggtttgcgacaattggcttcactaaaggtagaagaagcattggtggttgcattggctcaacataggcgaccaaatatgttgaaagctggtttttcagatgacctaaaactaccaattgaagggcagtgtgatgcatttgaattgagtcaggaggaggctgaagatgtatcctttaaacaggcttggcttgcttacatttggaggagagcaaaaaggcatgaaatagagcctgacatagctaatgagcgtttgcagcattggatcaatcataactctatgactcctacctcacaagacgcagttgatgttgaacgtggacttgcagaaatcaaaaggttggatattgaagcgcaactatgggatgaatctcgtagagaattggaggaagagattggcaattcaaacatacccggtcgttctgacttttga

SEQ ID NO: 93612 - DNA, 1218 bp, Glycine max
  Peptide Sequence Number=SeqID_210390
atgggttttggtaaatcactggatatgggggattatctagcaattggtgcaatatttgctgctacagattctgtctgcacattgcaggtgctaaaccaggatgagacacctttactgtacagtcttgtatttggcgagggtgttgtgaatgatgctacatctgttgtgctttttaatgcaataaaaagttttgacctcaacaaaattgaccccagaattggtttgcattttattggcaacttcttgtatttgttcaccgcaagcaccctgcttggggtcttggctggtctacttagcgcttacattattaaaacgctgtatattggcaggcactctacagatcgtgaggttgctcttatgatgctaatggcatacctttcctacattctggctgaattatggtatctgagtggcattcttactgtattcttctgtgggattgttatgtctcattatacttggcataatgtgactgagagctcgagaataactaccaaacatgcttttgcaactctctcatttgttcttgaaacctttatcttcctttatgttggtatggatgccttggacattgaaaagtggaggcctaaaacatctgtcgctgtgagttcagtattattgggtctagtacttgctggaagagcagcctttgtttttcccctatccttcttatccaacctcactaaaaagacgcaaagtgaaaaaataagtttcagggagcaggtgataatttggtgggctggtcttatgagaggtgctgtttcaatggcacttgcctacaatcagttcaccttgtcgggtcacactgaacagcgaaccaatgccatcatgatcaccagcaccattactgttgtgcttgtcagcacaatggtgtttggtttgatgactaagccactcataaggtttttgctgcctgttaatccccttcctaaacgcaaaaacagtatggcaaatatagattcatctaataattcccccaaatcaatcactgtgccctttcttggaggctcccaagattctgaaaacgaatttgatggcagtgaaattcatcgtccaagcagtattcgtgccttactaacaactccaacacataccgttcatcaactatggcgtaagtttgataattcatttatgcgtccggtttttggtggtaggggatttgttcctgtagctccgaactcgccaaccgctcgcaacattaatcaacagtggcattaa

SEQ ID NO: 93613 - DNA, 426 bp, Glycine max
  Peptide Sequence Number=SeqID_210391
atggggtttgatttcctagtcgtgcgtatggaaaagatttgttgggagagacaaaacccactccacttcgatgatctttatgccttcaagaaaaaaaaatggcaggcagttattaagttttatagcagttattacgttgaaaatttgtggatggatgcggaaatcgtattcttcttcacaacagtgctgggtatttatttggacatgaaccatataccatcccctcaactaataccctcgccaaatttctctgaggggaatcagttcagaaatgcttccttgatggcagatttagctggtgtgactgttataactgaggatgagctagactcaagtactctagccattgcaattgaaaagattttaattttggaaatcattccagaatctttcgtgaatcatgccatatgctttgatgataaataa

SEQ ID NO: 93614 - DNA, 864 bp, Glycine max
  Peptide Sequence Number=SeqID_210392
atgagttttaacaagactatccatttcatcaaaggcttcaaccccagtttgccaaataacatacaagccactatcctgtctcagcatctgataatacaaattcagcatcgcaatgttaactgcattggcgccaaaagatcccgcaagcaccaacaaaatcctgctcccactatccgaaccggggaaaaaatgagacatggcggtcaccttggaaacgaggttcctaatagacaacctcaccgggttcccacacacgaaacacttgttcctcgggaaactatcgagtgtggagttaaaagcaacgaagatggcatcagcgaagaaggaaagaagagagttggcgaagccggggacagagttgggttcgtggatgacaacgttggtgcctctgagcttggcagcgaggcaggcggggaaagagacgtagccgccggtgccgacaacaacgtcgggttggaagtgtcggaggtggcagaggcattggatcagagacttgaagagacggtgagggaagaagagaaggttttggggtgctcctccgcgatggccaccgccgggtacacgttgctgccggtgccgccgccggcgaaggccacgcggagagtctcgttgttggagttggatgagtggcatgagattgagactcttctggatagtggagtgctttggaacacgggaaaggagaaggaaagggtggttgccattaacattaacgcatgtgcttgctcaagctcaactctgatttctggcagttattatgagttacttggaaagtttcaaccaccagcgaaagaaaacaatttactagagaataaattaaatgaaatcaacgagattaattatacctcgccctttgaagggtaa

SEQ ID NO: 93615 - DNA, 150 bp, Glycine max
  Peptide Sequence Number=SeqID_210393
atggatgcttatgccagtgctttacgcagtgtcactctctcaggacgcactttatttgacccagttatcaacatggccgcacaaatggctgtccagtccctcacatcacataacaacaccaagtattatgcattgcttatcataatgtag

SEQ ID NO: 93616 - DNA, 915 bp, Glycine max
  Peptide Sequence Number=SeqID_210394
atgcagttggaagcattacagcttgctgtggaattgggggctgatttcatagaggttcagctgaaggtaccattgattgcttattctgttggagaaagaggattaataagccagcttctaagtcaaaaatttggcgggttctttgtctatgaatcattggcaggaaatccaatccctggtctgccttctcttgacaatatccaggaagcctataaattggaacatcgaaccagccagtttaaccgcttgaatgggaaaccagtgactagtccagagactctaaaaaatcagagcattgcagaaccagtggaaatcggtcaaacaggagcagttaatactataataaggagagcaagacatggaaagcttgttggttataatacacattgtgaggctgcaattactgcaattgaggatgcactcattgagcatggctgcaatgatggtggagcatctttaggttcaccccttgctggacgattgtttgtgctagttggtgcgggaggtgcaggaatagcactggcatttggttctaagagcagaggagctctgctagtcatctttgacattaattttgatagagcaaaatctctcgcttgtgctgtatttggtgaagctcagcctttcaaagagttggtcaactttcagccagagaaagaagcaattcttgccaatgcaacacccgtaggaatgcttcccaatacagacagaattcctgttgcagagcggttagtctttgatgctgtctataggctaagaagaaccagattgttgaaagaagcggatgctgcaggagcaataactgtgggtggggtagaaatgttcctaaggcaggccattggtcagttcaatcttttcactagcctagaagcacctgaagaatttatgcgggaaattgttttatccaaattttga

SEQ ID NO: 93617 - DNA, 1137 bp, Glycine max
  Peptide Sequence Number=SeqID_210395
atgaggagtggaagggtgttggagtggtgtcctgctattgtggagttagaggctgggaggtgtgacgtggatgctgccctgaatgtttgtaaccgtcttccaacttcattggacaaagaagttagaactagtgggccaacgcgtaatcaaggcgaagctccactcacatgtcgaaatcagggcattagggtttttccttctcacctgcaactgcaattggccctttggaagatggttccacagtcagtgataacgcaagtctccgattcaagtggcgtgaatgcgatatcaaacgtttcttcttctggctacggattctacgattggctgttcaaatgtcacggattctggcacaatgccactctcatcatcccctccttcctcttcgtcttctacttggcacttcaagccaggcacagcttactcaaagtttccctcgcacgctcctatatcatcatttcgtataacctttgcctctgcctcgttactctgctcaatctcgcttggtgtttcctccaggcatgggagtgcacgtctgggagagagttgacatggaatttgttatccttgtttactacttccggaatgctgtttttggaagtgagcttgctggcttttttacttcaaggaaataatgctggcggcttagaagcaatgaaacgaacttttggtatctcaacgctcgttgttggtttggatattctgctcaaggctatatatctatttgtatttgggatccctttattcgtcgacagcaatgatcatactcatcatgggaagtggaacttgtgggttgtccacaagctgttgctcactgctgtttatggcttcataatgtttatgtaccattccggatggaaagaaacgttgcctgcaaaaattgccttttacaagtatgttgctatcatgttcatttttaatgcgattgcgacacttgcttgtggccttgctggtacccatgctgcgtttgctttctggttgtatcgtgtcactgttgtcttttaccatgcattttatcttccctttttgtatacaacattcctagcagactttttccaggaggaaaatttccatttggaaaatgtgtattattctgagatgaaagatgcgggtttcttcgacacggactgggagtga

SEQ ID NO: 93618 - DNA, 2850 bp, Glycine max
  Peptide Sequence Number=SeqID_210396
atgggtcttggtttgaagatgaagagcctgaggcaccaccccatggccttgaagttacatgagcaagcggggagcataagaaagtacactttcattcaggcacatagggcatggctgcccaagtttttgatgctgtggatccttctcatggctctaattggctgtttcatctatagtaaaatggatgctgacactaaggttagaaggaaagaggtgctgggtagcctctgtgatcaaagggcaagaatgctgcaagatcaattcagtgtcagtgtcaaccatgtccatgcccttgccatccttgtttcaaccttccattactacagaaccccttctgccattgaccaggaaacctttgcagagtatacagcccggacagcatttgaacgaccattactcagtggggtggcctatgcacaaagagtagttaactcagagaggggaacatttgagaagcaacatggatgggttataaagacaatggaaagagagccttcactggttagagatgagtatgcaccggtgatatttgcgcaagaaacactctcttacctcgaatctcttgatatgatgtccggggaggaggaccgagagaatattttgagggctagggccactgggaaagctgttctcactagtcctttcaatctgttgggttctcatcatcttggtgtggttttaacatttcctgtttataaatctaagctccctccaaagccgacaatggaagagcgcattaaagcaactgcaggatatgttggaggatcctttgatgttgagtccctcgtggagaatttacttggtcaacttgctggtcaccaagcaattttggtgaacgtatatgatatcacaaattctactaaccccttaatcatgtatggcaaccaaaacgaagaaggtgatatgtctcttgtccatgaaagaagtttcaatttttgttcagaagatgcttatcatcaggtttttgaacagtttctagctactgtctctcatgaaatcagaacacccatgaatggcattctaggaatgcttggtctgcttctaaagacagaattgagttcaactcaacgagattatgcccagactgctcaagcatgtgggaaggctctgatagccttaataaatgaggtacttgaccgggctaaaattgaagctggcaagttagagctggaagcagttccatttgacattcgttccatacttgatgatgtcctttctcttttttctgagaagtccaggaacaaaggtttagagctggcggtgtttgtttctgataaagttccagatattgttatgggagatcctgggagattcagacaaatagtaacaaatcttgttggcaactctgttaaattcactgagcgaggacatatatttgtgaaagtccatctatctgaaaatagtatgtccacaatgaatggaaaaactgagaaatttataaacagaggatcaggcgaacctgtgcatatgtctggtgcttataattccaaaactttaagtggatatgaagcagctgatgagcggaacagctgggacaattttaagcatctaattgctgatgaagaatttttctttgatgcttctgttaaaaaggcagccagtgaatcttatgagcaagtcaccttgatggtcagtgtggaggacactggaattggaattcctttctcagcccaagataggattttcatgccttttgtgcaggcagacagctcaacctctcgacattatggtggtactggcattggcttgagtatcagtaaatgcctggttgaactaatgggtggtgagataagtttcataagccaactgcaggttggcagcacattttcatttactgcaggttttggaacgattgagaaaaatgcaataactgacatgaagaaacataatttggaagatctgccttccaattttagagggcttaaagccatagtggttgatggaaaacctgttagagcagcagtgactagataccatctgaagagactagggatacaagctaaagttgcaaatagcatcaataaggctgtttctttatgtgggaaaaatggttctttgacctcggtattatttcagcccgatattatttttgttgagaaagattcatgggtttgtggagaggacgagatcttcaatgtgtggcaactggactggaaacaaaatgggcatatgtttaagatacctcaaatgatccttcttgcgaccaacatcggtaatgctgaatttgataaagctaaagctgcaggtttcagtgatactgtgatcatgaagcctctaagagctagcatggtggctgcttgtcttcagcaagttcttggaacagggaagaagaggcagcatgggaaagacatgaagcctaatggttccactttggtacgaagccttctttgtgggaaaaaaatcttagtggttgatgacaatgtggtaaaccggagggtcgctgcaggtgcattaaaaaattttggagctgatgtgacgtgtgcagaaagtggcaaaactgctcttgaaatgctgcagttgcctcacaattttgatgcttgcttcatggatattcaaatgccagaaatggacgggtttcaagcaactcagcgaattcggatgatggagacaaaggcaaatgagcagcagatgaatggtgaaggaaatgggtggaaagacaagtaccatatacctatattggccatgacagctgatgtaattcacgccacatatgatgagtgcgtgaaatatgggatggatggatacgtctcaaagccttttgaggaagaaaatctgtatcaagcagttgcaaagtttttcaaccccaagcctaccacagacaacagcctaatagaaaatggcagaacttga

SEQ ID NO: 93619 - DNA, 3177 bp, Glycine max
  Peptide Sequence Number=SeqID_210397
atggagtgcaacaaggatgaggctttgagggctaggcagattgctgaaaataagatgcaagctggtgattttgaaggggggctgaaatttgctacaaaagcccaaaggctgtttcctgagattcagaacattcttcagatccttgctgtttgtgaggttcactgtgctgcacagaagacatactctgggtcagacatggactggtatggaattcttaagactgaaaagtccgccgatgaagcaaccataaagaaacagtataggaagcttgcactgctacttcatcctgacaaaaataaatctgctggtgcagaggctgctttcaagttgattggtgaagctaacagagtgttgagtgaccaaacgaagcgtgctttgtatgacttaaagtttggagttcctgtgggaaatacagcaactaaggtgccacctcgtcacccaaatggaaatgcttctgggatgggatgtgatggaactgcaagaaattgtcagaacagttatttttcacaataccaagcttggaatgcataccatcgggatgataatcagacattctggacatgttgccctcattgtaatactagatatcaatatgtcaaaaccattttaaatcataccatacgctgtcaacattgttctaaatcctttacagctcatgatatggggaaccacaatgtgccaccaggatactgggcaccatttaataaccagaaagagcctccaaaacatgcatcgtctaaagaagcatcaaaaggctatggtggaaaatcttctggtagagaacaggagggtgtatccatgtcaaaatgctcagctggtattggtgcccattctaaagttgcaaagagaagagatggtcatgtggctgcaggagtgacgaaggctggtgttgggacatccgaccccactaattccaaagccaaggaattgcgagcctcaacaaaggttggacataagagatcaaggcagtcagcatcagatgatgataagaaagctgcaaacggtaaagccgtgaaagataccaaggttcaagaaaatagggttgatcctaataggagatcttcaaggaaaaaacagcatgtttcgtacacagaaaatgataaagatggtaattttgggaattcttccaaaaagccaagacaccataaatccagtaacaataatccagcctcttttactgatggtgtgggtggtcagaatggagagataagaaataaagcaagtgcaccacctggagaaactattttaaggaataaaaccaaagttgagcagacaaatgtgcaaagaaaggaggcatccaactcagatcttaatgatagaaagtcaaaagctgacaattgttctccactcaagtcaaattttcctcccacttcagagatttgctgtcctgatccagatttcagtgattttgagagagataaggcagaggattgttttgctgttaatcaattatgggctatttttgacaataccgacagtatgccaagattctatgctcttgtcaagaaagtgtactcccctttcaaattgcggattacttggctggaacctgactcagatgaccaaggtgagattgactggcatgaagcaggtttgcctgttgcttgtggtaagttcaaactaggtcattctcagagaacttcagatcgctttatgttctctcatcagatgcattgcataaaaggaattgacactggtacttatctgatatatccaaagaagggagaaacttgggcaattttcagacattgggatcttggatggagttttgatccagaaaagcattcagagtatcaatttgaatatgtggaagttctatctgattttgataaaaatgttggcgttaaagttgcttatcttagcaaactaaaagggtttgttagtctctttcagcgaactgtgctaaacagaattagcttcttttgtattttgcctaatgagctatataagttctctcatcacattccttcatataagatgacaggtgctgaaaggcaagatgttccaagaggatcttttgaacttgatcctgctggtctgcctaatagtctttttgaagtcggtgatcctggtgttgtgaagatggatggtgtcaattgttcgcaccacgaatactcgaagtgtaaagttgaagaggcaatgcctaatgatagtattcacaaagcaacactgcgagagagtattgattctggaagagtagcacaaatcctcagaagatcaccaaggtcaagtaaaaaaagtatggacaatggtcaagcaagcactagtcaatatatagtcagaaaggatgacataaacattgtccacagggatgacagtccaccagagggaaacactgctgcatctcagactattaagaggaaggtcaagacacctcagaaacatgagaaaaataattatgaaggagaggcattgaaagctcgaaagtcacctaaagatttaggcaagaaaaatgctcaaggagatgcaggtgaatattcaagcaacagtaaaaatgtgaaggttagcaatattcctcagtcggtgggagcatcatgttatggctttaagaaggaaaaatctgaagagatgtttcggtgtggtcagatatgggcaatatatggtgatagggatcatatgcctgatacttatgctcaaattaggataattgaatgcactcctaattttcgattgcaggtgtacttacttgaaccctgctcaccaccaaatgacttaaaaagaacaacatcttgtggcacctttgcagttaaagaagccaaattacggatgctttctctctctgcattctctcatcaattaaaagctgaactcgtggcaaataatagatatgaaatttaccctagaaaaggtgagatttgggctctatacaaggaccagaactatgaacagacttcttcaaatcagggcagaggtgaatgtcatatagtagaagtattagcagataataacaagagtttccaagttgttgttctggtgccgcatggcagctctcagacaattttcaaggctcctagaattcagagatctaaaactggtgtaattgaaatattaagagaagaggttggcagattttcacatcagattcctgcttttcagcacagcgacaatgttcatctcagagggtgttgggagcttgatccttcatcagtacctggctgtttgataccaatagactga

SEQ ID NO: 93620 - DNA, 312 bp, Glycine max
  Peptide Sequence Number=SeqID_210398
atggccaccaatgcactcgctggcacatctctctccatgcgatctctccttcctcaaacacaggctaaaccagagacagtagagaaggtgtgcaaaatagtaaagaagcagctggctatgcctgaaactgatgttgtgacgggggagtcaaaatttgcaactcttggtgctgattcccttgacacggttgagatcgtgatggcacttgaggaagcatttggtattgccattgaagaggacagcgcacagagcatcgctactgttcaggatgctgcagatcttattgaagaaatcgttcagaagagttcttag

SEQ ID NO: 93621 - DNA, 990 bp, Glycine max
  Peptide Sequence Number=SeqID_210399
atggatcggaggagaatgtacgataggcagaacagctctccagggacgccgtcctcgccgtcctcgccggtgaatgtgatatcgccgctgcaccgccacgcgcgcgcaggttccaccggctccgccatgaccaacgtccggagagcgcagaacaacgccaccaaagccgccgcgcagagacttgcgcaggttatgtcgcaaaccgacgacgatgacgaagacgaggacgacgttcctcttgactattccgcgatcgctggcagcggaggtattggtctcggcggcggaagaccaatgccaactcgctctcccatggcagttcggagcgttcaggatgctgcatctgcaaggtcgcggtcaccaatgccagttcgcgctgttcaagaacaacctccatctgcgagatcacgttcccccgcgtcagttcgctccgttcaagaacaaccgccatctgctagatcgcgttccccagcgtcagttcgcatcgatcaagaacagccacgatctgtgagaggcatgtcgagtgttcgatcatatgcatcttcaaatgctctagctgagcaacctccacctcggacacccactctaatgaataacgcagagcaacaaccaccttctgctcgttcaacgccagcaaaccgaaccctagaattgtctccctccgctcgcactacaataattacacggtcgcctcaacccagtagtgccaacaatgatcagcctccctctgctcgctcaacctctggccgtcccagtggactttctaaggtggttcccatggtgccgcctagtgtacctattacactcagaccagcctcttctgttggtgttcctccctctgagcctcttcttgatattagaaaagacaaaaggtatgctgctgcctgctcctgttcttatttgcttttacatttcttttccaagaaaatattagacactatggattcatcatatgcttcctcttcgtggttcttttctgcatttatgtaa

SEQ ID NO: 93622 - DNA, 801 bp, Glycine max
  Peptide Sequence Number=SeqID_210400
atgaacagcaggtgcgaagaggaaaaaggaattgaatatagaatcccttggatcatagattcgaggcccaaagttaagtgcagtaatttctattctgatgcgagcgaggcaagggaagcaagcaagacgatgggtataattagcgagcgagagagagagagaatggttcgggaagtatcagagagttgcgttgatagcttgttgacggagatggtggcgtgctattgcaatcgattctatgccaacaagcctgaactcgccgcacgcaggatcgaggccattggatatcaggtcggtcaccagctctctgaaaggtataccatggagcggcctcggttcacggatcatctcgaggccatcaagttcatctgcaaggatttttggtctgagctcttcaagaagcagattgacaacttgaagacaaaccataggggcacatttgtattgcaagataataaatttcgctggcttgcacggatgtcaattgatccatccactgataatgttagtccacttgaagatattacttcacctacagctgaaagcaaggcagcacaagcaatgagcatgcatctttatttcccctgtgggatcattagaggagctctttccaacttgggaattccttgtgcagtttctgcggatatatcaaaccttcctgcattgatgcagcactgtgttctggcatctggcttctatatttttcagattgcagtgagttttccatttgaggaagttgcatacatggcttatagcagggtgttagaaatccttttttctcccttttgctgcattatctga

SEQ ID NO: 93623 - DNA, 750 bp, Glycine max
  Peptide Sequence Number=SeqID_210401
atggtcattgtatcgatccttagtgagctgaaagggacacgaagcttaggggaccacaacagaggcaacccattaggagggcataatgcatggaaatgcaagggcaatgcccttttcacggagggaagaaactcacaggcacctgccccatgccattggtggatgatgcagcatagggcgaattggaacaaagcagtgaatagcagatggagattagcggggatcaatgagaaactgaaggcagtgaaaggcgcactcaaagacgaactcagatcaacagataatcagcttttggaaggggttcgacaaatgtttgaattgaagaaggaaattcccaagccagggatcagagaagtcacgatgcaagctggggattacaacacccggctagccggtctagtgcataatgctgtggaaaaaggtatttttaagggcgtcaacttagattcagattgcaacttccccataattcagtatgcagatgattcggtgctcatgggggaagcttcttttcataacttttgggcaataaagacaattttcaggggttcaatcaccacctttcaacttccttggcctaccggttggaaaaagcccgctcttatcctcgacatgggaaccggtcctaaacaaatttcacaaaagattagcaacttggatgtcaaagttaactctaatcaactcggtcttaccaagcctctcagtgaactacctatcaatgtccaaggctccgaagaagattctcaatga

SEQ ID NO: 93624 - DNA, 702 bp, Glycine max
  Peptide Sequence Number=SeqID_210402
atgttgctcactatatttctgcttatccctatgataatattatttattcagagaaagaatgctccacttgcaaaattccaaaacctgctaggtcaaaacactgcagcatttgtgatcgctgtgttgctcgatttgatcatcactgtggatggatggcatttccttatatgcttgtatggaacagttgccattgtcttggttcttgctggaagactgagagaattaagagttgttgatattctaaccgtttattatggaatagaaaattcttttctggatttagctcctaatgttgtgcagtggttgttgggatcttacaacactcagatacttcttatggtgttccttgctatcgttgggatgctgttagctggtttcttcggttaccatgcaaagctttgccttaccaacactaccactaatgagacttttaagtggcaagattacatggactggcagaggaagctaaaagaagcaaatgtcagtgctgaagccctaaaacaaagtattggtggaatgagcagtgagaaacagcccttgttgagcaaatggagagccttctttcgaaaatcacctctagaagatgtggtagtagttaagaataatgtttacgataaagggttcttccacaatattcaggaggttatttcccctttctctacaaggcggtcctttacacaaaacaaattgaagtccagctga

SEQ ID NO: 93625 - DNA, 339 bp, Glycine max
  Peptide Sequence Number=SeqID_210403
atgggaacgtgtttttcagatatcaaaggagggaagcaagcggtgggagggaagagcaatgaagccactggcactggcgccacgacgaacaacaatgggggccaaaacgacgctgttgatttcttttacaagacgcaagggtttcaacaattgttcacgcaagttgagttgttgttgtgctttatacgctttttcctgcgaagaacgagtgaggtcaatcttttgttgtatatcttcttccaatcaaaccaaattaataagagcaatgttgttaatggtggatggcggttcatggcggaaagtcaaaaatccgccataaaaatatggcggatggcgtag

SEQ ID NO: 93626 - DNA, 3372 bp, Glycine max
  Peptide Sequence Number=SeqID_210404
atggaattacggggccttttccagtatcttgtgaatcagttaaagaaggggcagggaattgagcttgttctactgcaggagcttattcaacaaatggctaatgtccagtacacggagaacttgactgaggaacagttggatgcaatggctgggagtgagactctcagatatcaagcaacatcttttggtgtaactcggaataataaggcattgataaagtcaactagcagacttcgagatgcattacttccaaatgatgaaccgaagttggcgatccccctgttacagcttattgctcaacattgttctttggttgtcatcaatgcagatgcaccctacattaaaatggttagtgagcaatttgatagatgtcatggaactctccttcaatatgtggagtttctttgcagtgcagtcactccagcatcaaattatgccattcttgttccctccctcaatgacctggttcacctttaccacctagaccctgaggttgctttcttgatatatcgccctgtaatgaggcttttcaagtctccgaggaaccctgatgtttgctggcccttgggtgataaagatgctgcaagtgatgcatctacaaactttgagtctgatcctttggatcattctgctagtatggttctaaatcttggctctgatcaaaatcctataagttggtcgtatcttcttgatactgttaaaaccatgttgccttcaaaagcatggaatagcttatctcctgatctttatgctacgttttggggtcttacattatatgatctgtatgttccaaaaaatcgttatgagtcagaaatagccaaattgcatgctaatcttaaatctttggaggagctttctgacaattcaagctcagcaatcgcgaagaggaagaaagaaaaggaaagaattcaagaatctcttgatcgtctgatcagtgaactgcataaacatgaagagaatgttgcatctgttcgtagacggctttctcatgaaaaagacaaatggttaagttcctgtcctgacaccttaaagatcaacatggagtttcttcagcgttgtatatttccacgctgtacttttagtatgccagatgcagtttattgtgctatgttcgtacacacactccattcccttggaacccccttttttaacacagtcaatcacatagatgttcttatttgtaagaccctacagccaatgatatgctgctgcactgaatacgaggcaggcaggcttggcaggtttctgtatgagactttgaagattgcatactattggaagagtgatgaatctatttatgaacgtgagtgtggaaacatgcctggctttgctgtctactatagatatccgaatagccagcgagttacatatggccagttcattaaggtacactggaagtggagtcaaagaatcactcgtttactaattcagtgtcttgaatctaccgagtacatggaaattagaaatgctcttataatgttgacaaaaatttctagtgttttccctgttactcggaagagtgggatcaaccttgaaaagcgggtagctaagattaaaagtgatgaaagggaggatcttaaggtgttggcaactggtgttgcagcagcattggctgctaggaagccttcttgggttaccgatgaagaatttggtatgggttatcttgagttgaaaccttcaccatctatgactaaatcttcagctggaaactccgcaactgtacaaagtgggataaatctcaatgtttcacaaactgaatctgtcagtggaaaacatgtggactccggaaacacagtcaaagatcaggcaataagaacaaaaactgtagatggcaagtccgagagaattgaaagcattacagtgacaaaatctgatgctggccacattaaactcaagagtagttcaatggtgaatggattggatgctcaatcatccatggccccgtcttctgtacaatctgggatgccaaaatctatggaaaacccaaagcaagtggaagaatccataaatagagcatcagatgaacatgggacaagaagtactgaggtagcatttaatatctcagttatgctgtgtggtacggctgcctgtactcctatgcaggttgtcttgcattcagctcggtgggacacctgcctgacaaggttaagaacttcagcaaaacgttcagttcctgctagttcacttgcaaagccctcaaaacaagatcctgtaaaagaggatggtagatctggaaaacctgttgctagaacttctggttccttgagcagcgacaaggatctacaaacccatgcattggagggaagacacactggaactaccaatgtaccttcttcaaatggtaacaccatttcaggttctacaaaaggttcaaatccaccagtcaagatttcattggatggtcctggtaatgaatccaaggcagaggttggagttgccaagtcttctgatattagggcttctatggtgaaggatgatggaaatgatattactgacaatccaagaggatcctcctctcgcatagttcattcccctaggcatgaaaacacagtagttacttcaaagtctaatgatagagttcagaagagagctagttctgttgaagaacctgacagactaggtaaacgacggaaaggggatgtggagctaagagattttgaaactgaactcagattctctgaaagagagaagatgatggatcctcgatttgctgatgacaaattgggaccagaggaacatggtctgtacagggcaagtgataagccattggaaaggacaaaagacaaaggcaacgaaagatatgaaagggatcacagggaaagaatggaccgtctggataagtctcgtggtgatgactttgttgcagaaaaacctagggataggtcaattgaaagatatggaagagaacgatctgttgagagaatgcaagagaggggtagtgataggagttttaatagactccctgagaaagccaaggatgaaagaaacaaggatgatagaaataaattacgatacaatgatgcatcagcagaaaaatctcatggtgatgatcgcttccatgggcaaagcttgcctccacctccccctttacctcctaatgtggttcctcaatctgtaggagctggtaggcgtgatgaagatgttgatagaaggtatggagctacaaggcactctcaaagactttctccaaggcatgaagaaaaagaacggagatggtctgaagagactgtggtttctcaggatgatgccaaacgccgaaaagaagacgattttcgagatcgaaaacgtgaggaaattaaggtatggatcattattgggtatcgattttttcactctgctactaaggaattaaggatgcgtgctttgtggtag

SEQ ID NO: 93627 - DNA, 1533 bp, Glycine max
  Peptide Sequence Number=SeqID_210405
atgtcaggagagttccgttctcgtctcatcaaactggcaagatggcttgtggaatctgaaatggttccagttaggctacttcaagaacgttgtgaggaagaatttttgggggaggttgagttgatcaaaattaaggctcaggagttgaaggttaaagaggtcagagttaatacccgacttctctatcagcaaaccaaattcaaccttctcagggaagagagtgagggctatgcaaagctggttcttgagtgttttgaactgcagcctgatgatgatgtgtttatagaattgattcctatttttccaaagtctcatgcttcacagattcttggatttaagtttcaatattatcaacggatggaagtcaacggtcctgttccatttgggctctatagactgacagccttgctggtgaagcaagattttattgatcttgatagcatggatgatgaggcatttgagcattacaatactttctcttccaagcgccttgatgaggctaataaaattggaagaataaaccttgctgcaattggaaaagatctaatggatgatgagaaacagggggatgtcactatagatctctttgctgctatagacatggaaacagatgcggttgaagagcggacaactgagcttcagagcagtcagactttgggcttgcttactggctttctttcagtggatgactggcttatcaagaagtcaatttcttcagcatatgatgttattcgtcagacacatcttcaaaatcctggattgtccacaggaggcagcactgatgttatggatgtagataactcttcaggattcagttctttcatagatcttccaaaggaactttttcagatgcttgcttgtactggaccttatctctaccgtgatactgtactgttgcagaaggtttgtagggtgttgagaggttattacctttctgctcttgagcttgtaagtcatggaaatggtgtcttgaatcctcaattacaagttcctggaaatcttcacctacatcttaaggaggcaaggctaagggtggaggatgctttaggagcatgtctactaccttctctgcagttaattcctgccaatccagccgttggccaggaaatttgggaactaatgagccttcttccttatgaggtgcgatatcgtttgtatggtgaatgggaaaaagatgatgagcgcattcctatgcttttagctgcaagacaaactgccaagttggacactagacgtattttgaaacggctggcaaaggaaaatttgaagcagctgggccggatggttgcaaaattagctcatgccaaccctatgactgtccttcgaacaattgttcatcagattgaggcttatagagacatgattactcctgtagtggatgcatttaagtacttaactcagcttgagtatgatatattggaatatgttgtgattgagcgcttggtgcttggcggacgtgataagttaaaggatgatggccttaatttgtctgattggcttcaatctcttgcttcattttggggccacctgtaa

SEQ ID NO: 93628 - DNA, 459 bp, Glycine max
  Peptide Sequence Number=SeqID_210406
atgtatggtgtgtctcggttgcagagacagttggctgaatacacttcttccctgtttgaagagggttttctggatgatcaattcaaccagcttcagcaacttcaagatgaaagcaacccagagtttgtggttgaagtggtgactcttttctttgaggatgcagagaggcttcttaatgagctggcaaaggcactaggccaggagagcattgattttaaaagggtggaagctcatgttcgccaattgaaaggtagcagctccagcattggcgcacagagagttcagaaagtctgcattgccttccgaaactactgtgaggagaaaaatgttgaagggtgtcttaaaaacttacaggaaataaaactggagtgttccttggtgaaaagcaagtttgaaactctcttcaagatggagcagcagctttttgccgcagggggtgggttattaggtagtgagtga

SEQ ID NO: 93629 - DNA, 348 bp, Glycine max
  Peptide Sequence Number=SeqID_210407
atgggcgtagagtggttattggtgtgccatggcttggtcactgcggtggtcgttgtctctttcctctgcggtcgatggccaatctttgagggcactttcatccaacgcattcactacttcctcactttcggcgcttacgattacttcctgcgtttcgttggcgctgtttttggccctaagtgtacggatgcggttctctccgtcgaatattactgttgtgatcgtcccaatcctcttctacaggtagggtgcgagtgccttcagttggaacatcttttttttttaaaggataatgataataatgtccttaagtggcattatattccactggttaaactattcacttag

SEQ ID NO: 93630 - DNA, 1038 bp, Glycine max
  Peptide Sequence Number=SeqID_210408
atggcgacccccattcctccccctcctgccgccgccgccgccgccgccgccgacaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagcaagttatattcagtccctggctgctataggggcagccgtagtggagaagttgatttttgcggatgcttttgcagttggaatagcaggaattgcacttgatagcactgcctgcatgagtgctgcacctcttcccttttgctattttgtagccacagccccttctccatctgcgagtgtgacacagcatttatcattgggtggggaggtattttgggctggtcagcatcggaagtctggtattggttatgctgctcgctacaacactgataagtcgtctttcaatttgctcacctacatccaggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacaggtagttttctctttctttcaggaattcaatcatgcattggaatttggaactaatacgacaggaatgtggaccagttag

SEQ ID NO: 93631 - DNA, 507 bp, Glycine max
  Peptide Sequence Number=SeqID_210409
atggcggtgattttttcaagtgcaataccaggaggggcagcaccagcagcaatcgagcaagtgcagtgcttcgggcggaagaagacggcggtggcagtgacctactgcaagcgcggccgaggcctcattaagatcaacggctgcccgatcgagctggtggagccggagatcctccgcttcaaggccttcgagccaatcctcctcctcggtcgccaccgcttcgccggcgtggacatgcgcatccgcgtgaagggcggcggtcacacctcccagatatacgccatcaggcagagcatagccaaggctctcgtcgcttactaccagaagtacgtcgacgagcagtccaagaaggagatcaaggacatcctcgtcaggtacgaccgcaccctcctcgtcgccgatccccgccgctgcgagcccaagaagttcggtggtcgcggtgctcgcgccagtgtttggattgctgcttctattgcgataatcgcgcttgattgtgcgattatatag

SEQ ID NO: 93632 - DNA, 1581 bp, Glycine max
  Peptide Sequence Number=SeqID_210410
atggtcaacgccattgaccaactaagtgttttaaaaccttccttcctctgctttgcttttcatagaacgcaaagcatggacaacaaaaccgatttctcaagtcctcttctccccacaagttacggtcccaatgatgccgttgactctcagggcaaaggcccttcttcttcttccataccaactactcttataatcactaccctcgtcgctgtttttggttcttacgtttttggctctgctattgggtattcatcacctactcaatctgcaatcatgcgtgacctcaatctcggagtggcccagtactcaatttttggttcaatattgacgattggagccatgattggtgccgttgtgagtggtagaatagctgattatgctggtcgtcgagttgccatgggattctcccaggttttctgcatcttgggatggcttgccataacattctcaaaggttgcttggtggctttatgttggaagactgttggtaggatgtgggattggccttctatcttatgtggtaccagtttatgtagcagaaataacacccaagaatcttcgaggggcattcactgcagttcatcagttaatgatttgttgtgggatgtcattaacttatcttattggagcatatgtgaattggcggatcttggctacaataggaattattccgtgtcttgtgcagcttctgagtcttcccttcatccctgattctcctaggtggctggctaaggctggtcgcttgaaagagagtgattctgctttacagcgcctcagggggaagaatgctgatgtttatcaagaggccactgaaatcagagatcatacagaagcctttcaaaagcaaacagaagctagcatcattggcttatttcaaatgcaatatttgaagtcacttaccgtgagcattctaaatcatccctattcatatgctccttttttatgccttatccatcgtatggcaagtaagaaaatgaatatgataatatcggatttcacacaaaagcaaaaactcttatccatgacagggttttcagaaagtattggaacaatagcaattgttgccgttaagattccaatgacaactataggagtacttttaatggataaatctggaagacgaccacttttgctggtgtctgcagtgggaacatgcgtaggatgcttcctggcagccttgtcattcgttttgcaggttcttttaataacagaatctgatctagacttgcataagtggaaaggagttagtcccattttggcgctagtgggtgtattggtatacgtgggatcttactctataggcatgggagcaattccgtgggttataatgtctgagatatttcccatcaacgtgaagggttctgctggaagccttgtgactttggttagctggttgtgttcctggattatatcatatgcttttaacttcctcatgagttggagttcagcaggaactttcttcatgttctctggcatatgtggcttcactgtgctattcgtagcaaaactagtaccagagaccaagggccgtacactagaagaaattcaagcttctctgaattcatattcttctaagagatga

SEQ ID NO: 93633 - DNA, 1071 bp, Glycine max
  Peptide Sequence Number=SeqID_210411
atgagttccaccggtggttctaccaagggcggaaggggcaagcccaaagcctccaaatccgtttcaagatcgcagaaagctggtctccaattccccgttggaagaatcgctcgattccttaaggctgggaaatacgctgagcgtgttggtgctggtgctcctgtgtacctctctgcagtgctcgagtatctcgctgctgaggttttggaattggctgggaatgctgctagggataacaagaagaatcgtattgttcctaggcacattcagcttgctgtgaggaacgatgaggagctgagcaagcttttgggatctgttaccattgccaatggaggtgtcttgccgaatattcatcagactctgcttcccaagaagaaagtggacaaggagctagcaaagggagatgatagagctgcccttgcccttgtcaaggatttgcagggccttgctgcatggaatgcctttgctatttccccacagcaaatcttctatatctcattgggcttgctctttctgtggacactggacgcggatgctcttccaactgattgtttgcaggtctcttttggtggaggtattggtagcttggttgttgatacaattgttcacagcttcagtcagaaataccacaatagggttattcaacatgaagctggccactttttaattgcctatctggttggaatacttcctagaggatatactaattctagtttggatgctctgcagaaggagggatccctgaatattcaagcaggcacagcctttgcggattttgagtttcaagaagaaacattgaataaattttcatgtatagcattggctgggatgtctaccgagtatcttatatatggattttctgaaggaggtctggatgacataagaaagggcctaggcttcacacagaagaagtcagatactcaagttagatggtctttgctaaacacagtcttgctcttgcagatgcatgaagcagctcgagcgaaggttgctgaggctttatcaatgggaaaatctgtaggatcctgcattgacattatagagaattctatcaatgtttcagatctctaa

SEQ ID NO: 93634 - DNA, 888 bp, Glycine max
  Peptide Sequence Number=SeqID_210412
atggcttccggtgaaaaccagtttccccgccagaagcaagacacacagcctggcaaagagtatctcatgaatccaccaccccaatacaacagccccgattacaagccatcaaataaacttcatggaaaggtagctgtagtaactgggggtgactctggaattggacgagcagtgtgcaacttgttttcattagagggtgctactgttattttcacctacgttaaggggcaggaggagatagatgcaagggacacgcttgagattataagaaaggctaagactgaagatgccaaagatccaatggctgtagcggttgatcatttgggttatgaagagaattgcaagagagtggtggaccaggtggtcaacgcttatggcagcatccacattctggtcaacaatgcagccgtgcagtacgagagtgattcacttgaagagattgatgataaaagactcgagatggtgttccgaactaatatcttctcctatttcttcatgactaagcatgccctaaagcacatgaaggaaggaagcagtattataaacacgacatcagtgactgcatacgagggattcgcaaaactagtggactacagttccacgaagggtgccattgttgggtttactcgttccctggcgcttcagcttgtgagcaagggaataagagtgaacggagttgcacctggacccatctggactccgttagaggtagctagtttgacggtggaagaaattgttcgatttggttccgatgtgacgccaatgaagagagctggccaacctattgaagttgctccctcttacgtgtttcttgctagcaacatatgctcctcttatataacgggccaagtcctccaccccaacggtggaatcattgtgaacacttga

SEQ ID NO: 93635 - DNA, 465 bp, Glycine max
  Peptide Sequence Number=SeqID_210413
atgggtgggaggcagctagcgactttatttggggtttccacccttttctccttcttgggtcccacctcacattcactctcaaccaatctccaccgtccgatcacattccaatccaacggcacaaccgcgctccgcttcccgccgattggggggcagaatctttccccaaaggaaaggagtagagattggattggagttcttatgaacagcagctttggttattgtacttatcaccatgatcttcgatctaatgagatgaatgtgttctgcgtggactgtgcacttaggatgtgtaggcactgtaaggaagctcattccctacatagaaggtttcagatttacaaatattcctaccaggatgtcttccgccatgccgagctgcagaagtattttgattgctccaaaattcaggtcctcatttctttgtcacaagatagtaatgatttcatagttagggtttcttga

SEQ ID NO: 93636 - DNA, 732 bp, Glycine max
  Peptide Sequence Number=SeqID_210414
atgacaaacccaacaaccatcttctccttagtcctccccgccatgatcaaattgttcaagaggaacacaaacactgacacgtgtcatcaccaccgttaccgccaccccgttttgggcctgggcctggccacaagggaggcccacaggcctcctaatgttctggaatccgctatgttgaggcccacggctcctccaccgagcgagaagagagtaattattggatccgtggacgacgtcgttacggggctggcgtcttgcaccgagagtctagggtttgaaagctccgacgaaattcacaacaacaacgataattgctgcgacgagaaagagaattgcgacgatgagatttggcggaggaggaccatgaaggcggaggggagagggaaggtgcggtcgtttccgccgccgctgtcgtccttgaaccgaaacggtaaaccgagtttttatctccggcctgtgaggaaagacgggaggttagagttgacagaagtgagaatacagcgatcggagattctgcatgcttcgaggcataacggacgcttgacattgcgcctggtgccagatctagaagaggaagaagaagaagaagaagaagaagagagggttgaggagtggaggctgcgtggtgtgggagggagtgaagggttaaggaggtgtcacgaaatggtgaagcaacatcaccatcataatgttcatggaaacctgcgaatgtgtggaatcagcattgtgtga

SEQ ID NO: 93637 - DNA, 1633 bp, Glycine max
  Peptide Sequence Number=SeqID_210415
gatgtacaattttgtccttattgtcatgtctcttgcatatcaatctccttttgttggagacttcagtgatatcaaacatggttcaatagaatccatgaaagaattggttggattccacaagtatgattatggatttcgaattacatctagatcagcatttgtggaaatcataatatttgtgttagtagcactacagtcatacatgttttcattttcagagtttgattatgtttcaaaatatctcgagaaagagcagattggggcgatacttagacagcaggagaagaaatctgcttggaagatagctcagttgcggcatatacgtaaagctgaagagttgaagcatctccgaagcttgcaggtagaaaagatgaaatcagagatgctaaatcttcaaaatcagcttcataatatgagcactgaagcaaattgtagtaatgcacacctagatttgcatgaggaaaatggatccaggaagcaagatcgtgatataactactgagtcaataggcccatttgatgggaaccaatttctactgagtgaaaaatcaaaaagtccattggtaccacaataccggaagtatccaaaggattctttgcatgaaattgtggagttaaaggaaagaactaaaaataatgatgttttggatttagaaataagaaatcgttataaacttccagccaggaaaaatgctttagtttcagctatacatttcatagggaatggagtatatcaggtgcagtcgcttggaaatatggcagttaataatctaatgaactatctgaagatagaacatggagaactagagtcaactgaagattcttcagaggatgaggagtactatgagattgaaattgagaatcagaatatgggtgccgaacctctggaacctacaatttccacacactctattcatgagcatactgtgcctgatactgctttcctccaaattggaattattttacgttacatgtggtcccgaatgaggtactggaaatcattgacatgggaagcagaaactcccccttactttgttcagctgtctatggaagttaactcatggccaaaagagggaattcagccaaagaaaattgaatcaagaataaataagttgctgaagatcttgcataagagaagatgcaaagaggagaaccattttaagttgcactcagcaagtagggttcgtgtacagagcattgaaaaaggtgaagaaaaggaaaacttgtgtcttgttgtttttgaggtgttatatgcctcccctccaattgaatttgctgctgaagaatggtacagttcattaactccagcgggagatgtatccaatgagattcagaaagctcaacatgctggtatttttaaacaaattgggtttccatatcgcatactttccgtcattggtggtggaaaaaaggaaattgatctgtatgcctacatctttggagctgatttggctgttttcttcttaatttccattttttatgaatcggtcatgaaagctaacagtgagtttcttgaagtctatcagcttgaagatcaattcccagaagattttgtattagttctcatgtttcctttcttcgaagttggtaccatagttcctgatctcaagtgttctgcttctaccaccgtctaa

SEQ ID NO: 93638 - DNA, 225 bp, Glycine max
  Peptide Sequence Number=SeqID_210416
atggattcaattggaggaagtggaactgaaggtgcaatgagtggagcaaatggaccgctgcctaaaattcacaaaaatgattcatgtggcatggaaacaccgtgtttcagttgtcggcaaaatttggccggaacaaccaaagatgtcggagcttgcggcttgtccctaaagatgttcaaaaagaaatgttggatattgtttcatctttgcatgaaaagctcataa

SEQ ID NO: 93639 - DNA, 696 bp, Glycine max
  Peptide Sequence Number=SeqID_210417
atgacaagtgaggacgacagtgttggagacaagtcatcagcacctttaaacgccgaaggttcatccaatctccgaaggccttcaccggattgcaaccatgaacgcaagaggtcgaggagaaaggttagagagccaaaggaggaaaacgtgactctgggcccagctgttagagatggtgaacatgtttttggagtcgctcgcatctttgcctccttcaatgacaccttcattcatgtcactgatctgtctgggagggaaacacttgtccgcatcactggcgggatgaaggttaaagctgacagagatgaatcatctccatatgctgctatgcttgctgcgcaggatgttgctgctagatgcaagccagtatccattgttctgtttagctttttcagtgattttgttctggtcatgctctgtgaaatcactgtagtatgggatgttattttctgtgaagctgtcaagcttaatgcactgtttcaaattattgtggagcaggaactgggcataactgctcttcatatcaagctccgtgccacaggtggaaacaagacaaaaacaccaggtcctggtgctcaatcagctcttcgagcccttgctcgttcaggaatgaaaattggtcgcatagaggatgtgacccccattccttccgatagcacacggagaaagagtggtagaaggggtagaaggctttaa

SEQ ID NO: 93640 - DNA, 1188 bp, Glycine max
  Peptide Sequence Number=SeqID_210418
atgtatagcagtggtaacccaacaaatattgcgaacccaatcaaagatgcaagtgctcgggttgatataaagacatcaagtggaaggttgacattgtttgagactactttgtgcgaaaagatatcttgggaaaagcttgaagcacgcaaaagtttggatcccctgggttatcttagagcatacaatgagaaagacattcaattaatttgttgccaatcagaggcaagtacattgtggcttgttccgccaattgtgcaggccagatttataaagtcccttaggtggaacatggacattactttctcctgggaatttatcagagataggcctaaaggaaaggaagcagtaaagtatgaactaaccatactggagcaggatcttcccaaatcttcagaagtgactaaagttttcaatggtagttcaaatagtttcactgtattcaatatttacccgagatattttcgggtcacgggctctggagatgtgcggtcccttgaacagtcgttggactgctacattcatttactagctatggctcagatcacaaagggtaaaaggtctttgcaggtggagcttgtcagtggggatcttgttcttaaccgtggagatccagagtggtggtccttttatgatttgggcatcttaggttcacatggatgtgggaagttcccaggacctatggctataattgtatctgaagaaaccccactcagttttactgagggcattattggtgacactctgagcaagttcagcatctggggtttatacattaccttcgtgctagcagttggacgttttatcagattacaatgttctgacttgcgaatgagaattccttttgagaatcttccttcttgtgacagattgatggcaatatgtgaagacatatatgctgcaagagctgctggagagcttgaagtggaagaggttttgtattggactctgagtatactcagactgaataaatacttcaaagggttggaagatttgcagtctcctactgcgtgcgtgagtcattgcagacaattgagcatggcccaattcttcgatggaaacgcaaagcaggaagaggaagaccaaccacgtgtaaaggctgctcaattatatgaatctcgagtgtatgaagccactcaaacaatcaagattttactcgaggattctattggtgtggtttactggttttga

SEQ ID NO: 93641 - DNA, 369 bp, Glycine max
  Peptide Sequence Number=SeqID_210419
atgattggcgccattgtaagcggtaaaatagcagattatgcaggtcgtcgagttgcaatgggtttctcagaggttttctgcatcttgggatcacttatcatagcattctcaaaggatgctaggtggctttgcattggaagattgttgataggatgcggcattagcctgatatcgtatgtggttccagtctatatagcagaaatagcacccaagaatcttcgaggagcatttactgaagttcatcagcttctgactcttccctttatccctgattcacccaggtggctgactaaggttggtcgcttgaaagagagtgatgtttatcaagaggaaagcatgctgatgtttatcaagaggaaagcatgctga

SEQ ID NO: 93642 - DNA, 1053 bp, Glycine max
  Peptide Sequence Number=SeqID_210420
atggtgttgactgtgaaagaaacttggtcggtaccagctattcttattcttaccacccttgttgctgtctctggttcttacgttttcgggtctgctgtgggatattcatctcctgctcagactggaatcatggatgatctaaatcttggtgtggccaagtattcactttttggatcaatactgacaattggagcaatgattggagccattataagtggtagaatagcggattatgcaggtcgacgaactgctatgggcttctctgaagtattctgcatattgggatggcttgtcatagcattctcaaaggttggttggtggctttatattggaagattgttggtgggatatgggatgggccttctatcctatgtggtacccgtttatatagctgaaataacacccaagaatcttcgagggggattcaccacagttcatcaggattttacagaagcccttcagaaggaaacagaagctagcattattggcttatttcaattgcagtatttgaagtcacttactgtaggagttggtctgatgatactacaacagtttggaggggttaatgacattgctttttgtgcaagttctatattcatctctgctgggttttcgggaagtattggaatgatagcaatggttgctgttcagatcccaatgacagctttgggagtacttttgatggataaatctgggagacgaccacttctgctggacctacataaatggaaggaaggaagttccattctcacgcttgttggtgtattggcatatacaggatcattcttgcttggcatggggggaatccccttggttataatgtctgagatttttcccattaatgtgaagggctcggctggaagtcttgtgaatttggctagctggttgtgttcttggattgtatcatacgcttttaacttcctcatgagttggagttcagcgggaactttcttcatattctccatcatatgtggcttcaccattctattcgtggcaaaactagtaccagagacaagggagaactctagaagaagttcaagcatatatctctga

SEQ ID NO: 93643 - DNA, 543 bp, Glycine max
  Peptide Sequence Number=SeqID_210421
atgaggaagatgaacttaaatctatatcaagttattactaagattcaacaacaacttttgttgctaggtattacagaaacacatgccaacaaaataaacatcaaaatgtatccacatatatatttaagacatttgtatcttgcacctcccaatatgaatcatacacttcctcaaaaaatctcaatggtcaaaagtatccttagccctaacacctcttctccatcttctatgtgtcatccaagcaccttctcttatgcaatacaaatgcggcaccacccatggtgcaagtatccaattcttgtgtcattgtcctcttttaccatccaatacgagcgtgatgtcgttgtcgtcttcttggcaataatgttgtggttattgatggtggtggttgggcttgttgagaacaaagttaggagagggacgataatgaaggaaaagaggggtcctggaaactatgttacaacaatgattgtggtggctgggcttggtgagaaggtggtgcgcaaaggtgcagacatgacacacattggcacgacggcttag

SEQ ID NO: 93644 - DNA, 2448 bp, Glycine max
  Peptide Sequence Number=SeqID_210422
atgactcatgaactttacgagttgattaatttcattaattggtacaccttgcagatttccttgctggctctatcattatggagttttcacttcgctagtctgtgctcatttggattgcttgcttatgtgggatacatcttgtatgccttcccttccatgttgcggttgcagcatttaaatggcatgcttcttgtttttattctgttttgggtatctagcacgtatatcttcaatgtagcattcgctttctccaataacaaatcatggaaggatatggagatatgggaaactataggcttgtggcattaccctatcccaggatactatttgcttgcccaatttggtcttggttttcttgttgctatgtgtaatcttgtgaacagttcagtgttattgtgcattactgatcaagaacaattaacagctgatgaatctgttgtggaagaggaagaagagacattattagttgtggctaccatagcatggggactacgcaagtgctcacacactgtagtgctgatattgatatttataattgcaataagatctggtatcgttcatgctgtttatagcctgcttaatcatatccattcagtggatttcttccaaatatcagttctcgcttgcttctgtgcaattcacaatcatgggctgcaaacactcctttcattttcagctattgtacggcaaacatcttgccctccagttggctttagcatcttgagagctttcttgatcaaaccagttcgtttatcaggttatagtccaagatctagtgagagccagggaactcatgagaggaagactatatcatatctggaggtcataagacagaatttcctttccatttatcggttatgtggcaaatacattgccttcctaacaattctcttcaatgtatacctttgcacgcccaactatgcttcatttggttacttattctttcttctactgtggattattggaagacaacttgtagggaaaacaagaaagcatctttggtatcctatgaaagtgtatgctatagtggtgtttgtctccatttacagcattggcgccttttccagctctgagatttggtttcccaggatcattgatcttcaaactgcgcttggttataacccagcatcttcaatgttgcaaaacatttggggatctttggctgtattggtagtgatgcagctatatagctatgaaaggaggcaaagcaaaagatctggatcaagtgactatgatgcaccagaaataagacctcttgcttttgccagatgtcttttggtccggcatgccgagaaaatactatatcttgccctattttatgcatccttatcacctataagtgcatttggtttcctgtatcttctcggtttaattaattgttcaagattaccaaagttgtctcagattcttgcaaaagtattcctagtttattcaggacttcttataatggctgaatatcttttccagatgtggggagatcaggctgagatgttccctggtcaaaagcacttccagttatctttatttatgggtttacagttgtataaacctggttttaaaggtttggagtcaggtttaaggggaaaggttgtagttattgtggcatgtatacttcaatacaatgtttttcattggatggagaaaaggcatgtttatggaaatggaggaaaatggaatgagccttgtcctctattcaatccaatagaagttcctaatgaaactactgcctgtaccccacaaagcaaacaattagaaaatgcaacttcagcaacatttaaaagaggtggaagaaatcattcaatgccaactgttaattctgcattatcacaagggccaggttcagggcccgaaagagagagtgccaaagaaattagacattttcatttctgggagagttccaaggatagcttgaagtggaatagaaagcggattcttttcttgagaaaagagaggatggagatgcagaagactgttttaaaagtatctttgaagttctggatggaaaatatgttcaatttatttggtcttgaaatcaacatgcttgctttgcttcttgctagttttgcagtattgaatgccatctctttgctctatatagcgtcacttgctgcttgtgttcttcttcatcggctaattattaaaaaactatggcctatttttgttatgctatttgcttccatcattgttattgaatacttggctatttggatgcgcctcacttttacgaaccaacaaattgaagaacaagtaccatgccatgactgctggagagtatcaaatatatattttagcgactgcaaaaaatgttggctaggaattattgtcgatgaccctcgtatgcttatttggtattatggggttttcatgttttcatgtttcaaattccgtgctgaccagtcttcttgtctcactggactagaggatactggacattcatcgaccacctga

SEQ ID NO: 93645 - DNA, 186 bp, Glycine max
  Peptide Sequence Number=SeqID_210423
atgtcactgcatctccaggcgccgatgtcctcctccacttcgccttccactatactgggaactctgagatcgttgtcggtggtgatggcagacctctccggtggaccaattacaaactgctctacgctagccaaacccatcttctgttgtagatctcaacaactagatattgagcaaggatgctaa

SEQ ID NO: 93646 - DNA, 435 bp, Glycine max
  Peptide Sequence Number=SeqID_210424
atgactgagacaagtatgcgagtggggaatttcgaggtgtgtggattccttgagccacagtccatccagagatctgggcaatcacaatttgaatcagaaagttacatgaagaactggatgcagaattcaaaacgggatgtctacgtaggagcctacctgaatggtgcacattggcaaatggtcgtcattttgcctaaggaaaatcttgtcgtctggttttgttcgttgcataataggttagacaactacctgaaaggaataattaacaatgctttgaaaggacttgacgatactccacaacctaaatccaaggctggtgctgggtggattgttgttaaatatttcaatgatgctagaccactggaaccagagagattgaaggcgcttcgcatccaatgggcaaagtattatttgaaagttagaaatgaaacttag

SEQ ID NO: 93647 - DNA, 363 bp, Glycine max
  Peptide Sequence Number=SeqID_210425
atggcagcggaatggagaaggaagagagagaggagacgccacttcaaggagaagatgagtctagaagaagctcaccaccataggaggccatggataagagcttggaggaagaaggagatgaatgaagggagaggaagagaagagcatgaaattttgtgctctaaaagagccttgaaatctgaagattgcatcacaatggctgctaaacaacaaaattttagcaaaactaacctgaaggctatgaatgtggccttggaacaaactttgaaagaggctccaaaagtggacgtggacaccatcaacaagcgcaaacaaatgagattggccaagtccattactgaggaaaagaccatggctgagtag

SEQ ID NO: 93648 - DNA, 719 bp, Glycine max
  Peptide Sequence Number=SeqID_210426
ggaagttgaagaagatgttgggtaaagaagtagttgtcatcatctcatgtgaagcaaacacaagcatcatcaaagtgatacgtcctggaaagttgtccattcatcgtgagcattgggagttcaaatcagctgcttcccatgaaatagagagctccaattgcagggatggttcagaatctccaccttcatctgctgtgaaggcatatatgccttgccaggaaggatgcgctggcaatagttttataatgggtgtgcacagaggtactaccttgggagctcttctgatctttgttcttcttcatactccgtcaaacttgagagagtgtcatctcagtggagggttgaaccggttgttgagtgccaggcttcagatggagtgtgctcatagtcgaaacatgcccaggcttgtgcctcagccgatgtgttattcatccattaatggctcccttgaagctagccttcttaacctatcaaggtgtaacggagagggaggaggacatggttatggagttggtgcagacttatggaatggtgtgagaggaatgttattagtggattcatcttctgatgaggaagaggctggatcttccttctttccagtgaaggaaattgcccattctttgtccctaatttttggattggccttggtagcctttgtcttgactcatcgaggaatggacaaaggaagaacggatgcacgtggttcaattgcaagttga

SEQ ID NO: 93649 - DNA, 222 bp, Glycine max
  Peptide Sequence Number=SeqID_210427
atgacgaatgtgataactcattctcagtgtgcgtttgtgtttgggttgaatgtcattttgcttcaggtgagccaacatatgatgcattccatgctggagatgaagaggcttagcctgtgctatggaagtgctctgataaatgtggcattgggaaggtgtcacattttctgggttagacctgaatcaggaaggaaagactctgacgaactcttcggagtctag

SEQ ID NO: 93650 - DNA, 1053 bp, Glycine max
  Peptide Sequence Number=SeqID_210428
atggacctttatgttttgccgatatcaggagccaacgtggtgttgggcgtccaatggcttaaaatcttaggccccgaggatgcctcctatttccacattgcggtgctcaccgaggaccctgcttccgcaccggctccggacctacccctggaaattcaagatttacttgctaagttcgccaccttatttcagaatcatcagggccttccaccggctagggacatagaccaccacattcatttgattccacacttcactctggtcaacgatgggtcctggaaattctgcatggattttcgtgctctgaatgcggtcatcgtccgggataggttccttattccgacgatcgatgagttgttggacaaattaggaggcacgaagtatttttcgaagctagacctgttgcagggatactaccagattagaatgcatgtcgccgatatacccaagacagcttttaggacccaccatggtcattacgagttcaaagtagagtatcttggccatatggtttctcagaaaggtgtggaacctgtagcttcaaaggtggaggccattcatcaatggccagtgcctcagtccactagagcagtacaaagctttctggggctcgtgggtttctatcgtcgatttattagaggctatgccaccattgccgcctctctgatcaaaatcaccatcgtgaaaccattcaagtggacctctcaagctcagctggcattcgaacaacttaaagcagctctctcaatgacccttattctagctttacccgatttacagctacctttcactattgagatggatgcctccaacatgggaataggtgtggtcctctcacaaaaaggacacctcatcgccttcttcagcaaacccttcagcccaaagttcctccgtgcttccacctatgtacaagagttgtttgctatcaccaaggtggtcaaaaagtggcaccagtacctcctcgatcatcgtttcaccattatcaccgaccaccgaagcctcaaggaattactaactcaagtaattcagacgttggaacaacacatgtatctg

SEQ ID NO: 93651 - DNA, 260 bp, Glycine max
  Peptide Sequence Number=SeqID_210429
ttttatcccaccatctctcagtagaagttttacagttttactttgcttatgaaaatccatgccacataggtacagaagatggcagcagagaaataactacttcaggactaagagatgggtcctcggatgatatgcacagggatggcagtctggttaaagtcaatggcatcagtgacacaaatgggtctggtcatcagctagactcagttgaagaaactagagatggtatgaatcagttcctttggctgccttatgattag

SEQ ID NO: 93652 - DNA, 650 bp, Glycine max
  Peptide Sequence Number=SeqID_210430
aggaagttggtactttcgatgatgaaaatgataacccttctgaaggtgatgtggcgttgagcaaggatgggacttcgaaactgatcaatttttctgtgaaggggctccagccttttgtcaggaatagcaaaaacaagcatatgattgagcaactacttatgaaggagtcattctcaagggaagaatgtgaccggttaataaaaataataagatcaagagtggtagatcctgcaaatgatgatgatggggataagaggccaacggatatgtccaacaagattcttggaagtgatacagattcacctgagctccatgatgttgccattatggaggcaaagaaatggctgcaggaaaagaagtcagcattagatacaaatacagatataggttatggaagtcttagtttgaacttggttgcattaccacaagatcccaaagatgaaggatcaccagtggatgtggccaagtcgtatatgtgcacacgccctccatgggcatcaccttctatagaccatactaaacctcaaacaccatctggaattcagctattcaaagaagaaacaccatatctatttggcaacaattctatgccatcctccaagaaaattgggtcctacattttgagcagatattgctggcacaaggcatag

SEQ ID NO: 93653 - DNA, 402 bp, Glycine max
  Peptide Sequence Number=SeqID_210431
atggcttccgttcccggatctcgatccggcggcaaaatcgtccgaacgcgccggagcgccgccgcgaggagccacaccccctacgaccgacccgctcctccgccggagcctccgagccctaattggctctcgcgtttcgttatctctccctcgcgtttcattgcttctggcgccggaaaaatcttctcctctgttttggatctcgacaattctccttctgattcttcctctgctacttgttctctctcctcttcggctaacgattccgatgctgggattttgttttatgttgagtatgtggagtggagtaacagagcttgtgtatgctgcctttattttattttgactttagttgatctaggtttggtagatctagtagtcaaggtaggtggtgcttcgtaa

SEQ ID NO: 93654 - DNA, 1176 bp, Glycine max
  Peptide Sequence Number=SeqID_210432
aagacactagtgtggttgggaaggagaagaaggccccatcttcaaattctcccatgacaaccaccaaaaagaccccaaccaaggcaccatccacaacaaagaaggccacctcaagcccatcagagaaacaagtcccaaactatctcaagcccacaatcagctcaggccttgattctcactcctctttcaagctccctaggaataatgatggtcccaccaagcccactctaaatagaagaagatctcttgacccatcttcatcttcatcttcaaggttaccgaaacaaacacatacaccttctctttcaagacaacacaaggcccttgtgtcccctgggccacgcgaaagaacactgccacttcgatcttctagtgttcctattaaaactactaacaacgcttcaaaacccattccagagaggctctcaaggaccccaaaggaagggagaacacaaccactgagtgccaagaagagccccaacaaagtttttgcttcaactagtaagaaggtaatgagtaatgatgcttcttctaactcatccaacgtttcaaagagtggtggtattaatgaatcagaagttgaagaagctgtaaatgaagagcaggttggagaagtggaaaatgtggataatcatgaagaactcccacgtcaagtagttgactctgaacatgaacatcttgatcaaaagcttgaggagtctgatcaacctcatgttcaagatgatgatgagaagggcattcctacagtgctagaagaaaaagaggacgagaatacaaaccaatatgagtgcaacattaatgaaagtcatccaaaaattgatcattcaacaactgaagaagttgagttgaaacaagaagaacaagaacaagaagaaggtggggttgttcacaaaagtgagaccaacaatgaggaagaggtagtggaagagaaggaaggagttgaaaaagtaataagtgaggaggttaaagagttgagggaaggacaaggtgaagatgaacaagtagagagtgaagttaaagaagaaaaggttgagtcaccaaagccaaaacaagtagaagaaggaggttggatgcaagagaagaaagaggttcagtctccagtatccaatgatgtgatcgaagagaatgcagggaagcaattagaagcgaggaggaataaagtgagagcattggctg

SEQ ID NO: 93655 - DNA, 1260 bp, Glycine max
  Peptide Sequence Number=SeqID_210433
atgcaaccccagcagagctcaagaattgatttgggtgaattgagagcacagattgtaaagaagcttggagcggataagtcgaagcgttacttttattacttgaacaggtttttgagtcagaagttgagcaagactgagtttgataagttatgttttcgagttcttgggagggagaatcttccattgcacaaccattttataaagtcaattttgaagaatgcctgtcaagccaagaccccaccaccaatccatccgccagatcccctgaagtctggagaacatgcttcagacatgtctcctggcagggaagatgggcatgaacacagtgttgccagcttccaaaatcaaagtcagaaagcacccgtttggtcaaatgggtttttgccggcatcccctaaggttaggtctggagtacgtgaacggaagctgagagataggccaagccctcttggaccaaatgggaaggttgattctgtttctcaccaaatcatgggtacagaagactgtggtagtaaggttgacatggagaatggaattcgttctccatgtgattaccagagaccaatacagcatcttcaagctgttgctgagctacctgagaatgaaaggggagatgttgttcagaaacctgcagaaaaaccaagaatacacgggaaagggccggctgaaatgtcaattgttgaagacggggaagaagtggatcagttaagtcgcctgggtttctctagaagtcccttgatagcaccacttgggattccttactgctcagcaagtgtagggggagcccgcaaaacattgccagtgagtagtgctggtgattttgatagctgttgtgacagtggtaggttgtctgatacagatacactgcggaggcgcatggagcagattgctgcagtacaaggtcttggagctgtttctatggaatgtgcaaatatgttgaatagtatgttggatgtgtacttgaaacggttgatcaggtcctgtgttgaattagttggaactaggtctacaaatgagctgaggaagccccttgcccccaaacagcagatgcagggtaaggtcatcaacgacatgtggccaaataatcatttacatgtgcagtgtgctggtgggtcagcagaagctgtgcctgaacacagaccaccatgctcagtttctttgcatgattttaaagttgccatggaactaaatccacggcaacttggagaagattgccctctgctattggagaaaatatccatgcaatcgtttgaggaataa

SEQ ID NO: 93656 - DNA, 147 bp, Glycine max
  Peptide Sequence Number=SeqID_210434
atgagaacaaaggaatgcaatagcaaccgaggtctgacagaacaggggacaaaggccacagaaatcacaggctggccagagaaagctggaaatattgtgggagaagggtggtgcagtgcacaaggttctgacaattgcgagctttga

SEQ ID NO: 93657 - DNA, 780 bp, Glycine max
  Peptide Sequence Number=SeqID_210435
atgagtggaaggcacttctttgactatgcggcaggggctgtgcagctgttgttatgtaatgctaggaagcgctcatattgtttagaaactattagttctgatttctgctattgtgtggtaatttgctgtttggaaggggcaagaattggtgtacaatatgagacatcttttgctggtgaaccttgtgagttttaccattgtgtgctggagagtaagtcatttcttgaaaagatgactgtccttgaacatacagttccatttttcctgccaatacgagaaatagaaaatgatctcctttcatccaatgcaatgaaattcatagatcatgttggagatctattgcaggcttttgtggatagacgggaacaggtcagacttataaaggagctgtatggaaatcaaattagagagctgtatcatagccttccctaccatatgatcgaatttgtattggatgattctgattgcaaggtgacagtcagccttagatatgcagatctcatttcggtgcttccaactcgaatttcagtgctagcctggcctatgttcaataaaaatactatggctactttgagcaggaaggaagatggactctcaggaagtcattcttctccaattcgcttaacctatgcagaagatgccttacgaaccatgagtttacctgaagctgttcatgtcctaatcggatgtgtgcagctaagccagctagcatatgcagagattgtattaaacttaccacaggcgcttcagcagacgtatcatcaaaaagcccctgcttag

SEQ ID NO: 93658 - DNA, 108 bp, Glycine max
  Peptide Sequence Number=SeqID_210436
atggttggagttgcagaaattctgtgcacttgctggattcttattcttgggttgaaggctacttacataaggcaaatgctagcttgccctccgttagttagaggttaa

SEQ ID NO: 93659 - DNA, 893 bp, Glycine max
  Peptide Sequence Number=SeqID_210437
tggatatgaacatggaaggatcttatgattcatcatgcaatggagaagctgtgtgtggcattcaggttgatgaatccaccccagagtttctctctctcaaccatattcctcttagtcctgatacccttttagaggtgaatggtgttaggagcagcatttactctgatggagaagagtcttcagttctgagaagggatagagtggataagaaatctgaggaagctacctttgtgaacactgatagtatacgttttaccgggagcatgaagtttgaggtttatgataaggagaattgcattctctctggggttctggagacgtctaatagcaatggttttgttggggaatcaagaagtggtgtgaagagatggagtatgaattgtcaaacagaaatgtcacctggttgtggcttcttcaagggaaaacatgttgctgtccctgaattgccttgtcctgaaattgaggtttatgttgctggttgcttctcaggaacacctatcatcttaaccaagacactgcaactcaattgccggaagaagcataacaggaaattcgccttggattctattccagaatatggaacaaccgagtgccagaaagatgtatctgatcatggacttgatttgcaggtagttgattatagaagcttcaaaccggaacaagcagaggattacaacagcatgtattgccaaagaacaatatatgtagatgaggaagatggtgaactatcatggtttaatgctggtgtaagagttggtgttggaattgggcttggcttatgtgtaggagttggtataggagttagcttgcaacaaaccatcagtggtatttttttcccccttcataagtctttaaagaatgttcttgtttcaaaggatggcatagatgcttaa

SEQ ID NO: 93660 - DNA, 2338 bp, Glycine max
  Peptide Sequence Number=SeqID_210438
atggctgaaccacgcgccgcctccgacactcgcctcaacctctccgtcgcaccgccattgcagatctccaaagatgtccaaggatctgacaatcccattccactctcaccacagtggcttctgccaaagccaggggagagtaaacctggatcgggatctgtggagaaccatgtggtctcaaactcaccatttggcaatcgctcagagactgttaagacatctggaaagggagaggatgttcatgatgcccataagaaaaaggatgtctttaggccatccatgtttgactcagaaagtggacgtcgtgaccgttggcgtgatgaggagagagacactaagtcctctgtccggaaggatcgttggagggatggagacaaagacctaggtgattctcgaagagtggatcgatggacagataatttgtccacaaagaactttgcagaagtacgccgtggtccatctgataatcatagatggaatgattcaggaaatcgagaaactaactttgatcagcggcgtgagagtaagtggaacacacgctggggtcctgatgacaaggagccagaaggcattcgtgaaaaatggagtgactctggcaaagatggtgatatacatttggaaaaaggcttgcctaacatttccaatcaaggaaaggatgagaaggagggagatcactatcggccatggagacctaactactcacaaagtcgtggaagggtagagccttcccatacgacaccaaacaaaccagcctctacattttcctatgggcgtggccgcggggagaatacatccccagtctctagtcttggacatggtcgggctggttcttttggtagttctttgagtagcacataccctggaactgcattggaaaaagtcgaaagcgggcatgaagaaaatcacccctttaaatataataggacaaaattgcttgatgtgtacagaatgactggtatgggtacaaatagaaaactagttgatgattttgtgcaagtacctaatcttactcaggatgaaccagtggagcctcttgctttgttgacaccaaattccgaggaactgactgtcttaaagggtattgacaaaggggagataattagcagcagtgcaccccaggtgccaaaagatggaaggagctcaacagattttactcatacaagacgaatgaaacctggtagtgcacctttccaagatagaggtgaagatggaggttcttacaaagtgcctgatgaggtgtccagcaatagagattcatcctttgaaggaaatagctctgttcatcctggtgctccacggcgaacaatgctgttgggcgaacatgctaccacccagtttcatgatagcagagatgtaactagtgatgttagattaagaaaaggagatctgaactcacaccagccaaaagatcctcataatcagtgggaaaataatttgggttatttatctgactccaaagaagtaggtaagtggcaagctaacgaagatcctgtaattaagaggcagttatctggcattttggacagtgaacttgaaaccaggagagttcctcagactgctccagaggagttatcgcttttatataaagatcctaagggtctaatccaaggtccatttaaaggaattgatattattggatggtttgaggcaggatattttggtattgatttacctgttcgtctggaaaattcagcggtggactcaccgtggttttctcttggtgatgtcatgcctcatttgcgagctaaagcccgaccaccacctgggttttctgcaccaaaactgaatgactttacagatgctcctggccggcaaatttccaatacttttgggaatacgcttgctggtttgaatgaggttgacattttgagaagtgattctaggcacaggcagggttcggatactgaagctgaaaataggtttctggagtcacttatgtctggtagcaagaatagtcctccccttgatagcctgacattatcagaaggtttacaagggtttgttggaaataatcctggtaatatgggtccatcaggagttgatagtggaaataatctttacttgcttgccaagaggatggtgcttgaacggcagaggtccttaccacccaatccctacccgtattggcctgggcatgatgcagcttcatttgctccaaaatcggatgttgtaccagatgcatcattgcattcaaaactattgtcttcagtgagtgataactctcgtcaacctcagtcccaaaattcggagttaatgtcaatcatccaaggattatccgatagggcttctgcaggcttaaataatggtgctgctggatggccaaattatcccttgcaag

SEQ ID NO: 93661 - DNA, 2100 bp, Glycine max
  Peptide Sequence Number=SeqID_210439
atggccatagctcggttagttcggcaagcaaagcggcctcatgggttgtgggtgaagatgacagctgtgaccatattgggtctctgcttcatcttcgtgtggggggtgttttcgtcttcttcaacctctgtcaccacccaaagggagagctttgaggacattgcagaacctgcttcctcttcctcttctcacaagcctcaaaagttgaagaaagatgaatctaaaaaacacccttctgctgccacgcgtcaccaccctgaacaacataagggaaaagacaacaacaacgacaacaaagagaagaaacacgtgcataaggaggataataataaggagaaagggaatcatcaagggaatgaagatcctcaaccacaacatgaccaggaagaagagaaagagaaagagaaagaggaggtggaggtggagggtgaggccgatgtggatgctggcggcggcgatttggctgaatctgtggatcagggcgactctgatgaggcggtggaagatgtggaggaggtgagaaaagcaagcaagggaaagggaaaggtgaaaggacccttgtttgatccaaatgctacctatagctggaaactgtgtagcactagaagcaagcataattacattccctgcattgatattgaagttggtggtgggaaggtacctagttaccggcacacggagaggagttgcccgaggacacccttcatgtgtctggttcctcttcctcatgaagggtatgagtctccactaccctggcctgaaagcaaattgaagatattgtacaagaatgttgcacacccgaaactagctgcatacgtaaaaaggcataattggttgatggagtctggagagtatcttacttttccccaaaaccaatctgagttcaagggagggattcttcactatcttgagtccattgaagagatggtaccagacattgaatggggtaaaaatattcgtgttgtcctggacattggatgtacagattcaagcttggcagctgctctctttgacaaggagattttaacattatcactaggcttgaagaatgacctagtggacttagctcaggtggcgcttgagcggggcttcccagcagtgattagtcctttaggtagaaggaggcttccttttccaagtcaaagttttgatgctatacattgtgggggttgcagcataccttggcattccaatggtggtaagcttctattagagatgaatcggattctacgacctggtggatactttattatgtcaactaaacatgacagcattgaagaagaagaagccatgaccacattaaccgcatctatttgttggaatgttctggcgcataaaagtgatgatgttggcgaagttggagttaaaatatatcaaaagcctgaaggaaatgacatttacgaattgagaaggaagaaggttccaccaatttgcaaagaaaatgaaaatcctgatgcagcctggtatgttcccataaagacttgtttgcacaccattccaattggaattgaactacatggagcagagtggcctgaggaatggcccaagaggctcgaatcttatcctgactgggtgaacgacaaagagaaagtggttgcagacaccaaccactggaatgctgttgctaataagtcatatctcaatgggttgggcattaactggacaagtatccgaaatgtaatggacatgaaatctgtttatggaggattggctgttgctctctctcaacaaaaggtctgggtgatgaatgttgtacctgttcatgcaccggatacgcttcccatcatttttgaacgaggactaattggtatataccatgattggtgtgaatcatttggcacttatccaagaacatatgaccttttgcatgctgatcatttgttctcacggctcaaaaacaggtgcaagcagcctgtgaccattgttgtcgagatggaccgtatattacggccaggaggttggataattatacgtgacaaagttgaaattctaaatccgttggaggaaatattgaaaagtatgcagtgggagattagaatgacttttgctcaagacaaggagggtatcttgtgtgcacggaaaactatgtggaggccttga

SEQ ID NO: 93662 - DNA, 381 bp, Glycine max
  Peptide Sequence Number=SeqID_210440
atgggtaagaagaagccacaaaaaactaaggaactttccgtggcaatagctgaagcatcatcagcaattgatgagaaagagcaacaaattcaagttcaagttcaacctcaacctcaagctcctagaaagagaggtagacctcgtaagattgttttaaagagggaggaaagtgaagaggaaaaaacacaactgatgatagggcaaagaggagcacaaggcacagagagttcaatggaaaaaggtacaaccaacgagcaagaaggaacatcatcatcagcatgcatgagggttacaacaaaacaagaggagatgcagcttccaaaagtggagccatcgagaagcagagctaggaggaaaagcaaacccagaaagagtagttaa

SEQ ID NO: 93663 - DNA, 239 bp, Glycine max
  Peptide Sequence Number=SeqID_210441
atgaacgaactaggattaattaatcaacaagagaatctgaaatcaagccttggagaagacgaacctgcggacgcggagtgtaaccgtgcggggaaggagaagattcgagtgttggggagagaaaacgagacgaaacggttaagattttgcatcgcgctactgctttatatacgcaacggaattggtggcaagttggcaatgcaggttcagaatggcaatgcaaccttgggtagcgtggg

SEQ ID NO: 93664 - DNA, 2502 bp, Glycine max
  Peptide Sequence Number=SeqID_210442
atggggatgagttcgagaacggaatggtttgcgttaagggagcttcgacaatcgttggagattagggcaaagtattggccaataaaagccgaaccgtgcgggaactggaccggggttcagtgccggaacggtcgagttgtgggcataaacgtgtcaggtttgaggagaacaaggtggggaaggcttaacccaagttttgaagtgggttctcttgtgaatttcacactgttagaaacgtttaatgcttctgggtttaagcttaatgggtctattcctgagtggttgggtgagagccttggtgtgttggaggtgcttgaccttagcttttgttctataaagggttcgattcctgattcaattgggtggttgagtaagttgaaggttttgttgctttcagggaattttctcactggcagaatgccttcaacctttgggaacctcacaaggctttctgttcttaatctctctggtaactctctttcagggactgtgcctgattctgtgtctaaacttgggaacctctcaaggcttgatctttcttataatttcttgtctgggtctgttccacctgaattgggtgccctttcaagtcttcaattttttaacctttctgggaattcttttactgggacttttccctctcaactgggtaacctttccaagttggttgatgttgatcttagtatgaattttctgtcggggtcgttgccaggtggttcatcttcttctggccttttggcactcaaggttctcattctcagagggaatttgtttgatggtgttcttccggctgatttgtggccaatgcccagattgcactttcttgatgtgtccagtaacaacctcactgggacgctgccgaatttcacgagttggaatgttagctctgttggttttgtgttcaatctgtcaaacaatttgttctatggacttttgaatacttcactggacaggtttgaaattattgatttatcaagtaattatttggaaggtgaggtgccaggtggtggtgttaataatgttagtctagatagaaattgcctacagaggattccaaaccagagggatttggaagactgtagagtgttttatgataatagaagtttaccctttggattcctcaagtccggaagccgtagtcgggtgatattcatactggtaggaatatttggtgggcttggctttattgtgctgctggcattggtcctcatgcttgttctaaaacaatgtcacaatcgtagaagcttgggagttcaaagggggaccaaagatggggggcctgttcaagaaggggaaagtcctatacctcctaaggataccgtctttgtgactgtgggagatgcattcagttttgagcaaatgctccatttgaccagcaattttgctgaagcaaatgtcataaagcatggtcattctggggacctcttcttgggagtcttggaaggtggagcaaccgtggttgtcaaaaaggtagatttgaatttatttaagagagaatcgtatgttgtggaattgggactattaagtaaggttccacatgcaagattggtcccaatcctgggccactgcttggacaatgaaaatgagaaattcatagtttacaagtacatgccaaatcgagatttagctacttccttgcacagagtcaccggttcagatggtaaattacagtccctggattggatcacgagattgaaaattgcaataggagctgctgaaggcatagcttacctacatgagtgcagccctccccttgtccacagagatatccaagctagcagtatactacttgatgataaatttgaagtgcgacttggaagtttgagtgaggttactgcccaaggagatcttcaacaaggagtcatctcaagggttttcagcaagccaccatcttccaatcaagcagattctggtaaatcatcagtgacatgtgcctatgatatctactgttttggcaagattttacttgagctcattaccggtaacattgaagtcagcaagttagatgatgcctctacaaaggagtggttagagcaaaccttgccttacatcactatatacgataaagaacgggtgactaagattattgacccatcattgatcgtggatgaggacctgttggaagaggtatgggctatggcaattgtggccaatgcatgcttgaatcccaagccttccaaacgccctcctatgaggcatgtcctgaaagcattggaaaatccattgaagattgtgagagaagaaaatactagctcagcaaggttgagatcaaactcttctaggaaatcttggagcactgcattctttggtagctggagacacagctcatcagacagtgttgttgccacaaacaaagagggttctagtgacactaaaaaatcaggaaaagtaggttctcaaagtagtggaaacgatcactcttcttccaataaaagatcgtccaatgaaattttccccgaaccattggaaatactagatgtggagacaggagtggcaagataa

SEQ ID NO: 93665 - DNA, 1356 bp, Glycine max
  Peptide Sequence Number=SeqID_210443
atggatgggatccatgcaattggtgcacgtcaccaaaactcagttgattttcctgacagtgatagtgccaaacagctgcgtatattgtcatcatctcctgatttaggacctacaactgatataggcaagcagattttctgtaaccggtcactgaatatgaaaaacattgttgctgtgggatttgacatggattatactttggcacaatacattcctgaaacttttgaatctcttgcttatcaacacacagttgaaaagctggtttatgatttggattaccctagagagttactgagttggtcatttgactcgaattacatggttaggggcttggttcttgacaaaaagagaggcaacatcttgaagatggatcgccacaaatatgtgaaagtggcctatcatggatttaaagagttgtcaaaagaagataaagttggaacatatgaaaatactttagtacatgattctttcgatgggccagactatgctctcattgatacacttttttcacttgcggaagcctacttatttgctcagcttgttgattttaaggacggaaatcctggaaagattcaagagcatgtagattatgctcgtctgtacaaagatgttcgaaatgcagtagatttgtgccaccgagatggaacattaaagcaaaaggttgctatagatcccaaaaggtatatcaatgaagacacctccatagttcccatgcttaaaatgcttagagattctggacgagctacatttttggtgacaaacagtttatgggactattcaaatgtcgtcatgaatttcctctgtggatccagtgaggcaaatgagagtacccagtttgactggcttaaatactttgatgtcgtcatcactggcagtgcaaagccaagcttttttctcgagggaaatcatgccaacctgtttgaggtcgtccctgagagtggaatgctacttaatacagataatggctctccaatggctcaggtgggtaatacctctgcaagagtactaaaggaagagaagggtcatgctcgaaaagttttccaggttctatatgttggggatcacatttacggagatattctacgcagcaaaaaggttcttggttggagaacaatgttggtaatcccagagcttgagaaggaggttaaactactttgggaattgagagatgctcgtaaggaacttcaacatctgaggagtgagcgagaccgcattgaggatgaaatgcattatctgaatgagtctctcagattaaagaatccagatgaggataccaaacaaaagtttaactcgaaacttgataaattgaaggttaggccttttaggcccattctcattttcttatgtcaagcatag

SEQ ID NO: 93666 - DNA, 240 bp, Glycine max
  Peptide Sequence Number=SeqID_210444
atgttacagaactttacggattgcacattaacagttcctttcaactcccgacatgtcgcggaacttcacggattgcctaacgatgggcgtcaagtacctcgaagtggtaaagtgagggtcgcatcccaacaaacagatgatccccggacgaaattaggggaaggatatgaatatgagtttattcagattgttgagttggtctctaacaagattaattgtgctcttttatatgttacctag

SEQ ID NO: 93667 - DNA, 681 bp, Glycine max
  Peptide Sequence Number=SeqID_210445
atggctccgagaaagctttccataaaaagatctaggaaggacgcgcggccgaagggactagtgccgctcccaagttcgatagccatcgtttcaggagcgctgagcacctgcagcgtttcgaagccatcaagggatggtccttccaccgagagagacgcgtccagctcagggacgatgagtacacagtgcgagtatagtcagagaaggaaccgggccgatggatttgacgaggaggccattgcccagctgctatgcataccgggtcaggattttgcccggaccgctgccgggagacgggtgcggatcatgcacaccagcatgactacattgacccagacgtggatgacgttgctgctcagcaacatcctacccagcgatcataactccgacctccctctgccgaagtctcagctggtgtatgccatcctgacacggatgagcgtccatgtgactcagttgatcgctgacgccatttatttatttgtaggtatgccacctaccagacaccctttagacctagataagtctaatagggccctgggttttccagaattgatcacaggtctctgccagtcgttcgaggttcccgtcacacctagtaaggtgattcgaccgtcgatcacccgggccttcatagagaagtattgcacacctagacaggcgcagagtggcacaccgtag

SEQ ID NO: 93668 - DNA, 303 bp, Glycine max
  Peptide Sequence Number=SeqID_210446
atggacctctgcgacaaggttgacgatgacaaaatacgcaggcggcatgagggggaggcactctgcgacgaggttggagcaaagggcagtggcgaggagctggcaatgacctcacgaatgccacgcctactccctccccctccctggccagcactgcgggaccaaagggagggcgatggccatgaaggaggtggaagtgctacgccacgtcagaggttggagcaaagggcaatggcggtggcgaggctgcaacacgacagaggtggtgtaacggagttggtgaggaggaggtggggaaggtaa

SEQ ID NO: 93669 - DNA, 150 bp, Glycine max
  Peptide Sequence Number=SeqID_210447
atggcagtgtcagacagagcatccaaactttggaatctatacatggatctcccaatctgcggttacaaatcagtgttgtggtcccaattccaacttgtattggcagtggtgagtgattatgaagcttgtgaagtcgaaattcagagataa

SEQ ID NO: 93670 - DNA, 786 bp, Glycine max
  Peptide Sequence Number=SeqID_210448
atggacgcttcttccttcaaggtactattactgttagttagggtttctccacatttcattactcactccttctcgttattaactcagattatattgggctcatcctccgtcgcgcgccgcaagatattatccgaaatgggatacctattcacgataatggttgctccatatcctctatgtttcatcgtacctttagatattgatgaaaagagcatccgaaaggaaactccagaagacttagttatggctctcgccgaagccaaggccaatgccattatatctaaacttcagaccaccactaatcaacagagggttgatgaacccactattttaattgcagctgacacagcagaagccatcttacaaaggctccctgttgatgactacttaaaggaagctgagccaacattattaattacctctgaccaagtggtggtgtacgaaggtgtgattagggaaaaaccaacaagcaaagaagaagctcgacaattcttgaaagattattctggaaggcatgctgcaactgtgggatctgtactagttactaacctcaaaacaggattgagaaaaggagattcggatcgtgtggagatatatttcaatgaaataccggatgagatcattgagaaactggttgatgagggaattactctcaatgttgctggggggctgataatagaacatcctttagtattgccatttgtcaaagaagtggtagggacaaccgacagtgtgatgggactccccaaagctctgactgaaaaactgttgaaggaggccctgtag

SEQ ID NO: 93671 - DNA, 1542 bp, Glycine max
  Peptide Sequence Number=SeqID_210449
atgacagtgacgagtggagaagaagaaggcgccgttggaggagttcagatccaacacaggagcagaatggtgctcccagattttctccagagcgtgaatctcaagtacgtgaaattaggttaccactacttgatctccaacctcgtaaccttattccttgtccctcttatcctcgtcacgctcattcaggtttttcagaccaccgacatcgaccacctccgccacctctggctccacctccagtacaacctcctcaccatcctcacctgctccgccgtcctcgtcttcggcctcactctctacgccgtcactcgcccccgcgccgtctacctcctcgactccgcctgcttccgccccgccgaccacctcaaggcccccttccgtagcttcatggatcactcccgcctcacgggagacttcgaggactcctcgctggaattccagcgaaagatcctcgaacgctctggcctcggggaggaaacctacgtccccgaggccatgcactctattccgccccagccctccatggccgcggccagggccgaggcggaacaggtcatgttcggtgccttggataaacttttccaaggcaccaacataaaaccaaaggatattggtattcttattgtgaattgtagcttgtttaaccctactccctcactgtctgccatgattgttaataagtacaaattgaggggtaacattaggagctttaatttgggagggatgggatgcagtgctggagtcattgctgttgatcttgctaaggaccttttgcaggttcataggaacacttatgctgtggttgttagcactgagaacattactcagaattggtactttgggaacaagaaatccatgctcattcccaattgcctatttcgtgtgggctgctctgcgctgcttctctctaacaagccggcagatcgaaggagggccaagtaccggcttgtccacgtcgtgaggactcatcgcggggccgacgacaaggcgttccggtgtgtttaccaggagcaggatgatgctgggaaaactggtgtttccttgtctaaggatttgatggcaattgctggtggagcattgaagactaacatcaccacacttggtcctctggtgctgccaattagtgagcagcttctgtttttcgtgactctgctgatgaacaagttatttaaggctggtgtgaagccttacataccggatttcaagcttgcatttgatcatttttgtatccatgctggtggcagggctgtgattgatgagttggagaagaacctgcagctgcttcctgagcatgtggaggcttctaggatgacccttcatagatttgggaacacttcctcaagctccatttggtatgagttggcttacattgaagccaaagggaggatcaagaagggtaacaggatttggcaaattgcgtttggaagtggtttcaagtgtaacagtgcggtttggcaggctctgaggaatgtgaggccttctcctaatggaccatgggaagattgcattcataagtatcctgtggaaatagtcacatag

SEQ ID NO: 93672 - DNA, 762 bp, Glycine max
  Peptide Sequence Number=SeqID_210450
atgtccagtaacaatgcaacagctttggagattccaattctaagctactgtaaagttaaggtacgcggtgcagtatgcttggagcttcatagactcattgatagaatttcgcatgtaattttagccatcgaatctgctcgaccaaatagtacgttagcggtgcaggtgttgtgctcattaaacttcactttggctaaagccaagtcagttatcagacattgttccaagtgcagtaaactctacctggcaatcacatcgcacaagatactttcaagatgtcaaaaagtaagaaatgcatttgaattttatttggctcagattcaaaatgcggttcaaactccattggctgatgagatatctgcaatactacatgaccttagggatacagaattttccctggaatttgcagaagacgaggctaggaaagtactactttcactgcttgagaagaattttccagatgcagcttctatacaaaaggaagaacttgaagctattcaaattgcaacttctagattggagatcaaatccccgttttctctcttagtagagaaagcaacccttaagaagcaacttgaagaagtcagtgaaaaaaacctaaaggagaaggagcttctacaataccttttgtatctcttggtcaaacatgggaaatccatttgtcagtttcaaaatggaagccactccccgaaacatgaatgtcatgaccagtcctttgagaatgagttggttgtggatgaatcaagtcaatcactctcttaa

SEQ ID NO: 93673 - DNA, 1836 bp, Glycine max
  Peptide Sequence Number=SeqID_210451
atggcacatagaagtaagtcatttcgttttaggatcccatggctatcagtaccatctgaatcattcgctcgtcggacaaaagaaagaccaagatctccaccccactcagacacaagtgtgccaattcatagaccatctaagccttctttggtagttccttcagagttatctcctcctagtcccaccaaaactgaagaagccccaagagctgaacctcaaaaagagtcactacctcatccaacacaaccactaacatcttcattcagcactgagtctccagtgaaggttcaacctcagccaaaaccactttctccgcagccgccacttcaaccttcatctcatgcagactctccatctcaggttcatattgcaccctcatcccccaaaactcatttggcctcaggtagtggagtcatgaaggtgccaaagcttgttgctgaagaaaccaatcctcttgcatcatcttcctctgagcaagaaaaggaaaagatggtcttgtctgaaccaaaacaacaagaagccgagccaaaggtagaatcaccattgagaacaatcaccaaatcaccagaaacctcttttcaacccgagaggatgtcaacacggcctgaagacactaaagaacaagttccttctgtgccctctttatcctcagtttcaaaaactgaaccaatcactcatccatcatctcctttggcctcaaaggacatcaaaaccgaagaaaccactcctgaagaggaaaaagagaagatggcagtgctagttccacaagaagaaaaacgaaagatgaagtcacctttgaaaaccattcccaagtcaccggagatctcttctcaacctgagaatctgtccacacagccaacaacaattgagcaaagatcaacaccaccaaaaagcaagtcccttcaacctgaagaaaaggagaaagtggtgcatgaaaccaccaaggcacgaggaaaaggcaaagacacaacaaccacagcacaatcaagtgaacaaagcaccatggcatctgcctcaggaacatcatcatcaacaacaacaaaggctaaagattcattcgccaagaggtttcatggagagaagaagcatcatggagcacgagaaaccgtggagagaaaaataatgtttgccacaaccaaccccattgggaaagacacaaaagttgtgagctcaacagatgaaggcacaaggaatgtgtcaagctcaagcatatcacctgaaaaaactgcttcatccagtggtgaaaaggctcctccattacaaaaaggcatcaaagatgatatcacaaattttgttcacaaactaacagcctctgtgcaccctacacaacacgtggatgaaaaacagtttagtgtcataaccttggctggtgacaatagaggagccacaatgcacttaggttctgagtcagctaagaaagagggttcaattcacatacaccgagcctacaagagtgatcctgaagataccaatgaggtcaccactgatggagaagaaaacacaaatgaagaggtgggaatggcatatgtcaatagcaacatacaaagtattaacaactcactcatgtttcatggtttaatcactgaaagagaccctggtgtgcaagtgactcttcctcaaaagcccgctgagcccatcaagcccgatgataagcccagtcccggcttggaaactcagagaactcagttcaacatcaaccgggccgagaagtcaacataccagcccacggtcggaagaagcatcagaggccctttccttaaaccaaatgacaaacctcgccgtcccggttgcaacttcagttgtgacaaggatattgaagacattgagattctgtga

SEQ ID NO: 93674 - DNA, 2082 bp, Glycine max
  Peptide Sequence Number=SeqID_210452
atgagctggagaaccctagcttccacttcaagacacactttcaagagactcaatgcaatcctacgatccccttccaccaccatcccttcttcacgcgcctcctcctcactcttcctccacgtgccgttctccaccaccaccctacattccctgccacaacccaccaacgccctcatcgaccctaaactcctcgctccgcaaaacgacgccgtcaacaacaacgacgacgaaaccacgaacgagttcttatctcgattcgtgtggataatgcggaagaaggtgaaggaagcgtaccctgactccgacaagcccaccgtcgacggcatgctcgtcgccatcgtcgagatggtcgtctcggagatggaaaagggtagcatcggaacgacgtcgtcgttgttttgttctgctgatttcagcgaggatttgtggagaacggtgtgggaggtgagcagtctggtgctggaggacatgaacaaggagataaaaaaagagaaaatgaagagcttcttgcagtgcgaggaggttaaggagatgtgtagattcgccggagaagtcggcattcggggcgatttgctcagggagcttaggttcaagtgggcacgtgagaagatggaggaacatgaattctatgagggtttggagagattgagagaagaggcacgaagtgagggcaatggaattggtgttattactgagaagaaggagaaggtgaaagagaaggttgttgttggacttcccaagaggagagggaacataaggtacaagatctatgggcttgatctctcggattccaagtgggcacaagtggctgataggatacatgaggccgagcaggtgttttggccgcaggagccgaagccaattaccgggaaagcaaagattgttatcgccaagattctgtcctcgaaggaggaggatgacgatggtttgcaaagcctgttggctgagtgggtggagcttgtgcaacctagcagggtggaatggatggatttgctcgacaaattgaaagagcagaatcatggtttgtacttgaaggtggctgaaatggtattggctgaagattctttccaaacaaatgtatctgactactctaggcttattgatatctatgctaaagagaaccgctttgatgatgttgagagaatgttaaagaaactgaatgaaaatggtctacaagtagatgcttcaatagccagtactttggtcctcatgtactgcaagggaggcaatcttgcacgtgcaactgaagcatttggagtcttgacaagcctgggcttccaaccagatgcacatgtctacaactcaatgatcatgacatttgtgaataatggccagcctaagttgggcgagaaattgatgagggacatggatgatagacttattacaatcacaaaggacatatacatggcattgctccgttcttattctcaacttggtgatgttgcaagcgctgaacgaatttcaacaactatgcaatttgcaggaatccagcagagtacggataaggagacatgcaccctgcttgttgaggcatatgcacttgccagtaaccctgatcaggcaagaagccattttgactgcatgataaaatctgggcatcagcctgatgataggtgcactgctagcatgattttggcttacgagaagaaaaacgacttggacaatgctttaaatcttcttttggagttagaaaaggatgggtttgagcctggggttgccacttattctgttcttgtggactggttgggtaagttgcagcttgttgatgaggctgagcagcttttaggcaaaatagctctgctgggtgaggctcctccctttaagcttcaagtaagtctttgtgatatgtatgcaagggctggaaatgagaaaaaagcccttcaaagtctaggcgttctggaagctaggaaggatgaattaggtcaagctgagtttgagagaattataagtggccttattgatggtgggtttcagaaggatgcacaaagaatatgtcagatcatggaggcacagggttttgatgcatcaagggttaagtttaaactttcgaaacctgtctccagagcaccgagtttgagatag

SEQ ID NO: 93675 - DNA, 318 bp, Glycine max
  Peptide Sequence Number=SeqID_210453
atgagaaaatgcgacggtgttggaagacgagtgggctggctcaatgagaagtttaaggaaagtgaagagatgatgggaaggggtggcattggaagtttgaggaaggagttggaggagaaggttctagagaaaagagagaaagtcactcccatttttcactctatcttcactctcacctcactcactctacagtcgcgcccaattcgtcatatcgaaggccctgtcgtgcccagttcaccgtctaggagtcctccgtcaccggctcgtcgtcgcaagctttctccatcactaggtcatcgtgccttgttccccgtgtag

SEQ ID NO: 93676 - DNA, 777 bp, Glycine max
  Peptide Sequence Number=SeqID_210454
atggagttgcaagatttgccagaaggatgcattgcaaaaatactgtcatacaccactcctgtggatgcatgcaggctctcagtttccatagcctttcgttctgcagctgaatcagacactgtgtgggattgttttctcctctctgatttcacctccttcattcctccttcctctacatctaagaatgatctctatttcactctctctgacctccccaccatcatggatcagggtagaaaggaaaagaaccaagaaaagcattattggtttcgaagtgttcaattggcaaaaggaccgggaagaagtgttacatgctttccgctagaaatctggccattatatggggtgatactgttcgacattgggagtggacaagcctgccagagtccaattgtaatggtagatgatcaccatttgaaaccttcaattgaattattgatttttgcaaatgtctttaattttgtgccacgtgccattgattcatatgtagccaggttccaagaagttgctatgcttcgggctgtgtgctggtttgacattagtgggagcataaacactcttaccttgtcctcaaatactcattattcagcttcactagtgttcaagatgatcaatcccagtggatttcactaccatcccacggtgttatcagttggcatttttggaggcaatagcaataccaaatatgtttgtttggaccccaacttaaaagataatcatcgcttccaagaactacaatgtcctaaagtgagaagtgatgggtggttggagatttag

SEQ ID NO: 93677 - DNA, 975 bp, Glycine max
  Peptide Sequence Number=SeqID_210455
atgttcagaaaccagtacgacacggacgtgaccacatggagccctgcggggaggctgttccaggtggagtacgctatggaggcggtgaagcagggctcggcggcgatagggctccgatcgaagacccacgtggtcctcgcatgcgtcaacaaggccaactccgaactctcctcgcaccagaagaagatcttcaaggtcgacaatcacatcggcgtcgccatcgctggcctcaccgccgatggccgcgtcctctcccgctacatgagatccgaatgcatcaactataattacacctacgagtcgccgctccccgtcggcagactagtcgttcagctcgccgataaggctcaggttttgaaagatttccgccacgataatgtcaagtattgcggttgggaagacttcaaaatccttgatgaaggctacaatcgtggttgtggactaattttgaaaaccttttggcgtgctaccggtttgcacacagcggtcttggaaacgtccttatgggttggactcctggtagctggattagatgaatcaggagctcacctctattacaactgtcccagtggaaactattttgaatatcaggcttttgctattgggtctcgctctcaagctgctaagacatatttggaacgcaggtttgagaatttcgtgggttcttcgagagaagatctgatcaaagatgcacttattgcaactagggagtccttgcaaggtgaaaaactcaggagttctgtgtgcacaattgctgtggttggagttggtgagcctttccacattttggatccagaaactgttcaacagttgattgatacttttgagattgtgagggaggaagaagccgctccagccgaagaagaagctcagccagcagccgaacaggatgctcccacagatcagggtgctgctgctgctgatcaaggtgctgctgctgctgtagaccaaggtggttctcctatggacatctaa

SEQ ID NO: 93678 - DNA, 480 bp, Glycine max
  Peptide Sequence Number=SeqID_210456
atgggggtcattgttcaagagaaggaaaaagtagaaaatgggttagtgtttatggttgtgttgttgccgtgggctttcaagggaggaataggagaagcagcaacggtgggggaaggggtggcaacaacgatggtgtggagctggtggaagagttggttagggactggtgggggtggtttggggggttttggagaagcagcagcaacaacgtcatgttttactttaaaaaaaatcctatgtgtaatctcagtcaagacaaaaatcacacatgacactacacatagcatgcctatgtggccaattaacgatcacctaccaccatcactgatggtggtagtggtggtggcaacaatgacgacgacggtcatgacaacaatggtgatgaaaattgatgacgatggtgataacgacgagaatcatggtgataactgcaatagtggtaatgacgatgacaaagacagaggtggtgacggtcgttga

SEQ ID NO: 93679 - DNA, 1398 bp, Glycine max
  Peptide Sequence Number=SeqID_210457
atgccattcaggagcattgtgcgtgagctcaaggagattggagagggcattagcaacatgtatagaagaggtggagaagccaagcatgtgcatcgccatggaaaatctcacattgcaccagaatgttccttaccaccaccaccatcatcatcttcttcttcttcttcatcttcatcatggcagagccggtgggctaatttgccacccgagttgctattagacataattcaaaggttggaagccagtgaaacttcttggcctgcacgtagagcacttgtggcatgtgcctcagtttgtaagttgtggagagagataacaaaggatgtggtcaagacaccagaacagtgtggttttatcactttccccatatcactaaagcaggtttggaaggacatgcctggtccaagagactctccaatccagtgttttattaggagagaaagaatgacttcaacatattgtttatatctcggtctgagccctgcaattgtactggcaaatgataattcatggatatttgctataaatgtaactgcagcaaccgtgatgaaaattgctctttctggtgatatgagcaaacttttactggcagcaaagaagattagaagggcaacatgtacagaatttataatatcattggtttccgatgatttctcttgggctagcaacacttacgttggaaagctgaggtctaattttctgggcaccaagttcacaatcttggatggcgagcccgcgcatgaaacttcacttccactgaattgcaagttgcagcaaagagtccatctgaagcaggtacttcctaacaaggttgctgctgctgctaactacaaagtggccacagtatcttatgaactcaatgtcctccgaacaagaggtccaaggcgaatgcggtgtatgatgcacttaatccccatatttgcaatccaagaaggagggaacgcccctactcctttgaagtttaccaccaattatcttaatgatcatgcgtctaccaccaccgagcatgcatctaccaccacaccagactcaaaaggaaagaaaccagaagttgttgagtttgactcaactggcactgccaatactccagaatcaatccagcgggcaagggaaccattggttttgaaaaacaaagctcctagatggcacgaacaactgcaatgttggtgcttgaatttcaagggaagggttacagtggcctctgtgaagaacttccagcttgtagcagctgctgaaccatgccaaaatgtttcagctgcagaacaagaaaaagtgatactacaatttggaaaaattgggaaggacatattcaccatggattaccgataccccctctcagctttccaagcctttgcaatatgcttgagcagctttgacacaaaaccagcttgtgaatga

SEQ ID NO: 93680 - DNA, 210 bp, Glycine max
  Peptide Sequence Number=SeqID_210458
atggcgcaagcaatggctggtggcagtgccaatgggagaacaaaagaagacaacaatggaagcaaggatttgcgaaaagagctcgtgactatgaaatgtcggcggcaagttccggcaccactactccactcaatttttcgtgctctacgcaatggatcgagcgaaatcgcgttttgggataaggttctattgatcctcttctacctatga

SEQ ID NO: 93681 - DNA, 129 bp, Glycine max
  Peptide Sequence Number=SeqID_210459
atgaagaggcgagagaagggtagtgtgggaatgagatatagtagtaatatggtaagaggaatcaaaggacgtgaccacactctcaacatgccaccctctcattattcgacaccacaccaatacggttag

SEQ ID NO: 93682 - DNA, 744 bp, Glycine max
  Peptide Sequence Number=SeqID_210460
atgggaggttcagggacaatgaagactcaagttctcgttgttggccggggccccatattgatacttacattcttgcgccagaaagtcactcttgaatcgactggctctacttcccctcagttgaaacagagatcaacaggtttaaacagtggtgacaaagggattccatcaatgcaaaagaatcatgacatctcatgtgatggagaagtaatgcatacagatgcaactaatgttgttaataaaacaaaatctacaaatcagggaaatggaaagggttctagcttgttgaatttaataaacaaagaggattcttcgaagcaatctttgaaaacaaaaatgctgggagtcccttcctcggtgaagcttgattatgaatgtattactgaaaaatgtgagaggaatgaaagaaaagagtgttgggataaaacatgtgatgaatcagggaaaccactaaattcgtgttcaaaggtgaaggacaattctagtagtggtggtcctcttcgttatgctctccacctacgctttatttgcccttttccaaagaagaccaacagatcaactcaaaaaagcaaaaataattctcttcaagaaaattctggattggacatggaaggggaacgaagattctacttatgtaatgatttgagggttgtgttccctcaacgtcattcagatgccgatgagggcaagttgaatgtggaataccatttccctgaagatccaagatactttgacatcaactga

SEQ ID NO: 93683 - DNA, 309 bp, Glycine max
  Peptide Sequence Number=SeqID_210461
atggaaatgaaaatggagattcaaaaggaagggtcatttattgtgactgagcatgaagcttatgaaatcgattgggatgctggaatggaattgcaaagtgattccccaacaacaggtacgccattaacgagtggagaacgagttgcaaggagcattagggctgtggttgaatccatgttggaatctcatttcgggtgccacataatggatgagctgtttcgaaggtacgcacaaatggtagaggaccacttatcaaagactaggaccaaatacattaatttggtcatttctctcgtcaagcaaggttga

SEQ ID NO: 93684 - DNA, 1575 bp, Glycine max
  Peptide Sequence Number=SeqID_210462
atggatgcaacttttgcaaccctgaatgccagtgctaatctagtcactaagggaattggatctagaaacagaacttcttctgggttctggggtgagaacacaaggggaagttttaacatgagattttgtagtgttcaatcacgcaagagtttaaaagctactactttcaagcctggctttgcacaagctgtttattcaccagacgtgaacaaagagccactggtattccatggacccatttttcagaatccaaaagcaaacccagaaaatgtagctgctatcatattgggtggaggggctggaactcgactctttcctcttactagcacaagagctaagcaagcggttccaattgcagggtgttacagactcatagatattcctatgagcaattgcatcaacagtggcatcagaaaagtgtacgttttaacacagttcaactctttctccctcaatggccacttgtctcgcacttacaattttggaaatggcgtgaactttggaggtggttttgtggaggtcttggctgctactaaaactcctggagaatctgggaacaaatggttccaagggacagctgatgcagtgagacgatttatctgggtttttgaggatgccaagaacaaggatattgagaacatattgataatttctggtgatcatctttgccggatggactatatgaagcttctggagaaacatattgggacaaatgctgatatcacagtttcatgtgtgcctatggatgaaagccgtgcatcagactacgagctaatgaaaattgatagaaagggacagattacccagtttgtagaaaaaccagaaggatcagatttgcaggcaatgcatgttgataccactctcctaggcttaactgcagaagaagcacagacatatccttacattgcacccatgggtgtttctgtattcagaactgagaccctgctgaaactgttaagatggagctgtccttcttgcaatgactttggatctgaaattatcccatctgctttgagggaccacaaagtccaagcatatatgttcagggactactggaaagatattggaactataaagtccttctttgaagccaatctggaactaacaaaacagtctccaaattttgaattctatgatcaagagacgcctttcttcacttctccaagattcctaccacccactaaagcaataaagtgcaagatcatggatgcaattatttctcatggttgcttcttgagtgagagtagagttcaacattctattgttggtgtgcgctcacgtttagagtccggttcagagcttcaggataccatgatgatgggtgctgactactatcaaactgattctgaaattgcaactcttctggaagaaggaaaggttccaataggtgttggagagaatactagaatcaggaattgtattatcgacaagaatgccaggataggaagaaatgtgattatagccaatactgatggggttcaagaagcagacaggcctgcggaaggattctacattaggtccggcatcgtagttgtagtgaagaatgcaacaattgaagatggaacagtcatttga

SEQ ID NO: 93685 - DNA, 900 bp, Glycine max
  Peptide Sequence Number=SeqID_210463
atgaagcttggtttctttgtggtctttctggttctctatatgatactagaacgtgggatcttgttattaccccaagtagaagctgatgatcatgatgatggctttgtgaaagtaagaggggtgcagcttatgctgaatgggagcccctactatgctaacggttacaatgcatattggttgatgtatatggcctctgatccatctcagagaaacaaagtgtcttctgtgtttcaaaagggtacaaaccatggacttaacatagccagaacatgggctttcagtgatggtggatacaagcccctacaatactctcctggattctacaatgaagacttgttcctggggctggactttgtaatatcagaagccaggagatatgggaccaagcttgtgttgagtttggtgaataactatgataactttggaggaaagaaacaatatgtggactgggcaagaagtgagggccagaccatagattctgaagatgatttcttcactaaccctatagtgaagggatactacaaaaatcacgtcaagagtgtacttacaagacgtaataacttcacggggatcgtttacaaagatgatccaactataatggcttgggaactcatgaatgaaattagatgcccttcagatcaatcaggaaacacggttcaggcttggattactgagatggcatcttatttgaaatccatagatggaaaccatttgctagaagctggtctggagggcttctatgggctgtccaaacaagagtctaatcccagcttccacgtaggaacagatttcattacaaacaaccaaatccctggcattgactttgccacagttcattcataccctgatcaatggtgtggatttttccttctattctttataaaaacttcacaaggataa

SEQ ID NO: 93686 - DNA, 231 bp, Glycine max
  Peptide Sequence Number=SeqID_210464
atgacaccatctcaaaaatcaataaaaatcaacaaattagacgaaggggccggggagcgccgccaaaggaaacctggctcttggttttgtgaggtggtgtcatggttgtgcgtggcaatgttgtggttgtttgtagcggcgttaagtcattggtgtcggcatggtgggtttatgatttgtggtgattttggcacttctagtcatcaccgaaggctctttcattctttgtag

SEQ ID NO: 93687 - DNA, 429 bp, Glycine max
  Peptide Sequence Number=SeqID_210465
atggaggagaagaaaaagaaacaactggaggaagctgctaaatctgaaagcactaacaccgtcattgatcctccatctcccatcagaagacacgtgaagtggaagatggcccgcaccaagaaaattggccaaatgacgtctgaggcagtaaaggaaattgctgacaagattgattccttagaggagcatacctcacaaggttcctttgtcgcctatggacgtcaagatgtactgactgctgccattggcacaaaggaaggttttgtcgatccctcagggaacgatccagacatgggtgactccaagaaatgcgggttatcaatggcagtggaatggagaaggaggaaaggtgattggagacgccacttcatggagaagatgagtcaagaacaagttcaccaccataggaagctatggataagagcttga

SEQ ID NO: 93688 - DNA, 774 bp, Glycine max
  Peptide Sequence Number=SeqID_210466
atggaaacgttggaagtacttcacatgaacaaaggcgcaggccaaactagctatgccatgaactcttccgttcagaatacgataatctcttgcgcggagccagcaagaaagaaagctcttgtgcaaattctttgctcaagtaattggcctgagaagatgggaattgcggacttgggttgttcctcaggaccaaatgccttaagggtcatttcggagatattggatggtgtgtatgccaccacatgcctcttgaatcgccctgcgccagagttggtggtgtatttgaatgaccttttcaccaatgacttcaacaacatctttggctcattgccatctttctacagaaaacagaagcaagaaaagggtagtgggtttggatcatattttgtttcagcagtccctggctctttctatggtaggcttttccctagcaaaagcctccactttgcgcactcttcttctagcctccattggctttctcgggttcctagtgggttagagaatggtagtgggagagcattgaacaagcgaaagatctacttatcaaagagcagtccaaagtgcgtgctagatgcttattctcagcaattcaaaaacgatttttcagtgtttcttgcttcacgttcccaagaaatggtagcggggggacgcatggtcttgtctcttatgggcagagaatccatggacccaaccactgaccatagttgctatcagtgggaactcttagcacgatccctcatgagcatggtttctgaggtacgtacacgtaaataa

SEQ ID NO: 93689 - DNA, 561 bp, Glycine max
  Peptide Sequence Number=SeqID_210467
atgtcatcacaaacagccgcctccatggaggcgccggagtcccacgcgccgctgctccgccccctcaccgatgccagccgagcccccgtccccacgctcgcgctcctcctcggtcgcgccggccgtcgcggtccctccatgctggtgcgggagacggcagcgcgtgagcttgaggagcgccgggccgactggggttactccaagccggtggtggcgcttgacatgtcgtggaacatggccttcgtcgtcgtcacggcggtgatgctcgcatgcactaccgccgagcgcccgaacacgccgatccgcgtgtggatcgttggctacgcgctgcagtgcctcgtgcacgtgttgctcgtgtggctcgaataccgtcgccggagccggagggactcgcaccacggccagagagcgcgggacgtggagagcgacgccggcagcggtgacgaagactacagtgacgacagagattggagctctggctactcgtctcgctcccgatatgagatagaaatgaatagagagtacagttggtcagatgaacgtttacgctggagcttgtga

SEQ ID NO: 93690 - DNA, 330 bp, Glycine max
  Peptide Sequence Number=SeqID_210468
atgggtaacaattccccttgcaagactattgggatagattctatacaaatcaaaatgcatgatggaatagttagaaccttaaccaatgtttgtcaagttctaaagcttaagaaaaatctagtctttgtggatgccatggattcaaaaggttttatctattgtgttgaaggtggagtgatgcaaatcaaagggaaagttccatccttggaaggagctaggtactttctttcagtcatcaatgattacttagggatgacacaggtttggcatagaataatggacaaatacaccattcttttgcaggcactgattttctacccccctggataa

SEQ ID NO: 93691 - DNA, 351 bp, Glycine max
  Peptide Sequence Number=SeqID_210469
ataactgtggtgtcagtagaacttggccgttcaaggtgcaggcaaaaggtgatgaagttaattgcaagtgttgaaggaatcacttccattgtcctagacccagacaaaaacacagtgacagtggttggtgaggctgatccattaaggatagtaaagaatgttagaagattcagaaaatcagcaaccattgtgagttttggccccccaaaggaagaaaagaaagaggagaaagaaaaggaagagagaaaggatgctgatactcatactccgaatttgagtcagagatgtgatgtgtggcctcactggtatgtgactgttgaagatgggtatagtcactgttccattatgtaa

SEQ ID NO: 93692 - DNA, 1830 bp, Glycine max
  Peptide Sequence Number=SeqID_210470
atggctgatgcttgtgctggagagagcaatagagaaaacgcgagaaaggattcgaattcaatatttcctctctcaactgagcggaagtgcgaagaaattgacactgagcatgttgctcttcttctgcacgcaggaggttgcaaaatgagaaaaagaaaggtacaagtgagtgataatagtcaacctgtaagagagatgttgaggtggacggatgagatggacaaccgtgtactaaatgcaatggttgaagaagctcgagcaggtaataggatagatggaagttggacaccacaagcttacacaaaaattgtccaaaccttgagagattcaggattaacggatgttacaaaaaatcatgtaaaaaatagacaaaaaacaatgaaagatagatggcgtgaaattcatgacctattcaatggtcttagtggatttgcgtggagtccagtgacgaagagatttgaggctgaagatgaggtttgggatgaactaataaaggctaaaccatcggctgcaaaatggagagcttctcaagtgaggcattatgatcttcttgaagaactttatggttcaaatcatgccacagaacacatgggatgtactccaaggcaaactcatcgaactatggacaaggagaatgtcaccattgactccaaggaaacgttgagttcatctaaggaaaaaagaggcagagatggcaaacaaaagaaaaggcaaaaaacctctcaacctcaatcacctgagcccgtagcatctgaggacattgcacatatattggatcatagtcgctatttcagcaaacaaaaacaaatgacatcatatgctgatgatttccttttaagggatctcgtccatcctaagattatggattttgattactttgtgactagtggtcttcaatttcaggaattactctccgtccaaggacttgacgcttttgtctcacttgaggatacctactatccgaacctgataaaagttttctatgcaaacttaaccatattggacaatggtgacttgtgttctgaggtttgtaaagtgaagattcgagtcaaaccacgcgattggttggctatagctaatttgaagtatgaggggcaaaagtttcaactttccaaacttcctgacaacattgggtttcatcgtggtcaggcattggatgcgatggtcagacctgatttgcagggacgcaactgtaaaaatactggtagtttgacaattgaagatagactcttgcattatgcattcgtgcatattttgatgccacgcgggagcaactatgcactagttttgatggaagacatttttattctttgggctatcaaacaacggattcaaatcaattggccatacctcatttgtcaacatatgaagaagtgcaaggttaatgggatgccccttccatatggtttactaataaccaagataatggaatttcatcgcattcatcttggtgcagagaatgagagtttacctggttggtctaatcgtttcaatcaaaaaagcttgaagaaattgaaagtcatacaagttgatggagtgtggcaacattctgatcaaaacatgtcgatgcctatggaacatggagaggaggatggtgactcagaaagtgctgaaaaacctcaaggtagtcaacctcaggcacctcaagtaactcctgatagtgatatgttaaaccaatttttctctagtatacaaggtttacaagatggattaaaccgtttaacagatattgtacgtgaggagtttcaaagggttgacaaaaggtttgatgactttgacaaacggtttgaagatcttcataatctctaccagcaaggcccatcccaatag

SEQ ID NO: 93693 - DNA, 1290 bp, Glycine max
  Peptide Sequence Number=SeqID_210471
atggctggcacgaagaaaactggtcaaatgacatctgaggctgcaaaggaaattgcaaatagaattgattccttggagaagcaggcctcacataaagctttgtcgcccatggaccaccttggtcgtgtccgtgctgctggaaccagtgtgatgatcaaacactactttggactggcttcaaggggctcccacaactcttgctccatggctattgaagacctagagcagctgacacaaaagatcaaagaccaactggaggagccgatcacacaaaaagttggtccttctgctactcatgtcagcacaaagggaagttgtgtcgatcccttggggaaggtcccagaaataggtgacttagacaactttgggttgtatgtcgatgacaatccttcccgactcattactcttggaagagtttatgaggggtcaacgaccatccacaacattcttttgggcaatgatcagatgaaggtcggtgttcaggaagttcgagatgctaatgctcacattcttgtacccattcaagaggtagctgaggcaccagcgaaacttgtacatatgccaaatcttgacgttgatctgttgtacctgatgacattgaccattccgcagcttttcctgaagttgttgcaggtgtcatgggatgctagtgtgtttgggatgaaaagaaaaaactcagtgcgaggggcaattcttccaccacagacattatcttcaaaatctcaacggatagagagtgtgccaatgagagagagtgagtggaccaccgtgaggagggggaaggggagacagcgagagagacaaagagatggagaggatcctagactaaactacgcatcggcaaggacaagatttctacacaagtatcacacctcaagctggagggagaagcgagacatcactacatactacttcacacgtttccctgaccatacaacagcgaaagatctctggacctacttcaagaaatggggtgacgtaagggagattttcatccctaatcacaggaaccaagggggaagaagatatggtttcgctaggttcaaggatgtactggacgaacacgaacttgcaaggaagctggataatctcatcatagatggcctaaagttgtatgtgaatctcccaaagtatgggagacgaaaaatggggtctgaacagcatgttgacaaattgaagaccaaacaagaaggacacaacacagaggggaggaatgaacatcacaagccaacaatgttcagaactgagcacaagacatatgcggaggtcacagctaacaacaacccaatg

SEQ ID NO: 93694 - DNA, 1308 bp, Glycine max
  Peptide Sequence Number=SeqID_210472
atgtcagggcctcttgatcgttttgcacgtccctgctttgaagggttctctggtcatgatgaaaggagggagaggaaatcagattttgagaactcagaagacgataggcgaacgaggattggtagcttgaaaaagaaagcaatcaatgcttcaagcaagttcaggcattctcttaagaagaagagcagcaggagaaagagtgcaaaccgaagtaattcggtttccattgaggatgttcgagatgttaaggagctccaagcagtggatgcatttcgacaggcacttatgttggataacttgctgccaccaagacatgatgactatcacacgttactgagattcttgaaagcaaggaaatttgatattgagaaagcgaagcacatgtgggccaacatgatccaatggaggaaagaatatggtactgatacaattatggaggattttgaattcggtgagttgaatgaagtcctgcagtgctatccacatggctatcatggtgtggataaggaaggaagacctatttatattgagaggttaggcaaagttgatcccaataagcttatgcaagtgactaccatggaaaggtatttgagataccatgtgcagggttttgagaaaacgtttgctgttaagtttcccgcatgttctattgctgcaaagagacatatagattcaagtacaaccattttggatgttcatggtgtgggtttcaaaaatctaaccaaatctgcgcgggaactcatcatacggctgcagaaaattgatggtgactactatccagaaacattatgtcgaatgtttataatcaatgctggtcccggttttaagctgctttggaacacagtgaaatcatttcttgatcccaaaactacttcaaagataaatgttcttggaaacaagttccagaacagattactagaaattattgatgcaagcaagctgcctgaatttctaggtggtagttgcacttgtatagatcaaggtggttgtatgaggtctgataaagggccatggcaggatccaaacattttaaagatggttcttagcggcgaagtgcaatgttctagacaaatagtaacagttactaatgatgaggggaccctgattgaatgtgataaggcttgttttccaatgccaataagaagtagtgatacatcaacagcagaatcaggatctgaagttgaagatatcacttctcccaaagcaagtgggaattatacaaacccaaggttgactcctgtccatgaagaagtaagtgatcatgacattggtattttgatgttgcaaaaagaaagaaaagatagataa

SEQ ID NO: 93695 - DNA, 273 bp, Glycine max
  Peptide Sequence Number=SeqID_210473
atgttggctactggtaatcgattactaccttctggtaatcgattagcagagagtaaaactcttagcttcctctcccttcattcatcttcttctaccttcaagctcttatccatggcttcctatggtgtggcgtttccattcatctttctccttctccactccactgcaatcaaacctcaagaagcaaaggaatccgttgatgaagaagatccaaggtctacaagctccaatggagctcaatcatgtagtatcagagcatcttcatctaggtga

SEQ ID NO: 93696 - DNA, 474 bp, Glycine max
  Peptide Sequence Number=SeqID_210474
gcgacgagtctccaatgtggaggaatgatcctgtgcacgatgttcaaccattgcctatgcgacgacaccagctcgtcacagtttttacatgcatgggccaagctcattagagagccaaacaccgaattgacaatggtgcacttcagccacctaggatacactagaacaaaccctgcctttcaagacgagctactgcttaagatgatgatgatgatgatgatgcaatcgcaatccgagccactggttgtcacgttgttcacgttcggagcctccgatgtggtttggttgaagcagcagtgcgtgcctgagatcatagtgaagctccccaaagggtattatgggaacgggttcgttctagcgtgtgctgagatcatagtgaaggatttagtagcagttaacttgcgtcacggtttggaagtggtgaatgaagctaaggctagtttggatgatgaggagtatataaggtcgatatga

SEQ ID NO: 93697 - DNA, 414 bp, Glycine max
  Peptide Sequence Number=SeqID_210475
atggaacaatgtaggcaagggaagtcggcaaaatggatccgtaacctcgggaaaaggattggctctgagggctgggcacggggggtcccagtcccgaacccgtcggctgtcggggggactgctcgagcgcttccgcggcgagaacggggtcgtcgcgttccggtcgggggacggattgggaacgggcccttcggggcctcttccccgggcgtcgaacagtcaactcagaactggtacggacaaggggaatccgactgtttaattaaaacaaagcattgtgacctccaaatcaccaacaaaccctgtcccccccaaaaaaccaatcaatccggtatccctttcttcttctactatgtttggccaaaagaggctaccgttcgtcggctctctctcgttttgcctgcctggtgctaa

SEQ ID NO: 93698 - DNA, 285 bp, Glycine max
  Peptide Sequence Number=SeqID_210476
atggtaatcgattacatgttcaaaattcaaattcaaaacctttttcaacagctctttttcattcttcccttctgtccaaccactgctcttgcaacactttttcgccgaatctccactcaaactcgtcaacggactccaaaatccgacgccatttgcacatgcattgtcggaggcaaattgatcaatgcggaaatgaaggtggaagcagtagccaagctaatcaccggcgataagagaacaaaggcactgagagagagcggggaggcggtagaatgcaagatttaa

SEQ ID NO: 93699 - DNA, 261 bp, Glycine max
  Peptide Sequence Number=SeqID_210477
gttgactgcgaaggatgtcaggtgatggctgaggatttaggagcgattgctgaggatttggagcgggtcatcaacctcaggatggtcactgaaggcactgacttatatgacatcatgactcgttgtctgaggagagctagaggtgacgccgcagatggaagttgtcgcaacctacccttcggcgggagggcgacgcgtgactcgctggatgcgtgttccacgaaaggaatacgcgcggagtcgccaccaacgtttatttga

SEQ ID NO: 93700 - DNA, 180 bp, Glycine max
  Peptide Sequence Number=SeqID_210478
atggtgggagtttggagcgtctcttggatgatagtctttaggtgcctggtcattttagtgctggctagcttagtgagtaagtctactctggtgttactttccctggttggcaacctgcccctggacaagatgcgagtccgtgtagcatcagagctttatggccccaacttttgttgctag

SEQ ID NO: 93701 - DNA, 531 bp, Glycine max
  Peptide Sequence Number=SeqID_210479
cattggccaaagaaagggaagctttctgcagggaaactaagtgtgaagtatgcaatcctgcataggattggcactgccaactgggtacccaccaatcatacttccactgttgccacagaatcttttgctgtcaaattacccattgccttcccaactgtattgtgtggcatcatgttgagtcaacatcccaatattttaaacaccattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcttgatcaaaagactctcagacaatggcgttgatgatggagaagcagctgaggaagaagaagatgcagcagaggatacagaatcagatgatgatgattctgatgccaccccatga

SEQ ID NO: 93702 - DNA, 1275 bp, Glycine max
  Peptide Sequence Number=SeqID_210480
atggcatcaagaaaaagggcaagaaccgatgacatcccttcatcatccaacccagctcctccgacagcagccatggaaccagatgagttggttcataataggccaatcatatctatgaagcattttcttgaaaaagtggcctggcctgaagctcagcttccattggagagatcccatgaggttgttcctcctgaacccgcaccagcaaggattgagccgataccagctgaaccacaacctccagtagtggatccacctccttctcctgagcttgaaatattgtctcctccaccaactccacctcggataatcatctccgaagaatcatttgatgaagctgctgcccctcttgattcaccatcttgcaacatagatgatgcgtccgctaagcgcaatactcattggctaagcgcgaggaagaatctggaagaagatgagctgtacaagttcgctgagcgcaccgcttcatcatactatgtgcaccgcttcagtccatccgctgagcgagaaaggcacgcgctaagccgaaattcactaatgtgcgctaagcgaccagagcttgaagaggaagttgttctgagagctttagatgagtttatgagtggttgtgagatcctagagaaagctaaaatcctctgttggatcttccgtgtagggtcattcaacagtggaaactggtctgattctgatgaccttgataggacaggactaagttgttgtactatcacgaggaattgggggttatgggagttttatggaagaattacgggagccttggaagccatttttcaacaaaaggagggaggtgcttgccgcccagctcacccagttgtgaaactttatggattacgcaacgatgcttgcttttcctttcggaatgttgcgaaactttatggattacgcaacaatgcttgttttgagggtcctgaagggaacaaacaaggttcgaaagtcgaccacaagtgtccctggatgaaattagggtatgacacccctaattatatgccgcctaccatgcacatgccgaatgagaacgctaatcgtgccgttcccgttatcattgagggggggccgcctccagcagtggaagagacagaaaaacttgatctcatcgaagagagattaagggctatcaaagggttcattgattaccctttcgccgacatgacaaaattttgtttggcacctgatgttgtcatccctccaaagttcaagagacgagaaactgctgatgcatttcttccaagaaagcttggccgaggcggtggtcatctg

SEQ ID NO: 93703 - DNA, 651 bp, Glycine max
  Peptide Sequence Number=SeqID_210481
atgggtctgaaatcgccagacaactcaatttctgaaggtaggccatcatttgtactctcaacttgcagcaatgaaatggcagctggatccatatgcggatcatctgatggctggtcaatgcgcaccttttctgagctggttgcatcatcacaaagggaaaggtggtcctttgatagtgagtgttttggatctggccgtcacaagataagtggatccagtagcaggttctcgtattctccctccatggaactacaatcttgtggggcttgctcaaagctattgaccgagagatcaacatggagcaaccagaagtttattgccaacagtgacctctcagttgttgctgtactagtctgtggtcattcatatcatgcagaatgtttagaggctatgacatcagaggcagataggtatgatccagcatgtccaatttgtatggttggagataagaacttgtcaaagttgttgtccagaaaaggtcttcgggctgaatcagagatgaaggccaagaaccacaagatatccagaaaccgtgtagttgatagctaccttgatggtggttttgattgcaaggagctcatttggaaagcctttcttgaggagacacttttcacttggatcaaagtggagccgatccctgtccgagaatga

SEQ ID NO: 93704 - DNA, 544 bp, Glycine max
  Peptide Sequence Number=SeqID_210482
atgaagattatgatctctattccactaatgaattgtgatttatccggaggagagcatcaccaggacagttgttatttttactctataaataactttgaccagagaaaggaactggccatgtacgactaccatgagaaagaaagaaccccagttcttgaaagtatattggcagacttcatgacataccaagctagctctaaagattatcaaagggagtcacaatggcaacctgatcatcacaatgaagcagaaggatttcttaatctggatgatctattaatgcaattcagggatttggtagagtcaatgcaacaagcctttagaaggactgaaactcagattagtaagttggtagataacatgactaacgtggtggccagaaaagaggaagagcgtgcagagattgaaatgcatcaagaaagcattcttcaagttacctcaatccatcatcaattgaccaatgaagaagaaaagcatgaattctccagcaccctggaatatccctgcttggccactatcggctatgttggagggaaagataaag

SEQ ID NO: 93705 - DNA, 1323 bp, Glycine max
  Peptide Sequence Number=SeqID_210483
atgacggatgctgctgaagacgctacacgccgccgtaatgcggtggccgagtaccgcaagaagcttcttcaacacaaggaattggagtccagagtacgatccgtccgagagaatttgcgtgcctcaaagaaagagttcaacaaaactgaagatgatctgaagtctcttcaaagcgttggacagatcattggcgaagttcttaggcctctcgacaatgaacgcttgattgttaaggcaagcagcggacctaggtatgtggttggctgccgcagtaaagtagataaggaaaaactgactgctggtacgagagtcgttcttgatatgacgacgctcaccataatgcgggctcttccacgtgaagttgatccagtagtttacaatatgctgcatgaggatcctggtaatatcagttactctgctgttggtggtttatccgatcagataagggaattgagggaatcaattgaattacctctgatgaatcctgagctcttcattcgagttggaattaaacctcctaagggtgttcttctttatgggcctcctggtactgggaaaacattgttagctagggcaattgccagtaacatagatgctaacttcttgaaggttgtttcaagtgcaataattgataaatacattggagaaagtgccaggttaattcgagaaatgtttggctatgcacgtgatcaccagccttgcatcatttttatggatgagatcgatgccattggtggtcgtcgtttcagtgagggaacaagtgctgatcgtgagattcagagaacactaatggagttgcttaatcaacttgatgggtttgatcaacttgggaagaaacacctgctccctttcttaacaaatttgaagctagtggatggtggaccagtgtgtgtcaaggttaaaatgataatggcaacaaaccgtcctgatgtactggatcctgctcttctgcgtcctggaagattagatagaaaaatagaaattccattgccaaatgaacaatcaaggatggaaattctcaagattcatgctgctgggattgctaagcacggtgaaatagattatgaagctgttgtgaagcttgcggagggctttaatggagctgatcttcgaaatgtgtgcacggaagctggaatggcagcaattcgtgcagaacgtgattatgtgatccatgaagattttatgaagggattactcctccttgtcactcataggcacaacaatttgacttctttctttggttcccaggctgttagaaaactgaatgatgcaaagaaactcgaatccagtgctcactacagtgctgattttggcaaagactaa

SEQ ID NO: 93706 - DNA, 1194 bp, Glycine max
  Peptide Sequence Number=SeqID_210484
atgaagtcgaagctcgttctcatggtctcgcacgaactctccctctccggaggacctctcttgctcatggaactagcgtttctgctacgctccgccggatccgacgtcgtttggatcaccaatcagaaacctcctaaacccgacgatgtcatctacactttagaaaacaaaatgctcgacagaggagtgcaggtggtggatgcgagaggtgaaaaggctgtggatacagctcgtaatgcagacttggtgattttgaatactgctgtggctgggaagtggcttgatgctgttctcaaagaaaaagttttggaggttcttccaaaggttttgtggtggattcatgaaatgcgagggcattatttcaaagtggagtatgttaagcacctcccttttgttgcaggtgccatgatcgattcgcatacgactgctgaatactggaagaataggactagggagcgtttagggattaaaatgcctgaaacctatgttgtacatcttggaaatagcaaggagcttatggaggttgcggaagatagcgtggccaagagggttcttcgagagcatgttcggcaatctcttggagtgaggaatgatgatctactttttgccatcataaatagtgtttcacgtggtaaagggcaggatctatttcttcggtccttttatgaaagtttgatgctcatccaggagaagaaactgcaagttccatctttgcatgctatagttgtagggagtgacatgaatgctcagacaaagtttgaaacggaattgcgtcagtttgtcatggagaaaaaaatccaggaccgtgttcactttgttaacaaaaccctggcagtggctccttatctggcttctattgatgttcttgttcagaattctcaggctaggggagaatgttttgggaggataaccattgaagcaatggcatttcgcctgcctgtacttggaactgcagctgggggcacagtggagattgtggtgaataggacaactggtttactgcaccccgttggaaaagaaggtgtgacacctcttgcaaaaaacattgtgaatttggcaactcatgttgagaggaggctaactatgggaaagaaaggatatgagagagtgaaggagaggtttctggagccacacatggcacagagaatcgcattggttctgaaggaagtgttacggaagggtagccacaattaa

SEQ ID NO: 93707 - DNA, 1008 bp, Glycine max
  Peptide Sequence Number=SeqID_210485
atggaaatagccttatcgcttcctcttgagcgttgccatgttcatgttgggacaagttttgggtcgataaccccaacgttgtctgaaaagcgcagcatgttcattctcggtatgggattttttgggcaatcacttgcacgcaaactccacaaccaaggatgggtcgtgtctgggacttgcacaacccatgtgaagaagaaggaacttcaggaaatggggtttaatgtccaccttttcgatgcaaaccaccccgatgtggacgtcctacaagtaatgaaaaattactctcacattcttgtttctgtcccacctcttgtgggcattggtgacccgatgcttcggcatgaagagcttttgagaagctcgttaactgatggggatcttcggctttctaaaactaggtttgccccactacaagccatgtctactgctgctttgacatacttttctaatgctttcagattcaaatatgatgacagagacactttctgccttgcaggtgtctatggagactgtgatggtgaattggtggatgaggattatccaacaaacccggaaagtgggttggctaaattaaggttagcttctgaagaaggctggtcaaatttggctcacaatcttgggatctcaccgcttttatttcgactaggaggtatctatggccccggtagaagtgctgttgatacaataatcaagcagaagccaatgtcagaaggtcagaaaaggagaaaaaaccgaaaatatacatccagaatacatgttgatgacatctgccaggcactgatggctactgttcttgcacctccccccagggaagtttacaatatcgttgatgatgaccctgctccgagggaagaagtatttgaatatgcaatgaaattggtggagaagaaatggccagggttgaagttacaaagtgtagagcagaagcagaaagagtggccaaatgcgaagaatccaaggggtgagaagagagtgtgtaatgctcgaatgaagagggaactgggg

SEQ ID NO: 93708 - DNA, 228 bp, Glycine max
  Peptide Sequence Number=SeqID_210486
atggagctatgtgacattgatgtcaagatggacgacaaagatctagcattgattctgttagcctctcttcctccctcctatgagaattttcgagcatccgctaagcgcaacactcattggctaagcgcgaggaagaagatgagctgtacaggttcactgagcgcaccgcttcatctcactaagcgcatcgcttcagtccatccattgagcgagaaaggcacgcgctaa

SEQ ID NO: 93709 - DNA, 930 bp, Glycine max
  Peptide Sequence Number=SeqID_210487
atggaataccaactacctcgtctaacaaaaatgtggactcatcttgagcgtcaagcaggaggaaaggtgaagggaatgggtgaaaaacaaatagaagtggacaaacgtattctgcgcaaccaaattggtattcttaaaaaagagctagaatctgttaggaaacatcgaaagcagtaccgtaacaggcgtttctcagtacctgtggcagttgtatccttggtgggttacacaaatgctggtaagagtacacttttgaatcaactaacaggagcagatgttcttgccgaggataaattatttgcaactttagatcctactacgaggagggtacagatgaagaatggaaaggagtttctcctaacagacactgttggttttattcagaagttacctactacactagttgctgccttcagagctacactggaggagatatcggagtcatcgctcttggtgcatgtggttgatataagtcacccgctggctgagcaacagataaatgctgtggacaaagtcctgtcagaactagatgtatcgtcaattccaaaattgattgtctggaacaaggaccaagtggacaagagggcgatcattgctaccccgattctaaaagttgacaaagttggtgatccccagaaactcaggctagaagctgaaaaaagagatgatgttgtatgcatatctgctttaagtggtaatggcttgcaagaattttgtaatgcagttcaagacaagctaaaggactccatggtttgggtggaagctctggtcccatttgaaaatggggaccttctcagcaccatacaccaggttggaatggttgagaaaactgaatatacagagcaagggacatatatcaaggcacatgtgcccctgcgttttgcaagaatgcttacacccatgaggcaactgtgcgtatcgcaaccttaa

SEQ ID NO: 93710 - DNA, 1836 bp, Glycine max
  Peptide Sequence Number=SeqID_210488
atgtatccgaaccaagccttttcttcagggtcctatgctgatatgttgtctgggaatcctcttttacctcataactacggtgaaactgtaggaggacaaaatgaattgaagttcatcacatccatgagggacacgatgattatgcaacctattgatgggcatcccaatgccgccgccaccacaggcaatccggattcttttgagaatgccggagattcccattcccatgttattccaaggacaacacaattgggacttgtggacaatgagcaaaatgtacaaaaccaaggcttgtctcttagccttggctcagtgatgccttctattgcatctgttcctacctttccatatcagtatcctggcaccagtttctcttccctaatgtctgcttgtgtcccaaatttaaagggaacttcatctcttaaagatgatgaggccagcttacaaagggaattgagaaatgctgagtgcatggcatctttagcttcttctggtggctttcacaaaagggatggtttgtataatccacaacacccctcaatgtgccttggtgaaggccaaagtcatggatcacaaggtttttccaacaatatgttgaactcacaatacctcaaggcagcacaggagttgcttgatgaaatagttaatgtccgaaagcaaaccagtttggaaaagcaaccgagtttccgtgatgttggtttagatggctccaaagattccgatggaaaatctaccacccaatctgtgcagatatcttcaggccccaatggttcttctgctgcaaactcttcatgtgagctatcacctacagaacgacagaattttttggacaaaaagacaaagcttttgtctatgctggatgaggtggataaaagatacagacagtactgccaccaaatgcagattgttgtgtcatcttttgatatggtttctggatgtggagcagctgaaccatacactgcacttgccttgcgcacaatatcgcgccactttcggtgtttgcatgatgccattagcggccaaattcaagtgactcaaaggaaccttggagaacaagagggaatacctcgtctccgctatgttgatcagcagcttcggcaacaaaaggcccttcagcaacttggtgtaatgcgacaagcttggaggcctcagaggggacttcctgaaacctctgtttcaatactccgtgcatggctctttgagcacttccttcatccttatcctaaggattcagagaaaattatgctagcaaggcaaactggcttaacaaaaaaccaggtggcaaattggttcattaatgcaagggtgcgtctttggaagccaatggttgaggaaatgtacaaagaagaatttgatgttcaagcttctgacaataaaagggaagagtcacaggacaacttaataacagttgatgatagtgttcagcatcatgggctgaagttggatcatgccgacagaggaatccaaagcagtgatcatggagaaaatgccatggatcctagaattggaaaattgcaaggtgatcaaaggttcaacatgaacaacaacaatagtccttattatggtgatggctgcataatggcttctactccggccacatatgatttatcagagttaggtaacattgccgttggtggccacgtgtctctcgcattggaattgaggaactgtgaaagcgaaggatttggtgtgtcgaatgatgacatgcataaacgacgtaagaaaacattggcttcttccccagaggctgatttgctagattaccatttcacagacacaggaaagcaacaaaacaagtttggcaatcctcacctattgcacgagtttgttgtgtga

SEQ ID NO: 93711 - DNA, 340 bp, Glycine max
  Peptide Sequence Number=SeqID_210489
ggaagtgtcgcaacctatccttttgcgggcaagcgaggcaaggctcacagttgcgtcttccaaaggaggaaaatgcacggagtcgtcaccaacgtttatttatggaaaacgtcggaaaaatcgaaggaaaccggtcatgaagaatattccagattcgggagttgtatttacgtttgaggaagattggaaaacttacccgttgaagaacgaagaacggatgaagaacggtgaagaacgacgaagaacgatgaagaatttccacataatcgcttacggaggcattacggaaacacttcgactcgattttgccgcccagagacttaatgaagaagatttctaa

SEQ ID NO: 93712 - DNA, 213 bp, Glycine max
  Peptide Sequence Number=SeqID_210490
atggtgcaagaagagaataagtggggaggtggaaaaagagaaggagaatggagtgtttggatggtgcataattggaagaggaagaggctagagttacctggtgcctttaagagggtgaggggtatttttgtccgctcgggtctttatgaggtgcaggaagcaagagcagtagaattgggtaaatcggtctgcatccagttggaccaaatttaa

SEQ ID NO: 93713 - DNA, 1032 bp, Glycine max
  Peptide Sequence Number=SeqID_210491
atgcatttcatcaaagtcactcttcttgcaatgatagcttttttcctctcagtgaaactctccctggctcaccctggcttccattttggttggggtgatcatcataggggaatatcttttggtctttcacctcaattctatcaattttcatgccctcaagctaatgacattgtcatgtctgtgttggagaaggccattgcaaaggacatgagaattgctgcttctctacttagacttcactttcacgattgctttgtgcagggctgtgatgcatcaattttgttggaagatagcgcaagaatagtgagtgaaaaaaattctggacctaacaaaaattctgtccgaggcttcgaagtgattgataagataaagtctaagttggaagaagcatgtcctcagactgtgtcctgtgcagacattcttgcccttgctgccaggggctccactgttcttagtggaggacctaattgggaactcccattagggagaagagactcaaaaacagcaagcttaagtgactcaaacaaaaacattcccccaccaaatgccaccattgaaaatcttgtgacatttttcaagcgtcaaggccttgatgaagtggacctcgttgccctctcaggtgcacataccattggggtggcaagatgtgtcacattcaagcagagactatacaaccaaaaaggaaacaaccaaccggatgagaatctagaaaaatccttttactttgatttgaagacgatgtgcccaaaatcaggtggtgacaacttcatttctcccttggactttggctccccaagaatgtttgataatacctatttcaaactcatacttcggggtaaaggactgcttaattcagatgaagtgcttcttatgggaaatgttaaggaaactcgggaattggtcaagaaatatgcacaagatgagagccttttttttgagcaatttgccatgtccatgatcaagatggggaaccttcgtcctcttactggatttaatggagaagttaggaagaattgtcgccgtgttaattaa

SEQ ID NO: 93714 - DNA, 1221 bp, Glycine max
  Peptide Sequence Number=SeqID_210492
atggctaagcaaaagatttgtgcactaagccaccaaacctcggaaaaagacaacacgagggctaagcgaatatggcatcaaggaaaaggaagagcactgcttctaggccacaggctcagtatgataccaggagatttcaatccttggaagcctggaaccgatatacatgatgttcctccagaaggcggttgcttctggaggaagcaacctatctcgcctgggcgagctggaaaattcaagttgaggcgtttccgtaacgttttcgtgggtgatttcgcgaagattttcaaccgttcttcgtcgttcgttcttcgtcgttcttcgatcttcaaccgacgcacccgtgagcctcgcctcgctcgcccgcaaaaggagttgaagaggtttaacctacataaatgcctcaccaaccttcaggagggaagcatagatgtggcagtggttaaagaactctatgccaatttatacagctcggaagaccagagccctaagcaagtgagggtgagaggacatttaatcaggattgatgctgacagtctaaattctttcttagagactccaatagtcttggaggagggtgagacactgcctacctattctaggttttcgaggatgaggattgatcctcaagagtttgctgcccatctctgcatccctggtaggggttttgttctaaatgcagggggccatccttggaagcttctgaggaaagatctcaccactcttgcacagacatggagtgtcctctcctacagtaacccgactcccacttcccacacctctgatcttaatatggatagagccattaacttcagaagggtcaggaaggtaagggctcgaccagcaaatgctccttctttttctgcaccaccagctcctcccacttctgccacgcctacaccagctgcccatgactctcagcgctttgaagccatgcttcaaaggtccattctgtcggtagaacagttcattgagaaggtatcctggcctggaaccgtaccttctgctatgagagagggtgcaggagtagagatgagactatttttcttgagccaattgtgccagatatacatgagactattgaagcaggtagcagatcctcctacaccagtacatgagagaccagatgacccctctactcttattttagagataccaaaggaccttaccacaccggtcctgacattgaacaccactcctccagccacacttgagctttag

SEQ ID NO: 93715 - DNA, 459 bp, Glycine max
  Peptide Sequence Number=SeqID_210493
atgtccagcctttctatcagccttgagccacaatcccaactaaccataaacctggccctcaaaagaaaacaaaaacaaaaaaagaggaaaagaagagaaaaggagaaaaggagaaaattcccgatcaaaagaatcgaaagaaagcgaaaagagaaaattcccaatcaaaagagtgggagaaaacaaaaagaaagaaaattcccgatcaaacatcgaaagaaaaagaaatgtgcagaaaagtctttggaccagacgacatctgaacaaatacagaactgtcaccaattgtcgcaacatgcccttttgcgagcgtgcgaggcgagggtcacgggtgcgctttccaaaggaggaaagatgcgtggagtcgccaccaatgtttatttgtggaaaacgtcagaaaaaccgaaggaaactggtcaaaatgaaaattctaagttcgggagttgtatttacatttga

SEQ ID NO: 93716 - DNA, 836 bp, Glycine max
  Peptide Sequence Number=SeqID_210494
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtaaacatgatagcccagacagagggcctggagaggggctctgataagggctctgggggtttagaagagccagcaatcccttttggcagtgggaagcagagctggctttgtgtaagaggtggtgttgtatgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 93717 - DNA, 333 bp, Glycine max
  Peptide Sequence Number=SeqID_210495
ggatcgcacccacaagacacccagtggacccggaaaagtccaacagggccctggggtttccagctctggttacgggcctctatcaatcctacagggtgcccgtacccccccggcaagggatcgcacctgcaagacacccagtggacccgaagaagtccaacagggtcttggagttgtcaagctctaattacgggtctctgtcagttctacagagtacctgtaacctccagcaagggcatcaggccccctactgatcgagctttcatcaagaagtactgcgtccctaggcaggcgcagggcgaaacactacagcagcctggggatggtcggtag

SEQ ID NO: 93718 - DNA, 378 bp, Glycine max
  Peptide Sequence Number=SeqID_210496
ggaagagaggagatagagcacagcgctcagaaagaggctaagctagggttgctactggttttgaggtcatcgatgaacccagttcccgctctaccttttcggcttagtcactctctcgtcgttccgattaaaggattgaacaagaagaccctagttcttaaggcgaagtatcacatgaaagagaaaagtcaacatgagactcgaaagacgctcggcgataaagaaaagaaaatgactctttcttcggtggacatggcggaggctcatgcacttacacttaggaaagcaactccggatgtcccaccacagctggtcggtataaagggtgaacagattagccaatgcttcggccgattgggtggcaaagcatcttcctga

SEQ ID NO: 93719 - DNA, 474 bp, Glycine max
  Peptide Sequence Number=SeqID_210497
atgaccaagacatcaagtgtgaagttggctgaagctgaagatgatgtttaccagtgccggtctgatttgaaagaaagtgagaattgctctttcctaactaccacatcaaaagctaagctcgaaactctatcaacagaggaaactcagctgcaatacaattatgacttggttcagatttctgataatgtggaattcccatcctcacttgtgattccccgatttgatagatatttgagctttaaaattacagaaagaaataatgtcagagatagtgaacgagtcaaaaggacactcgatcacaatctggctgccatatatggcaagaaactattcagcaagagaaaaagggatgcagtgaaattccagcaattatctgatctaatgcggactctgatgtactcgatgaaaatcactccaaaatatgtttgggatagttgtgtattagcttacatttgttatgaaatggatcaatga

SEQ ID NO: 93720 - DNA, 510 bp, Glycine max
  Peptide Sequence Number=SeqID_210498
atgggttttccggtcggttacgtggaggtgttcttcccgaacccgttcctgcacacgctggccctcctcggcctcctccgaaacctcgtattcttcctcttccacctcctcggactctccgacttcttcgaaaccgaggtcgcctggccggacccccgcccctcagacacggcggaggcacggcccccctccgtgtcggcgctcctgatccgggacctcctgcccgtcgccaagttcggagactccgacattgccgcccgacaaaacggctgcgcctgcgcggtttgcctgttcgagttctccgaggaggaggagattcggtgcatgcgcaactgcaagcacattttccaccgtacctgcgtggaccgttggatcgaccacgatcagaaaacttgccctctctgtaggaccccctttgtgccagatgatatgcttgatgattataatcaacgcctctgggctgctactggggttaacgagttttacaccgattacacttcttctttctga

SEQ ID NO: 93721 - DNA, 714 bp, Glycine max
  Peptide Sequence Number=SeqID_210499
atgtccgccatgttgttcacctcccaccgtctgggcccgctgaccctgcccaaccgcatcgtgatgccgccgatgacccgctcgcgtgcggctgccggcaacgttgctaccgccgagatggcgacctactacgcgcagcgtgccggtgccggcctgattgtcagcgaaggcacccagatcagcccgcagggccagggctatgcctggacgccgggcatccacagccccgaacaggtcaagggctggcgcaaggtgaccgatgcggtgcacgccgccggtggccgcatcttcgcgcagttgtggcacgtgggccgcatttccgatccggttttcctgaatggcgaactgccggtggcgccgagcgcgatcgcggcgggtggccatgtcagcctggtacgccccaagcgcggttacgtggtgccgcgcgcgctcgagaccgatgagatcccgggcatcgtcgaggcctatcggcgcggcgcgcaactggcgcatgaagccggtttcgacggcgttgaagtgcacggcgccaatggctatctgctggaccagttcctgcaggacagcaccaatcagcgcaccgacggctacggcggctcgctcgagtgcccgcgcccgcctgatgctggacgtggtggatgcctgcgtcagcgtctggggcggcggccgggtcggcctgcacctgtcgccgcgtggcgatgcgcatacgatgggtga

SEQ ID NO: 93722 - DNA, 798 bp, Glycine max
  Peptide Sequence Number=SeqID_210500
atggcccggcatgaaggctcatccacgcatggcgtggatctactccaggcggggttcgatctttaccgcgccatgcgccacgcggtcatagcaggtgcgcaccacgtcttccccgtacttcagctccagccggcgcacgatgaagtgaccgcgcgccatgtcctggtagtagtcggtgaacatggtattgagcgttgcacctgcagcggcaccgacaatcggcaccgcctgcgcggcgaatttctcggtgaccaccacgccgaaacgcgccgccactttctccaccatcttcgccagcagcttgccggcctccttcggtgccacgcccagggtcaggtcgcggccggtcaccacgcgcccggccaattcggccgacaggtggcgcatcacgtcggtggtgaagccgcgggccaggtagtagccggtctcgctggcgtcatcgcgcggcgagttgccacccagcgcgaacacctccaggcaggcctggcgggtgctgaattcggacaggtcaaagccctcgctgcgggccacgtcggccaccgcgcgcatcatgatggtggtcgacaccggcagctcgatgaacaaggccgcaaagccgaatgccccgccgaccgcgccggaggtggccgccgccaatttgtgccagcgggtggaggcccccttgcccggggtgttgtccatgctccacagcgcggcctgcgccgatttggtcagcgccgcctgcaccgcatcgtggatgcggttggagaccgaactgggcagcgccttcaccgcgaactccagcggcgtgccaaccag

SEQ ID NO: 93723 - DNA, 384 bp, Glycine max
  Peptide Sequence Number=SeqID_210501
atggctatttatagaaaaagtcatttggttcagggcaagctcgcccaggcgagtttcttgttgagggctgaaggtatcagcttgcctaggcgagtagcttacttagggctgaagctttttcttggcctaggcgagctagatgctagcctgggcgagtttaggaatgtcattacaatacagttctccaaccttggtgtcattcttttacagaacatccaacaacctcagatgtcaatgctaagggttgttgttgcacttgcacctattccaccacaaccctccatacatgcctctcttaaacctccaccccaaaccttgactctaataccaccaccaactccatcctctccaccaccttcccaacctctaccctctcaagactga

SEQ ID NO: 93724 - DNA, 774 bp, Glycine max
  Peptide Sequence Number=SeqID_210502
ggtctagttccttgtattcaagagatggtgggagatagtgagcatagattctgtgtaagacatttatatgccaatcttaaaaagaagtttgggggtggtactcaaataagggatctgatcatgggagcagccaaagcaacatacttttctgcctgggaggataaaatgaatcaactcaagaagatcaatgaagatgcttataggtggttaactagggatgaattgcctaagaatatttggtgtaggcatgcatttaagtaccattctaagtgtaatgttttgatcaataatttgactaagtctttgaacaacaccttgctgccagctagggacaagcccatcttgatcttggaggaatggatcagaatttacttgttgaggagatatttcacattaagagaaaaagtcaaaaaacaagaagggagtatcatgccaaaacctatgaaaagcttgaccagagaagtagaatatagttgtcaacggtttgcaagttggtctcatgcaggaatttttgaagtgatacacaccttatttaccgagaaatttattgtcaaccttgcaaaccacagttgtacttgtaatttttgggacttactgggaattgtggaagcaatgccttcaaaggttattttgatgatgccaaagaattcaagaatcaagagaaagattcaagagaagtttcaagtttcaagttttcaagaatcaagaatcaagaataatcaagaacaagattcaagaatcaagagaagacttaatcaagataagtatgaaaag

SEQ ID NO: 93725 - DNA, 861 bp, Glycine max
  Peptide Sequence Number=SeqID_210503
attggcggtgagcatcagttcgtcgggcttgtgccgttcgacgaaggcggcgatgccctcggccacctgctgcggatcacccagcacggtgcaggccaatgcccgctccacacccagcttttcatgcggcggcgtgactcggcttcgctgtcgctggcgacaacgttcagggccagcatcgcgtgcggctgcttcaacgtggccgaagggcggaactcgcggcgatacaccgccagcgcttcgtccatcacgtcgggcgcgaagtgcgaggcgaacgcatacggcaggcccatcgaggcggccatgcgcgcaccgaacaggctggaaccgaggatccagctcgcgcacatcctgcgggaactggtcggcgctgtcgaagtaacggcgcaatgcacgcgcgggcggctgatcggtgcccggcgcgcggcccaggcccaggtcgatccggtccggatacagcgaggccagcgtgccgaactgctcggccacctgcagcggggcatggttgggcagcatgatgccgccggcaccgacccggatgcgccgggtacggccggcgacatggccgatcaccacggcggtggccgcactggcgatgccgggcatgttgtggtgttcggccagccagtaacggcggtagcccagcgcatcggcgtgctgggccagttccagcatgttggcaaaggcggtggtggtgtcactgccctcgcagaccggggccaggtcaaggatcgacaacaggatcatcacgcgtttttccgtcacaggatcccccatgcatggggaccacccggcgcaacggccattgccagtggcgggatgctgattcccgcagcgcgggtccacgactggctgcgctga

SEQ ID NO: 93726 - DNA, 1271 bp, Glycine max
  Peptide Sequence Number=SeqID_210504
gacgtgctcgacgccgccggcagcaagtggaatttcctgccgttccgaccggggctggtcggcggtcactgcatcggcgtcgatccgtattacctgctgcacaagtccgagagcgtgggctaccacccggacctgatccacaccgcacggcaggtcaacaaccgcgtcggcgagcatgtggcggcgcgggtgctggcgatgctggccgagcgtggccgtgtgccggcggacgcacgcatcctggtgctgggcgtgaccttcaaggaggattgcccggacctgcgcaacagccgcgcgctggaactggcgcaacggctgcgcgatgccggcgcgcagggcgctatgacgcagtggtgctggcggtggcccacgcccgtttcaaggcgatggatgaatccgcaatccgggggctgttggcgccggtgaacggcgcggtagactcgggggcagttgcaaccgaggaaagccatgcaccggtatatcgtctacctgctcgccatcctgatgttcccgatatgcctgtggctggccacgatctggccggcctggtattggggcgtcggcctgactgccgcgatggtggcgctggggacctgggatctgctgcagaagcgcagcacgctgcgccgcaactatccggtgatggcgcacttccgctacgggctggaatcgatcggcccggagatccgccacgggcactgatctaccagcgcgccaagaacgagatggacacggtgccgttcggcaccctgcgcagcacctatgcggtggactacgagtggatcaatcattcattggcaccgaccgccatcgccaagcatgacttccgcgtgttgatcggcccgaactgtgccaagccctattcggccagcgtgttcaacatctcggcgatgagcttcggttcactgtcggccaatgccatccgcgcgctgaacgaaggcgcgcgccagggcggcttctatcacgacaccggcgagggttcgatctcgccctaccaccgcgagatgggcggtgacctggtatgggagatcggctcgggctacttcggttgccgtgacgagaagggcggtttcagcgaggagcgcttcgttgccaatgccacccatgaccaggtcaagatgatcgagatcaagctgtcgcagggcgccaagccgggccacggtggcgtgctgccggcgccgaaggtgaccgccgagatctcggtgacgcgtggcgtgccgatgggggtggactgtgtgtcgccgtcgcgtcactcggcgttctcgacgccg

SEQ ID NO: 93727 - DNA, 540 bp, Glycine max
  Peptide Sequence Number=SeqID_210505
gctcgtaaccaaagctggaaatcctagggccctattggactcctcggggtccactggaccaactgacactttgcagggggagattggagttgtggtcgctgggcagaatgttgctaacggcgcgggtgaaatcttgccccagtatgcatcgtggctgcacaatagcctccctctggttgtgctcacacagttggccctcctccgagatcaaaggggtgaccaagggactgataaagggaaactactggcccctcacatgggagcacaagcacagatgtggagccctctaaaagtgaggacgtgcaaccctctgaaggcaaggacatgtagtcctctgaaggcgagggcatgcagctctttaaagacgaggacatgtagtcctctgaaggcgaggatgtgcagtcctctaaaggcaaggacgtgtagtcctcagaaggcgaggacgtgtagccctttaaagagaagggtgtgtagcactttgaaggcgaggacgtgcagtcctcagaaggcgaggacgtgtagccctttgaaggcgaggac

SEQ ID NO: 93728 - DNA, 435 bp, Glycine max
  Peptide Sequence Number=SeqID_210506
atggagaagaagatcagccattgtggcaagaggagagatgagatattcccttcagaagtgcagaaaaaatcccttagagtgtgtttggataggtttctcaacggacctgctattgtggcacaatggagtacacgccggaaaccggcacgggagcaatggggccgacgacgggaggagcagggatttgcacggagggggcgacaacgtagagcgcagcatagtgagtggttgcgggtagctgaaggtgaaagggaacagggaagtaggaggaggaggaagggtttgaataggagaattgcgagtgcgaagctgaggaggaagacgatggtgtcatcatggaattggaatagatcacaacgcgaggcagtaactgttttggttctttttgaagtcttcttgaagagagaggttgtatccaaacacaaaattttataa

SEQ ID NO: 93729 - DNA, 249 bp, Glycine max
  Peptide Sequence Number=SeqID_210507
atggctcaccattgttcaaacaaggccttaggttgctacctcctattttccattgttgtgtctatcttttcaacctttacttgtgctcattttgatggatttttccctaatgaaccaataatattccaagacactaatgcttatgcaccaacacttgaagttgatgttattgaaccaactctaaaaattgaagatgattcacaacttgctccaccacctgtagttggtgccattccaccaactttcgaa

SEQ ID NO: 93730 - DNA, 2349 bp, Glycine max
  Peptide Sequence Number=SeqID_210508
atgccatttttctataaccaaaacttagatgcagacatatccttaagtgcttttggtgttgtacttctgtcagaatttgagtttcaactcgatacaagtaaatcaatgtggatgaatcttcccatgtccattctgtttgttgctgctctgcgcattcttctgaacaaggtggaattccattggaaggttcagccacctagattacagacttacctatctcatttggagaaaaatcaactgcctttgaatgacgaacgcctctcttcttcacctccaactcccaaatggaagaagaagattgattctcctgttgtggaggctgccttgaatgatttcattgatttgatattgaaggactttgtgataaatatgtggtacgcagacattactccagatatggagtttcctgagctggtacgtgacttaatcatggatgctattgctgaagtgtcagcgagggttaaagagataaatctcgttgacttgctcacaagggacatagttgatttaataggcgatcacatagaccttttcagaagaaatcaagatgctataggtgttgatgttatgttaaccttatcttctgaggagagggatgaaagattgaaattccatctgttgaattctaaggagcttcatccagcactaatatctccagagagtgagtacaaggttcttcagcggttaatgagtggattattagctacagtaataagaaaacgagaagttcaatgtcctgtcattcgatctatagctcgagaaattgtaacttgtttgatagtgcaacctgtcatgaatttggctagccctgcgtatatcaatgagcttattgaatcccttctagttttccttaatgacgagtgtataaattggacggggggcggcgatcattcaactaatacaacaattcataatcatggtcattctggtgctgctgggggtggacatgataaccatgcatcctcttctgattgggcacaaatgctggaggctgcaactcagagaagaactgaagttcttatgcctgagaatcttgagaacatgtgggcaagaggaaggaattatagacggaaacagcataaaaaaaccaaagttggctttcaggacccttctgtgaaaaatcctgctacagatgcaattccagaaggaaagtcttctctgcattatgtgagttcagatcccctcctaactgcaggaggcacaaataggtcagagtctccaccagatcatgacaaggaattgtcttctgaagcagatccacttgatgaggtgaaggatatgaaggacttcagttgtaataaatataaggatccgttcaagagatctaggagtgcttctcttgtgggaatccaaacttataagggaggatctccaaggtcagagttccacactgctgaatctgagaaacatggtgaaggatttcgaggaaagagtagttctgacatggttgttagaagagaggcacatgttgttcccaagcttcggtgccgggtgttgggagcatattttgagaaactaggatccacttcttttgctgtctattcaattgcagtgactgatggtcaagagaaaacttggtttgttagaagaagatacaggaattttgagcaattgcatcgacatctaaaagatattcccaattacgtgttacatttgcctcccaaaaggatattttcctcaagcacggaggatgcctttgtctatcagcgttgcattcaattcgataaatatctccaggacctcctatcaatagctaatattgctgaacaacacgaagtatgggactttttgagtgtttcctcaaagaactactcttttgggaaatcttcttcaatgatgaggaccctggcagtcaatgtagatgatgcagtggatgatattgtacgccagtttaaaggtgtttcagatggtttcattcaaaaagttgttggttcatcatccccttctactgaaggttcttctacatcaaccagtaggaacatgtcctggaatgtggatgaaatggataaaagtatttcgaggcaaaatactttagagtgtgtattaagctctgataatgaggaaggtgatgagaatattgataaagaagtagcagaagacaatgagtggaattctgacaatgaattgagctcaaaggattattcacaacacctaataaatcatggtagtgaatctagtaacttggatcttgatagaaaacatgatgcaacagtggaagccaaggttggcaaggatgtgccagctacaaatttcaatctagttcctgataatttggaggacgttccacctgagctgcttattctctttgggatcaagctgttgaatgttatgctgctgcctacttggtaa

SEQ ID NO: 93731 - DNA, 693 bp, Glycine max
  Peptide Sequence Number=SeqID_210509
atgaaaacccatgatgttgtctttgcatcaaggcctcaaagtgcaacatttgatatattgtactatgaatccacaggtattgcttctgcaccctatggaaattattggagagtgatacgaaggatgtgcacgatagagcttttcacccaaaagcgtgtaaattatttccaaccaataagagaagaagagctctcttatctcatcatcaaaattattgattattcacacaaaggatcatcatcatcacccatcaatgtttctcaaatggtgctttcatcaatatattccatcacctcaacagttgcttttggcaagaactacaaagaccaagaagagttcatatcactagtgaaagaagaagttgagattgcagggagagatttgtattgttctgctagatggcttcaacttgtcactggtctcagagctaagcttgaaaagttgcatcgacaaatggatagggttctcgaaaacatcatcattgaacataaagaagcaaagtcaggagctaaggaaggccaatgtgaacaaaagaaggaagatttggtcgatattctcctaaaatttcaggatggtagtgacaaggatatttgtttaaccaatggcaaattcaaaggtataatccaggatatctttgttggtggaggtgacacatcagcaattacaatagattgggcaatggctgagatgtaa

SEQ ID NO: 93732 - DNA, 339 bp, Glycine max
  Peptide Sequence Number=SeqID_210510
atgtggaccaagctgaaggaaaagggtgagacaattttctctaatgctggctggattcaccgtgaacctagccagggaattcaaggaaaggagaagagttcacctgggttggctgtggttgctggccaacaacacgtgcaaggggagctgacaaagctcagagagaaagttgttatggcccgaaagagcctcttctccaaaggcaaagaggggtcagaagaagaacaagttgtgaagaaggaggctcacaaggttatgatggctgttcagagagacactcatgaaaccatgtcagaggcaacagtgtgcttgcttatggatagatttgtgccatgctga

SEQ ID NO: 93733 - DNA, 1317 bp, Glycine max
  Peptide Sequence Number=SeqID_210511
atggtgcctccatggcggaatgacgtggcagattttttgccaaccaccatagacaatttgattccagataattttctgaggaaatatgggacccagctttctacaattgctaccctcactgttcctgatggtagtgtttggcgtataggattgaaaaaagcagacaacagaattttgtttgttgatggttggcaagattttgttcaacactactccattggtgttggatacttcttggtgttcatgtatgaagggaattcatccttcattgttcatatttttaatttgagtacctctgaggtaaactatcaatcggccattagaaaccgtaatgaaggatcttgcttggccaattatcatcatatttttgatgaaatggaagatgtagactcccttgatttgtcggatttgtcacctcagtaccttactcctggttcattgcaaaacaagggttgtgttggatctgtcgatcaactgacacctgggaagagtcatactccagctttgcagaatttgttcaatggtggatcaaaactcaaccgcataaactggggtgatggtgggagtgctttttcttcgaagaatgccaattcacaaggcaatcagtcaaccagagacataggtgttcagtttaatgctaatgagtttaaaaggtccactgaagaattgaaattgcttttctttgtgtctggtaatctaaaagatgatgttttcctttttattactaattcaatgtgtggaactatagatggggaggaaccctctggtgaaaatgaagaggaggcagaaatgcgctataggttttatgaaagtgcatctgcaaggaaaagaaccgtgacagcagaagaaagagaaagggcaattaatgcatcaaaaacatttgaaccaactaatcctttctgccgagttgtcctgcgaccctcctatttgtataggggatgcataatgtatctgccttcctgctttgctgaaaagaatttgaatggggtttcgggattcatcaaacttcagttgtccaacggtagacagtggtctgttcgctgcctctataggggaggtcgagccaagttaagccaaggttggtttgaattcacagtggagaacaatttgggagaaggtgacgtctgtgtgtttgagctccttagaacgaaggaagttgtgctgcaagttacggtatttcgcgtaaccgaggatgcagggttgttgaaccagcctcctatgatgcagcagcagcatatcccaaatatgagccacactaaactcttgaaccctcacttgcagcatcgcgtcagtactaccaaattgattagaaattag

SEQ ID NO: 93734 - DNA, 393 bp, Glycine max
  Peptide Sequence Number=SeqID_210512
atggattcaaaggttgaagcagcacagaagggagtgaaaaaaagaagcttgactgagagtggaatgaatgagcatgaaaattgtgtaggccttgatttagagttgaagctatcactagcgggatcaagttcgggtaatttatcaaatgccttaaaatctacaacttcaaggactctgctgccatcatcatcatcatcccataaagtgtacttaccttccttattgggaatcaatgggaaccatgagccaacaccattaattgcaacgggatgtcctcattgtttatactatgtgatgatatccgaagctgaccctaaatgtccgaactgcaaaagttataatctgattgatatgtttcaagagaatcctacaaagaaaatgaggacatgctaa

SEQ ID NO: 93735 - DNA, 210 bp, Glycine max
  Peptide Sequence Number=SeqID_210513
atggcagaaatcaaccaaggtaagacgatgaccggtcacgattggtcgcatatcatttggctcttacttgcaggttcaagtgggcaaactctaacccataaggaaggaggggacatggttaatgttcccctccaaaaaaaaaatggcaggttagttcccctgggggagttgagttcgcctgggggagcaacccctgctttcaaaatataa

SEQ ID NO: 93736 - DNA, 519 bp, Glycine max
  Peptide Sequence Number=SeqID_210514
atggatcagacaattgggttagaggaatgcaaagctaagtgcttggataactgttcttgtatggcttacgtgaatttggatattagtggacaaggaagtgtctgtgctatgtggtttgatgatctaattgatattagactatttgcagctggaggccaggatgtatatgttcaaattgatgcttcagaattagaatatgccaatgagggccacaagaagggtggattcctagtggcagtaacagtttctttggtcatggctgtagttgctagaatactaataatacttggttcgtgctttagaaagaaatcatgttgcagtgtcaaagagagatcagacttcaatatcaaatcaaatcaaaatagtggaatgcgagtggatgatatggacctaccagtttttgacttgtcaacaatagctacgaccactagcaacttcacagtcaagaacaaaattggagaagatggttttggacctgcatacaaggcacatgaatttgttgaggataaagatggttaa

SEQ ID NO: 93737 - DNA, 613 bp, Glycine max
  Peptide Sequence Number=SeqID_210515
aacttgccccaagacacagcagacacttgtgcatacagcccttacccctaactatgttttgaagagtttgattgctttgtggtgtgaaagcaacggtattgagctaccaaagaggcaaggaaactgtagaacaaagaaatgtggtggcagcagtctttcagattgtgatcgaactgctattggtgctttattggataaactaacgagtaacgatatagaacaacaaagggcagctgctggtaagaaggatgctgctactgctctaataaagttactttgtgaaggtactcctacagatgaagcactagctattatggcaatccttgcaagccaccatgaaggcagggtagcgatcggtcaggccaagccaattcatattcttgttgaggctatacgaaccggctctccacgcaatcgagagaatgctgctgttgtcttgtggtcactatgcatcggagatccactgcaattaaaactagcgaaagaacatggtgcagaagcagcactgcaggagttgtcagaaaatggaactgatagagctaagagaaaagctggaagcatattggaactcttgcagcgaatggaaggggttgataatctgcagagttcatag

SEQ ID NO: 93738 - DNA, 453 bp, Glycine max
  Peptide Sequence Number=SeqID_210516
atgaagaagagggatagaatccatgtcatagttaagaaagaggatctaaaaaattgggaagttgaacttaaggaagggaaaacatattatatgtataactttagggttgttccaaatgatggccagtacaaagtttgtgcacatccattcaagctttttttcactggtggtacaaccctgaggcaagtggatctcgctgaaattcctcttaaatcatttgagtttaagagttttgaagacatcgataatggaaattatgatcctaatatgctgattgaaaatgtgttcttatgttcctctttttccatttattggaccgtacccaacaacaataattcattgaaagcatcaaaattactgataaaccaactaatgcttattattgaagaattcaaggagagacttactgaattaaaaatcatgatccgaccagttctcatgtttcgtggttaa

SEQ ID NO: 93739 - DNA, 510 bp, Glycine max
  Peptide Sequence Number=SeqID_210517
atggtagatgaagcactagctattatggcaatccttgcaagccaccatgaaggcagggtagcgatcggtcaggccaagccaattcatattcttgttgaggttatacgaaccggctctccacgcaatcgagagaatgttgttgctgtcttgtggtcactatgcaccggagatccactgcaattaaaactagcgaaagaacatggaacagaagcagcactgcaggagttgtcagaaaatggaactgatagagctaagagaaaagttggaagcatattggaactcttgcagcgaatggaaggggttgataatctgcagactcatagatggtctgaaaaattagaggacctatggaagctcaaaatccctttaaaaccaacaacatttgcttggcaattgatcaaagatacaatcccaactaaagggaatttgcggaaaagacagctggagaaaggctttgcccagccctacaactattggtctagtaatttatcaacaacattttttgattag

SEQ ID NO: 93740 - DNA, 463 bp, Glycine max
  Peptide Sequence Number=SeqID_210518
gcactccaggacccgccaacgctcatgaaaacccgggtcggtcggtcctccattcatctgacgggaggtgtggataacgaggccaccttcacaaccttctcccttctgtccttatgttgtagtaagggcatagctagcggcataggagccgactcggcgtcagcggcttcgtgccgcactggagtgatccaatatgtggttccgcacgttccaccacttctccgttcatttccaatactgatcgtgaaacaccatgagcagcaggatgttgagatcgcgagacataatgttctctgcgacactggaatagatttcttcaatttccggaaagtgaacggaaagccgccctttccccttctcacaatattaccgaacttgctcaagaatgaatggcacttcgaagtgcctcacgttgggggatcggcgtggggaacttccaccggttctggactggagccagcgg

SEQ ID NO: 93741 - DNA, 894 bp, Glycine max
  Peptide Sequence Number=SeqID_210519
atgaagttccctatcttgacgggagaaatcgtcattgtcaagacagaccagaagcaagcccgaaaatgctatgttgagagcttgaaagtgactccttatactcccatgaaagagccatgcaagctttattcccccactcgtggcagcaacagtcaagtcatgagcgttgttgaagaattcccaataaagaccctgacaatctatgaaacaaataggggaagtcaagacaatacattcgacgtggatccttgggatgatgcaatcaataaaggcccaaaaccaatcaaagagctcatcaagttacaacttggacctaaactcgggcaatgcacgcaactcagtagagacctcaccaactgcaattacaaaaatatagtcgaaccaaaccaatctcacagaagaagagaaacatgggaaaataattacgtagggtggttagggaagagatcgacaagatgctcaaagcctagtttatcagggaggttagatactcaacctagttggccaacgttgtcatgcatcgaccaacttgtggatggagcatttggcttccaattgttgagcttcctggatgcttattcagggtacaaccaaatcaggatgaacccactagatgaaggaaaaactatcttcataacggaagacgccaatttctgtaacaggattatgccttttggactcaagaatcatgacctaacattagtagaattagaggaagttttcagagagatctacaagtacaacatgtggctcaaccctgaaaagtgcacctttggggttggtggcagaaaatttatgtgcttcatgatcacccatctgggattgaagccaaccttgacaactgttcctcccgaagcttgcaggaaaggcgaagccgttctaccggctacttag

SEQ ID NO: 93742 - DNA, 699 bp, Glycine max
  Peptide Sequence Number=SeqID_210520
atggaggtcgacctacctataggttggaaaccactcaacctggagcattacgatgagaccactgacccgcaaaagcacctggatgcgtttctcacccaggctaacctttacactaatgacgacatgatcctatgtcgagtagatgatgagtcattctgcagatttatggatagattcagtcaactcattgtccaaatcaggaatgtcaatcccaatgtggcattacattccatgttgctagccctacaacctggcaagttcatcaatagtctgtgcaagaaacctccaagcaacatagatgaactacgagagcgagcaaagggctacattcagatggaagaaacatcgatgttctggaacaaagttcaacaagttggacaaaagcgtgagaaaggagaaagtagcacaaggaccgactcacacaagtcaggtaagcaacacaagaaatacaagcatcaacctcttctaaggggaccaagattgttgggccctcaagaacaagatcgaggaactcatacaggccagatacctagcccaattcgtaataaaagcccgatgacaaccaaactggaggccagtctagggggcacaatgaggaccattgtagaaacagagatactgatagaagggggggaccaaacggaagagacggggaggcagaggtgtcacacacaaaggcatgaacatcaacctcaataa

SEQ ID NO: 93743 - DNA, 300 bp, Glycine max
  Peptide Sequence Number=SeqID_210521
atgatcaagaaggtggcattggcactcataacctctgctcgacgtctcaggccatactttcaaagtcaccagatcattgccaagacggaccaccccattaggcaagtgttgagaaagcttgagctggcaggaagaatggtagtgtggtccgtagaactgtcgaaatttgatcttcaatatgagcctcgcagcctcatgaaaacccagttcatggtaaactttccaacagattttgctaacaacatccaagctaccctagacttgttcaactacatggctatatcagatgaaaggcagtga

SEQ ID NO: 93744 - DNA, 252 bp, Glycine max
  Peptide Sequence Number=SeqID_210522
atgcacgaggtgtacgccaacgaccgcgccgaggaaatcatgggccaggccattcaggagctcgactggaagcactccgacatcatcatctccacctcttgcaacgacaaagggctctcatgcaagcacatcattgagggaaccaaggcctccttgaaacgcctcgatatggaatataatatgtggatgttttctactgtcaccggtcggattcctctatgccgatatggaatacgccgcatccaattctaa

SEQ ID NO: 93745 - DNA, 222 bp, Glycine max
  Peptide Sequence Number=SeqID_210523
atgtcggcatctgaggcagactctatggaggagagcggtcctgaggggatagcgactagtggaggtcttcatcatagcagacaactccttagactagagtttatatactttttgggggaatttgatgattgtatacatgtggctgaagccaccacagtggatacctttgctctggatgtcactgtgtattttgcaaaactcccatattttggacagctttag

SEQ ID NO: 93746 - DNA, 1524 bp, Glycine max
  Peptide Sequence Number=SeqID_210524
atggattcttctgtgcctcctgttgctttggaaactgaagacagcataagcagttactccattcctgaaatccctgctttcaaacttgaccaaatcctagttgcaacccttgctcctctctctcatgatgagttctcagacccagttatccaacctcttggcaaaagccttcacaaaagaaagcagaatctgtgcacggcagattctgctgtcctttcaggcctggaggactcttgtgcagtcatatcaccaccagcaccagacactttggaagtgcctgatgatagagatggaaccgttcttcacacaacttctgagaccacagaatcaggtccagggtcaagttcaacctctctttttgtctcttctgatgagatttgttccttcagagaggaagaggaaacaccaagtccaactccaaagcatgtgaaacgtgtttctgatgtgatcttcagtgatcttgagtcaaactacacagatactgatgagtttgatgattctcagattgagagtgttccagtgatggaacgtgctgtgagtatttctgtgatggaacgtgccgtgagatctgggaagaagggttcttgctataggtgcctcaaggggaaccatctcacactaaaggaggtttgcattgtttgtagtgcaaagtattgccgcagctgtgtggtgagggctatggggtccatgccagagggaagaaaatgtgtgacttgcattggctacagaattgatgagagaaatagaagtaggctcgggaagtgttctcgtatgctgaaagggttgctgtctgagtcggaagcagcccaagccatggatgatgaaaggtcttgtgaagcaaatcaaataccaccagagcttgtctgtgtcaacttgcaacctctgaatagggaacagcttaagttgctcctcaattgtcgaaacccaccaaaacaactgaagacaggatcctattggtatgataaatgctctggactttggggaaaggaaggtcaaccacctagtcacctgcagaaaaacgcaagcaatggaaacaccaacgtgtttataaatgttcgtgagattacaaaagaagagaaattggtgctgcaggtggctggagtgccgtgggagggaacgcgcaacttttgggtgcatgccgatggatcatacacggaagagggacagatatatcttaggggcagtatatggcataagcgcatagtaaggttgacttgtgcagttttgtctttgccagttccttcaaagtctgtagctctttcttgtgaaggtgaaatagctaacacagacagccttagtaagaaaatacttaacaaatttctacttattggctctgtcaattctgattcaaaaagttttagttgggctgtggacaatgcgataatgagtgagagtgagactgcatcaaaattgggagcatcccctgtccgtagttttggttcagttgtggacaatgcaataagaagtagtagtgctagtgaagcagatttgggaactgttgctttgtcagtgaacatgaggatg

SEQ ID NO: 93747 - DNA, 210 bp, Glycine max
  Peptide Sequence Number=SeqID_210525
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatctcgcacagatattgtccggtccaaagacctctctgcatattccttctgtttttccttag

SEQ ID NO: 93748 - DNA, 564 bp, Glycine max
  Peptide Sequence Number=SeqID_210526
atgacaggaactgttggagttcccatgacaaccattgaagccaggcttgaatctgtgccagagatgggatatgatgccctctccaatgtaccccgtggagaaatttgtctgagaggaaataccttgttctccggttatcacaagcgtgaagatcttaccaaagaagttatggttgatggctggtttcatacaggtgacattggagaatggcaatcaaatggggccatgaaaattattgatcggaagaagaatatctttaaattgtctcaaggagaatatattgctgtggagaatattgaaaacaagtatttgcaatgccctcttatagcatcgatttgggtgtatggaaacagctttgagtcattcttggtggctgttgtggtccctgaaagaaaagccattgaggattgggcaaaagagcacaatttgactgatgattttaaatctttatgtgataatcttaaagcaagaaaacacattttggatgagctcaacagcactggtcagaaacaccaagatcatattgatcaactatacaaggaagcaaagggagcaatggtgtaa

SEQ ID NO: 93749 - DNA, 207 bp, Glycine max
  Peptide Sequence Number=SeqID_210527
atgacattaaccgataagtcttatcctgtatcaagtgttatagggaaagcgggatcccatgtaacggctagtggagcacgtgcggggcatgagagcaaggatgatgagtcacgcatagtggaaggcatgaataacaaacttccggatgatgcggaattgggacgtggaaagagagtgaggaggccaagctggaagctaacagaatga

SEQ ID NO: 93750 - DNA, 3779 bp, Glycine max
  Peptide Sequence Number=SeqID_210528
atggcagacaacacacgcatgaaagagatctatgcagaattaaaaaaaaatgctgatgccattacgcgtgtcagtgaggacttccatcgtcagatcgagcgtttggaaggtgctaaccacgctcatatggaaaggatggaagcgattcagatagcaaatgagtcacagattacacagctcaattctgctatgacgcaaatcctgcaacgactacaatccattccggtgtctccccatggtgcatcgaactcaaacaaagaacaaacgaggactccttttcaggtgagatctgtcaaactggattttcctcgatttgatggaaataacgtaatggactggatatttaaggcagaacagtttttcgattactatgctactcctgatgctgatagattactcatagcgtctgtgcacttagatcatgatgtggtaccttggtatcaaatgatgcaaaaaactgatccattgctgtcatggcaagctcttactcgagctctagaacttgattttggcccatccgcttatgactgtcctcgagctaccttgttcaaactagctcagtctgcatctgtgaatgaattttatatacaatttactgcgttagtgaatagagtcgatggtttaagcccagcagctattcttgattgctttattagtggcttgcaagatgaaattagaagggatgtgaaagccatggaacctaggaccctgagcaaagcagtggccttagccaaattatttgaagaaaaatatatagccaacaaaaaacctaaccaaatgaccaatgtagccagaaattatagccaaaacacttcattcaaccacaaaaacaaccaaaattcccaaaaacttgatcacaccactaagcccaaccttccacctctcttacccactcctcagatcaaaccttttaaccctagaaaccaaaacatcaaaaaaatctctccagcagaaatccaactgagaagggagaaaaacttgtgctatttctgtgatgaaaagttttctccagctcacaaatgtcccaacagacaagtcatgttgctccagcttgaggatgatgaagagctacagccagatcggaaccaggcaactatagaggaaggtgaagaaggaggtaatgtaactgaaactcaccacctgtcactcaatgctatgaaagggtctaatggagttggcaccattagatttacaggccaggtgggtagtataagggtcaagattttagtggatggaggcagctcggataacttcattcaaccaagagtagctcaagtgttgaagcttccaattgagccagctcctaacctcagagtattggttggcaatggtcagacgttacaggcagagggtatgattcagcaattacccttacatattcagggtcaagaagttaaagtacctgtgtatctattacaaatttctggtgcagatgtgatcttaggatcaacttggttagcaacattgggccctcatgttgctgattatgcagcattgactcttaaattctttcaaaatggtcatttcattaccctgcaaggggaaggtactatgaaacccagtccagcccaatttcatcatttcagaagattgcataacactgatgcaatagaagaatgttttgcaattcaatggttaccaaatgaagtacctggagatacattgctggagttacctacagatatggaccctgaaattgccatattactacacacttatgctcaggtgttcaaagtgccttcttcactaccacccccaagagaacaggatcatgccattccactgaagcaaggatcagagcctgttaaggtgagaccttacagatatccacacacacagaaagaacaaatagaaaaaatggttcatgaaatgcttgatcaaggcatcatacaaccaagtaccagccctttctcttcaccaatcctgttggtcaaaaagaaagatgggagttggagattttgtactgactatagggccctcaatgccattactgtgaaagacagttttcccatgccaacagtggatgaattacttgatgagttatatggagcccaatatttttctaagctggatttgaggtcaggttaccatcagattatggtaaaacctgaggacagagctaaaactgccttcagaacccaccatggccattatgaatggttggtaatgccatttgggctcactaatgcaccagccaccttccaatctctgatgaataaggtgtttcagtctgccttaaggaagtttgtgttagtattctttgatgatattttggtatttagctcttattggcatgatcatctcaaacacttagaggcagtgttacaaatattacaacaacatcaattgtatgccagattgtcaaaatgttcttttggagcttcagaggttgattacttgggacaccgggtatcaggcaagggtgtgtccatggaaagcactaaagtccaggcagttttggagtggcctcctcttaccaatagcaaacaattgagagggtttcttggcttgacaggatactatagaagattcatcaaagcctatgcccacattgctgcacctttaacagatttgttaaagaaagataattttgtgtggaattctgaagcagaagcagctttccttaagctcaaaaatgccatgactatagcaccagtgctagccttacctgattttacacaaccattcattttggagactgatgcatcgggaattggagtaggagcagtgttgagtcaaaatggtcatcctatagcatatttttcaaaaaaattagcacctcgaatgcaaaagcaatctgcttacaccagggaattgctagccattacagaagcattggctaagttcaggcactacttattaggcaataagtttatcattagaacagatcagagaagcttgaaaagcttgatggatcagtctcttcaaacccctgaacaacaagcatggttacacaaatttttggggtatgatttcaaaattgaatacaagcctggtagagataatcaagcagctgatgccttatccagaatgttcctgttagcctggtctgagccccattcgctgttcctagaagagctaagaagtaaactaactgcaaatcctcacctcaagcagttaatggaggattacaggtcctctaatgaagccagtcattatgcagtaagacaagggttattgtattggaaagacagattagtcattccagtggaagaagagatggttcaaagaattttgcaagagtaccatagttctcccattggtggccatgcggggattacaagaacactagcaagattgaaggctcaattttactggcctaagatgcaggaacatgtcaaagagtatgtacagaattgtgtgatttgtcaacaagcaaaagtgagtaacacactgccctcaggattactgcagcctttgcccattccccagcaagtttgggaagatgtagctatggattttatcacaggtttgcctagtgttaatggtttttctgtcattatggtggtagtggatagactcactaaatatgctcacttcctacctctaaaagctgattacagtagtaagtcagttgctgaaactttcatgaacaatatagtgaagctgcacggcattccaaaatccatcgtgtctgatagagatagagttttcactagttctttttggcagaatttattcaaattacaaggcactacactagctatgtcatcagcatatcacccacaaacagatgggcaatctgaaattctgaacaaatgcctggagatgtatcttag

SEQ ID NO: 93751 - DNA, 1134 bp, Glycine max
  Peptide Sequence Number=SeqID_210529
atgcttgacaacttcaagcctaatagaggattgcatcagggaaacccactttcatcgtacatgtttctgttatgtatggagaaattagctttgcttattcaggcgaaggttagcgagggtacttggcaaccaatgaaaacatcagtgagggggccaaaggtttcccacttgttctttgcaaatgattgcctactttttgtcaaagcaactaatgctcaagtgagacttgtcaaggaggttttttggatttttttgcaaggcctcaggtttaaagacatagtgaatagcaaattagctaggtggaagactaaattaccaaataaggcgggcatgctgactttagccaaatccgtcttatctgctatccctacctatactatgcagaacttgtggattcttaaaggcatatgtaatcgcattgatgtagccgttaggaactttatttgggataaaccttctacgcattggcattcactgatgaaagcttatgatcgactagaagatggattcaagtttagacttgggcaaggagaggtgtcgttgttctatgagaagtggtatggctacacagaagaagacttcattcacttaatcagagactttcctcaagctttgattcaagtgcacaaggagattatctcggcagcaactacctcaacaacccctgcgccacctagagaagttgtttggaagccacccactaatgcaactttgaatctgaatatggatggtagcgcaatagggaacccgggaccttctggatttagagggcttattaggaacaacattggagattggatcataggttttgttggtcactatggatatgctacgaacctcttcgccgagctcacgaccattcatcaaggattacaattgatatggagatttggacaccatgatgttgtttgcgaatcagattgcaagacaactcttcatctgatttgtgatgcaaatactgggtatcatccttatactactattattaacaagatcaaggactacaggtctaaaccacgaagacttcacttttgccacattttgcgggaaggtaacaaatgcgttggtgcattagctatgatagaattatctcatgaagataactttgttcaatgggatactccccctcactag

SEQ ID NO: 93752 - DNA, 318 bp, Glycine max
  Peptide Sequence Number=SeqID_210530
atgttttgggactctctcggctacaaaccttggcatgttgttgaaactcaaggacactctgggggactatggatactctcaatcagagatgacattgcttacaccattgttgactctatgacccatgcagtaactttctccctaccgaagcatcaagcagtttggttctacacagcaggttggtggctcaggagaggggatttcaaggagatacttttgtctcctaaagtatcaggtggcaactttcatccagctagagccattgatctggctacttctttacttggcggaagaatatcgacaataggaggcatgtga

SEQ ID NO: 93753 - DNA, 285 bp, Glycine max
  Peptide Sequence Number=SeqID_210531
atgcttgctgctttaaagcagagggaacaacaatttgggggtttaagggcttccatgatgaaggagaaggaggaggaactcacattgtttttggagatgaagaagagtgaggaggaaagtaataaccttcttcttaacaactctaaggatttttatgcatctctcgggtcaaatgggggcgttaaccacatttttaacattttgtcttctacgccgactcctatgtggaagactggtgttgatgattttctcaatttagaaaatgataagaatgactatgactag

SEQ ID NO: 93754 - DNA, 354 bp, Glycine max
  Peptide Sequence Number=SeqID_210532
atggtgggtgacacacgttcaaactttgtggatttggtcttcactggcgaaaggatcgaagtgggtctgaaaagaggcaaatttgatcatcttgctttaatgaatgagaaaattgggacaaatggaggggatgaggaggaggaaggaaaccatgttgtggctgtcattcctagatggccatgttttccaccggctcaacaatgccattacccaccacccaatcatccacaaggggggggagatgatgcaatcctccctaggaagggaccagtcactagagccataagcaagaggctccaagaggatagggctagagctgctgaagaaggccttagggttctcatgaacctcaag

SEQ ID NO: 93755 - DNA, 531 bp, Glycine max
  Peptide Sequence Number=SeqID_210533
atggctacaccacccaactctcttcctccgattggtgcagcatcatcgtcaccatctaccttaaagcgcacaagaaatgtcacaaggctaagagcattggcgactagaccagttggggcagagagatcgttggtccatgtcgatcctatgaccgagaaggccgactgtccccacagtaagaagttaagaacatatttggggatcgtcgctcgtgataaggtcgatgtcacatacgagaattggaagcaagtctctgctgctcagaaggatttgatatgggaggatattcaggctgaatttgatatccctgaagtatatgatcagaggacaaaaaggaaaatacttcagattgtgggggagcgatggagacaattcaagtctgatttgacttcgaaatgggcacttgcagacgacaaggaaagtgtcgacgacactgtatgccaaaagtacgacattaacaaggagaaatgggcccaattttgtcagagccgcagagacccttcgtgggaggatgtacaaaaaaaagcatag

SEQ ID NO: 93756 - DNA, 213 bp, Glycine max
  Peptide Sequence Number=SeqID_210534
atggaacgagatgaaaagaggcataattccaattccctcaaatgcatacaccaccacacctattctcaacagaaattggacctaattgaaatagggaagcatgaccaaaggaacaaaaccttgggagcaaaacctagaaaaatcagcgtcatttcgttgttcgtgagaaacgcaagggtggtggagatgaatatggggaaagctaatgcataa

SEQ ID NO: 93757 - DNA, 228 bp, Glycine max
  Peptide Sequence Number=SeqID_210535
atgacggtgatgatgatgagtgtgacagtggacataaccatgacggttgatggcagtgacggcaactggtcgaggaggatagtcgcgacgatgagagtgcttggcggctccatcaaaagacttccctccaagtcacctactgctgcttatctgctcccacaaatgaaagttcgagatcatcacagacaccaatcacatggtacaaaaattgcaaatgtgagtttataa

SEQ ID NO: 93758 - DNA, 459 bp, Glycine max
  Peptide Sequence Number=SeqID_210536
atgcatgctagagctagagtaatgggtgaaatagacgaggtgcaagaacagatgaaggtcgacatggaggccttgaaagagaaaatggccacaatgatggaggccatgatgagcatgaagaagatattggaggccaatgcggctgtagctgccgctactagcaccgttgctgaggtgtacccgacccctccatctagccccaagcaaataaatcatcctacctcagatatgataggtcagggaggtaaagaattgggaagtacgggcggcccccattttgtgcaagttcaaaacaagcatgccttcccgccatatggcttgcctcccaactatacaccacccaatgtggcgcacacttccgatgagaatgtcgataactccactcccatactcattgagagccaacaaactcaatttgatcatgcacatggtctttcaacccatgggggatacacatga

SEQ ID NO: 93759 - DNA, 1397 bp, Glycine max
  Peptide Sequence Number=SeqID_210537
caccgaagccgacgccgccgtcagctggcccagcagcgcctgctgctgttcctcatccggccggccgtgcagacgatcgaccagatcgtgcatctggcgtaccggctgattcagctcaatgcccaggttgtgcagcatcagcttgcgcgcctgaacgtttttgtcgtattcgcgccgtgcctgctgcagccgcttgttcaccatcacctctttatcctgatcgtgcatcaggaacagatgcggatttcatacacctcgttgttgaccgtcgcctggatcaccccgtgatgctgttcggccatatgggcgatcttttgcagactgaggtgcggcaacaggtgctcggcgattttattgctggcgatcaccgcattgttggcgaagctgtagaccagcaggccggaaggcaggctggagacgatttcctgattcagcgcgcgctcggcctccagttccaccgccatgttttcgctcgggcgaatgtactggcggcggataaagtagatgctcagcatcgacagcgccagcagcagcaagttgaccgcgatcagccagatgttgttgcgcagcaggtcgatggccagattgatggccgaaacgcgatacaccaccttcagcggcgcattgggcagggcggcgctgaactccacccagccgccgctcatcgtcgcatgggtgccgaggacggtttccgccgggatggtgctgtcgtcgagatcgacatcgtccggctgcagcaggaaattggcgcgggccagattggccggaatgatgtcgttgatcggcaagtcgaaggcgatcaccgtcgccagatgccctggctgattgaaagtggtgcgaatcgagaacgaataggcgttctggaagcgctgcttgcgcagatcggaaaagctctcgcgctcgtcgagcatattggcctgctgcagcatctcggcgcggcgttcgtccgccgaggtggtcaggtagctttcccgaaagcgcgaagccagctctttgagcggctgagtggtgatcaggctgaggctgttgtcctgaccattgaggtaatacatggcgtagttttcggtcttggcgccccagcgggtgtccaggtaatccgagatgttggcgatcatcgccagcgtgctctcgtcatggctgccgaagatcaccgcgtcggttttcttgtgcggtttctcgatataatagacgtcgggccgcaggcgggtttcctgcaaaccgggatcgacattctgcgccggcgcattgccaaatttgtcatagacctgataggtcatatagcggtaggtatcgatgcgcttttgcagcgaaccggcaatgctgttcagcgcgtactttttttccgccagccaggcattggtgtagttgtagccatacaggccgatgccgatcgttag

SEQ ID NO: 93760 - DNA, 879 bp, Glycine max
  Peptide Sequence Number=SeqID_210538
atgcccagaatcatatctccttttcagactagatttatccctatcagatctcctttctttgcaccggaaagaggactaagacaaggggaccctttgtccccttatcttttggttcttgctctggacaaactttcacgcattatttccaagcgtgttgatgatggttccaagatgcgggctggaagagaggggcctcttgtctcccacttgatgtctgctgatgacttgcttatatttggagaagcatccatttcccaaatgcaaactgtgactggagtgttggaagaattttgtagcatgtcgggccaacaagccacttcattggtgaataccaaactcgcgggatggaaagcctctccattgtccttagttggaagaatcaccttggccaagactgctatccaacctatccctgcctatcctatgttgataatgatcattcctcagaatattattgcagagattcaaaaggtacaaaaagcctttatttgggggacaatgctgagcacaagaggcttgcatcatgaagttgggttgggaaatggggagaataatctgtggactaatgtgctaaaaggaaaatactccagaagatttaatgttgcccaggctatggattacaaaggaactgactcccctttgtggatagatattgtgaagcattcagctcctctggttaaagaagagtggtgggtcattgggaatggggagaaggttaatgctttgaatgataaatggttagatgagaatactaaagttgcagactttattactgacattcctgatcagttccagaatttaactcgtattagagccattatgcctcagtctcagatagcaggggaagatattaggatgtggactattgatataggctag

SEQ ID NO: 93761 - DNA, 282 bp, Glycine max
  Peptide Sequence Number=SeqID_210539
atggaactggacctcttttttgttagggagaaagttcccagcaaacaactccaaatacatcatgtcccagcctctgcacgtttaatagaggacaaggtgtctttcccaagagggagtgatggcacaacacttcccttacaaacatatttcaggaaaaagaaacgtgaaaagaaggcagagttggaaggttttgaccaagttaacagtaacctccccactattgtagtgcaggctgaaacagtgtttttaaatagcgtccatggcactgccatggtggaatga

SEQ ID NO: 93762 - DNA, 909 bp, Glycine max
  Peptide Sequence Number=SeqID_210540
atggtgtgcatgtcgtgcgagagcttgagtttcttggcggtgccgtttcagtgggtggtgttgtcgttttctgtcagcggtgaccttccagataaagttttcgccagagtttgtgatgaaggcgttgccgcggtggtcgacggtgacgtcattggcagcatcgatctcttcggaggagagggaggaaaggaagagacggtggtgggagcggaggtcgtaggcgacgagggtgttgaacggagggatccaaggaggaagcgctacggtgatgatggtgtgggtgatgttatggaatcgatggaattatgcatatttgatttgcggagaggccaacacgaaggccaagagctcgataagattctcttcttcttccccgccggtttgcccttttcaaagcaactctccgtcattggcctcagcgaaggactcatcactttcactagaatcttctcgccagaggctgcctgcgacgtcatcgaagcagaaagacattctcatgttttctacgaggccgaacccgatatctggatagtcatggttccttctcccgttgccgacaaaagcaatgattcagaacctatatggagagttgatgcattaagaaaagttctcaaggaaattcactcactttttgtcatgtttcatggatctattagagcaatgctggagaaagaacccggcggaggactaacaagacggcatttgtatacctttatcatggattatctgagggcatgtaaaaagcggtctccgtgggatacttgctgctgtggtaatggtgaagttgctgtatcaaatgattttcttgcggggaaaaagctccttttaccttcattccgtgattgcttaaaggaacgtggaactgttcagatgctgacaataggtcgcgaggctgcaattgaggttcag

SEQ ID NO: 93763 - DNA, 876 bp, Glycine max
  Peptide Sequence Number=SeqID_210541
atgtgtagccacagccagagagtgttacccaagagaataattctggtgcgtcacggggagtcgcaagggaacctgcagcccaccgcatacgacaccatccccgaccccaagatccagctcacgccggagggcattgcccaggcacgccacgccggtcaccgcatccgccacgtcatcgccggcgagggttccaccaattggcgggtgtacttctacgtctccccctacgcccgcacccgatccacgctccgggagattggtcgctccttctccagaaagcgcgtgattggggtcagggaagagtgccgcattcgggagcaggatttcggcaattttcaggtccaggagcgcatgaacgtcatcaaggaaactcgccaacgcttcggaaggttcttctatcgctttccagagggagaatccgccgccgacgtcttcgatcgcgtttccagtttccttgaatctctgtggagggatgttgacatgaacaggcttaaccatgatccttctgatgatctgaatttgataattgtgtcacatgggctggcatctcgtgttttccttatgaagtggttcaagtggacagtcgaacagtttgagcttctgaataattttgaaaatggtgagttccgcgtgatccagttggggagtggtggagagtacagcttagccgttcatcacacggacgaagaactacttgagtgggggctctctcctgatatggtagctgatcagaaacggcgagccagtgccagcaagggtgactggaatgatccatgttcctggtaccttgatgctttttttgatcatcttcctgactctgacgatgacaatgtggacaaacatgacgagacagattctttgagtgaatgttcatag

SEQ ID NO: 93764 - DNA, 408 bp, Glycine max
  Peptide Sequence Number=SeqID_210542
atggtgggagagaagaggaggaaaatgagcgagatggcgtcgttggtgaagaacctacgtctgaaacacgctcatccttttctcccacacacgcacacaagcaaacgaaccaagttcttcttccctgtgataagatcgcacaaattttggaaccctaatctactacattttgttttggaccttcatctgaatcgtaaaaatcaatcgtgttgtgccactcgcatccttgcttcttcgctgtggaaccaggtcatctacgatgaattggagcccattgcggaaactttggcttcctcgatggaggatttcccctccatcgtcgttcgggtggatgattttagctctgtgaactgtaacaacgacattaagatccactccaacggtgacggcgcaatgcaactatggtag

SEQ ID NO: 93765 - DNA, 162 bp, Glycine max
  Peptide Sequence Number=SeqID_210543
atgtctactttgtcttggggaaaaataaaaggagacccagatcccgataccttccacatggccaagggtgcacgtgcagatgctgctaaatcttcaaggtgctacgataaagacaaaggcaaatggaacgttattcacaataccatgtctagtgaattataa

SEQ ID NO: 93766 - DNA, 303 bp, Glycine max
  Peptide Sequence Number=SeqID_210544
atgacaccagcaacacgtttgaatgttcttggaatacaaacaaatggcttaacctctataagatcacctttttcagtccttatgtataccgaccgcaatctcctagctttatttagtgggctttggggtttgcaaagagaagcggtttgtcattgcgggatttggtcttggcggcgtagacgaggaggaggatggcttcgaaccccgcaagggatggtggctctaaggagtggatgcgagagaggtagaggccgacaaggaaggggaggaaggagaggactaccaggtggaggtgggggttag

SEQ ID NO: 93767 - DNA, 552 bp, Glycine max
  Peptide Sequence Number=SeqID_210545
atgggtaaacaattagggttgctaaaaataattgttatgcaagggaaaaggttggtgatccaggatttcaagactagtgatccttatgttgtgctcaagctagggaatcagagagagagagagatagagagagagagagaggaagtgtttgataaagatcttttgaaggttgatgacaagatggggaatactttcctgaaccttcaaccaatagtctctgtagccagattaagagacatcttaagagtgtcctctattgagacgacattaaggaaggtcatacctgatggtgaaaactatcttgtccgtgaaagaaataccaactgtgtgaatggtgaggtggtgcagaatgtttggttaaggcttcgaggagttaagtatggggaactagaattgaccatcaagttggtcacacatgttgctcctgcaatacaatgcaacaattgcatgtgtcataagtgtagatctctaattaacattttatgtctagttaatcggggtttctggcaaatctgtacgatctcctctacagctagtgaccaagtttcctaa

SEQ ID NO: 93768 - DNA, 225 bp, Glycine max
  Peptide Sequence Number=SeqID_210546
atggctcgctcatcgggccaattctcgctcagcgcaattccctctcgggttggaattgcgcttaacgagcccttcgcgcttagagagacatcaaaagttgttacttttaaaatcccaacggtcacactatgtataaatgtctttggaagcttcaaacaaaatttgaagatgatccaacggttaacgaatccgagattgcgattttactggaataggtttaggtaa

SEQ ID NO: 93769 - DNA, 111 bp, Glycine max
  Peptide Sequence Number=SeqID_210547
atgtcagcttggaaaatctcttgtagtgttccactctggggatttgttgtagctttcatactatttagggttaaaggaaatgaggattcacacactgtcgaagttccttaa

SEQ ID NO: 93770 - DNA, 1290 bp, Glycine max
  Peptide Sequence Number=SeqID_210548
atggatgtgaaggctttggcgaaatcaaagagaaaccacacgcagcaccatagcaaaaaatctccccatagtcacaagcccaaagccccaacatcatcatcgtcttcttctgtgggccccaatgacgctgcgaagaacaacccgttggggaagcagcaagtgagccagaagaagaaaagccaccgttccgcgcttccctcgaattgggacaggtacgaggatgaggaagaagaattggattctgggtccggaattgcgagcaaaaccgtcgatgttgtcttgcccaaaactaaaggtgcggactttcgccacctggttgcagaggctcagtctcaagcggagacgagtttagagggattccctgctttcgatgatcttcttcctggggagtttggtgtgggattgagctctatgcttgtggtcaggggagagggcattgtctcctgggttggagatgataacttcgttgtagatgataagacaactggaaatccagaggcatcatttttgtccttgaatttgcatgctctagctgaaagttttgccaaagttgacttatcaaagagattattcattgagtctgacctattacccactgagttgtgtgtggaggagttggcagtgagcagcaatgaagagcacaaggaactgaaaactaaagaggacagtgaactagccaataggatgtctaaagaattagatttagatgatctagctgcagatcagtttacatcatctagttccagtagcagtagccatgctgtttctacattccccttgtccaacaatgtctttcacattcctgtaaactatgtcaatgctgaagctcagcaaactagctgttctagtaaaaataaagcatttgttccatgttcagatgctagtttacattctactgaagatgcaagagggaaacagtactcagcatttggggctgctgatgttgaaaaagaactagatatgcttctagattcacttagtgagaccaagattctagattcttcgggctttaagtcctacacctcgattccggtttcattgggagtctcttctgtgtatcctcaggtttcaaagaaagatccagttccatccaaaactgcatcaattactgctagtctagatgatgcacttgatgaattgctggaggaaacatccactttgatgaatccaaatgttttattacggccacaggaagaaaaacctttccatcacagcatgcaatcttcttcacattctggaaacaagtccaaagtggctgatgattttgattcatggtttgatacactttga

SEQ ID NO: 93771 - DNA, 987 bp, Glycine max
  Peptide Sequence Number=SeqID_210549
atggagttcatctgctttggtgtcgtcagacccaccgccatcggtgccatagtcgatcttctggcacttcctctcattgaaaatcttggtcttcttgcgcttcctcaaatcttcgaggacaccgaatcactctcttatttcacctctgttttcaaacttcgaaacattaaaacccccaaatggccaaaccctcaacacaaatgcaatgactatcggttcgatacagaacaaggaacaacgtgcaaagaagtatacattagaagtaatcaaatggaagaaaagcaggagaacataccttcaagtaacactcacaaaaggaaaagcttaagtgccctcggtatgactttgtctgtgctgtttggtttgctagaaactttctctgtgactttaaaccgcgaaaacggaggagagggtgcgcagggagggtttgagaggagggagagggacaaaggagggtttttcgattcgcagtcttgcgcagatgaatttgatagttgggttttgaataaaagctttgtgtcattggaggggtggagattcagctccaacgacggcggagagaggagggttgttggattcggctccagcggcgacacggattccgacaattggaacaataagaaaaagagtaagtccaacattggtagcagcgaaagtgttggtgttggtgggaggctgaagcttgtgttgcaacctcggacattgtcggggttaatccgttcggagaggcgaggccgagggatgttgaattttcgtagagtaccatatgctgaattttgttttctccctcatcatcctttgaaagaagtgtcagcggtgagattgatgtggattgagcttggcggtgcttttgctgaccttctcaacgagaaagggaaaggttctggtgaaaacgagatgggatatgttcaaagaacgcttggctttcccactttctcctatttgaccagactttgtaaagtccagagtataatcactcctaattag

SEQ ID NO: 93772 - DNA, 732 bp, Glycine max
  Peptide Sequence Number=SeqID_210550
atggaacaatcttctgctgtcaaatgcccttcaatatcctatcatttggttggcaccaaaaagattcaacaggaacttgcaaagcctggtgttcttgaaaggttccttgataacaaagatgacattgccaaactgcgtaaatgctttgctgggttgtggagtttggatgactcaaatattgttagaaaagcaattgaaaggcccgagttatttgtgatgaagccccaaagagaaggaggaggtcttgtacacccaaactttgatttgcctactgccctacttttatttaaaaacaaagagagaggggaagaaacttatctaacaaaccctcctaattacttttcaggaaacaatatttatggtgatgatgtgagggaaaccctcctaaagttgcagaaagcagattctcaagaagatgcagcttatatccttatgcagaggatatttccatctatttctgcaacagttctgttgcgtaacggttgttggcataaggatcatgccatttcagaacttgggatatttggtacttatttaaggaataagaataaggttatcatgaacgaacaaagtggttatttgatgcgtacaaaagtatcatcatctgacgaaggtggggttgcagctgcaaggaaatggtttgagtatggaattttccatgaccgaaggtccatcttcaatccagttgagctcatattattaggcaagcggcagcaaggaacattagcatga

SEQ ID NO: 93773 - DNA, 319 bp, Glycine max
  Peptide Sequence Number=SeqID_210551
gcaacgggaagctgccgttgttgctgaggatgctcttaacgtggatgatgcaactaaagaggtcttccaacatcctgaagaagttggtgttgatgcccagggttttccaggcaggtcacgtgacacatcagttctgactgtctatgttgatcatgttgcaatcattgtttggaatgaagaggaacgtcctgaattgaagttatcctcccatggaaggaaggttcagaaattcaggaggtctgttgctaagattgaagggttagtcgctgccacaggattaagtcctttgatcgcatgttcattggacactggcgattga

SEQ ID NO: 93774 - DNA, 366 bp, Glycine max
  Peptide Sequence Number=SeqID_210552
atggtgtcccacactcccagcgtattgggaaagaaaggtatgaatagcgtcgcagacttgcagcgtgctcctaggcgtggaggaggtggcggcactcgtcggtgtcgcagcgtcaatggggtcgcagcctcgccggtgtcgcagccttgcaggtgtgcagagcagcaacgcgctagggttttcgacttccagctatggagccctgagcagcggcgtgaaaatccggtccagatctcgcgtcgctctgccacgatagcggtcactccaaccgtgatgttgaatcgcgccgctacgtccatccccgtcgcagatggaggccgtgctgctccgctccgccgcgacagcggccgtgactcccgcgattga

SEQ ID NO: 93775 - DNA, 438 bp, Glycine max
  Peptide Sequence Number=SeqID_210553
agtaggagcccatgcacaaacatatataagaaagagacagcagtgcagaaattgcaagtaggtggtaacctggagagagagtcgtggagaaacgttgcatccaaactgacccgatcaacgagttcattgaatataggggctaactcacaggcttctctccagtggttttccggaaatggcgtgggaaacaaggcaactggggcatgcaccaatcccacgccaggaacgcttcccgatctctgcatgcatgcaatcacgaacacattgaacggaaataaaaaaggtgggagagtgagggacctgaacggatttgtcaccaacaaggaggccgtggagagaggtccaaacgagagcatcgtaggcgatagtgtgaaggaattgctgatgaagacgatggtagtcgaagatgccataaatatgttgagacatcgggaatag

SEQ ID NO: 93776 - DNA, 357 bp, Glycine max
  Peptide Sequence Number=SeqID_210554
atggtggaaatatattttcgttttaaggatttttttaagaaatatctttatattagttggtcattttctagatacatactttctcgccatggaaaattgcttggactagattccaaaaggattcctgccaacaatgctgtcaatcagtatgcagaggccttggctaaagcttggagtgagtataataaccccagggccgtgattatgattgtagttcaggctgaagaacgaaacatggatggacaagcaatttcagtcatttatttccgggctggctatacaccaattgactatccttcagaatcagtgagtgacatcagtctttttgctgctcataagcatgtttttccattgtag

SEQ ID NO: 93777 - DNA, 2211 bp, Glycine max
  Peptide Sequence Number=SeqID_210555
atggagcatgttttggagaaaagatttcctcttaatgcagaagattacacattatatgaagaagttggtgaaggcgttagtgcctccgtatacagggctctctgtgttccactcaatgagatagtggccatcaaggttctcgatctagagaagtgcaataatgacttgctgtattctgtagctgtcgtattggataaattcttattgatagctctgcaaattatgcaggatggcattcgtagagaggtacagaccatgaacttgattgattacccgaatgttttacgggcacattgctcttttactgctggacacaatctatgggttgtgatgccatacatggcaggggggtcttgccttcatataatgaaatctaactatcctgagggttttgaagagcctgttattgctactttattgcatgaagttctcaaagctcttgtctatcttcatgcccatggtcacatacatagagatgtaaaggctgggaatattctgcttgattctaatggtgcagtcaaactagctgactttggagtgtcagcatgtatgtttgatactggagataggcaacgttcaagaaacacttttgttggaacaccttgctggatggctcctgaagttatgcagcaattacatggatatgattttaaagcagatatatggtcatttggtataacggcacttgaacttgctcatggtcatgccccattttccaagtatccacctatgaaggttttgctcatgactttacaaaatgcccctccaggtcttgactatgaaagagacaaaaaattttcaaaggctttcaaagagttggttgccacctgcttagtaaaagacccaaaaaagcgtccaagttcagaaaagcttttaaaacaccacttctttaaacaagcacgtgccagcaaatatttagctcgcaccattttagaaggccttgctcctttaggagatcgttttagaatgctgaaggctaaagaggcggatttattggtgcagaacaaggctctttatgaagataaagatcaattatctcagaaagaatatattcgaggaatcagtgcctggaattttaacctggaggatttgaaaagtcaagccgctcttattcaagatgatgacatacctaatgcagaagagccacaaagggataagaagcaaaaagacagattggacaacttcaaagtttctgcagagaggctatcagctggagcagctaatcattcagatgatgcacccacgcaggacaaggaggatggattcaacaatcttcaggatttggagggttcacttgtttcatttcctactaaacctcttcaagcacttaaagggtgctttgatatgtgtgaagatgacattaataacagcagtccaagagatttggatcatgatggaagaattgacaatgaaagctctaggccaagtacttcattacaacaaaatactaccagtcagcaaaaaaagtttccaagtggttctttactacctgataattttctttttcccaaaatggttgttactgatggggacagggattatctacaaacaaagtattcttcagagaggaatcacagtggtccattgcaatatcggcagaaaagagacaccaacaaccttccactggttgatgacacatcggatggagcatttttccggcgtagggggcggttcacattgacagatctcagtccaatgggtccttcaaacagcacatctggcccagttgttagtcctaccagtccaccaaatcaaaatttcatgtctaccgctattcttccatcactgcagtgcatcttgcaacataatggtttgcagagggaagagattattaaattaataaagtatgccgaacaatcttctggcaagaatacagaatcagtagaggcagggacaggtgatatgttgcaggcaccacctgcaacaactagggagcgagagctgcattttcaggtgattcaactccaacagagcattggaagccttgttgaggaattgcaaagacaaaagatgaaaaatgttcagattgagtattgttttcttggtattgtgctcttgtttcaatctcaagaaatgttaaacattccgttaactaggaaaatagggtggatgtacaaagaaagtccaaagacttatgtggaatgggagggtatgctgaaacatgttgcctgtagtggtattctttcccaagatctagcagtccatgggtga

SEQ ID NO: 93778 - DNA, 679 bp, Glycine max
  Peptide Sequence Number=SeqID_210556
atgcaggaatggagtgctaggatactgatggaacaatcttctgctgtcaaatgtccttcaatatcctatcatttggttggcaccaaaaagattcaacaggaacttgcaaagcctggtgttcttgagagtggtgtcgttcagaatgtggctgcagccattgttggccaatggtggcaagaatgcatggttaataattgggatctttggatcttggcttcgaaaacaagcagttctaagttcaaactaaatccttgtgtcaaaactgtaagcaggttcattgaaaacaaagaagaaattgccaaactgcgtaaatgctttactgggttgtggagtttggatgactcaaatattgttagaaaagcaattgaaaggcccgagttatttgtgatgaagccccaaagagaaggaggaggaaacaatatttatggtgacgatgtgagaaaagccctcctaaaattgcagaaagaaggttctctagaagatgcagcttatatccttatgcagaggatatttccatctaactctgcagcaattttgatgcgtaatggctgttggcataaggatcgtgccatttcagaactgggggtattcagtacttatttaaggaataaggataaggttatcatgaataaacaaagtgggtatttgatgcgtacaaaaatatcatcatctgatgaag

SEQ ID NO: 93779 - DNA, 168 bp, Glycine max
  Peptide Sequence Number=SeqID_210557
atggcttcctgtgtggtgacatttttcgagatcatcgtgcattcaagcatcctctcttggttccttggcattggaggaatcgctggtttaatagagtatctcgctcactggcttgatgtgcttcgtggtatctcatatataagagtatgtttggatagagaattttaa

SEQ ID NO: 93780 - DNA, 219 bp, Glycine max
  Peptide Sequence Number=SeqID_210558
atgaaaggtttcaagtcattcaaggcacatcctatccctcttaagattattgaggccacaaggtccaacacaagatccatgtgcagcactgatgtctgcgacatagtcatcgtcggctctggtcctgtcggcatcatcattacccacgccagaggtgtcatcccctatagaagagggttggactcctggccaggcaacctattggagaaaggcctctag

SEQ ID NO: 93781 - DNA, 504 bp, Glycine max
  Peptide Sequence Number=SeqID_210559
atgagactcaatgcctatgagtcttccaaactttataaacaaaagatgaagcctagccaacaagttctgttattcaattcaaggctgaggcttttcccaggaaaacttaagtctaaatggtctgggcccttcataatcaaagaagtgaggccttatggagcactggagctggtggatcctaccttaagtgaccttgagagaagtcagattgtcaaagatggcctcaaaagactcaccaggcttgctgagaagcaaattgatgttgccctggtgaaagaattctactctaatgtgtatgattcggaggatagttctccaaagcagtgcatggagagggggaggactattagatttgacgctcaggtgttgaatgagtttctggggactctgctcatcattgtcgaaggggagcaactgactgcttactccagtacctccatacttacccaaaccatgaggccattgcggccaagctgtgcaccccaggagggtgattcatgttga

SEQ ID NO: 93782 - DNA, 555 bp, Glycine max
  Peptide Sequence Number=SeqID_210560
gaatggagagctaggctactgatggaacaatcttctgctatcaaatgccctacaatatcttatcatttggttggcaccaaaaagattcaacaggaacttgcaaagcctggtgttcttgagagggtgctctccacagtccatgccttagggttgtggagtttggaagactcagatattgttaaaaaagcaattgaaaatccagagctatttgtgatgaagcctcaaagagaaggaggaggaaacaatatttatggtgatgagttgagggaaaccctccttaaattacaggaagcaggttctcaagaagatgcagcatacatccttatgcagaggatatttcccgccacttctccagcaattttggtgcgtgatggtaattgggatacgggtcatgtcatttcagaagctggaatatttggtacttatttaaggaataaggacaagattatcattaataacgaaagtggctatatggtgcgtacaaaaatatcatcatcttatgaaggaggagttttgcctggttttggagtggtagatactgtatacctaacttga

SEQ ID NO: 93783 - DNA, 573 bp, Glycine max
  Peptide Sequence Number=SeqID_210561
atggccaatgtggtcccaattgtggtcggacggacagttaaaaagaaccttgatattgcggctagaatcacggtcgcgtggacgagatcaggaagcgttcctggagttggattggtgcatgcgccgcttgccttgttacccacgccatttccggaaaagcagtggagagaagcgaatgagttggcccctatattcaatgaactcgttgatcgggtcagtttggatgcaacgtttcttcaggaatcactttcaagaactaagaaagcggatgagttcacctctagacttttggacattcattccaagatgctacagattaacaaaaaagaggaaatacgattggggttacatcgttcagattatatgcttgatgaaaagactaaatcacttttgcaaatagaactgaacactatttcctcttcttttgccggtcttagtaatcttgtgactgaacttcatagaatagtcaatcttgaacagctcgatagcaaagctatagctccatatagtgccatggcatcgtggcaggtggccgctactggagttcagtcatgtcacgtttttgggtcttga

SEQ ID NO: 93784 - DNA, 897 bp, Glycine max
  Peptide Sequence Number=SeqID_210562
atggcaacccatttcccctcaattttcaagccaatttcaagcactgatgaaacaagtaaccaaacatctaggggactacccctttggatgggtcaaacatcttctcaggctcaagaaacaatggtcaacacaaattttcgtgagattcatcaacttggttctgccacaagctcatcaggaacaatgtatggtggcaactcaattctccaatactcaaatcttccaccttccaataactatcaactaagttgggtgtttggaactaaaatttccaatagcagtaacaaccaagagttaacaactaacactactactactacttcacttcctattggaaactcaagtgttccttccttgtattgttcccaacaccaacctcaacaaacatgttcatcagcaaacatgtcagccacagctttgttgcaaaaagctgctcaaattggagcaacctcaagtgacccttcatggcttgggagcttaggtttgaaatgtggcaacagccaaggtcaagatgggaacaataacaagtatagtgacatgtacggatcaagcttggtgctaaccactcttgggagtgaagcagataactctgcatgtgaattgtcccaaatgcaccctcacaaacgaagacacgtgctcaatgaagaaagtggaggggggcagactagagatttccttggtgttgtttctttctttatgtgtaatgggaaaataacaataaaagcaaatgggggtggagttgaagttggacttggaggagaagaattaagtatctggaaacttttaagagaggaaaaggtgggaattgagtgcttgatgaggggtaaaaagtttgctgttagaaaaactattgaagggttgaaaggagagatccatgcatattcttttgaatgctga

SEQ ID NO: 93785 - DNA, 564 bp, Glycine max
  Peptide Sequence Number=SeqID_210563
atgatgttcattgttcctttcgaattgattttcttactgtatgctgttttgttgcctagaaagtgcaagaagaaaaaggcttctaagcggcctaacaatgtgagattatcattgacgttgcgtttgatagaagattgcctcatgctcatgcttaaccacgattattcaacttccgaacaacttttgtgggcacgctctaggcttttgaactcaaaagagaagcaaaatggccatgactctttctgcattcggtgcatagacaccgaaactttctttttcaaggatgaaaaggatgaagaattcgtgtttagctttgatatagtgttctacgaacaatctgagcaagctgatgtgtatcagttcctagctcttcccgtgattagagatgttgttgatgcaatcaatgggacaataatcacttatggccagtttcaaatcatgcatgcgaggacatatgtggtttttctcctcatacaaggcagctacgtgtgtgtcgggagttgtgaaaaattacaagagatactgcatcgtaggagcttcgctgaatatgatccttggcattag

SEQ ID NO: 93786 - DNA, 963 bp, Glycine max
  Peptide Sequence Number=SeqID_210564
atgggtggtagatctggcggcttggtttgttctacttcctcttacactgggattagaacaaggcgtttgtgcacttctaacaacaccacctttcccttcccccaacaacctcaatcactctctttcgctaaacctctcaaactcatgtctcaacctttgaccaccaactctgttcttgttgaagaggctgctgctgatggtgattcctccgccgccgcacctcccctcttcgattatcatcgtatcgaccaaaaactgctccaaaacatagtttacgatgctcttgtctggagcaccctcaactgcctccttgttggtgacaaatctgttcagagatcaggaagagttcctggtgtgggcctggtacatctcccactttccttattacctgggccatttcctgaaagtcattggaagcaagggtgcgaattagctcctatatttaatgaacttgttgatcgggtgagtttggatgggaaatttctccaggaatctctctccagaactaagaatgcggatgaatttacctcaagacttttagatattcattctaagatgctacagattaacaaaaaagaggacatacgcatgggaatagttcgttcagattatatgattgatgagaagactaaatcacttttacaaatagagatgaacactatttccacttcatttgctttgattggttgtcttatgactggacttcataagagcttactttctcaatatggaaaattccttggactaaattccaatagggttcctgccaataatgccgttgatcagtctgcagaggccttggctaaagcttggagtgagtataacaatcccagggctgcaattctggtcgtggttcaggttgaagaaagaaacatgtacgagcagcattatatttctgcacttctaagagaaaaatatccttttcttattagttataattatgatacagaaggaacaatctag

SEQ ID NO: 93787 - DNA, 339 bp, Glycine max
  Peptide Sequence Number=SeqID_210565
atggaccaaagagaacttaatctgggcatctgctataggctctatcatttcatcatggaaactttggcttcacaagctatgaagacggtaactttaggaagatcttcacattacgattcaagctcaactaaggtgaagattacaacaagaggttttggcgctaatgcagacaaagtagtgcagccagagataccatgtgtagagaagaatattccatgcaggaacagcattgatgagaaagtggtggtggtgggagatttacctcatgctccaaagaaaatgaagcctctgcgatcaatcttgaaagttggtgctaatctcaatgacaaatcaaactga

SEQ ID NO: 93788 - DNA, 1434 bp, Glycine max
  Peptide Sequence Number=SeqID_210566
gtccatgaaaaagaacttcaacaagatgaaggagtcaataagggaaaatctcttgctcccaacactcagaaagcaaggaaaacaccatcatccaagaaatccttatctaggtcatcgtccaaaagtgtgtccatggcattgagtgtggataactcttctaatgatgaatctaaacaagaatctgaaaaggataatgagttaactttcgtctccagaaagatcaggaagatgtggaagaacaatagtgggtccagatggaagaactcttccatgaaggtgtttaaggagaagaaggacaaagaaaaaagctccattataggctatgaatgcaagaagcctagacacttcaagttagagtgcccaaaattggagaaatccaaggacaagtacaaacattacaagtccaaggaaaagaagaatttaatgagcattggggaggatttggatgacaccacctctaacgaagataaagaagaggaagccaacctatggttaaaacataatctactgagcataagtcaattgtgtgacattggatatgatgtttcttttaacaaggatgagtgtatcattcagaataatgatgggttattactcttttatgccaagaggaaagttgaggaatttattcatgtgaggtttgatgacaccaagcttgataaggaatcattagagttgggtgagtcctttgtagatctaagactagacaatggaatcaaaaactttgtgtcacctattcacaacacagacaaaaaagctattggagctaagtgggtgtttagaaacaagctagaagaggacactaaggttgcgagaaacaaagcaagattagttgctaaaggatactcacaacaagaaggtattgattacactgaaacctatgctcttattgcttgtctggaagcaatatgcattttactatcgtttgttgcttataacaatataaagatatatcaaatggacacgaaggttgaaatgagcatgatgggagaaatgaaaattttccttggtctacaaatcaagcaaacagacaaagaaatatatattaaccagaccaagtatgtgaaggagttattgaagaaattcaatatggatgatggaaaggaaatgaagacaccaatgcatctaaccacatacctaggacttggcaaggaatataagaaagtggatggaatccaatatagaggaatgattgggtctctattatatcttacagtgtctaaacctgatatcatgttcaatttgtgcttgtgtgcaagatttcaaaaagaaccaagggaagtccacttaactgctgttaagagaatatttagatatcttattggtactcctaaccttggtctttgctttaaaaaagggaaagatttcagattatcaagttactgtgatgctgactacgctagagaaaaacttgaaagaaagagcaccggttga

SEQ ID NO: 93789 - DNA, 843 bp, Glycine max
  Peptide Sequence Number=SeqID_210567
atgacaagtggaagtgaagcgtcaatgtatggagaacccattcccaagatcgacacaactttggttctcactaagaacgaagccaccatccacattgaacacttttttgatgttcctgctttagagggtataggtttaagtctcaacgagaccatgctttattgtggtattagaggattctacaatgactaccagaccattcacccaaaacttataagaatgtttttgtgcaaagcttacttcaaaactgcctatgccaaagtctccactattcttagcaagacaatgactttatccatggagtccatcacacaagtcattggctgcatgagggaaggcaacatatataacaacaactgggaaaagaactatgaagaacatcaaacacccaaggactactcccacaaagagaagtccatagaagcaagctatggagaagaactctcttgtcagttggaaggcaacactttagcgcataatccttatccattacagaggcagagtacatggggcagaagcaacaaaggaaggaatctagttgaaggggccttttgtgcttcttcttcttctactactactaccctcacccaaacccagaatctgagtgaccctcaaatcatagtccctggcaaaaagcgtagggtcaaggcttctgatactcaattcaaagagaattggttggcttcactctctaacccttttccagaaaaaacacatcttttgaatggagagcatgaaccgacccaccaaaatgacggctccaaatgggtccttggaattgacccagatgtctctggcgctgttgcactgttgaaaacacacggttctgtttgttcggctcag

SEQ ID NO: 93790 - DNA, 138 bp, Glycine max
  Peptide Sequence Number=SeqID_210568
atggatgtcgtttgccaagcgaaatctgggatgggaaatactgctgtttttgttttgtcaacacttcagcaagctgatcctgttccggatcaagttgcggctcttgttctttgccacacaagagaactggcttatcag

SEQ ID NO: 93791 - DNA, 219 bp, Glycine max
  Peptide Sequence Number=SeqID_210569
atgggagaattgaagtacattgaggcttacgaggaagagctcatcaactaccaagaagaagaaaaagctcccgattctgctaaacctgttgctgaatctggcaagaagggttatgttggcatccatagctcgagatttcaagacttgttgttgaaaccaaagcttcttcaagccattgtagattcaggatttgagcatccttcagaaggcaagatttag

SEQ ID NO: 93792 - DNA, 273 bp, Glycine max
  Peptide Sequence Number=SeqID_210570
atggctaatatggaggtttatggtgcttgtggaattccaaatgttggaatcagattcttagtttattcatatggaggtgaggcatggagtggaagagtcatggtagtcatgggacattttaatgctatcttgtatgataatgagaggcaagtaggtgttgctcgtccaaatactacagggataagagctttcaaggaggcaatgaagtggtgtaagtcacttgatgttggttataaggggcaaaaatttaaatggaagaggcgtgatctttaa

SEQ ID NO: 93793 - DNA, 873 bp, Glycine max
  Peptide Sequence Number=SeqID_210571
atggaccatgaacagtttttccttaaaggcaagtttcctagtttggatcccttggaattggagatgatgggaaaagagatggatgaaaagatcaaacaagctattttcattgtgggaagttttaaagttccgagtgaggataagttccaagcattattctatcaaagccaatgggatgtgatgatttggagggtggctttggatgctctttctcctactggagggattaaacaaggggatctattatccccttatatgtttgtgtcatgcatgaagcgtttgagtcagttgatttctgttgcagtggataatgagctatggaagcctatccaagtgggaaggaaaccccccaagttatctcaccttgcttttgttgatgaccttattatttttgtagaagcctccatggagcaagtagaggtaacttcaacttgccttgatttcttttgcaataactcaagtgagaagaaactttctttgggaggatacatattcaataagaaagctgaaggttctagagagagcagaggaaaagccatcaagaacctccaacgcctacccgaaatctccgtcgtggccctcgaacaagcacccctcagtgacggccaggtccgccagtgcgccaccagcagcgcacctctacctcctcgtacctcccctgcatctccccacaaattcgcagcagctcctgtgccgtggcggcatggacgcgccattgtcctccgcgggctcgctagcaccagccttcgcttccactccaccttgggaatgaagccacacatgggaaccacgcactttgtcgggacgaccgccagcacgactgagaggaagagcttgagacccctagggttcttcacgaactcaaaactgtga

SEQ ID NO: 93794 - DNA, 1062 bp, Glycine max
  Peptide Sequence Number=SeqID_210572
atgggagaagaacgacgcaaagctgtcagagaagaagtggagaaactccccaatgttaacttcattagagaagttaggtactctacctggctcgccaacatcgtcatgcatcaactgactagtcgacaaagtgtccgggttccaggtgctaagcttcctggatacttactccagatacaactagatcatgatagggtcatgtccttcggtcttaaaaacacaggtgctacataccaacggctaatggatcgagtctttaaacagcagatcaaactaaatgttgaggtatatgtggacgacatggtcgtgaggtctcaaagcatagtccagcacgtggtggacttagaagaagtcttcgagaaactatgcaaatatggcatgtgccttaaccccaaaaaatgtactttcggggtaagcagaggcaagttcctcggcttcatgatcactcaccggggaattgaagccaaccccaacaaatgcactgtcatactggaggctagtatccctgtccaggttcctcccgaagctcgccaaaaaggcccaaacaatgtcaccctagagcaagcccttaagctcaacttcagagccccaaacaaccaggcagagtacgaggtgctcattgcaggtcttaagctagcaagagaatactatcacatcgcaaagactctcattgataatttcaaatgtttcaaaatctactacattcccagggagaacaatgccagagcagacctactctccaagcctgccagcaccaagaaggttgggcacctaaagactatcatccaggagatgttccaaactcccaccatacacattgaagaagttatggccagagaagaggaagaaccagattggatgaccccttacaagaacttcctaatttggggggaactaccaccaaacaaggatgaagacgctcccttgccactaaagtggtgtgagccggctactactggccaatgcttagggcaggtgccctcgactttaccaggaggtgcagatgatgtcaagagtttgcagacatgccacacactcctcctcgcaatctttatagtctaa

SEQ ID NO: 93795 - DNA, 327 bp, Glycine max
  Peptide Sequence Number=SeqID_210573
atgtcacgatctcgtgcatcgtcatcacgttggactagcgttaatgaggaactgggacagcttcttgcgaatgtgcctgaattaacaattgaagagcatgaggaatggagggaattggcaaacatgatgcagaatgtcgcggctccaccagaggcttttttccaaacctttcacgccacggaccagattttcgatgaagttggtaaggacgttccaagcagcatgtattatttttttaaagacaaaggatggactcatttgcacttggagaacgttgctgaatgttggcttgtgttcaatcattggaggaagacacttaaaatttga

SEQ ID NO: 93796 - DNA, 525 bp, Glycine max
  Peptide Sequence Number=SeqID_210574
atgaaggtgtctttcaagcattttcttagggagtgcaatgcttcggcggatgctcttgtgaaacatggctcgcctgatatatgggctcgtggtgaagatggacatggatgtgggaagcatcatttcacagtagattacacagatcgcccaatccacctgatgatcaacctagcctacatcaagaagaactgtaggaatccaacagattcttctatcacatttccatggcctaggcgggtctgcgctcgagccactcaggacgcaccaccaccacgcctcatcatcgagaacctgcaccagctgtctattcacctcgccatggatcatccactaatgatgccagaggacttcattcagcgagttgcctggccgggagtccagccttctactaatgaggggatgatacctctagcattggagatgctgcaaatgctgaagcagacactgattatgttacggatctcatggccacatagggagattgggacccatggcccatacaggactgaggcgattttgagctga

SEQ ID NO: 93797 - DNA, 522 bp, Glycine max
  Peptide Sequence Number=SeqID_210575
atggcttgccttcatgatcagtcgctttcatttgcccctagatgtgcttatgaaactaaacccagttcaaaatctgtacttcagcaaagtgtcatagacattgaagccaccatactagaaatggaagcttttagaggtccaagaaagatcaatagagaagaagaaatcgaacccaactctaaaataattaactcacagacaaaaagaaatatatgtaataaaaatatatatggaaaatttttactttggacttgcttctactacaaggacttattgagtactaaatgtattgatcacaatttctgggagagacctgaagacatggacaccccaagaaaaacctttgttgttagcagggacttcccttgctctgaagtttcagcaaagatagtagaagcacttgcaaccttttcaattgtatatagaaagtatcatataggttattttacaagacttctcgaaagagactgttatgaatgggaagcaaaacacaaaacattatgcagcaacagaacaatatga

SEQ ID NO: 93798 - DNA, 537 bp, Glycine max
  Peptide Sequence Number=SeqID_210576
atgctgaaattaaagggatggggtccaaaagatgcagatgcaagaggtacaactagactgactagtaatcttgttgacattcctaacaaagggagacgattatcaatggatgctagaattgataatttccatgctggaagctcaacagatgccactgataagattaggatgagggagaggcaggctttgggtaaaaaccgtgaagaaattgaagagatatggttagagatacttgagaggatacaagttactagtctaaaagagtttctgtttaaagaagacaagatgatctctgttagttttggggaagatctagaactaggggataaatttgtcttgtatttgattgcactagatgtagtatcatgcaaagggcctgaaaattctgatatggctaaaaaggtcatgaaggatctgatgcaatcctaccctgcaagggcattggatagaagactccaagaagattgggccagagatgcaagagaaggccctagggttctcatgagccttagggtagatttcgggcccatgggctaa

SEQ ID NO: 93799 - DNA, 797 bp, Glycine max
  Peptide Sequence Number=SeqID_210577
atggacatcctggcacttttgatcttcggggtggtcctctttccaaatgtggatggattggtggactgggcagcgattgatgcttttctcgccttttacgaccgcaaggaaagcccggttgtcgctatcttagccgatctatatgacacattcgaccgaagatgtgagaagaacaatgcaaggatcatttgttgtacaccagttctctatatatggttggtttcacacttcttttgccaagagatgagacacgtttgcccgctagaaggccaccgctcatgcaccgagaaaaaagaggcaaactgggaccgactcttagcgagcaaagaaggagcgcctgtcaattggttcccccgatggaaggaaggaagaaccgagattcttatttcgtgtgggaaatttccaaatgttcccttgattgggacaaggggttgcatcaattacaatctcgtcctcgctataagacaacttggttaccctaggagaggggtgccattagaggaaggcctcataccttttattacacgaggtttcgatagcaccaacgcgggggtgcttcagaaggtccacaaggcatgggaaatgtcgcaaaggaaggacaaggaacttaagtggagtagcaatgggcccatcggcgattaccataggtggttgaaagcctacgcacaagatctagattggctcttgagtttgaggaccactaaggggatggaggttgaaactctggaagaagatgaagaggtgcaggccctcaagacagaacttgagaaagcccaaatagtcaaagaaaagttcaa

SEQ ID NO: 93800 - DNA, 183 bp, Glycine max
  Peptide Sequence Number=SeqID_210578
atggaggctcggtgtgcaaagaaggaggaaggggaggtatgcatgcaatcgggtgacagaaacccgagtaagcctaagcctttggtgattcacttcatcagggacattaccactcagaggccccgaggcttccaaccctttacaacaaagacacctgcacccttcccttatgtcataccttaa

SEQ ID NO: 93801 - DNA, 228 bp, Glycine max
  Peptide Sequence Number=SeqID_210579
atgtgggggtgcgaaaaggccaaaatagatgggccaaagcgtttgtctccaagggagaaaatgagcggagtcaccaccaacgtctattcgagggaaaacgctagaaaacccaaaaaggggtcaacgggttttgaaaatgaggcttcgggagttttttatgcatggggaagggtgttgcccttgctcctacgtatcctcaggtgcgatgaggaattcagacctacgtag

SEQ ID NO: 93802 - DNA, 300 bp, Glycine max
  Peptide Sequence Number=SeqID_210580
atggggttgaaccaagaacatgcttttaaggaaaggatcatcaagtcaagaggaggtgcaagagcagatgaaggccgacatggaggccatgaaagagcaaatggccacaatgatagaagccatgatgagtatgaaaaaatgatggaggtcaatgtggctacagttgttgccgcaagaaaagagttgggaagtgcaggcggcccccattttgtgcaagttcagaacaagcattccttcccaccatatggcttgcctcccaactatacaccacccaatgttgcacccgctcccgatgagaat

SEQ ID NO: 93803 - DNA, 204 bp, Glycine max
  Peptide Sequence Number=SeqID_210581
atggggtcggaccaagcgtcatcatttaaaaagaggttatatcatgtcaaagtcaagaatctagagctagtcagcatgcgaaaactagggcagcggatggatcaagttcggcgtcaagccttcagcaaggtatatgggaagatctgggatctggaaatgatagaagtgttcgttgaagccatcacatctcttactcaatattaa

SEQ ID NO: 93804 - DNA, 266 bp, Glycine max
  Peptide Sequence Number=SeqID_210582
atgagtaaggtggtgggcggagataccttatggtcatctgcgcctttcatcgaccgaggggaacgaattcggaagtatcaggatgatgttggtcattcggcgattgggtgcaatggcaaaggttccgctgggaccatctgtttggtgggatgtgaccttcgcatgaccgcttcgaggaacttgacacccatcgttaggcaatccgtgaagttccgcgacatgtcgggagtcgaaaggaagcattattgcgcaatccataaagttcc

SEQ ID NO: 93805 - DNA, 456 bp, Glycine max
  Peptide Sequence Number=SeqID_210583
atggagcaagagttagatccctctgttccttgttgtcagcatctgctttctgcaatcttagcgatggaaccttccgagtgcttaatctcccacgccagggcgtgtggcggaggctctatcaccgaccaagttcaacaattcatctcggatcattgcctttccactcctggtgattttcatgctccttacttgaagacttttctcaagaaactcatcactcaagttgagttcgaccgtggctgtgtgttggaccacttgtacgaactctatgctcactacatctcttcgttcaaggatgatagtttagggaagagagatggcagaatctgcaaaaggatttcgtttctctttccggatggttgttctgaactcctaagttttccgcactcgagggtgctggtcttttcgttgcagtgttctctgaacatgcttgaaggtgatactgggtatgctcat

SEQ ID NO: 93806 - DNA, 804 bp, Glycine max
  Peptide Sequence Number=SeqID_210584
atgaggtccggaaaactaattctagtggacttggctgggtcagagaaagtggaggaaacaggtgctgaaggaagagttctggaggaagctaagaccattaacaaatccttgtctgctctgggaaatgtaataaattctattacgtgtggtttgcaaggaaaagcaagccatatcccttatcgtgattccaagctcactcgaattcttcaggatgaacttgttagtccaccctcccccttttatagtctatcaaataatacccattgttcaccaaatctgtatcccaaacgtggtactatttcttattcgcaggaggaaatgctagaactgcattactctgttgttgctcaccctgcgcttttaatgcatccgagagtctgtccactcttcgtttcggtgtccccatccatgaaagcatttgattatttgagggcgaaacatacaaaggcgttgcctcgtttgagggagaaattgaatgttgaagatgtgatgttacaagaggaattgctgatacaagaaggcattctctttgatccttcatcagtagaagaggagtcagacatagaagacctcaccttacaggcgatatcctcactacaagccgccatggaaaagcttacagctactgttgatgagcttaaaggggagaatagcattctcaaggccaaagttgatgcctccatggaatctctgttctacaagggagcagagaatagatcgatttttcaaaatatggtttcagatgtctgtcttctgaaacgtctccaatggattcaaccagatcatgatttaattccaccatga

SEQ ID NO: 93807 - DNA, 363 bp, Glycine max
  Peptide Sequence Number=SeqID_210585
atggctctccttgctccttttttgcatcttcttccttccatcttgcattttggtgctacccatggaattgtgttggcaaccgatgagaagtataatgaagccatttttagcacagccaataggctagttgctgccattgatggacttcctgatcctggttggcccaaatttaaagacaataaacgcgagtctaactttaaatctagggaagagacagatgagaagtgtgggcaattcactcttgtagttggaggtttgttggtcattgcctttgttgttcctatggcacaatactatgcttatgtatccaaaaattataaccaatgtcatgttacacttgggctcgagaaagttgtagaataa

SEQ ID NO: 93808 - DNA, 114 bp, Glycine max
  Peptide Sequence Number=SeqID_210586
atgtgggcagtgacaaaaagaggttatggagatttattactaaggaaatcgatgatgagacggccatcagagtatctccccgatggtttttggaagtggaaggtaaaaatataa

SEQ ID NO: 93809 - DNA, 511 bp, Glycine max
  Peptide Sequence Number=SeqID_210587
tttgggtgctgatgtgatatatgatccagtttgcctgccacatcttgttagagtacttgccatgcttttgaatcagacgaatttgggctcttgcagacagcatgcaagctgcaagggccactctccaaacattgaacatgagaatggtgaacataatcatgaatatgctattgacaaatctgatggtggatgcaaagcaatttataatgatggtagtagtagcctgtcaaaggaagcaccggtggcttatattgcatatgttatccggaatattgaaactttcaactattttctctccctagggaaacaggctaaccttgatattgtggaccttactgattcattgaagccggctaggaatctagctcctagtttctgccaatctctcgttagggaaatcaaagttttcttgaagaagaatgatgggatgatatatgtccatcatgcccctgctgacttcatggctaagttggatcttcaagggggtgcatcagatttctctacatcatga

SEQ ID NO: 93810 - DNA, 258 bp, Glycine max
  Peptide Sequence Number=SeqID_210588
atgaactacgtaataccggtggaagagaaactcataagcagattccttcaccggcctgtcggcgaaatcggggctgttgagaatctccttcgcggtttcttgttcgctcgagataacgaactaggcccaagtaagcccaccgagagtgaagaacatcgtgaacaagagggtaaagagaaggacgcagagggtgacttggaaagtgatgatagtggactccatgagttccgggaagaacaaaagtgtgaaatcttgtga

SEQ ID NO: 93811 - DNA, 1473 bp, Glycine max
  Peptide Sequence Number=SeqID_210589
atgtcaccagatttcacacttttgttctccccggaactcatgcagtcccctatcatcactttccaagccactttctgtgtccttctcttcaccctcatgttcacgccgttcttcactcctggtgggcttccttgggcctgggcccggcccagaaccatcatccctggcccagtaactgccctgctcggggtcttcacgggttccacacctcacagcgctttatccaaactggcccgcacttatcacgcggaaaagctcatggctttctccatcggtttaacccggttcgttatctccagcgaaccggaaaccgcaaaggagattctcggcagccccggttttgcggacaggccggtgaaggaatccgcctatgagcttctcttccaccgtgcaatgggtttcgcaccgtacggagagtactggagaaacctgaggagaatctcagccctacatctcttctccccgaagagaatcaccagctctgagtccttcaggagcaaggttgggttaaaaatggttgaacaagttaagaaaaccatgagtgagaaccaacacgtcgaggttaagaaaattctacactttagttcgttgaacaatgtgatgatgacggtgtttggtaagtgttatgagttttacgagggtgagggtttggagcttgagggtttgggggtgaggaagaggtgtaggtgtttggttgaaaaggttaatgtttttgttggaggggttattaaggagcatagggtgaagagggagaggggtgactgtgtgaaggatgaaggagctgaggattttgttgatgttttgcttgatttggagaaggaaaacaggctcagtgaagctgacatgattgctgttctttgggaaatgatattcaggggaactgacacggtagcaattctgctagagtggattctggctcgcatggttctccaccctgaaatccaagcaaaggcacagcgcgaaatagacttcgtttgcggatcctccaggctcgtatccgaagcagacattccgaacctgcgctaccttcagtgcatagtaaaagaaaccctccgtgtgcacccaccaggcccgctactctcgtgggctcgccttgctgtgcacgacgttacggttggcggcaagcacgtgattcccaagggcaccaccgcgatggtgaacatgtgggccataacccacgacgagagggtgtgggccgagcccgagaagtttaggcccgagcggtttgtggaagaggatgtgagcataatggggtctgatttgaggttggcacctttcgggtctggaagaagagtgtgtcctgggaaggcccttggtttggcctcggttcatctttggctcgctcagttgcttcaaaattttcattgggtttcatctgatggtgtttctgtggaattggatgagtttctcaagctttctatggagatgaagaagccactgtcttgcaaggctgtgcctagggtttctgtttag

SEQ ID NO: 93812 - DNA, 477 bp, Glycine max
  Peptide Sequence Number=SeqID_210590
atgatgacaacgataataatacatatatataacactaatggtggtggtgacgacggcatgccgatgctaacaatggtcatgaatggtggttgtggtggtgaagatgacaatggtgaaatggtggcttgcgacaacaacaatggtgtgcaacatctgagccaatttgttgctgctctcacctcagctcatcaacaagatgttgttcgaattcttagagtagactttcataaacctgtcactctgtattgtgacgataaatatgatcttcacataacttcgaatcccgtgtttcatgaaagaataaagcatattaagattgactgccacatagttcgagagaaggtgttaaggggtcttgtgaagttgctttccattccttctacaaatcaattagctgatgtttacactaaagctccaatgtctggtgcttttaaatttatgcattccaaactaggaatgtctgatattcattcctag

SEQ ID NO: 93813 - DNA, 561 bp, Glycine max
  Peptide Sequence Number=SeqID_210591
gctactctacgtggtctctgtaatgatttggagattccttttcaacctggaatgctcaagtgggaagcaggtccaaagtcaatagacggcttgtgggccccttggtggtataagtctgtacataaatctactggttttgagaaaccaagaaagtatccccagccatttcctttttctctctatgatttgttggagcaaagtctacccctgtataatatgcttcgacgccatgtgaagaaaaagtcatctcttctgagccctcctttacctaatcctgatcttcctgttcctgcaaacgggaaattgcttgcttgggttggtgatgagattctgccacgtgatagtgcaaaggtgattaattgtatgacacttaaaagtctgctgtatgctgttgatagagcaaagcttcagagttatacagattctcatgttgtccaaggaggtgactcagtttgggaaggacttcgagtgtataatggaaagatatttaagcttgaggagcatctagacaggatttacttctcttttcctatagagcatccttaccttttaaaatcatga

SEQ ID NO: 93814 - DNA, 348 bp, Glycine max
  Peptide Sequence Number=SeqID_210592
atgaagtcatcccagaggggatcagcatattcgtggacagtcccagtggaagatgttctggattgttgcaaagggtttacttcaaataatctttgtagcatatgtggatctcatgcagaaactactgaggtgcatttgctgagggattgttcctttgctactaagctttggaattatctcactaaggggagattgcctcgtgacttcttctcagaaattggatgggcaactccggaggaaggttgggttaaagggatgggtcaattagaatgggtggttactaagtctcatgtggggaagttttcagaaatgagaatgatttatgaattaggtagagttccgaactaa

SEQ ID NO: 93815 - DNA, 942 bp, Glycine max
  Peptide Sequence Number=SeqID_210593
atggcactagaagcagtagtatatccccaacctcaagacccgtttggctacggaatcaaagacccttcttacaactacaacaacttgttagaaggtggtggaggcaactggggctttgaaaaagaagagcaaggttttgtcacttttctggagaaccaaacagagaattatccttatggagaatggaactgttctccttctccaccatccatgttgcctcacttgaatgcatcaaatcctcagtcttcagaaaccagcaacatacataacaacttagatagttcaatttccacccctgctcgtcccaaaaggcgcagaaccaaaagcaggaagaataaggaagagattgagaaccagagaatgactcacattgctgtagagcgcaacagaaggaagcaaatgaacgagtatctctctgttcttcgctctctaatgcctgaatcttacgtccaaaggggtgatcaagcatctataattgggggtgctatcaactttgttaaggagctggagcagaggctgcaatttcttggtggtcagaaagagaaagaggagaaatctgatgtgcccttttctgagttcttctcctttccacagtactcaacaagtgccggtgggggctgcgacaattctacagccatgagtgagcaaaagtgtgaggctcagtctggcattgctgacatagaagtgacaatggtagagagccatgcaaatctcaaaataagatccaagaaacggccaaagcagctcttgaaaatagtctctagtttgcatggcatgcgtctcacaatcttgcacctaaatgttaccaccacaggggaaattgtcctctattctcttagtgttaaggtggaagaagattgcaagctgggatcagtggatgagatagctgcagcagtgtaccaaatgctggataggattcaacaagagtcaatcttgaattaa

SEQ ID NO: 93816 - DNA, 2822 bp, Glycine max
  Peptide Sequence Number=SeqID_210594
atgtcttcattcttgtttgatactgccatcggcatgagtggcattgattctggggccttggttgagctacccatgatggactgggaggtcatttctattggcagttccttgtcgcaagatactcaccgtggtgcctctgacagtgagtcctcttctccagagagggtgagggttttatgtcgtattggtgggggcacttctcgccctcgcgggatagtgcgaccttccactacttctagggagcctatcctggttattgtgatcctccctccttctacttttgggggagtgaagagaggttgtggcaatggagatgtgcgggatgatgttttgaaatacaagtcctctctcacctctacaacgagttttgctgctcttcaacgccaggtgaagctagaaatccctgaggactcttgcaagttagccgttcaggcttacgagagtgatgacttccctttcttgagggcaacatcgggtcttattctctctttgactgctttccaatgtgctctacttgagcacttgaatgtagctccttctcagctccaaccaaacaattgggcaatggtgagggcctttgaaattctttaccatttcttcaacatttggcctagtgtgccggttttcttgtttttctttcaaatgaagctgaccggcaagattaattgggtctccttgatcaatgtgtccaataagctatttgagtttgactcaaacgtcttttgtcgctttaaggaccgtttctttaaggtcttggctactggtgtcgtagctgatggtctgccactgatgattaataaggacggggagccttacttcctgttttaccagaagtatgaacctaccaggttcaagtcatttgatgaggatctattgacctttgcggtaagggtcgacaaagctattttggagccgaaactaacacttgcttgtgctgttgttgcttattttgcaggaattatgggtgacttcacctggaggtcactcatgaagcaagtcagacctgcgggtgagactgtgccaccatctactactgctcttgttgttggagaaggggtcacccctggtgcctcttcctttgttttgccaaagaggaaatgggatgatggttctgggtcatttggctgtaaaaagtcaaaatcccctatgagccttcgtgccctgagacaagttgcagggttaacacccgatgtaggtcgcccttcagtcgtgcaggatgtgtctttggctccagcaaccgtcgaggctcctactgctattgtttctactcatgttactcatgctccttcacctcctgctgatgtacctattcaggaagtcattcctgttgttgctgttaatgtgccagccactttggctgctgaagttgccaaatggaaggtgactgcttgcactgtctggatagtaaagcgtcctaaggtagctaacgccaccatagccttcgctgaggtcgtaaggtcgaatcgccaactatcttccaaagtttttagtgtgttggccaagttgttgtgcctaaggttggacggtgatcaactgttcgcacgctgcaagagtttgcaggaagagaagaaggacttggccaaaaaggtggaaggtattgcagcagagaggaatgagcttgcgaaggtggttgctaatttagaggcctggcttaaggagtcggagtccaagctagaggactctgagctgtgggctgctagggaaagggaagctaacaaggaggttgaggaagagctgctcgtttacaagaagaaggctatgaagcagcatgaaaggggcttcaaaaagaccgttaggcaggctgggttatttgccaaggacttagcattgggtctctttgaccctttcaaggatatgaaggatggtgttttccttgacaaggaggaaattgctacgaaggaggaggctgccttgaagcaagaccttgtcgatgtagaggaagaactgtggtggtgttgtaaaaggtggatgacacgaaataatctcaggtttgagttcaacctggttaaaggtcttgtcacccatctattgaggcttgcttctgctttgtggagcttctcccctaatgcttataaggagagtaagtatgagttgcacctgattgaaggtcttgtcactcaatttggtgataggagtatgtaccaagggcggaccatgggttttggaggagtgcgtaccaaggttcctgtggagatggaacttagtaacagaaagctcaccaagggtgaaccttggcgcatgttctgtgcttttgcaaacatgtcacttgccatgggtgccatgactcgccaagggcggaccatgggttttatgagcctttttggaggatcaaccaaaaaattgtttgtcctgggttttgtacgtcgtgctcttgcatatatgtcgctcgtcatgggtggcactcatagtagtgtgtttgtgcctacatgtcactcgctgtgggtggcatgtactggagacttaatgctagaaggagggctcactaagggtagtccttcggttttaagagtcgtagagctacaactatggatgttcttgcttgataagagaaatgtgaaaaggaagaggcttgttgtgactctgaatgggccttcccagttagggtcgagctttcccgctcggggatcttttctggcttctcctcagactcaccattctagtttggcagcttcttccttgatcctcaccgtttctaggacttcgtctgtagtttcaagttctaccctcatactttcttcatgttgtggctggaacaataatctcctagtcgacgattccctgacttcaatggggatcatggtgtctgtgtcatatgtgatccg

SEQ ID NO: 93817 - DNA, 360 bp, Glycine max
  Peptide Sequence Number=SeqID_210595
atgtgggaggaaagcatctgtggcaatgataagaaagcagtgtaccagcatattgtcaagtcggattttgacatcaatgccatcggttggcaagcatcgtctggtatgtcttcttattccagaagtctaaactccagcaaaaattttggtgttggaaaaccagtcgggcaccactacatacattattgtattactaaagggaagaccgcagctgcaaaagtgcttatcatgagaatgccaaacatttacaggggagacaatacatatgtcacagataaagaaggcaaaattcctgttaagcttgcatcagaatctggctgtgttgataatgaaattatcgctctcttgacaagcagatga

SEQ ID NO: 93818 - DNA, 282 bp, Glycine max
  Peptide Sequence Number=SeqID_210596
atggcgatcttttctcaacacaatacttctgtagaccacactacctctgctaacattgagagaagcacaccactgccaacacccattgtattaacaacaacctcaaacaaaggcattgagctaattctcattgaaggacatgaagaagagtacaagaaagatgaatatcctataatccacaaagaaaccattaggagtgatttcttgaaagagaggagtgggatttttagggcctcccccccaaaggataggaaagttttattagttggcttgcttgtgtag

SEQ ID NO: 93819 - DNA, 258 bp, Glycine max
  Peptide Sequence Number=SeqID_210597
atgtctgaaattcaacttaggagaacgggggagccaaggatagaaaaatctggaccacttcgtcatagagaccttgatatcacgtcaaaaactagttcttccaaaagctggagtttaagcaaatcaaatatgctgcagagttggccatattggatgcccaactttcaacttccaataaaagtcaataccatagagaaacaaatagagggagctcagtttttctcaccattttctagcgtagttgaaaaggcatcttga

SEQ ID NO: 93820 - DNA, 528 bp, Glycine max
  Peptide Sequence Number=SeqID_210598
atggtactgagtgtcaactcacgaggtgttagggctttcacagcagaggctcacaaggtggtagtttggtttggaaaatccggttgctcatatgaaacctatgcaacctcaacaaaagttgcggatgaaggatcggtttccaaggccagggaaaatttaaacaagcatgttcaagtggcaaacaaacattcatatggccaaattcatagggatagatatcatcagtcctccaattctatcatgagaagctacaaagataagacaggtgaggatggaagtaaccagcacagaagatcattctcagtcagcatcaaactactttcggcgaacaagtcatcatcatcaacttcatctgtgtctggctcaactttattttcattttcaaacaaatcatatggatgccaagcgcgacagctatttgaaaaggtgcagcagtgcaaattcagagatagaaaattcaatccagggagcaattgcacactgcaagaagtgtcaggaaatgttttcttcaaagaagactgcaagtga

SEQ ID NO: 93821 - DNA, 276 bp, Glycine max
  Peptide Sequence Number=SeqID_210599
atgacaacgatatcatatttgtgttcctctcccggtttgcatttctatatcgtgatcttggtggaagagcacaccaaagctgtcatttttatctcaaaactctgtgagtgcagagaagagaaggtggaagaagacactaaagctatgatttttatctacaaaaagcttcgatttttatctcaaacagttgtagtaatggcaggaattcttgatagaaaatcagctgactccagtgatagggtagctgataatcaagaagcagcaaaattggagtga

SEQ ID NO: 93822 - DNA, 1236 bp, Glycine max
  Peptide Sequence Number=SeqID_210600
atggagaaaaggcagcttccaaatggcccaaatgcacgtcaacgcatatatttgattggtaggttgcggaaagcagtaaaatgggctactttgttttcactattgtgtgcggtcaaagcagattctagaacatctttagaagctgaggtagtaaacctagaaaaaaaagcttatgaatcctatatgaaagggagcttgttgtttgagcaagatcagaattgggatgtggctttaaagaacttcaaaagtgctagcataccagcttttgggatgtttatgtttttcttgctcaccctgcttgagtttttaaccatgtccttatttaatagggctgtatacgaggaattagggaaatatggagatttggataaccaagttttgtgtcgtgagcgagttgaggaactagaacctagtatccgatactgccttcacaaaattggtcagtcaaatttacaggcctctgaacttttacaaatcggtgatgtggaaggtcctgcgttagacctttttaaagctaaattagaggctgccatggctgaggcaagatctcaacaagctgcttccatgacagaattcatttggcttggccacagatttccaatatcaaatgccaaaacaagggtttccattctgaaatcccaggagctggagaaagatgtacatggtcccttggcagactcaattccggcagacaaaagacttgttatttttgacaaaatcttttctgcatatcatgaggccagaggctatattcgggctgatttggccactacaggaagtacagaaagcgtgaaagatgatttgaatggtcttgataaggctgtcagtgctgtcctaggagaaagaaccattgagcgcaacctcttgttggttaaggttgcaaaaagcaaactggcaaatcgtcatgatgataaaaatgaaaaactcaccaaacctgaagagcttgttcgcttatatgatctcttgctacagaatacagctgatctatctgatttagtcaattctggaagggataaaaagccagaagaagttagctttgctgaagtgtgttcatacaaaagtttggcttttcgagcccaaagtctatgtgggatctcaactcaacacacccacctcatgtctaggattgaacattttgagtgtggagattgcaggcctcatttttttatgtatatatattacactgggaaactctccggagatccatggagcaaagttcatttttcgacaacttag

SEQ ID NO: 93823 - DNA, 231 bp, Glycine max
  Peptide Sequence Number=SeqID_210601
atgggagcttctggtctaatgggctgggttgtcccagacgacacatcctgggaggactgggaccagcttcgttctgactatcaccttgaggacaaggtgtttctgcaagtgacaggaaatgatagcaatttaggggtgcagtcagaagtcaaccaacaggaggtgcatatagtaagaagcaagctcaaaagaaacaacaatacaccagcttacctgaaggattttatttga

SEQ ID NO: 93824 - DNA, 453 bp, Glycine max
  Peptide Sequence Number=SeqID_210602
atggaggtccacgaggaagggaatgtgctggatggtgatggtaacagcctgacaaaggaggtcgcactgaaggtgttggcaattttcgagcatgatgcgcaacgggaaagtgaggtgctggtgactatcgacaagggccgcggggggaggggggcatgggcgcggctcccggaacaagcctccaccagcttctcctcttgcagcttcgccaagcccgccgcctgcaccaacataaggggctggtgggcttggacctccctgcgtatctccggcgtccaccccaagataaagcagctcaagaggaacgacggagagggcactggtgggatcctcgtattgagacagggcgaaccgagtcaacaacgcctgaaggaagactggccaggagatgaactgaccattactggtcatccactggaacccagccagggcgtgcccctccatgtaaaataa

SEQ ID NO: 93825 - DNA, 1070 bp, Glycine max
  Peptide Sequence Number=SeqID_210603
atgacattctttcacatagggcacctagttgagtttcaaggaacgactgaccctgcttctgttatcctcacccttccccagggagcgagtgcgtgttttcacattgccatcaccccttcggagttaccttcaaatgattatgaggaaccttccttcccgccccaagttcaacacctcctgacccaattcaccaccctcttcgaggaaccacactccctgcccccctctcgactaactgatcaccatattcatctccaccccaactcaggccctgttaatgtccagccctatcgatatccacactatcagaagctggaaattgaatcgcaggtggcctctatgttacagaacaaaatcattcaacccagtacaagcccgttttcgtctccagtccttctagtacggaagcacgatggctcttggcatttctacgtagattatcgtgccttaaactccataatgatcaaggatttttttccgatacccacaatagatgagctactggacgagttgggtggtgccaaccacgatcttggggatgaaggggacgcattcgaaattaacccagaagttttatggtccatttccaattgtggaaaagattgggccgctccgaccggtggggtagctgcctctgcccgagaccgccgtagacaatcaacccttggtgacaccactgaccatattggattcacgacgtgtgatggactcccttccatccaaatgggaggttctggtccaatgggtctagagacggagatggttaaaattttgacaatctttacatctattgatttctcatccaaccattttgaaggacctataccagaggatttaatggatttcaaaacactacatgtcctcaacttgtcaaacaatgctttgtctggtgaaatcccatcatcgataggtaacctaaatcaattggagtccttagacctttcacaaaactctttgagtggagaaattcctatgtcacttgcaagcaatgacaagctatatgatcttccattgattgaaaaaatagatgggaaagagtcaggggtgctaccacaacaagaatgtgaaat

SEQ ID NO: 93826 - DNA, 366 bp, Glycine max
  Peptide Sequence Number=SeqID_210604
atggaagggagtccatcacacgtcgtgaatccaatatggtcagtggcgtcaccaggggttgattgtctatggcggtctcgggcagaggcagttgtgcctcactggtcggagctccgtgaaatggtatcagtaaagaacagtgaaagatgggatgaattcttgcccctgcagggcctgagttggggtggagatgaatatggtgataagttggtcaagaggggggcagggagtgtggttcctcgaagagggtggcgaattgggtcaggaggtgttgaacttggggcgggaaggaaggttcctcataatcatttaaagggtcttcagccactgcatacccaggacaatgttgacaccgtacaaaggtag

SEQ ID NO: 93827 - DNA, 309 bp, Glycine max
  Peptide Sequence Number=SeqID_210605
atgggttacacattgaacccaacgtttttcaaacacacccaaattggcattcagagggaacctatattccaggagggaatgggatacaagagaaagcggttatcatcggacattagtgaggacagcacagatttcaacaacattaccaaactactaaggaggaacagtgacatactaaaagctcatattgggactcagaacataaattaccaattggccagggaccagcagaagcagcaaactgatattatagttgcagcccttggcaagctcacagatgctcttacaaaaattgctgacaagctataa

SEQ ID NO: 93828 - DNA, 363 bp, Glycine max
  Peptide Sequence Number=SeqID_210606
atggtggtagaccaacaatacgattcgcaagatcttcgaactcggaaagagggcaccggtgggatcctcgtactgagacggggcaaaccgagtatgcaatgcctaaaggcagactgcccaggaggtgaaatgaccattactggtcatccactggaacccggccagggcgtgcccattcatgtaaaaagaggtgatcgacaggcggtccttcccgggtgtggcattgtaatcaaagaactggttgatcttgaagattcaactagtgggttcaattccatcaaaccgaggaacatcgagtttcaagcagtacaggttggaggtagggataggagaaagggtgttggaattggatggaaatggtga

SEQ ID NO: 93829 - DNA, 354 bp, Glycine max
  Peptide Sequence Number=SeqID_210607
atggttccttatcagataccttctacctatcactcccagccccatcaaaaacaccttgtcctcaaggtgttgggcttcaacgcatggcttcaaaaagtgataccgggatcccaaggacacgaaggtgcagttggcatgggaagcggaggtagcatggacggcggaggtggcatgggcgacggagtcggcatgggtgacggagtcggcatgggcgacggaggtagcatgggcggcggagtcgacatgagcggaaaagtcagcatgaaccacagagttgacatgagtgaagtcgatatgatggcggccggtgcctacacagggacggaagatgaaaattgtggagtggggttatga

SEQ ID NO: 93830 - DNA, 207 bp, Glycine max
  Peptide Sequence Number=SeqID_210608
atgttgagtggactgaaatctaggaatgctgtgattgatgaatggacaaagttgagatggaaaaccattcaagatggcttgggaatgttcgatgaatggatgatgacctatataggtcctggtaaatgtggaattgttgaatatgcccctataaaaagagatgatgagacaaaaaaagacatggtggaagactatttagaaggatga

SEQ ID NO: 93831 - DNA, 855 bp, Glycine max
  Peptide Sequence Number=SeqID_210609
atgactcagtgcagtgactctgaaaacaatcatcataacatcatagtggagggacgaaaagatagcttaattagaacttgtcctacgtgtggtcatcatatcaaatgccaagatcagggtggtggaattcatgacttacctggactgcctgctggagtgaagtttgatcccacggatcaagagattcttgaacatttagaagcgaaggtgcgatctgatattcataagcttcatccgctaattgatgagttcattccaactcttgaaggcgaaaatggaatctgctatactcatccagagaagttgccaggagttagcaaagatggcctgatccgccatttctttcaccggccttccaaggcatacactacaggaacaaggaagcggagaaaggtgcactcagatgaggatggaagtgagacacgttggcacaaaacaggtaaaactaggccagtttacaacaatgccaagttgaaagggtacaagaaaatccttgtgctttacacaaactatggaaagcaaagaaagccagagaaaacaaattgggtcatgcaccaataccaccttgggagtgatgaagaggaaaaagaaggggagttagtggtctccaaggttttctaccaaacacagccaagacaatgtggttcccttatgaaagactcatcagttcctgggaaacatatgaagggtcaaagtgtccatgaggtaatgaataacaaaaacaacaataatgggtatgttgggtactatcattcaaatttcatatcatttgaacaaggagggcaacatagacctagtaatgctcaagtgatttcccatatccccttccatgaaggtgcccctttcattccttga

SEQ ID NO: 93832 - DNA, 543 bp, Glycine max
  Peptide Sequence Number=SeqID_210610
atgttatctcttgcccagctggatgccaaggaatttgatgagaaagcttctgaggctgaaattgaagccaaaattctaaggcaagaactaggccagttggaagctcagaaggatgttggttttctaatatacaagcagtgtgttgaaaatatttcagttttggaggccaagataacccttgttgaggagaattccaggatgttaattaaagcactgagaaaaaatcttgctgagctgaatggagagaaagaatctttagctgtcctttaccatcaatgcttggagaatgaaattttgcttgcacaacaaaattctgagaaactaaatagagaaattgagaaaggggctgaaaaacttaagactgctgaagaacattgtcatacgttggagaaatcaaatcaatctcttcggctagaggctgaaaatctactgcaaaggatagctatgaaggatcaagcacttttagagaagaccactgatttacctcacaatataaaaatgatagcacgcatcctcatctccataaaagctaagagaaagtaa

SEQ ID NO: 93833 - DNA, 132 bp, Glycine max
  Peptide Sequence Number=SeqID_210611
atggttgtaggcgtacattatcttttgccatatagcaaaagcaaacgtgattttgtgtcaagagttgttgagttccgatcaaattatgcccaatttggtgaccctcgtaaggtttgctttccatggaattaa

SEQ ID NO: 93834 - DNA, 225 bp, Glycine max
  Peptide Sequence Number=SeqID_210612
atgacatgtttcactgttgcaaatgcttcttgctgcccatcatcgaggacaaacgggttatgtattcctaatcaaacaccatgcgagaatagaaccacatacgtcttttgggatcaatttcatcccactgaggctgccaaccgaatcattgcaataaattcatataatggttctgatccagcactcacttacccaatggatatcaagcaccttgttcagacctga

SEQ ID NO: 93835 - DNA, 876 bp, Glycine max
  Peptide Sequence Number=SeqID_210613
atgatgagcattaacgatgacggcgtttatctgatcgacggcacgcgcacggcgattggcgcctatggcggcagcctggcgcatacccgccccgacgacatggcggcaacgatcattcgcagtctgctgcagcgcaatccggcggcggaagcgaagctggacgaagtggtgctgggctgcgccaaccaggccggcgaggacaaccgcaacgtcgcccgcatggcggcgctgctttccgggctggatccgtcggtgccggccatcaccctcaaccgcctttgcgcctctgggttggatgcggtgatctacgccgcggcgaaaatccgcagcggccttagcgaactgattctggccggcggcgtggaaagcatgagccgcgcgccctatgtgctgagcaagggcgacacgccgttcgacaagggggtgaagctgtacgacaccacgctgggatggcgctttgttaacccgcggctggcggagcgctacggcagcgatccgctcggcatcacggcggaaaacgtggcccaacggcagcacatctcgcgcgaggagcaggatctgttcgcgctggcctcgcagcaaaaggcccgccgggcgatcgacagcggccggctggcgcgggaaatcacgcccgtggacgtgccggcggatcgcaagaccacgcgtacattcgcgcaggatgagttcccgcgcctcagcacgctgcagcagctgcaggcgctgaaaccggcgttctccgccggcggttcggtcaccgcgggcaacgcttccggcatcaacgacggcgccgccgcgctgctgctggcttccgggcgctacgtgaaacgccaagggtggcaaccgctggcggagatcggcgacagcgcggccgccggc

SEQ ID NO: 93836 - DNA, 648 bp, Glycine max
  Peptide Sequence Number=SeqID_210614
atggacggtgacttcgccccgctggcgcagatcgtggcgctggcggagcaatatcaggcgctgacctatctcgacgagatccactccgccggcgtctatggcgaacgggggctgggctacgccgaacagctgggcctgctggataaaatcaccattattcagggtgggttcggcaaatcttacggtgcggcgggcggttatatcgccgcgccccgctcggtggtggaggcggtgcgcagctgggctccggcattcgtcttcagcacctcgtcgccggcgccggtggtggccgccgcgctggccagttttaaatacaacctcgagcatgacacccagcgcaagcacctgctggcgatcgtcgatcacctgaaaaccggcctgcgctccgccggcatcccgctggtgtcggccgacagccatatcctgccgctgagggtcggcgatccgcaccgcaacaaacacatcagcaaagtgctgctcgatgagcatgatatttacgtgcaaccggtcaatgcgccgacggtgcccgcaggcagcgagcggctgcgggtgacgccgacctcggcgcactcccatgccgacgtggagacgttcctggccgcgctggggcgggtctgggcggcgaacgatctgcggagggcgggatga

SEQ ID NO: 93837 - DNA, 255 bp, Glycine max
  Peptide Sequence Number=SeqID_210615
atggcattcttgggagagacaagcagtcagacagttgtgaactccacattaggtaatgaattttggtttcaatgtatgcaactgaaagatgatgttgatgttaacacaatgttaatgtgtaatcatgaattttcgtttattggtccgattgagttattatgtagcattgctagaacctcagatggtattttaaacttacttcaagccactatgacccctactcatgatgctctgctatattacaaagggaggtag

SEQ ID NO: 93838 - DNA, 389 bp, Glycine max
  Peptide Sequence Number=SeqID_210616
gaaattcattaatttcatggaaggcaaagaaacagaagacagttagtaaatcatcttcagaagcagaatatagagctttatcatctgtgtcaagtgagcttacttggctacgaaacgatttaaacatcaagacatcatttgcagttgtctactgtgacaacaaagcagtaatccacattgcaacaaaccccacatatcatgaaagaaccaagcacctagagatagatttgtactatgttagagaacaagttggcaaaggagcactaaagctgattcatgtcagaaaacatcatcaactagcaaatgttttcacaaagtctttgcctcgaagtacttttcttagcatcatctccaagctgggcatcgagaatatcttcctcccatcttga

SEQ ID NO: 93839 - DNA, 557 bp, Glycine max
  Peptide Sequence Number=SeqID_210617
atggcatctaagaaaaggaaggctccttctacacctacccaggccagatatgacagatctaggaaactactaccagagaagaatgtggtagtttattacaccgagtttgacgagttcaaggaggaactcaagagaagacattgggatgagaagttaattgattttgctaatagtagcataaacattactattgtgaaggaattttatgctaacctctatgaccccgaggataaatcacctaagcaggtgagggtgagaggtcacttagtgaaatttgatgaagatactctgaacacatttctgaagaccccaacaattttggaggagggggagaatttgtctacttattccaggtttgcactcctgaggcctgatcctcaggagttggctgctaagctttgtatcccagggaggggattcaagataaatgttgacgggcagccgttgaagatactgaggaagaacatgaccaccttagctcagacatggagtgttctttccttctctaacttgatacctacctcccacacatctaatgtgaccttggatagagccaa

SEQ ID NO: 93840 - DNA, 132 bp, Glycine max
  Peptide Sequence Number=SeqID_210618
atgcggaaattgattaaggaaaggattgaaaataaggtggttaatttcgtgggtcttaataaggttaagtggtggctggacagaaatatagaaatggcaataactgaagctacagggctccaaatgaggtga

SEQ ID NO: 93841 - DNA, 1165 bp, Glycine max
  Peptide Sequence Number=SeqID_210619
atgactgccaagaatccaacttctgcaggatctacaaccagccgaagtggtgcaccttattccatttcaattgaagcagtacgtgaatttaaaattacgaccaaccagtatgatgttacattgggaagaagtggaggaggtacggtgagtgctgtaacgaaatcaggaaccaatacctttacgggaagtgcctgggaatatctgagaacaggatggttatccagcaaatatgatatcaggggaaatgaaagggtgaacgacttttcaacctcacagttcggggttttaaatattgggagagctaaatatggtgtcggaaatactccgcaattcggaagctttgataaagtaaggaattctgatgccggattcctgcgtttagactggcagatcaaccctaaaaacttactaaccttaagaaataactttacttatgattttaataaaaacggattggcagataacacggccatcaatttttttgaatcttatggaaatgacaaaaaccttgataatagcttattattaacattaagatcaaatctgaaatcaaatctcaccaacgaattaaaagcacaatatttatatacttaccagaacagttatcagaacaatcagctggggcatgctgttccaagggcaattgtagaacgtgtaccgtctaccattgatggaaaggaccttacaaccaatatccagatcggcggacaccgtttcggacaggaaagctttagaaataatgtattccagatcgtagacaatttatactataatacagataagattaaatatacagcaggtatcgacctgatgtacacgaaatcaaaatctatttatggtagcgaggtgaacggaagatttcaattcttaggaattgataattttaataaccttacgccttacagattttacagagaggttcctttaatggatgatccttctgtaaaatcgaacatttggaatgttggcgtatatggtcagattcaaacaaaaattgctaaaggacttgacttaatggctggtttaaggctggattatggtggatatcctaaagccgagcttaatcaaaagctatatgatcaaatgggaatcagaaccgataaccgtattaaatcattcgttattcaacccagatttcactttgactggaatatcaatgaagaaa

SEQ ID NO: 93842 - DNA, 215 bp, Glycine max
  Peptide Sequence Number=SeqID_210620
gccaagcctatcccgcaaccactgttggcgggatcctctctcccaagcctatcccgcaaccactgttggcgggatcctctctcccctgtcccgcaaccactgttggcggtaccgctctctcctatcccgccatctccaagggcgggacacttctctctcctgttttaccccatcccgccattgctgctggcggcacccctccccctctctcctag

SEQ ID NO: 93843 - DNA, 918 bp, Glycine max
  Peptide Sequence Number=SeqID_210621
atgacgacaccccctccatctcccacacaggccgagattccttctgatgggacgtctaggaaaactagacaagccactcggctaagaaggttgacaacaagaacattggagcaagcaagggcaacagtcaatgtgaatccagcgactggtacaggatctggacctcataaggatcagtttcacagttaccttggagttgtggcacgagacaagattccaattgttcacgctagctggaatgatgtacctgaaacactgaagaacatgatatgggataacatattggcaaaattcgacatccccgagggtgataatgctaaaaagaaggtgatgtcaactgtggcaacgcgttggaggcaatttaagttggcgttgacaacaaaatatgtgtatggtaacactgacggccaagcaaaagatgagcctttggttaaatatggcattaatgaaaaagattgggccgagtttgcaaaaatgaggcaaacccctacctggcaggactctttggaagagcaaagcaggcagggcagcattgtgccttcgggacgtgatgatattttgaacatggctattggaagaccggagcatcctggtcgtgtacgtggggctgggataggggttacaattatgcagtactttggtccagcatcgcgtcggtctaccacttcatcaaacatcactgtagaacagttggctgatataattggtaacctaaaagaagaatggcaaagacaggttgaacaagaaaacattaaaagagaggaggtgtggatgaggagggtagaagaggaaaaacagcgcactatggacacatttaaaggacaaatacaagaagctatcaagttggagttgtcacaaattgcatcacaacattcagccccacttcagccaaatgatatacaagtattagcagcaagg

SEQ ID NO: 93844 - DNA, 615 bp, Glycine max
  Peptide Sequence Number=SeqID_210622
atgaatgatgctagcctggatcaaaatccaaatctatgtgaatctgatccatgcatccagcagacaaataacaagcagccagatggtgatcaacagaagaacaaaaataatatagttatcccggtagtatcatcagttgctggggttttggtgctcctaataattgtagcagcagctataatctgtggccttaaaaggaaaaaaccacaagcatctgatgtgaacatttatgttgagaccaacactccaaatggatcacaatttgcatccaagcaacggcaatatacattcaatgagcttgttaagatcaccaacgactttaccagaattcttggtagaggtggatttggaaaagtttatcatggatttattgatgacactcaagtagctgtaaagatgctttctccgtcagcagttaaacttctgatgagagttcatcatagaaatctgacttctcttgttgggtattgcaatgaagaaaacaacatagggctcatctatgaatatatggcaaatggaaacttggatgaaattgtttcaggaaaaagtagtagggcaaagttcttgacatgggaagacagactccaaatagcattggatgcagcccaaggttag

SEQ ID NO: 93845 - DNA, 792 bp, Glycine max
  Peptide Sequence Number=SeqID_210623
atggcacaagattcagagaaaatatgtgaaggtgcttcggagtctgcaatcaccccagtgattggaacacaagcaccagagagtgaaccaaaaagcactccaacaactcaaagaatcaaagccacaaggcaccctcggtggacaagacaagaaacacttgttctcatagagtccaagaaaatggtagaaagtggagaacaagtttgtcgattcagatcagcatcagggtacgttcaaactgatccgaaatgggacatggtgtcgtcgctgtgtcagcagagaggtgtgaagagaggggctgttcagtgcaggaaaagatggggcaatcttctcactgatttcaggaagatcaagaagtgggaatcaagtgtaagagaggagagtgaatcgttttggataatgagaaatgatgtgaggaaggagaagaagttgccggggttctttgattctgtggtgtacaatgtgttggatggaggggtgtgcaccactgttgcatttcccttgacactcgttaagatggcgccaaataaagtggagattcttgatggtgagaaaatgggatggagcactgaggaggaaaacatggagactaacatcactggaaatatgatcaatggttttccgaaaacaccaaaaaaagggagtctcaaaaggacacccatactcacactgcctactccagagaaagtacagcagcagccatcttaccaagggaactacgatcctggtaaatcaaatcaactcacttttgctgtgcacatactatgtgttggttactatcctgtccattga

SEQ ID NO: 93846 - DNA, 1371 bp, Glycine max
  Peptide Sequence Number=SeqID_210624
atgagtaaacaagacttcttgaaagttcagagctgtgttctcaaggttaatatccactgcgatggttgtgagcaaaaagtcaagaaactgctgcagaaaatcgatggggtttattctgtgagaatagatgcagatgaagggaaagtggtagtggcaggagatgtggatccagcgaaactggtaaaaaagctaaagaggggagggaagcatgctgagatatggcagaaccagaaaggagaaatgatgtacaatcacaagtatcccatcaaccagaacatgatgcaacttgggggaaaggacaataataagtctcaaaatcaaaagggtcagaaagagaaaggtgctggaggtgttggtcaactagcacacttcccaaacattaaagggattcaggatctcaaggtacctgccaaggaacaaaaatctgtcaagttcaacttgccagaggatgaatttgatgcctctgatgatggttttgatgaatatgacgacaattttgatgaatatgatgaggaaggattaagccatgggcatccattgaatcagaagaagatgatgccaatgatgggggatggccgtgggcctcatgggcctcctgctatgatgaatgggcctgccataaatcacaaccataaaggcaattctggtgggagtagtgtcaagaaagctgacgtcattgatcaggcaatgatgttcaagggcaaaggtggaaatttcaacgaggcctatggaggaaagaaaggtagtagtaaccaaaaagttgaaaagaagaagggagatgatcataagaaaaagaatggattactaggtcggtttctaggctttgggaaaaaaaagagcaagaagggagagttagaagaagcaactaataccaataatagcaagaatggaggcgaaaataagaaaggaaaggaagggaaaaaaggtgaaggtaaattggaggaccatgctaacaatgactttgactttcatgattatggtcacacccttactcatcccaaaaacaacgtcaaagaaggccagatgggcccaggcccaataatgggtcatcagatgaagaatattccatcagtgcaaggacttcctgcgatgaacgatgatggtgggtattatcaaggggtgcaaatgcagcatgctccatataataaccttcagcagcagcactacatgggtatgatgatgaaccagcagcagcatcaacatcagcaagcaaatctgaataacaacatgtacccaacatccatgatgtatggtaggtcacatccatctatgaactacatgccaccacctcctatgccatctcacccaatggccgatcctattactcataccttcagtgatgagaatgttgagagctgcagtatcatgtaa

SEQ ID NO: 93847 - DNA, 369 bp, Glycine max
  Peptide Sequence Number=SeqID_210625
atggcttctgtatccgacaacttcaacacccccactccctctgcacaagtccaggttctgaacatcaactggtttcagaaacaacccaatggcaacgacgaggtttttgtttttctagctgctgagtatgaaactcctaagaattccttgaatcagatatccctatgggatggtatcattccctctaaagagcatgcaaagttttggattcatacatcaaataaataccgcttcatcgaccaggggagcaatttgcgtggcaaagaatataacctgactatgcattggcatgttatgccgaagactggcaaaatgtttgctgataaaatagtcatgccaggttatcgattgcctcaggaatatagatga

SEQ ID NO: 93848 - DNA, 279 bp, Glycine max
  Peptide Sequence Number=SeqID_210626
cccttgttatttttaattctctcattgtccctcaccctcaaaacatacacttctactaagctttctgattcgaccacagaacccaatcgccctcatgggctcaaaggccttgaagcggaggatctcccggtgagaccgggaccttgcttgaagaagattagactctttgtagcgcaattaagcagaagtgcttaccagattggtgttttggcaaacctttttggggtttggtctaagaggttcaccacgcattggttggccattttgatgtctatttga

SEQ ID NO: 93849 - DNA, 243 bp, Glycine max
  Peptide Sequence Number=SeqID_210627
atgttggtaaacgttgagtcaagtctagcagagatttctaaaacgtgggagcttcctgtcaaaactctcatgagattgacaatccctcaaccagcaccatcacaatggagcagattttatgcatgggccaatattgcactttgtccgctagccctcttgtatgcctgcaactcattcatgccatttaatcatcctatagggtctcacggtgctggcatggggaaattcagtgggagatcttga

SEQ ID NO: 93850 - DNA, 147 bp, Glycine max
  Peptide Sequence Number=SeqID_210628
atggggtctgcattggacgctgtgatcgaatgtttcctgatatgggggttattggagctgcggcgaggacttgaggagactttccagaacgcgtgggacagcctctgtgccaggttttccatagattctgtgctgcatttgtattaa

SEQ ID NO: 93851 - DNA, 201 bp, Glycine max
  Peptide Sequence Number=SeqID_210629
atggaaaaagttgtagtagctggttcagttagctcaagccagaaaaggaaggatcctaatcagaaaaaactttgccatcgtgtatgtctccctttcatgactattctttatcagtgccaaaatcaccagaaaatagacggggtaccaactgagaaggcagctgaaaggatttggagaaatgcccccgtggacaaagcataa

SEQ ID NO: 93852 - DNA, 132 bp, Glycine max
  Peptide Sequence Number=SeqID_210630
atgatacttgtacaacaaatcttacaacaaagagaaagggagaaaaataaccaggcaccggaatcagttgtgaatgtcaaactgaatggttgggaagatccatactacattgcgagcagaagctgtagctga

SEQ ID NO: 93853 - DNA, 1131 bp, Glycine max
  Peptide Sequence Number=SeqID_210631
atggaggttaaatccagagctccggggaaaattatcttgagcggcgaacatgctgtggttcatggatccaccgctgttgcctcttccattgacttatacacctacgtttctctccgcttctccactccttcagacgaccaagattcgttgaaactgcagctgaaggagacggctttggagttctcgtggccaatcaccagaataagagcatcctttcctcagctatcttccacgccaacctcatgctctgtcgagaatgccaaggcaattgccgcactcgttcaagaccttaatattccagaggccaattttggactcgcctctggtgtttccgcctttctctggctgtactcttccattcaaggctttaagcctgctactgtgcttgtcacttctgaacttcctctgggttcaggattgggttcgtcggcgtcgttttgcgtggcgctggcggcagccttgttggcttatactgactctgtctctttccatgtcaaccatcaaggatggctctcatttggggagaaagatcttgagttggtaaatcaatgggcttttgaaggagagaagatcattcatggaaagccctctgggattgacaacacattaccaccgttatcaggtaacattatcagcttcaagttgggtagcttgacgcatatgaagtcaagtgtgccacttaaaatgctcattactaacaccaaagtagggaggaacacaaaagcattggtggctggtgttggagagaggatgctaaggcatccagatataatggcttttgtgtttagtgctgttgattctcttagcaatgaattgacttccattctcaagtcacctacaccagatgagctctctgtaactgagaaagaacagaagatagaagaactaatggagatgaatgaaggtctgctccagtctatgggggtcagtcatgctacaatacaaactgttcttcaaacaacattgaagtataagttagcctccaaattgacaggagctggtggtgggggttgtgttctgacactgcttccaacatgtatcctcttcacttattgttctcttccttgtgcttctaatgttccattacatctctggttttcttcttttttgtttggtttgcatgggaggtga

SEQ ID NO: 93854 - DNA, 1257 bp, Glycine max
  Peptide Sequence Number=SeqID_210632
atggatatttcggagtacacaaggattgtttttgacaaacttcatagatttgagcctgagaatgctacaaagatcatcgggtatctccttctccaagaccatggtgagcaagacatggtgaaattggcttcactgccagaccatttaattcgcgacgtggcgtacaaggcgagaaccgagcttcaaaggttggcttctagatcagccattcagccaatttcacttcccaccaactctcaacaatgtttaagccatttgtcagtaatctcccctacttcggtaatcacccctggcactcttacttcaccagcaagcttccaggttcaatctccctattgggatcctcagtctgctagcaatactaatgcagaattcatggcactaggttatgtggattctatctcagaacttcaaaagcagacacctttgttcagtttagagaatcatatggatactatgaactccggaactgctgggattgctaatgattactatggcttagatgcttcatcagctagtaatttgggtggaaaaaatggaaggtttgaatttccagtcaagacctgtcactatttcaacaaagggttttgtaagcatggaaatagctgtagatattatcacgaacaaggcgccccagatatgttctctcacatgtatggaaatgatatttttaatgatgatcaggtgatttcacctgggtcactagcacaattagagtcagaaattgttgaactcctgaaacttaaaaaaggaggttccatatcaattgcttcccttccaatggcatactatgacaggtacaaaaaagtgctgcaggcagacggctacctgactgagagccagagacatggtaagtctggctacagtttgacaaagcttcttgcacggttgaaaaatagtattcggctaattgacaggcctcatgggcagcattcagttgttctggcagaagatgctccaaagttcaatggaaaggtagattatgctaaatacattagcgcatcgcgacagatatacctgacatttccagctgacagcacttttagcgagggtgatgtttcaaactactttagtacttttgggaaagttgaagatgtaaggattccgagccaagagagaaggatgtttggatttgtaacatttgatgatcctgaaactgttaaagtaattttggataagggaaatccccattatgtttgtgaatcccgggttcttgtgaaaccttataaggagaagccaaaacttatgctcaggtga

SEQ ID NO: 93855 - DNA, 312 bp, Glycine max
  Peptide Sequence Number=SeqID_210633
atgaagacattgatgaagcacattttggactttaaagaaaccagaagaggattagtaataatcattgacaattgtagtgaagtgatgtcaatttcaaggtctcaagtggggtgtctattgctgatactactaagtatttcggttttgaaccatcaagtattgggtgctcggtatgtaaaagaagaagtggaacatttgctcaacaagtctgcagtatggaggaaaagctttaccaatgaaacaaagggagacttttatggtacggttaatagagtagtgccttcctctcctgaccccttgcacaacaggtag

SEQ ID NO: 93856 - DNA, 504 bp, Glycine max
  Peptide Sequence Number=SeqID_210634
atgaaccccgttgattgggaacaagaactgaaaaagtatgaggatgttatagcctcaggtaccaattgtatgaaaataaaggccatggtgatgctgacacgtttatctaagcatgcccctgaggatgtgttagctcgcaccatacccattctcactgagattcttggtcacaatgtttcaaatgattctgctcctacacttcaagaggctgctgcttattgcttgaagtgcattgcttgcaggggtgatggtgagttggcggttgaaattggtggacatggcgccactcgttccttgatgaggttgttgcctcactctgaagggaggatgcagaaggtactgactaaatgtatgcttgttattgttagtttttgcaatgcaagtaggacagttgttgccaccaatggtggggtggaattgatcattggtttgttaagttcttgcaccgaagatactagacggtatttgttggagattttgcgcgcgctggcgttgaggagggat

SEQ ID NO: 93857 - DNA, 747 bp, Glycine max
  Peptide Sequence Number=SeqID_210635
atggctagagttattatgtttaactatttttcttggatatctgttttacatgtttgtgttgaattgtctcgttcattttatgcagattcattttcaaaacctgtatctggttctgatgaaccccagcagggtggttggtttcagacttttacaattgctgcttacaaaccatactttgatgttgacacttcagatgttctggagaggattatcgactcactatttccatttagaggatctttcaatgaaaaaactgctaccaaccctgatttgtatggtccattctggatttgcactaccttaatatttgttgcggcatctattggcacctttgtgacatatgtagcacacaagctgaagagcaaggaatgggattatgacattaatctggtgacttggtctgctggtttgttttatggatatgttaccattgttcccctttgcctgtatgtaatcctcaaatacttctctgcaccggctggccttgtgcaactattctgtctgtatgggtattccctgtttgtctttattccggccctgtgtatgtccgttgtgccactggatatatttagatgggtggttgcaggtgtggcagggttcatgtcagcaacatttgtggcactgaacctccgggcacatatcaaatcagcaggtgaaaggtggttcttgattgttgctggcatttttctgttgcagctggctctagctgttgtactaaagatttacctcttcacagtatcagtttaa

SEQ ID NO: 93858 - DNA, 4362 bp, Glycine max
  Peptide Sequence Number=SeqID_210636
atgttcttcctcttctctcactactactcttccatgatgcaccatggaactgattttctcctccaacctattttcacacgaggggtgtctgcttcactcaacctagttttgttacttgtgcttgttgtgtattgggtatggaagaaagtgcaagtggaccacagagaaaagagtgagagaaaaggattccgtaatgctggtttcttgtactacaaacacagtctggtttgtagcttagttatttgtgtgttcaaccttgtgttgtgcttactaagttacttttacttgtataacaattatggttcagaggagcttgtcacacttactgatttagctctcaaaaccattgtttggggtgctgtttgtgcttatttacattctagaaactccgaggcacaggatccgagtttaccacgctcctctattacgagtttatttctatgttatgttggatcacttggatgttctgttaacagtatggctaagcttgccccacttgaagagccccttttgaatggtgactctaatgtaagcaacaattctgttcccatcaaggctagaggaaatgaaaatttaacctggtattcaaatgctggatttttcagcattcttactttctcatggatcagtcctttaataactctagggaatgagaagactttagagcatgaggatctcccacatcttgctactgatgacagtgtggctgggattttcccaactcttagaaacaaacttgagtcagagtgtggtagtgttaggaatgtgaccactcttaagctcgtgaaggtgttattcttgtcaacttggcaaggaatccttttatcaggtttattagaattcctatattcatgtgcttcttatgttggaccctttcttattgacatccttgttcagtacctcaatggggaacacaagtttaaaaatgaaggttatgttttggctatggcatttgttgctgcaaagcttttggagtgtgtttcacaaaggcactgtatgtttaggttccagcaggttggggtaagcgtgcaatcaaagttggtggcaatgatttatgctaaaggtttgacactttcatgtcaatcaaaggaggttcgtagtactggggaaatcatcaacttgatgactgttgatgctgaaaggattggtgaattttgttggtacatgcatgatccatggatgtgtgttctgcaagttgctttggccttgttaattctctatagaagtgtaggggttgcttcaatagctgctcttgctgccactgtaactgtgatgttgctaaaccttcctttgtcatcattgcaagaaaagttccaaggcaaggtaatggagttcaaagataaaagaatgaaggctacgtctgagattctgaagaatatgaggattctaaaactgcaagcatgggagatgaagttcttgtcaaaggttattcagcttaggaagactgaggagatatggctacacaaatttctagctggtacagcaattattagatttctcttcactaacgccccaacttttattgctgtggttacattcggtgcttgtgttctcatgggaatcccacttgaatcagggaaggtcttatctgcacttgcaacattcagaattcttcaaatgcccatctacaatcttcctgacacgatttcaatgattacacaaactaaagtttcccttgataggattgcatcatttcttcgcctagatgagttgcagactgatgtaatagagaagattccttggggtagttctgataaggcaattgaattagtagatggaaatttctcttgggatttatcttcccctattacaacattgaaaaacatcaatctcaaagtttttcatggtatgagggttgctgtatgtggtactgttggatcaggcaagtctagtttactttcttgtataataggggaagtaccaaagatatcgggaacgcttaagatatgtggaacaaaggcttatgtttctcaatcgccatggatacagggaggcaagatagaagacaacatattatttggtaaagagatggaccgggaaaagtatgagaagattctagaagcatgttccttaacaaaagaccttgaggttctaccatttggtgatcagaccattattggagagaaggggatcaatttgagtggtggacagaaacaaagagtacaaatagcccgtgctctataccaagatgctgacatatatctgtttgatgatcccttcagtgctgttgatgctcatacaggatctcatctatttaaggaatgcttgctaggcattttaaaatcaaaaactgtgatatacataactcatcaagtagagttcttacctgatgctgatctaatattggtcatgagagatggaaggataacacagtcaggaaactacaatgatattctcaagacaggcactgattttatggcacttgtaggtgcacacagagcagctttgtcttcaattaagtccttagagagaaggccaacatttaaaacatcaagtaccaccaaggaggacacaaaatcattaagtaaaatatatgatcaaaagtcagatgacacaattgaggccaaaagacaacttgttcaagaagaaaaacgggaaaagggtagagttgggtttaatatttactggaaatacatcacaacagcttatggaggagctcttgtacccttcatattactttcacaaacactcaccgtgggttttcagattgcaagcaattgttggatgactgtggcaacacctgtttcagcaacagcagaacctgatattggaagctttacacttatggttgtctatgttgctttggctattggaagttccattttcacctttgccagagcatttcttgctgtgatagctggatacaagacagccactgttctcttcaataaaatgcatttgtgcatttttcaagcaccgatatcattttttgatgccaccccaagtggtcgaatccttaatagagcttcaacagaccaaagtgcactagatatgaaaattgctaatatattgtgggcaattaccctcaatctggttcaactcttgggaaatgttgttgtgatgtctcaagctgcatggcaggtgtttatagtattgattcctgtcacggcagcatgcatatggtaccagcgatactattctgcatcagctagagaattggcgcgattagttggtacatgccaagctccagttatacagcatttttctgaaacaatttctggatcaacaaccattagaagttttgagcaagaatcaagatttaatgacatcaatatgaaattgatagacagatattcccagcccaaattatacagtgcaactgcaatggcatggctgattttcagattggatattttatctactctcacttttgccttctgtttggttttcttgataacttttccaaattcaatgactgctcctggcattgcgggattggctgtgacatatggacttaatctaaatgctgtacaaactaaagcaatattgtttctttgcaatttggagaacaaaattatatctgttgaaagaatgctccagtacacaaccctcccaagtgaagctcctttcgtaataaaagacaaccaaccagattattcttggccattatttggagaggttcatatccgggatttacaggttcggtatgctcctcacttgcctattgttttgcgaggtcttacttgcacttttactgccggagcaaaaactggtattgtgggaagaacaggaagtggaaaatcaactcttgtgcaaacacttttcagacttattgaacctgttgctggagaaatattgatagataacattaacatctctttgattggaattcatgatttgcggtctagacttagcattattcctcaagaaccaacaatgtttgaagggactgtaagaaccaacctggatccactggaagagtacacggatgaacagatttgggaggctctagatatgtgccaacttggagatgaagtaaggagaaaagaagagaagcttgactccatagttatgcagaatggagaaaattggagtatgggccaaaggcaactggtctgccttggccgtgttctgcttaagaaaagcaagatcttggtgcttgatgaagctactgcatcagttgatacagccacagataatattattcagcaaacagttacgcaacatttttcagaatgtacagtcattaccattgctcataggataacttcaatccttgagagtgacatggttttgtttttaaatcaagggttgattgaggaatatgattcaccaaagaaactgcttaagaacaaatcttcatccctagctcaactagttgcagaatacacaaggaggtcaaactctggttttggaaattaa

SEQ ID NO: 93859 - DNA, 153 bp, Glycine max
  Peptide Sequence Number=SeqID_210637
atggctgttgcatggagaaaagaacagaggaggttgagcgtgtgcatcagagttcagaacagagaaagaacaggggcgggtgtctgccagaaataccactggactgaaggtgggagggtgttggtcgcacagaaaagagaagcatggagcaag

SEQ ID NO: 93860 - DNA, 375 bp, Glycine max
  Peptide Sequence Number=SeqID_210638
atgttgctaaaccttcctgtggcatcattgcaagagaagttccaaggcaaggtaatggaattcaaagataaaagaatgaagactacatctgagattctaatgaatatgaggattctaaaactgcaagcatgggagatgaagttcttatcaaagattattcagcttaggaagactgaggagatatggctaaagaaatttctggttggtacagcaattgttagatttctcttctataatgccccaacttttattgctgtggtcacttttgctacttgtgttcttataggcatccctcttgaatcagggaagattacagaagcaaaaacagacaaaagaacaaaaagcaaaaacagccaactatcccgcacaaagtaa

SEQ ID NO: 93861 - DNA, 816 bp, Glycine max
  Peptide Sequence Number=SeqID_210639
atggtgtctagggaaagggcttgtcaagcaattgggttgctaggagtcacaagacaggctaggcgcatgcttgttgaattgggggcgataccggtacttgtggcgatgtttcgtgatggagatcatgccacaaagcttgtagctggtaattctcttggtgtgatatctgctcatgttgattacattaggccggtggctcaagctggggctatccccctttatgccgagcttcttgaaggacctgatccttctgggaaggagatagctgaggatgtgttttgtatattggctgttgctgaggctaatgctgttgaaattgctgggcacttggtgaggattctgagggaaggtgatgatgaagcaaaggcgtctgcggctgatgtgatgtgggatctgtcaggttacaagcacacaacgtctgtggtccgggattcgggtgcgattcctattcttgttgagcttttggggagtggaagtgaagatgtgaaggtgaatgtttccggggcatttgctcaactaagctatgatggaacagatagaatggcacttgctgaggcaggggcagttccaattctcattgacttgatgaatgatgttgatgaggttgaggaactaagggataatgctgcagaggctcttgtcaattattatgtcgatccattgtatcatgatagcgtgtctgatgcgattaatgttccttcgttcagaaatatgcagaatagattaactcatattcgtgcatcgaatgagcacatggctagatccttgagaagaatgagtgttgagcagctcacttggaacccagatcttgcataa

SEQ ID NO: 93862 - DNA, 498 bp, Glycine max
  Peptide Sequence Number=SeqID_210640
atgatgtccggaaaatatacgtcgattgacgcgcagcagcttcagggatctgttcctgccgttccagattcacgacccgccaccgtcaatttcgcagattcaaatcttcagacatttcctccatctggtcctctgggcaagattactgctgcttccgggcctcctcgtgacgctgatgattgtgaaatcgcacaatcccacatgctaagcagcctcctccgtgctgaatcgttgcctggattgttccagagtgttatcgtgatcttccacttgaaatcttgggagcatcgatccccaatgagtcaagccggttttgtaaaaacacttaattccagttgtgtttcacatccattccctttcacgatctgctcttcttgttcgcaggcttcttctccttcatttgcaactgctggacctctgtcctacaccaccactgctgcccagggatgccaccgattgcgcctctgtttgcaaactctgttttgcgaactaaagtaa

SEQ ID NO: 93863 - DNA, 321 bp, Glycine max
  Peptide Sequence Number=SeqID_210641
atggggtatgcccataggcccgaaatctaccctaaggctcatgagaaccctagggccttctcttgcatctttgtcccaaatcttcttggagtcttctgtccaatgcccttggggggtaggattgcatcagcctcattacaagccaagaaagtttttcagattcaatttgccaaagaagagaaggttcaagtagttgatgactcactcagcgaggcagatccgctcagcgagtggcatccgcttagcgaggcatacagctcgcttagcaggtttggaaccctaaatgagaaagagttagagatgtgcttgcccagtgcgtag

SEQ ID NO: 93864 - DNA, 312 bp, Glycine max
  Peptide Sequence Number=SeqID_210642
atggaggctaaggaggagtccttggccactgcctttcaagcattcaaagtggtgagcaacgcttatgtggagtctcccccggtgcaaccgcgctcatctggagccatgttcatggtagcccgtgtgatgttgggacatggatacgagcccgacataggcttgggccggaatggtgatggtgtggcaagcttgaaagagttcacaggcaaccgcggaaggttaggactgggatatgagcctacacacaccaacgtgaggaggatttccctagaaaggaggggaaagagcatgggccagtcgcaagggccgtaa

SEQ ID NO: 93865 - DNA, 648 bp, Glycine max
  Peptide Sequence Number=SeqID_210643
atggttttgctccgatgtgtggatgcctgggaggctgagcagatgctagtaaaagttcacgaggggtcctttggaacacatgccaatggacatgccatggcccgaaggattctgagggcagggtattactggctcactatggaaaacgattggatcacacctcctagacacccagtggacctggagaagtccaacagggccctggggtttcctactttgatcacgggccttttccaattctatggagtgtcggtcactcctgccaaacttatccggccctccatcaatagggccttcatagagaaatattgcgtgccaaggcaggcaccacaatcgggtcaggcacagcagcagcaggacgagggccagcagcagccaactgtagatgtgccaccgtcgcctctacaagagacaccattcctggagtccatctccactcaggtgcacaggtgcatgcagcatgtgactggccaacaggcggacaatcaccggggtcagcctacccccaagcagttcggggccacggttgcctggcctggggatgagcccaattttaagataggggcaagacccacaggggcccctagggacgatgagggagcccaggaggatgacgatatggctgatgtgatggatttcttcatttga

SEQ ID NO: 93866 - DNA, 478 bp, Glycine max
  Peptide Sequence Number=SeqID_210644
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 93867 - DNA, 393 bp, Glycine max
  Peptide Sequence Number=SeqID_210645
atgttacggaactttacggattgcgcaataatgtttcctttcgactcccgacatgttgcagaacttaacggattgcctaacgatgggtgtcaagttcctcgaagtggtcaagtgaaggttgcatcccaacaaacagatggctccggacttgatggtggagggtgcatgaatagcgctaggcaatcaattcacggggctccagacttgatggtggaggatgcacgaacagcgcaaggtaatcaattcatgggaatccggactcaatggtggaggatgcatgaacaacgcttggcaatcaattcatggggctccagactcgatggtggaggatgcatgaacagcgctaggcaatcaattcatggggctccggacttgatggtggagaatgcatga

SEQ ID NO: 93868 - DNA, 288 bp, Glycine max
  Peptide Sequence Number=SeqID_210646
atggaagtatcagttggtctgtgccgtcccgacatagggatcgcgcccataagacacccagtggacccggaggagcccaacagagccctggggtttccaactctggttacaggcctctgtttgtcctacagggtgcccgttccccccagcaagggatcgcgcccgcaagacaccagtggacccaaagaagtccaacagggtcttggagttgtcagctctgattacgggcctctgtcagttctacggagtgcctctcgcccccagcaaggtcatcaggaaccctactaa

SEQ ID NO: 93869 - DNA, 333 bp, Glycine max
  Peptide Sequence Number=SeqID_210647
atgtcctcaccatcagaggactacacgtcctccaaagggctgcacaccctagccttcggagggcttcacgtcctcgcctttagggggctgcacgtcctcgccttccaagggctacacgtcatcgcctttggagggctacacgtcctcgccttcagaggactccatgtcctcacctttagagggctgcacgccctcgccttcatagggctacgcgtcctcacctttcgagcgctacacgttctcgccttcagaggactacacgtcctcgccttcagagggctacacgcccaaaccttcagagggctacatgccctcgcctttagaggactacat

SEQ ID NO: 93870 - DNA, 1662 bp, Glycine max
  Peptide Sequence Number=SeqID_210648
atggcttctaacaagtcctctccttctcgatctcattcaagaataaagcgttttcttatttgtctcgtactaatgtccctacccttattgttctttgtactttctgagaagcagaaaagagtcaccaaaatgcttgaggtggacccgaagccaagaccaagacccgcttggtttgatgtcatagcaaaaggtataatcaataacaaaaagaaaattaaggtaggcctcgttaatatcgatgctagagtggatggtagcatatttgaacaattagatacacttgactctcaagtagatactatatctatagattttgatcatgttgataagaatttgaaatgggaggatatttttcccgaatggatcgatgaaaacgggaaatggggtcaacccaagtgcccaaatttgccaatgccggcgttgcaaaattatggggatctcaatgttgtggtagcaaaagttccatgtgggattagggatgtgtttaggttgcaagttaacttggtggtggctaatttggctgtggagagtgggtgggtgaccaagatggagagtgatcataggaaagttcatgttgtgtttgtggggtcttgtggtcccatggtagagattttcagatgtgacgaccttttgatgcatcgacctgaatattgggtgtacaggcccgatttaaggagactcaagcaccaaacgcttatgccgcttggttcatgccaaattgctccgggttatgctgaaacaggtaaagaggcatggaggatagacgttgcacttacgcgcgttccaaagctggcctacgtaactgttcttcactcttcagaagcttatgtttgtggtgcaatagcacttgctcaaagcatccttggaacccaaaccatgtttatagaaactgacctagtcctactagcggataactccatcggtccccaatccacgacgggtctaaaagccgcagggtggaagatcaaacgcatccaacgcatcctaagccccttcgccaaaaagggtgcatacaaccagtggaactacagcaagctacgaatgtggcaactcacaacctacgacaaaatcatcttcatagactccgacctcttagtcctcagaagcatccaccatttattcgtgctccctcagttatcagccgcacctaacgagaaaacgctgttcaactcgggcttgatggtaatcgagccgtcgcaatgcatgttccggaaaatgatgaacgtgacttccaaggtgcgttcttacaacggcggcgaccaaggctttctcaacgaaatcttcacgtggtggcaccgtttgccggccaaggtgaatcagctcaagacttttcctagtagtggccatgggatgcacgagctccctgatgacgtgtacgccgtacactacctgggtctgaagccgtggatgtgttatagggattatgattgtaactgggacatgcaggatcgccatgttttcgcgagtgactcggctcacaggaggtggtggcaggtttatgatgccatgccgaaagagttgcaagcttattgtggactcacggagaagatgaatgaaaggattgtgaagtggagaaggatagcaagaaatgctagtttttccgatggccattggaagattaaggtccaggatcctagaagggggaattattattcagattag

SEQ ID NO: 93871 - DNA, 1170 bp, Glycine max
  Peptide Sequence Number=SeqID_210649
atggttgctagaagcccaccaaagcataacaaaatgttagctgttctcaatcgttctctaatcagagaaacactcaacaaggtggatcagtgcatggttcgattacaagaacttcagtacacggtggccggtggaaataaggttgtctcaggggtaagtctcagccctcgcagcaccagaggttatctgcgaaccagtctaaggtgcaagcaagaatcagtcaggatcaagcatgatgcaccaagaagatctccaccggggaagtttcctaagccaacaaattcagaaggtaaagaatggaggcaaatgtcactgccttcaatgcttgttggcgaaactgttggagaaattttaaaggcaagtcaatttgccagcgaaatagtctcagcagttagtaggaaaactgccaccaaggaaccaaaaactccacagtcccaacggtcaaaccagaaagttgacactgaaaacacacaactcaatgctagaaggaggaaagagaagcaaattaaaccactttctgataccccaccatctcaatgggctcgttcaaggattaacttcaaggtttctcctccaaaaagaacagtagagtttgacaaagagaataataacaagtgtttgccaaatagggcatgtgctagcagtagtactaacaagacagtgcttgtccccaaacctttattcttgtctacacattcttcaaggcaacaactattttgcaagacaaaatctcatgtcatatcaagaaacataggaacacaacaaaagtgtttgatcatgtccccaccttcagcagcttccaaagttcaagtcaaagtaaaaaacccatcaattatgtttatttcttcttcacccacaagacctacaaatacaagtttgagtttgagcaagaagagttctccaacaaagagatgggttcgaactttctctcctagagtggcaacaagattattagcttcaccaataaagagcaagaaaactgtgcaaaaaagtgatggggtagtaaatttgaggaagtgttctccaaagagatcagttgcatcaaaactatgtcgatctttctctccttcaaggctggcaacaagatttgtttcaccattgaagagcaggaaaagggcacagcaaagcgatgggttagtaagtggattgaaacaacgcccagcaaagtga

SEQ ID NO: 93872 - DNA, 1318 bp, Glycine max
  Peptide Sequence Number=SeqID_210650
gtgcaccatggcgacggtggagtggaactcgacggtggtgtagtgcaggaagaggaaatcgatggagatggagagggaatatgcataaggttgtatagtgcgccggtagtggcggcggttgtggaagtggtgtcactgcctgaggttgaatggatagttgtttcatcataccctgcatggtggaggcctctaatttctgaaaaataccttgaaggttatccatggtgggcttgctgtgtttgtgataaagaagggaggtttatggtagctcgaacatcctgccatcctggtccaaaccgtgtatctcagtcattgaaggagaggcaagtcgaattcttcaagctctgcagtttgtcacaagaaaagcttgtgacccttttggatttagtgctcaaagtggttgcttggggtgttggtggtgtttgcatgcacgatgagctcttcatttcaagggaaagaagattgccattcttcttcagaggttggtgtgtcctctacctctttgtttctggctattgctttatagtgaacattgttctctatgaaaagcatgctgctttgcctattcagtgcttaggttctgatgtttcctctgtttgtgtgggtttattcttctgttacttgggtttttttgtaaaatttgagggtggagtgagaaatagtactcttcaagaatctcttttgaatggtgattcaaatgataatgatgtgtttgggactaatgaaaccaaggggggtgacactgttaccccttactcttatgctggaattttcagcattcttaccttctcttgggttagtcctctgattgctggtggcaagaagaagagtttggaccttgaggatgtcccccaacttgacaaaagagacagtttaattggagcatttccaatttttagtgataagcttgaggcatattgtggagcaactaacacattaaccacacttaagttagtgaagtcattagtattctcaacctggaaagagattattttcacagctatccttgcactggtaaacacattggcgacttttgtcggtccctatctcattgattgttttgttcaataccttaatggaaaacgacaatttgaaaaagagggccttgttttggtgtctgcattttgtgtggcaaagcttgtggagtgcctgacaaagaggcactggttctttaggttgcagcaggttggaatacgaatgcaagcactgcttgtgacaatcatatataataaagctttgaacctatcatgccaatcaaagcaaggacagaccacaggggaaataatcaacttcatgagtgttgatgcagaaagagttg

SEQ ID NO: 93873 - DNA, 2916 bp, Glycine max
  Peptide Sequence Number=SeqID_210651
atggcggagcaacaccgcaagaccacgctggattcgggctgggtcgcagcgaggtccactgaggtccaattcaccggaatccagctcaccactactcaccctccaacacgccccacttccccatggatgcaagctctcgttcctggaactgttctagcgaccttggtgaagaacaaagccgttcccgatcctttctatggactgcaaaatgagcacatcattgacattgctgattctggaagagactattacaccttttggttctttacaacctttaattgcaagctttcaagcaatgagcattgtgatctgaacttccgtggaatcaattactctgctgatgtgtatttgaacggccacgaaatcatcctaccgaaagggatgtttcgaaggcactcccttgatgtcaccgatattcttcattcggatggcacaaacctgcttgctgttcttgttcatcctccggatcatcccgggagaattcctcccgaggggggacaaggcggtgatcatgagataggaaaggatgtgactacacagtatgttgaaggttgggattggatggctcctataagggataggaatactggaatatgggatgaggtttctatttctgttactgggccagtaaaaataattgatccacacttggtttcaacattttctgatgattataagaaggcatatctacatacaacaactgagttggaaaacaggagctccttgactgctgagtgttctttgagtgtccaagtgacaacagaacttgaggatagcatttgcttagtagagcatcttcaaactcaagatctctcaattcctgcaaactcagcggtgcaatatacatttcctgagcttttcttctccaagcccaatttatggtggccaaatggaatgggaaaacaatctttgtacaatgttgttattgtcattgatgttaaaggatttggtgaatctgattcatggagccatcactttggattccgcaaaattgagagtcatattgatgatgctactggtggaaggttatttaaagtcaatggaaaaccaatttttattcgagggggtaactggatattgtcagatggactactgcggctttcaaagaagcggtataatacagatatcaaatttcatgcagatatgaatttcaacatgattcgatgctggggtggtgggctggctgaaagaccggagttttatcattactgtgattattatggccttctggtatggcaagagttttggattactggggatgttgatggacgtggtgacccagtgtccaatccaaatggtccactggaccatgaccttttcttgttttctgcaagagacacagttaagcttctaagaaatcatcctagccttgcactatgggtggggggaaatgaacaggttccaccggatgatataaatgctgctcttaaaaatgatctgaggcttcatccttattttgaaagtgtggaggaaaatagcaaacctgtaggagactggtccccaatgtcgacagattttagtcagtatcttgatggcacacgcatttacatacaaggttcaatgtgggatgggtttgctgatgggaaggggaacttcactgatggtccttatgaaattcaaaatcctgaagatttcttcaagaatcacttttataattatggattcaatccagaggttggctctgtgggaatgccagttgcagctaccataagagcaacaatgccctcagaaggatggcagataccagtgtttaagaaacttcccaatggttatgttgaagaagttccaaatcccatatgggaataccataaatatattccttattcaaaaccaaccaaggttcatgatcagattcaactttatggtgatgctaaagatctcgatgatttttgtttgaaggctcaacttgtcaactacatacaatatagagctcttctggagggatggacttctcgcatgtggagtaaatatacaggtgtattaatatggaagacacagaatccctggactggtctgagaggtcaattttatgatcatctacttgatcaaacagcaggtttctatggttgtcggtgtgctgcagaaccagttcatgtacagcttaatctggctacatatttgatagaggttgttaatactacagcagaagaaatgtctaatgttgccattgaagcttcagtgtgggatcttgacgggacatgcccttactacagagttcatgaaaatttctctttgctgccaaaaaaagtagcacctatttttaagatgaagtatccagagtcaaaagatccaaagccagtctactttcttcttctcaaactctataacatgtcagataatagagttatatccagaaacttttattggttgcatctttctggtggagattacaagttattggagccatatagggagaagaaaatacctctcaagataacatcgaaggtttcaattgaagaatgcacttataatattcaaatgcttgtggcaaacacatctaaaagaccagcctctacaagttcaacagctaggctaagtgatggtttttatggcacacactcactggaaactctggcttgtggggttggaatagaacaaaaatctagttggtttaagaggatacatagatgttttgctgggaaaagtgatggtttgaaagttactgaaataagtgggcctgatgtaggcgttgctttctttcttcatttttctgttcatacttcaaagatggaccacaatgaagggaaagacacaagaattcttccggttcattactcagataactatttctcactagtcccaggagagaccatgcctataaatatatcttttgaggttcctctgggtgtcactcctcgagttattctgcatggctggaattacgatggaggtgaaatcatttgcgaagttgtatag

SEQ ID NO: 93874 - DNA, 1005 bp, Glycine max
  Peptide Sequence Number=SeqID_210652
atggctgaagaaatgacaatggtagaacctggaagaggtaagaggaaattttttaaaaagcaaggccataaaaagtcaagtaataaagcaaaagtgatgccaccacaacatggacagaagaaagttaaaatagacaaaaaaatgaagaaacttttccgcaagcgtgcacgagagtataattctgatgatgaagatgaggaggccactgtacctgctacctcagagcctaaaggtctggcatctatcaccaataaaagaaatgacgaggatgacacagaaagtgaggatgggtctgaggatgaaggagctgcaggaccacaaaaaacatggaataagaatgctactgatatgaataaccacagctctgatgatgaaggagaagatgataatgaaattcagccaggaattacaaaattcactgaaggatgtagagcattcaagatggcctttaagaatattatgcagaagagtgttcctgatgacatgttgggtccaatactgtcagggcaaaggaaacttgttgtagacaaacttgcagaagaggaagcagaaagcaaggtcaagggagaggccaaaaaagaaaagaagatgttggcagaaaaggggcatgtcaaacctgctacatacttggattcacatgaaaagtttttaataagtgttgctacaaaaggagtggtcaagctgttcaatgctgtaaataaggcacaaactgctcagaaaggactgaacccctcaaggactaaggatgcaaaagagatacgaaaacgaaccaaacaggccttcttttcagagttagggaaaccatcattgcctgcaattggcaccactacaaaggccaaggaaagcactgacagggtagaagatgaacaacctgcttgggctccattacgagataattatatgctgacaagttcaaggctaaaggattgggacaaaatgcctgataaaaatgtatcagatgacatgggaaaaacttctgaagatagtagttcagatgaagattag

SEQ ID NO: 93875 - DNA, 2016 bp, Glycine max
  Peptide Sequence Number=SeqID_210653
atgcaagacattttcggatcagttcgccgatcactggtattccgcggttcgccggagaacgaagaatcctctcttggagtcggaggaagcctcgtcgataggatcagttattgtatccgaagttccagagtcttctccaaaccctcgacgccgtcgccgccctcctttcctaaggacgctgctcctccgatccgatggcggaaaggcgagttgatcggttgcggcgcctttggccaagtctacgttggaatgaatctcgattctggagagcttctggcggttaaacaggtcttgattgcggcaagtaatgctacgaaggagaaggcacaggctcacataaaagagcttgaggaagaagttaaattactgaaagacctttcacatccgaacattgttagatatttgggtacggtcagagaagaggacaccctaaatattctcctggagtttgttcctggtggatccatatcatcactattggggaagtttggggctttccctgaggctgtaataagaacttacacaaagcagctactacttggacttgagtacttgcacaaaaatggaatcatgcacagagacattaagggggccaatattcttgtagataataaaggatgcataaaacttgcagactttggggcatccaaacaagttgttgagctggcaaccatttctggtgccaagtccatgaaaggtactccatattggatggctccagaagttattctccagactgggcattgcttctctgctgacatatggagtgtgggttgtactgtgattgagatggccactggaaagcctccctggagtcagcaataccaacaagaggttgctgctctcttccatatagggacaactaagtctcatccgccaatccctgatcatctatcagctgcagcaaaagattttctgctaaaatgtttgcagaaggaaccaattttgaggtcatcggcatccaaactgctgcagcatccctttgttactggtgaacatatgaattctcttcctctgtcatctaatgtcatggaaaatttggaagcttcttcaccatcatgtgccccaaatgcggaatccttcctttgctgttcaacggtaaatcctctggacttgggaattaaacagtcatggggaatgagcaacgatgatgatatgtgtgtgattgatgacaaagaagagttctcacagagtgatgccaaatacaaatcatttatgtcaactaatatcgagagtttcaacccaatgtctgatccctctgatgattggggggggtgtaaatttgatgcaagtccagaactggaaaatagaggggttaattttggcactgatgaaagttacgtgccacctgatcagtcaggggatgatgataaggggcagaaagatttttcctttccaggtgtgccatctctgtcagaggaagatgatgaactcacagagtcaaaaattaaagcatttttggatgagaaggctcttgaactgaaaaaattgcagacacctttatatgaagagttttacaatagtttaaatacatcttgttctcccaatgtgattgagagcaccagtgatgatactgcttgtcgaaaatatttgaaattacctcctaaaagcaggtcaccaagtcgggtaccaattagtactccgtctaaagccgttgataattctggaagtcctggaagtaatggccggtcatcatcaactgttggccatgtaaataaccatagtccacaggatattccagcatcttcccttaatgaatggaaaggactgatagctgactctcagcagcagcccagtagcccaagtctaagcttttctgagagacagaggaagtggaaagaagagctcgatcaggagcttgagagaaagcgagttaatttgatccttgacctgttgcttgggcacaaacgttgcagaaatgatgcggcaggctggcatgggcggaaagacatcttcaccgaaggatcgagctttaaatcggcagagggagaaaacaagatttgcttctcccagtaa

SEQ ID NO: 93876 - DNA, 2295 bp, Glycine max
  Peptide Sequence Number=SeqID_210654
atgttgcctctgccctctgattatttggattttggtatatcagcagataatgtattagcacaactgaacaatgagacctctgacaatatggatgagagtagtatacccaatggaatccatgaatgttctcctcgtgaggatcatacactcccaatattgaagaaaatccttgacttgagtactaaaattcagaatttgaagaaacaacatgtagccctatctaatcaagtgaaactcacaactgagtcatttccaggcctagatgttttaaagtctgttcagcttcttggtgctgaatatgaagtgttgaaaagaaagtacgtagaggagtcctctgagcgtaggcggctttacaatgaagtgattgaactaaagggaaatatcagagttttctgtagatgcagaccactaaatgaaagtgaaattgcaaatggatcagcagtatctgttgtcaattttgagtcatcttctgatgagctccaagtcatttgctctgattcttcaaaaaagcacttcaaatttgattatgtattcagacctgaagataaccaagagactgttttcgaacaaacaatacctatcgtcacatctgtgttagatgggtataatgtttgcatttttgcatatggtcaaactggaactggcaagacctttactatggagggaacacctcagcataggggagttaactatagaaccctggaggaattatttcgaatatctgaagagagaaatgatgtaataaaatatgaattgtttgttagcatgttagaggtttacaatgagaagataagagatcttttggtggaaaattcagttgaacctactaagaagttggagataaagcaagctgtagatggaacccaagaagtcccaggacttattgaagctcgtgtttatggaacagtggatgtgtgggaaaagctgaagtctggaaaccaagcccgatctgttggatccactagtgctaatgagcttagcagtcgttctcattgtttgttgcgagtgactgttttaggggagaatttaatcaatggccagaaaacaaggagtcacctttggctagtagatttagctggcagtgaacgtgtggggaaaactgaagctgaaggagaaagactgaaggaatctcaattcataaacaagtctctatcagcacttggtgatgttatttcagctcttgcatccaaatcagcccacataccttacaggaactcaaagctcacccatatactccagagctctttaggaggtgattgcaaaacattaatgtttgtccagataagtccaggtgcagcagacttaacagagacactttgttctctgaattttgccacacgtgtacgaggaattgagagtggcccagcccgcaagcaaacggaccttactgaactgaataagtacaagcaaatggttcgggatcttgagaaccaggtgacagaggagagaaaaatgagactgaaacaagaaagtaaatcacttgcagcagtttcagctcaaccttcaacaatgtcggagtcaatagctgctcggaaaatcatgaagaagccaccgctcgatccaagactgccacttagaagaattactaacattttacctccaccaccagagagaaagccctcatgcagctcttccatggatgaacaggaaaacattgctagaacaacttcaattaacacacaagaccttgtgaaaccaagaaggggggtatccatagctgtaagacccccaaccacaccatcaacatcacggacccttcagcctagaaggaggcgtgtttctgtagctacactatgtcctgtcagaactccactccgttcccccactcagcaatcaccgagaaggccctcatgcagctcttccatggatggacaggaaaacattgccagaacaacttcaattaacacacaagaccttatgaaaccaagaaggagggtatccatagctgtaagacccccacccccaccatcagcatcacaggcccttcagcctagaaggaggcgtgtttctgtagctacactttgtcctgtcagaactccactcggtttccccactcagcaatcaccgaaaaggaaccaaagggaaactcagtattcaaggttgtttgccccattgccagaagctataacctcagtcgagacagcatcaccaactttgatgaggagcagcagtaagtttgccggcagccctaggcatcaaagacgcaaacccttagtgtggactcctctcaagctgaagggcttgaaaaatagcagcagaaagtcattggttataccatctcggcctttctactga

SEQ ID NO: 93877 - DNA, 1905 bp, Glycine max
  Peptide Sequence Number=SeqID_210655
atgcagcgtggcctccttgcttcctctcttccactctcaacccgctctctcttccttcctctccctctatgcctctcaagcccaaacccattcttctacaaactcaattcccatagtaagcctttcttcaccattcgcaattgcagcagctccttcaaagtgaaaccctcttcccaaatcaaaaaaatccgcgccgaagccgagcttgaccccaagctcaccgcgctccgaaacctcttctccaaacccggagtaaacattgacgcttacgtcatcccttcccaagacgctcaccagagcgagttcattgccgagtgttactctaggagagcctacatatcgggttttactggcagtgctggaactgctgtggttactaaggacaaagctgctctctggacagatggcagatattttctccaggcggagaagcagctgagctctaattggattctgatgcgggcgggaaatccaggagtccctaccgctagcgaatggctcaacgatgttttggctccaggtggcagagttggtattgatccctttctttttacttcggatgctgcagaggaacttaagggggttatctctaagaacaaccatgagctcgtatatttgtacaattcaaatcttgtggatgaaatatggaaagaatctaggccaaaacctccaaataatccagtaagagtgcacaacttaaagtacgctggtttggacgtggcatcaaaattatcatctttgaggtcagaacttgtcaatgctggctcatctgcaattgtcatctccatgcttgatgaaattgcatggttgttgaacttgagaggcagtgatattccacattcaccggttgtgtatgcatacttgattgtggaggttagtggagcaaaattatttatagatgattccaaagttaccgaagaggtgagtgatcacttgaagaaagcagatacagagatcaggccgtacaattcagttatatctgaaatcgaaaggttggcagcacgaggtgcttccctttggttggatacttcatcagttaatgctgctattgtgaatgcctacagagctgcctgtgacagatattatcagaactgtgaaaataaacacaaaaccaggacaaatggttttgatggatcctcagacgtacccttttctgttcacaaagtctctcctgtttctcaagcgaaggccataaaaaatgaatcagagttagaaggaatgcgaaattgtcatttaagggatgcagctgcacttgctcagttctgggattggctagagacagaaattactaaggataggatattaacagaagtagaagtttcagataaacttcttgagtttcgctcaaaacaagctggtttcctagatactagctttgacacaataagtggttctggtccaaatggcgctatcatacactacaaaccagaaccagagagttgtagttctgtggatgccaataaactgttcttattggatagtggtgctcaatatgttgatggcacaactgacataacacgcacagttcattttggcaagcctacagcaagagagaaggaatgctttacccgagttttgcagggccatatagctcttgatcagtcagtctttccagaaaatacccctggttttgtgctggatgcgtttgcccgatcctttctttggaaagttggacttgactacaggcatgggactggacacggtgtaggagctgcattaaatgttcatgaaggcccgcaaagtattagtcatcgttatggaaatttgacccctctagtgaagggcatgattgttagcaacgagcctggctattatgaagaccatgccttcggtattcggattgaggtgatattctcttcagctatcttatgctctgaaatgataactttagctcctagtgttgct

SEQ ID NO: 93878 - DNA, 648 bp, Glycine max
  Peptide Sequence Number=SeqID_210656
atggctatcatcacagaagaaccagaagcagaagcagactcacactcacagatcccaaaaccccgcaaacccaaactcaaaaccccttcttctccaccccccaacagcaacaacaaccccttctccttctggttctacttcaccctctccgtctccctcctcactctcttctttgtcttgacctccagcctctccccccaagaccccaagacctggttcctcaccctccctccccccctccgccaccactactccaacggccgcaccatcaaggtccaaacacattccaacgaagcccccatccaagtcttcaccctccaagagggtcccacatcgtccgaaaacataatcattctccacggccagggtctcagctcatactcctaccgccaccttgcccaatccctcgccgccaacggactccacgtcacctccctcgacctccccggacacggcttctccgacaagtccgtcgaggcttccgtcgagggcgtaaacggggtttttgggaggttttggtacgtttacagcgagattcaagagaggggtcttttctgggcgtttgatcagatggtggaaacgggtcaaattcctgtacgaggaaattcaagctcgtatgtcgaagagaaaaacaagaaagcctattga

SEQ ID NO: 93879 - DNA, 827 bp, Glycine max
  Peptide Sequence Number=SeqID_210657
ggattcctcttgaagcagggaagatcttgtctacacttgcaacattccagattctccaagaacccatttataatcttccagagacaatttcaatgatggcacaaactaaggtttctcttgacaggattgcatctttccttcgtctcgatgagatgctatctgatgttgtgaagaagcttccgccgggtagttctgatatagcaattgaagtggttgatgggaatttctcttgggattcattttcccctaatataacattgcaaaacataaatctaagagtttttcatggcatgagggttgcagtttgtggtactgttggatcaggcaagtctactttactttcttgtatattgggagaagtaccaaagaaatcagggatcctaaaggtgtgtggaacaaaggcctatgtagctcagtcaccatggatacaaagtagcaccatagaggataatatattgtttggcaaggatatggaaagggaaaggtatgagaaggtccttgaagcttgttgcctaaagaaggatctagatattttatcatttggagatcagactattataggagagagggggataaatttgagtggtggacagaagcaaagaatacaaattgctcgtgctctataccatgatgctgatatatatctatttgatgatgtgtttagtgctgtggatgctcatacaggatctcatctttttaagggagatcagtcagggtcatgctgttttgggagaatgctccaaccatgtgggatcgacacagacttaaaggagcactcaaaccaggtgtatttacccctaaggcctacactccaaagagtctgttag

SEQ ID NO: 93880 - DNA, 3414 bp, Glycine max
  Peptide Sequence Number=SeqID_210658
cttgtggagtgcctgacaaagaggcactggttctttaggttgcagcaggttggaatacgaatgcaagcactgcttgtgacaatcatatataataaagctttgaacctatcatgccaatcaaagcaaggacagaccacaggggaaataatcaacttcatgagtgttgatgcagaaagagttggtgagttcagttggcacctacatgatctgtggttagtagtcctacaggttttagtaggcttgttggttttatataaaaatcttgggcttgcttcaattgctggttttgttgcaattctcattgtaatgtgggcaaacattcccttgggttcaacccaagagaagtttcacaacaagttgatggagtcaagagatgaaagaatgaaagcgacatctgagattttgaggaacatgaggattctcaaactgcaaggatgggaaatgaagtttttgtctaagataactgaactcagaaagatcgaacaaggctgtttaaaaaaagttatatacactttagtcttgatcatatctatattttggtgtgccccagcatttgtatcagtggttacttttggtacttgtatggtcattgggatcacccttgaatcagggaagatcttgtctacacttgcaacattccagattctccaagaacccatttataatcttccagagacaatttcaatgatggcacaaactaaggtttctcttgacaggattgcatctttccttcgtctcgatgagatgctatctgatgttgtgaagaagcttccgccgggtagttctgatatagcaattgaagtggttgatgggaatttctcttgggattcattttcccctaatataacattgcaaaacataaatctaagagtttttcatggcatgagggttgcagtttgtggtactgttggatcaggcaagtctactttactttcttgtatattgggagaagtaccaaagaaatcagggatcctaaaggtgtgtggaacaaaggcctatgtagctcagtcaccatggatacaaagtagcaccatagaggataatatattgtttggcaaggatatggaaagggaaaggtatgagaaggtccttgaagcttgttgcctaaagaaggatctagatattttatcatttggagatcagactattataggagagagggggataaatttgagtggtggacagaagcaaagaatacaaattgctcgtgctctataccatgatgctgatatatatctatttgatgatgtgtttagtgctgtggatgctcatacaggatctcatctttttaaggaatgctcactaggctttttaagttcaaagacagtggtttatgtcactcaccaagtagagttcttacctgcggctgaccttatcttggtcatgaaagatgggaatattactcaatgtggaaaatataatgatctgctcatctcgggcactgattttatggaacttgttggtgctcataaagaagctttgtttgcacttgattcattagatggagggacagtatctgctaaaataagtgtctctctttctcatgctgttgaagaaaaagaagtaaagaaagatgtgcaaaatggtggagaagatgacaaatcacatctaaaaggtcagcttgttcaagaagaagaaagagagaaaggtaaggttgggttttcagtttattggaaatatataatagcagcatatggaggagcacttgtaccactcatattgttggctgaaattttgttccaacttcttcaaattggaagcaactattggatggctttggtaactcctatctcaactgatgttgagccttctgttggaggaagcatgcttatagttgtctatgtagctttggccataggaagttctgtttgtgtccttgctagagcaacacttgttgccacagctggttataagacagctactctactcttcaacaacatgcatttctgcatttttcgcgctccaatgtcattttttgatgccactccaagtggaagaatccttaatagggcttcgactgaccaaagtgcagtggatatagacattccttttcaagctggatcacttgcttcttctgtggtacatcttcttggaattatagtggtgatgtctcaagtagcatggcaggttttcattgtcttcgttcctatcacagcaattagcatttggtatcagcaatattatttaccatcggctcgggagctatcccgtttagttggggtatgcaaagctcctgtcatccaacactttgctgaaacaatatcaggtgcatcaatcatcaggagctttgatcaagtaccaagatttcagcaaacaattatgaaactaatggatggatattctcgccccaagttcaacaatgctggtgctatggaatggttgtgcttccgattagatatgttgtcttctatcacattttccttttgtttgatattcttgatatctattccacagggattcatagattcaggtgttgctggtttagctgtaatctatggccttaatctgaacattgtacaatcatggatgatatgggaactttgcaacatagagaccaaaattatatcagtagaaagaatacttcagtatacttccattcctagtgagcctcctcttgttgtagaggaaaaccgaccacatgattcttggccatcatgtggcagaattgatatccacaacttgcaggtacgttatgctccacatatgccatttgtgttgcacagccttgcatgcacatttcatggaggactgaaaactggaattgtcgggagaacaggaagtggtaaatcaactctcatacaaacacttttccgaatcgttgagcctactgttgggagaattatgattgatggtgtcaacatctcttccattggactgcgtgatttgaggtctagactgagcattattcctcaggatccaactatgtttgaaggcacagtgagaagtaatctagacccattggaagagtacacagatgaacaaatttgggaggcccttgataagtgtcaacttggagatgaagttagaaggaaagaaggaaaactagagtctgcagtttgtgagaatggagagaattggagtatggggcaaaggcaattggtctgtcttggtagggtgttgcttaagaagagtaaggtcttggtgcttgatgaagctactgcatctgttgacacagctacagataatttgattcagcaaactctaaggcaacatttctttaattgcacagtcattaccattgcacatagaataacttctgtcattgatagtgatatggttctactacttaatcaaggacttattgaggagtatgattccccaacaaggttgctagaagacaagttatcttcttttgctcaacttgttgcagagtatacgacaaggtccaattccagttttgaccaactaaaataa

SEQ ID NO: 93881 - DNA, 2697 bp, Glycine max
  Peptide Sequence Number=SeqID_210659
atgaagctgagcttgcagccaggtcagtcaggttctagaagcaatcccaatccaagattccctgggccgttagaagatgaatgcttattggaccttttgagttcaaagactgtggtttatgtcacccatcaagtagagttcttaccagctgctgaccttattttggtcttgaaagatgggaagattactcaatgtggaaaatataatgatctactcaactcaggcactgattttatggaacttgttggtgctcataaagaagctttgtctgcacttgattcattagatagagggaaggaatctgataaaataagtacatcacaacaggatataagtgtctctctttctcatggagctgaagaaaaagaagtgaagaaagatgcgcaaaatggtgtaaaagatgacaaatgtggtccaaaaggccaacttgttcaagaagaagaaagggagaaaggtaaagttggcttttcagtttattggaaatatatcacagcagcatatggaggagcacttgtaccactcatattgttggctgaaattttgtttcaacttcttcaaattggaagcaattattggatggcttgggcaactcctatctcaactaatgttgagccacctgttggaggaagtaagcttatagttgtctatgtagctttggccataggaagttctgtttgtgtccttgcaagagcaacacttgtagccacagctggttataagacagctactttagtcttcaacaacatgcatatccgcattttccgtgctccaatgtcattttttgattccactccaagtgggagaatccttaatagggcttctactgaccaaagtgcagtggatatagacattcctcttcaaactggagcattggcttcctctgtgatccatcttctcggaattatagtggtgatgtctcaagttgcatggcaggttttcattgtctttattcctattacagcaatcagcatctggtatcaggctcctgtgattcaacacttttctgaaacaatatcaggtgcatcaaccatcaggagctttgatcaggtaccaagatttcagcaaacaaatattaaaatgatggatggatattctcgccccaagttcaacaaagctggtgctatggaatggttgtgttttcgtttagatatactgtcttctatgacatttgccttttgcttgatattcttgatatctattccacagggattcatagattcaggtgttgctggtttagctgtaacctatggccttaatctaaacatcatacaatcatggatgatatgggatctttgcaacttggagaccaaaattatatcagtagaaagaatacttcagtatacttccattcctagtgagcctcctcttgttgtagaggaaaaccagccacatgattcttggccatcatatggcaggattgatattcacaacttgcaggtacgttatactccacgtatgccatttgtgttgcatggtcttacatgcacatttcatggaggattgaaaactggaattgttgggagaactggaagtggtaaatcaactctcatacaaacactgttccgaattgtcgagccttctgttgggagaattatgattgatggcatcaacatctcttccattggactttatgatttgaggtctagactgagtatcattcctcaggatccaaccatgtttgaaggtactgtgagaactaatctagacccacttgaagagtacacagatgaacaaatttgggaggcccttgataagtgtcaacttggagatgaagttagaaggaaagaaggaaagctagactcttcagtttgtgagaatggagagaattggagtatgggccaaagacaattggtttgtcttggtagggtgttgcttaagaagagtaaggtcttggtgctagatgaagctacagcatctgttgacacttctacagataatttgattcagcaaactctaaggcaacacttccctaattcctcagtcattaccattgcacatagaataacttcggtcattgatagtgatatggttctactacttaatcaaggacttattgaggagtatgattccccaacaaggttgctagaggacaagttatcttcttttgctcggcttgttgcagagaaaaaatccaccatctctaatggtggtgatccgaatatagaagaaagagatggtgaattgagtaagggatatgagactaaagagctttgcattgctggatctgaatttgataaagaagacacatataagtttgtcagatacaagaaagaagaattgaataaagatttccagttcaagattgaccaaaatatcattgtggaaaggttttttaacaacaagaatgttaactctaaatgggtgtctaaaattactgctgagaagttaaagcccaatgatgatgtaaaattgacacaaataatggatgttgtgaggttcaagtatgcttatggtgaagagcttgagtgtgtatgtgaagggaacaactacaaacttatattagaaagatcatcgtggttgttgctacctaggcaactattgattgttgttggtagagatcctaatgatcaacacttgcctatagcatttgttgtggtggagaatgaaacaaaggattcatggaagtggtttttggagcttcttatatatgatattggagacataaaagccaacaaatggttatgcattagtgattaa

SEQ ID NO: 93882 - DNA, 1649 bp, Glycine max
  Peptide Sequence Number=SeqID_210660
atggggaactcttcatttcaagggaaagaagattgccattcttcttcagagcttggtgcgtcctttacctctttgtttccggctggagtgagaaatagtactcttcaagaatctcttttgaatggtgattcaaatgataatgatgtgtttgggattaatgagaccaaggggggtgacactgataccccttactctaatgctggaatttttggcattcttaccttctcttgggttggtcctctgattactcttggaaagaagaagactttggaccttgaggatgttccccaactcgacaaaagagacagtttagttggagcatttccaacttttagggataagcttaaggcatgttgtggagcaagtaacacagtgaccacacttgagttagtgaagtcattagtattctcaacctggacagagattattgtcacagctatccttgcattggtgaacacattggcgacttttgtcggtccctatctcattgatggttttgttcaataccttaatggaaaacgacaatttgaaaaagagggccttgttttggtgtctgcattttgtgtggcaaagcttgtggagtgcctgacaaagaggcactggttctttaggttgcagcaggttggaatacgaatgcgagcactgcttgtgacaatcatatataacaaagctttgaacctttcatgtcaatcaaagcaaggacagaccacaggggaaataatcaacttcatgagtgtggatgcagaaagagttggtgaattcagttgtcacctacacgatctgtggttagtagtcctacaggttttagtaggcttgctggttttgtataaaaatcttgggcttgctacaattgctggatttgttgcaattctcattgtaatgtgggcaaacattcccttgggttcaacccaagagaagtttcacaacaagttgatggagtcaaaagatgagagaatgaaagcaacatctgagattttaaggaacatgaggattctcaaactgcaaggatgggaaatgaagtttttgtctaagataactaaactcagaaagattgagcaaggctggttaaaaaaagttatatacactttagccatcatcatatttttattttggtgtgccccagcgattgtgtctgtggttacttttggtacttgtatgctgatagggattcctcttgaagcagggaagatcttgtctacacttgcaacattccagattctccaagaacccatttataatcttccagagacaatttcaatgatggcacaaactaaggtttctcttgacaggattgcatctttccttcgtctcgatgagatgctatctgatgttgtgaagaagcttccgccgggtagttctgatatagcaattgaagtggttgatgggaatttctcttgggattcattttcccctaatataacattgcaaaacataaatctaagagtttttcatggcatgagggttgcagtttgtggtactgttggatcaggcaagtctactttactttcttgtatattgggagaagtaccaaagaaatcagggatcctaaaggtgtgtggaacaaaggcctatgtagctcagtcaccatggatacaaagtagcaccatagaggataatatattgtttggcaaggatatggaaagggaaag

SEQ ID NO: 93883 - DNA, 2421 bp, Glycine max
  Peptide Sequence Number=SeqID_210661
atgggttatggttacggtcctttctctcttctactaaccagacgcctccatctctattcttccctaaaccctaaaccctctttcccactctttcaccttctcaccaaacccttctccaccgcccctccagaccctaaccctaaaccctcttccctctccgcccgtctcagcttcgtcttcgaccaaatcgacgccatcgaaaaagagcgctctcagaagcacgaaacgcttcagcgcattcgagcctggcgtgaatccaagaacgctcccccttcgccctctcagaacgatgccccaccggagccggcactatccgtctccgcagacgacgaaagccctccggagccgccgccgaacaaggcggtggagttggtgcatccgtggccggagtggatccaattgatggagatgctggtgcaccagaattacttcgaccacaaaaggagggacgaggataaaatggtccacgacttagggttcaattcgcccgaggttgccgaaggattcgatttcaccaaggatttcaagagcgttcacatggcgtgtctctatttcgggagagaccgttttgatatattgaggtccttgtcaaggaaggatattcaagttttggttggttatggatgccctactgtggacagaaaggtggttttctctgcaaaacttttaaggaagcatgttcaccttgatgaaggagatgtctgtagttcctgcagcttgagaaacacttgtgaaagggggtatctgctaacaaacaaagaggatgaggcacagactcttgatgtcatgaggctcctgctgacttttggttttgatcctgttgatggatcagtcatcaataagtcacttctaaagcagaagtctgtgaaaacagtggttcgtaaattacttcatgaggttgtcaagctgagttcagttcccattgatccaaatcttcctcctccggtgattaaaaaaccaccaccaaaagtgaaacaacctcctcctcctccaaagagacgtgttggacgggatgatgtcgagatgaaaaaaggggactggctatgtccgaagtgtgaattcatgaattttgcaaagaatactgtttgtttacagtgtgatgccaagcgtcctaaaagacagttgttgccaggagaatgggagtgccccgagtgcaacttcttgaattacaggaggaatatggtatgcttccattgtgagtgtaaacgcccacctgatgaatttcttgagaataaaatgcaagatagaatacagagttccaaacctaagttggataagatgggcagccgacaagaggtttccaatgcctggaattttgactttgatgacaatgaatcagatggtgcagatgtagctgcttttgagtatgcagatactcatgctatagatgagaattcagataatcatgctcaacatgcaaatcatacgggatgggaagatgattttgaaaaaaacaaagtgcaagggtcccctgatggagaatatgctaatcctggtctttatagacctagaacagggtttgatgattttgaggatgaggatgatatagatagttatgagctagaaactgctcaaaatagtagtagaatggaagaatctaaatataatttctcagaaggtgaaaacttttctgaatctgaagatattgaagccactgatgataagatgcatgcacgacgcaaaacagcttctggaagaagtgcacaatcccgatcaattcgcaagaatacatctttctctggatccgatgatgatgaacttaaatttggtacagatgaacaactgtccgttgtctccaatttcaaatctgggcatgtttctgctgctgacagaaaaagaaaaggcagaggtccttccaagaaattaagctttggttctgaatctgaggaagagattggtgctggaaaaataaagggaacaaacgtgatctatccagacaaaataaggggaatagacacgattctggaagaaggaacttcaccaaagacagaaagtcaggatctattggcggtcgccaaacaaatatgttcagtgatgattttgatggatcatcccagcagtcttataggaacagtagggggtctcgggaaaatgaccataatcggaagagttttgaagattttgatggaccgtctcggcaatcatatggtgatggtagagggtcccgaggaaacaacggtaatggatcatcccggcagtcttacgggaatggtagggggtctcgaggaaatgaccgttatcgtccgagatttgaagattttgatggactgtctcaacgatcatatagtgatggtagagggtcccgtggaaacaagcgcaaaggatcatcccggcaatcttatgggaatggtagaggatctcgaggaaatgaccgaaattggcagagatttaaagacagggaaaatggaacgggacggttaa

SEQ ID NO: 93884 - DNA, 459 bp, Glycine max
  Peptide Sequence Number=SeqID_210662
atggattccatagaccaatctgtggcttgcaggggagaaaaccttaaggttcgcacaacttttacaaaacctgtagcttctgatgcctgtacccaaaatccctttttagaccctcggatgagaacagctcctgagaggactccacaaactgatacttctgcttcaagtagtgtgcagagctccttcattgatgataaagtgtctggcaaatatagtttcatggatcaaagttctcatggaagcagatcttttgtgcaacatgatcagatgacgttttgtgagaattctgtggagaaaaatgctgcaagtgatgtgcaagtattgctaagtgaaaaagtggatagtcaaaagctgggggaaactttgttgcacgagactatgaaattaactgaaataaccacaagcaagaaccccatggctgataagaatctcgaagggctaatcaaggaaacaaaataa

SEQ ID NO: 93885 - DNA, 204 bp, Glycine max
  Peptide Sequence Number=SeqID_210663
atggggagactgcctatcaggcactatttcttgcaagtattggtcttggcatgcttaagaaccttgtcaatcacgcatactcctccaaatacagaaagaaaggatgaagaagggaaaggcaaagagaatggagcaggggagaaggtgacagacgctttagagaaaagcctaggaaaaagaaaatctacgttggagtattcataa

SEQ ID NO: 93886 - DNA, 705 bp, Glycine max
  Peptide Sequence Number=SeqID_210664
atggcaccaacgaagaaacctagaactacgacgaataagcggttttcaagtttaagtgaggtctctcccaagaaagatgaagtcggctcaagtaaaaataagcaacgggtggctgaaaatgtatctagcagatctgttgaaatggtgaaggctcttcacagtatcagtcaggcatacctatctatgccaaaggaatcagcttctgctgttggcctaattgcaatgatgacagattactataatatggtggtatgtttctttcatgtatcaccagtccaacatgacagccatctgtgttgggctgctagaaagtcctatattgtctacctcaattattggggtgatgcttatatacctgttggacaacttctgataatgccaattggtttaagttcccttggcaaacctcgcaggttttcagaacgctttcttcatggagaaagacaaaaacttgaacagtatcgtgaatctgttcggaaatattacaatgaactgcggactggtatcagggatggacttccaacagatttggctaaacagttatgtgttggacaacgagtaattgctcttcactcaaaaacaagagagattcatgatggtagtgtgcttacagttgaccatgacaattacaaagttcagtttgaccgtcctgaattgggtgttgaatttgtcatggtaatacggtctcttattagcacatactga

SEQ ID NO: 93887 - DNA, 474 bp, Glycine max
  Peptide Sequence Number=SeqID_210665
atgtttgcttctgttgtggatggggcttgtgaggggagtggagtttcaggacccattttgattccacggcgctttgtttggccttatgggggaacaacggtgtttctaactggttctttcacgagatggtcgaaccatatagctatgtctccgatggagggatgccctgctgtgtttcaagttgtttgcaacttaatgccggggtttcatcaggaacttcatgatgattttcaactttcattaggagttggtatcagtaatttatgggtaaaagttggcatggccttcatggaaggcatgagagttggcatggcccctgctggagttgttggaaagagtggacaagtaaaattgatggttggatttgaagtgacaaaacatttgggtaatttccatcattttgactatggaggaagtcatgcgagcttgctttctcagaagcaggatggtcaactaggtggtagattagactaa

SEQ ID NO: 93888 - DNA, 1122 bp, Glycine max
  Peptide Sequence Number=SeqID_210666
atgacctggaaattttaccaggaagctaatcccaggatgcctgtgtctgatctggaggtctctcgccaccgtatatctgtattcctgtccacgcatactgcatataatttgcttcccgagtcaggaaaggtcattgccttggatataaatttaccagttaagcaagcattccatgttctttatgaacagggtgtatctatggctcctctatgggattttttcaagagccagttcgttggagttcttagtgcaatggacttcattctaatattgaaagagctggggaatcatggttcaaatttgactcaagaacaacttgagactcatactatagccgcctggaaagagggaaaatttcaacaattcagaacacttgatagtaatgggggatcatatccttggcgatttgttcatgccggaccccatgaatgtctaaaagatgtggctttgaaggttttgcaaaacaaggtgtcaactgtccctatcatacattcttcttcagaggatggttcatatcctcaactgctacatcttgcttccctatccggaatactaaaaggtatatgcaggcattttaagcactccttgagttctttgcccattcttcaacttccagtggcttcaatacctttgggtacatggatgcctagagttggggaaccaaatggtcggccactagcaatgttgatgccaagtgcttctctcggtgctgctttgtctatgtttgttcaagccaaagttagctcaataccgattgtggatgctaatgattcgttgcttgacatttattcaagaaggtttcctctagcatatatgaaacgtgcctattattttcttttcagcgatattactgcattggctaaagataaagcttatgctaggatatctctcgatgaaattagtattcaccaggcattgcttttgggacaagatgcaacctctccttctgggatttacaatggtcagagatgtcacatgtgtttgagatctgaatcgttgtacaaagtgatggagcggttggctaatcctggggttaggagacttgtggttgtggaggctggcagcaagcgtgtggaagggattatttctttaagcgatgtgttcagattcttgttaggctag

SEQ ID NO: 93889 - DNA, 291 bp, Glycine max
  Peptide Sequence Number=SeqID_210667
atgacgaagaaagcattctcaatgaacgttgagaaatctgaatcacagtcatcagtcaccttcagcataccccaagttccattgaagtctgaaaatggtgaaatgatggcaacggtggaggaagatgggcagtgcctaaaggcagtggttgaggagccaccgagaacctcttgtgatgttgtatctatggaacatcagcctaatataaattccaggaggcagagcacaagaaaccgaccgttgtcacttagagcgttggaatctcttgaaaccttcatccaaacaaactga

SEQ ID NO: 93890 - DNA, 126 bp, Glycine max
  Peptide Sequence Number=SeqID_210668
atgcaggatatcacagcagaatgtctggaaatggagagctttctagagcataagaagcaggatgggctttacacagaacgagtatcttgcaaaggattcaatcagccggtatactttaatggataa

SEQ ID NO: 93891 - DNA, 1101 bp, Glycine max
  Peptide Sequence Number=SeqID_210669
atggtggccacaagcacaaatcaatcagagttagaaacaagtaagaaggattccacttatgacagaatagctgaagtcaaagcctttgatgaaacaaaacttggtgtgaaaggcctcttcgattctgggatcacaaagataccacgcatgttccatcatgccaaggtggaggaccacactgaaaccacgccaaatgactcgaacttcagtatccccatcatagatctccaagatatagacacaaactcatcccttcgtgtgaaagcacttgacaagattcgaagtgcatgcaaggagtgggggtttttccaggtggtgaatcatggtattgctgttgatcttttggatgagatgatatgtggaatccgtaggtttcatgaacaagatgctgaggtgagaaaaagcttttactcgagggatatgaataagaaagttagatatttctccaatggtactctttatagagaccctgctgcaaactggagggactcaattgtttttttgttactcctgatcctccgtatcccgaagaaataccagcagtatgcagagaaagtaagggcattaggctttacaatctttgagctattctcagaggctcttggccttcattcttcttatcttaatgaattggactccgttgatggacaatatcttttgtgtcactactatcctccatgccctgaacctgaattgactatgggtacttcaaagcacactgatattagcttcatgacaattcttctgcaagaccagatgggtggtcttcaagttcttcatcagaatcaatgggttgatgttcctccggtgcatggatctcttgttgtaaacattggggatcttctgcagcttataacaaatgacatgtttgtcagtgtctatcatcgggtcttatcgaggtatacaggccccagaatttcagttgcaagtttctttgcaaactcatctccacagagttcatcgaaggtagttggtccaataaaagaactgttatcagaagataatccacctgtctatagggacactactgtaaaagatgtcgcagcacattattttgagaaaggccttgatgggaactatttgcaaccctttaggttgtga

SEQ ID NO: 93892 - DNA, 423 bp, Glycine max
  Peptide Sequence Number=SeqID_210670
atgtgtttgcatttatttgatggtcaatttgatttttttgacttcagggcacattggcaacttcttgtgttgtgtccacgagagaatattgtagtatggttttgttctatacggagaaagcatgatgttcacattaaggctacagttaacagcgcaatgaagaaaatatccattactttccaaggcaaggagaatggacctccacctcaatggattgaaccaaagagttatgtacaagccggagcctatgagtgtggatattatgtgatgcataggatgtggtgcatcgtcaccggcggtttgaagaatgaatggaacaagtgtttttctaatggaacaccattagacagtgacaccatgacgacattacgaaagaaatgggcagcctattttctacaagttggaaagatggatgtaaattag

SEQ ID NO: 93893 - DNA, 105 bp, Glycine max
  Peptide Sequence Number=SeqID_210671
atggggctagtttatcgtattttcatgagggatcggggtacgttctggtcaagtttagtccaccaagagggatctgaggatgatgcttggctaggattaggctaa

SEQ ID NO: 93894 - DNA, 369 bp, Glycine max
  Peptide Sequence Number=SeqID_210672
atgaattgcgttttcgttcatgcgtcctccacccacgagtttggagccatgcgtagtgattgcttagtgcaattctccattctctaccctttttcggagccaatgaattgcgttttcgttcatgcatcccccacccacgagattggagccatgcgtagtgattgcttagtgcaattctccattctctaccctttttcggagcccatgaattgcgttttcgttcatgcatcccccacccacgagtttggagccatgggtagtgattgcttactgcaattctccattctctaccctttttcggagcccatgaattgcgttttcgctcacgcatcccccacccacgagattgtagccatgcgtagagatagc

SEQ ID NO: 93895 - DNA, 372 bp, Glycine max
  Peptide Sequence Number=SeqID_210673
atgcgtgagcgaaaacgcaattcatgggctccgaaaaagggtagagaatggagaattgcagtaagcaatcactacccatggctccaaactcgtgggtgggggatgcatgaacgaaaacgcaattcatgggctccgaaaaagggtagagaatggagaattgcactaagcaatcactacgcatggctccaatctcgtgggtgggggatgcatgaacgaaaacgcaattcattggctccgaaaaagggtagagaatggagaattgcactaagcaatcactacgcatggctccaaactcgtgggtggaggacgcatgaacgaaaacgcaattcatggggctccgaaaaaatggttgagaatggagaattgcactaa

SEQ ID NO: 93896 - DNA, 200 bp, Glycine max
  Peptide Sequence Number=SeqID_210674
gtgagggtaggtccaccactggtgcagaaggctctgaagtggcctcaagagatctctcaggagtggcagcagctacatgtctcacctgtgtctcacctgcctcctcccctaaaacaaatggctctggaatggtggcctcagatgattcatcctccacttgttgtggtacctgggctgtgggacctttatcttccctgtga

SEQ ID NO: 93897 - DNA, 162 bp, Glycine max
  Peptide Sequence Number=SeqID_210675
atggcgaaatatattgaaggagtttggccaaattacggattagccccactacgttttaaaaaaattggagtgacccttaggtctcaataccctaattgggagatcgactttgataatatatcttatagaggagctctaggtgcattgtgcaagggaatttaa

SEQ ID NO: 93898 - DNA, 279 bp, Glycine max
  Peptide Sequence Number=SeqID_210676
atgtcaaactcaaacatcacaagttgtgatagttggagcttcactacagagaataataataatggagaagatgcagcagcaactgttaaacagcaattggagatgcttggccagctttatagtccaaattcaaacacttcaaccacaacaaataatagcaatggtggctcaaacgcagattcacaaccacctgctaagaagaaaagaaacctaccaggaaatccaggcatcttttcttttttcttttccctttttctttttttctttttatctccatga

SEQ ID NO: 93899 - DNA, 798 bp, Glycine max
  Peptide Sequence Number=SeqID_210677
atgaaggtgtactactacatatacactattacactaggacaatgtgcatgcattcacatacatagttcaattaatattttgcgtgacactttcacgtgtgcagatccaagtgctgaagtcatagcactctcaccaaacaccctggtggccacaaacaggttcatatgtgaaatatgcaacaaagggtttcaaagggaccaaaaccttcaattgcaccgtcgaggccataacctaccgtggaagctgaaactgagaaccaccactgaagttcgaaaacgggtttatgtttgtcctgaaccctcatgtgtgcatcacaacccagctcgtgcactaggtgatctcactggcattaaaaagcactttagcagaaagcacggcgacaagaagtggaaatgtgagaagtgctccaagaaatatgctgttcagtctgattggaaagcccattccaaaatatgcggaacaaaggaatacaaatgtgactgtggcaccatcttttccaggctcttttgtttgctgccaagacctaagccaggcaaaccaatgagtccatcaccaccccactcagccgaacctcttggattttcactctccacctcactctcttgtttcctcatgttaaaaccgggaggagtcgcaaacagtgatctgccaccattgtcatcagccctgttcactttcctcctatctccaattccaccaagaacagaagctccaccttttagtctctgtgtaaacctccaatcctcctttgagagcaaaggaggcggaagccggggattcaaattcacattggagtaa

SEQ ID NO: 93900 - DNA, 183 bp, Glycine max
  Peptide Sequence Number=SeqID_210678
atggaagaagggaatagagagagaagagaatttcctaaggaagagttctcaggatttggtggacttgagccttcgtatttgcgcttagtgcgctctgctcgctcaatgcagatgcatgttttcgcgcttagcgtgtgttgcgcacttagcgccggtgcttgtttgtgcgcgcctttggactag

SEQ ID NO: 93901 - DNA, 1332 bp, Glycine max
  Peptide Sequence Number=SeqID_210679
atggcgagagcaagttctggtctgcaatacccagagcggttctacgctgcggcgtcttatgtggggtttgatggatcctctccaaccaaatccctcacctccaaattcccccagtccaccgctcttcttctctacagcttgtaccaacaggctagtgtaggaccttgtaacatcacagaacccagtacatggaaaattgtggagcatggcaaatgggccagttggaaccagcttggaaacatgtcctcaactgaagccatgcgtctttttgtaaaaatattggaggaagaagatcctggttggtattcaagattatctaactctgttgtagaacctgtcgtagacgtgcaaatgaatcataattccaaagttgagccagtaattgagaatggaaactcttatccagagacaaagactatttctatttccactcaaaatggaagtgaagttggaacacaggataaagatactgttgtggaaggctttggttcagttgaagtatatgatcaatggattgcacctccagtatctggaggaagtccaaaagcccgatatgagcatggagctgcagtcgtgcaagataaactgtacatatatggtggaaatcacaatggtcgataccttaatgatcttcatgttttggatttgagaagttggacttggtcaaagattgaagctaagactggagttgagtccccaacaacttcaatcccttgtgctggccattcattgattccatggggaaataaacttttgtcaattgcagggcatacaaaagatccttctgaaagtatccaagtgaaagtgtttgatcttcaaatggctacatggtcaactccaaagatttttgggaaagctccggtatcacgtggaggccaatcagtgaaccttgttgggaaaaccttagtaatttttggtgggcaagatgcaaaaaggactctcttgaatgatcttcatattcttgacttggaaaccatgacatgggacgaaattgatgctgttggggtgccgccttctccaaggtctgatcatactgctgctgtacatgtggagcgatacttacttatctttggtgggggttcgcatgcaacatgctacaatgatttacatgttcttgatttgcaaactatggaatggtctcgccccatgcagctaggtgaaataccaacaccacgtgctggacatgctggtgtgacagtaggggagaactggttcattgttggtggtggtgacaataagagtggggtctctgagacgattgtactgaatatgtctacactggcttggtcagtggtaacttctgttcaaggacgagttcctgtagccagtgag

SEQ ID NO: 93902 - DNA, 912 bp, Glycine max
  Peptide Sequence Number=SeqID_210680
atgatctgcagaagagacagtttcgtcacccacagagctttctgcgatgcactgagtgaggagaacaacaagtgcaacgaagtgccaaagatgcatggttcaaacttgcaaccaccaataattccaaacatagttgcatcattaccaataatcaatgccaacaatcacaagaacccattttcactcccacacgacctcatgacaacaattcccgcaaaacccttcaacaacatggctgcagcattcacgagaagcctttcatccacctcttcaccctctcaactaagctcaaattcaccaaacattaatatgttggtggaaaatggtctcctttcacctcacatgtccgccacggcattgctccaaaaagcagcacaaatgggtgcaacagtgaatagtaacaacaacagcatgatgagtagtgatgaaaaaagctttattgtcacaagcatggcaccaccatcatatgggatcatgaaccacaacatgcacaatggtcaacaagacttgtcacaatataatttcaatgcgaatgggatggtggatggtggtagcaataatggcatgggaatgggtggtttggatatgtttaatgctatattggatcaaagtaaggccttgtcgaagatcatagagcagaacaacagaaacagtacttataatggtgttttgcatgcaatgaataatggtaagtcaagtgaccccattgaaggtggtggaactaaagggagtgaagctgtgaatcatgtgatgactttggacttgttggggataggaggtggtggtggagatggtaatttctatggtggtgatcaacagtcagaaatagctgctggagatggaatatggagaaattggtcaaataagaatgcagggcttgaatcattttcagcaacaaacagcactatgtga

SEQ ID NO: 93903 - DNA, 222 bp, Glycine max
  Peptide Sequence Number=SeqID_210681
atggttttggttagtttttattctgattttgtcattgagttaagacttggttgccaaaacagacactatggtttgttgtctcttggaagtcttgtatttagagtggttattgaagtattaggggacaaagttggggtgcccattaaggtactagtaaaaagagcgggtgataaattggtgactttgactgtgatcccggaggaagccaatctcgatgtgtaa

SEQ ID NO: 93904 - DNA, 384 bp, Glycine max
  Peptide Sequence Number=SeqID_210682
atgagccacaaatcaaccttgcaatccaaaataattgaaaattccataccagacagtgtttcagctatcccaaatgtcacaaatgtggagtctgaatttgaagcaggccatgattctaatccaccaaaatccaaaggtgatattgtatcagtcttgaaggctgagaaagaagagttggaatcatcactgatcaaggagaagcatcatgctcttcaactaaagcaagatctggcagaagctgagtcttgtaactctgacctttacaagcagtcttggttggcctcctctgtggctgctggtggggtttttttgcggctgcagaagaagactgctgacggtggtgctaaaccctacctggctctcataccaagtaaagagagataa

SEQ ID NO: 93905 - DNA, 3309 bp, Glycine max
  Peptide Sequence Number=SeqID_210683
atgaccgaattgcactctcatgacaatgccgcggttgctactgattccaagccggaggtttcttcgacggaagaatttagggttagtgtttgctccgacgctaacacatcatcatccaccgtcgataccgataagtttcacggtttcgatagcaaatcgctgttaccggaatttgacgagtacgtggctgctgagagacacgtgtcgcaggatctagggtttgagttcgaggtcggtgacatggtgtgggggaaggtgaagtctcacccgtggtggcccgggcacctatacaacgaagcgttcgcgtccccttcggtgcgtcgctcgaagcatgagggccacgtgttggtggcattcttcggcgatagcagctacggctggttcgaaccggaggagcttattccgttcgacgcgaatttcgcggagaaatcgcagcagacgaattctaggacgtttcttagggcagtggaggaggcggttgatgaggcctgcaggaggcgttggcttggattggcttgtaggtgtagaaaccctgaaaattttagtgccaccgatgttgaagggtatttttgtgttgatgtggaggattatgagccaggagggttgtattctgatggccagattcgaaaggcgagggatagtttcaaaccgagtgagactcttgctttcgtgaagcaattggcgattgctccgcatgatgatgaccaaggaagcattggattcagtaacaataaggctaccctttccgcttatcggaaggccgtgtttgagcagtttgatgagacttatgcccaggcttttggggtccagccgatgcacgctactcgtcctcagagtaatccactcgatcagcctgggattgtgaggcaccctcctagagctcctttgagtggtccactggtgattgctgaagctttgggtggtgggaagagcactaccaaatctgttaaagttaaggaggctttgaagaaggatagataccttcttaagcggagagatgatcctaataactctgtccaattagcatacaaggaggacaaatctgatgcagcggaccgttatgtatttcagaagagggctccagctgtgcctgtggcacctcataatttagaaaagcaagcagacacagaattttttagtcatgacggtgctgcttcaatttcagatgctaaagaagatttaataggtcaggttcaagcagatgactgtgatcttacatctcatgccatttcctcagatgtgaagccccatcttgacaaggggaaggagccttctgaagaagtgatccatagctttgaatgggataatgcttcaagtaaaagcattctaagcatagatgatgagatgtctcaaccatcacatctggagaatcaagattctgttgatgttaaacatgacgggaatgcaaaattatcgggaccatgtgaagattttaagcaaatagagcagggacttctgactattgctaatggagtaaatgacatgcatcaagttaagagcgaaaataatgtatatggttcgccagttgaagcaaaacatcacaaaattagtgcagtgaagaagaaaaaaggtcttaagagacccgcagatgagttgaactctgagacttctgctgttggggaggaaaagaagaaaaagaaaaagaatttaaatttacaacctactttaggctctcaggataaacattctacctttgggaaaatgatacacctttctggaaaatcaacagaaaatgctgtctcaagtggtttggctccaagagaggattttcctgcagaacaaggggaggtggatgttaatgcccgtaatttgctgcccatggataccacaggaaatgctaattttgaattggtgcaacttttgggagatttacaggcccttgctttaaatccttttcatggtattgaaagaaagatcccttcagctgttcagaagttctttctgcgattcaggtctcttgtttatcaaaaaagcttgtttgtatctccaccaactgagaatgaagctcctgatgttcgtgtcactaaacctccttccagtgtcgggatatctgacagtcctgatgagtatgtcaaagcttcaccggttgtgaagaaaatcaaggatataaaggcactagcttcagaaaaagcagtgaccaatcagaaaacttctgaagcctggcaggaagatggaaaagaatccatgtcccaggctccatccaagttagtgaaactagagtcgaacaagaaagtggactgtccagctaaggcagttgagcccaccatattaatgattaaatttcctcctgaaacatcacttccatctattgcagagctgaaggcaaggtttgctcgctttggtccaatggatcaatcaggtttccgtgtattttggaattcatcaacttgccgggttgttttcttgcacaaggttgatgcacaggctgcctataaatattctgtaggaagtcaatccttatttggcagtgtgggtgtgaggttttttcttcgagaatttggggattctgcacctgaagtctctgaagctgccaaggctagggcggatgatggtgccaacgaaacaccccgggtcaaggatcctgcagggattcaccgccagacactggtatcatcacagcaacctcttcttcaaccgatccagctcaagtcctgcctgaagaaatctacaggtgatgactcgggtcaggttacgggtaatggaagtagtagtaaaggaaactctcgtgtaaaattcatgttgggtggggaagaaagtagtaggggagaccaattaacgtcgggtagtagaaacaacttcaacaatgctagttttgctgatgctggcgcacctcctgttgcaacggattttaatagtaagaacgttcagaaggtcactttacaacccccgttgccgccaattcttccccttcctacccagtttataaaatccccacaacataatttgcgtaattctgaattggcaatggcaccccgaaacagccccaattttattaacaccattgcatcagcagctactgcaaccacagttgatatatcacagccaatgataaaccttttgaccaggtgcagcgatattgtgactaacctgacggtccctgacttttgtgtacctgaggctttgcgttatcattgcccggattacattcaccttccccctacgtgtggttttgggagaaagacaagcagcgcaccagagggggaggaagagcagatcgagatcgtgaaagagaggaagggaggaactattaggggaacagcgcaatttgtggtggtcgtgaaaaagattatctataaatctcaaaaagag

SEQ ID NO: 93906 - DNA, 846 bp, Glycine max
  Peptide Sequence Number=SeqID_210684
atgacaaggatgcaggacatattctgtaactacaacacctgtagcggctgcaatagcaaattactagaaaggcactttacagctgcaatgaatgaagctggtaggaaacagatggatattgccaaacagcatgctgctactgtaacagctactctaaatgctatgaatgcatatgctgagtgggctccattgtcagattttgctaagtctggcatcattcatggttgtggtgtactactatctgcaccagattttcgtcttcatgcttcggagtttttcaaacttgtctctccaaggaagaggcctattgatgcatctgcctctgaatttgaccaagctatgagcagcatctttcaaatattgatgaatgtatctagagaatttttgcatagatctggttcaggtcctgggtccatagatgagggcgaatatgaatttgctgaatttatatgtgaaagtatggtgtcactgggttcttataacttgcaaagtattgctggtgatagcaccatacttccactttaccttgaacaggtatgcgtcatatatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 93907 - DNA, 2376 bp, Glycine max
  Peptide Sequence Number=SeqID_210685
atgggtcttgattctcaggctcacagcatgatattcatcattaccatattgatattcctaacattgcaaaatgcagcaggaaatgaaaatcagattgagaaaatctcaggaatggatgagaatgacaacaagcaaactcccattgtggaaaacttcagacttttgcttggactcaacatgttcaacacaagaaggccatgctataaggttgctaactctgactttgagtccctctcaccttctctgtcacccaacaccgaagctgaggctccggttccggctccggagctgcatgtgcaacctcattcctatcacccacataggaacatgccacttcacaagattctacaaaaagatagaggcagggcaaaaagaacaacactagtagctgttgtagtacctggtggagttgctaccttaatttgtgcacttgggtgtgtatgtgtttgcaagaaattcagaaatcagaaaaggaaacccaataggacaatgccactcttcagtaagaacgaaagaacaggaggtacgtctacgtaccaaaatccatcaagcaatgtgagtttaaactctgcccctgatctgatttatctcacttgtttgaaacaaacttgtggaacacaaaatagcagcacttcaagccattgttcacaacaacgcacaatttatgagaagaaagtgttgcatcgagaagaatatgacaaggttagcactagtagttcttccacaaaggaaattctctctgtccatgaggatttggaatatgatggtggtggcaaagcttcctctggagagaaaactgttcttcaaggatgccatagcctttcatcagacagcgaaagttttcattcgtgttttgatacacattcatcaataagtgaaacagaaacactgtctctctctcctagaaattcaatctcttcaacaaatcaatttccttgctcccctcagaattcaactacaaaggtaaaaccaaaccagtcacaatcaccatgcattccaaaacaggaagagcaaaagaagcttgaaacttgtcaacctagcattcctcccccaccgtgtccacctccatttttgaaaggaaacattaacagtgcaatcaaaactccaccttctccacttcctcaaggtaagggtggaagttctccactgccaaaactcaaaccacttcactgggacaaagtaagagccacgccagatcgaacaatggtgtgggataagctacgaacaagctcatttgagttggacgaggtaatgatcgagtcactctttggctacaatttacaaaactcaatgaagaacgacgaaaccaagagcaaaaccccgtctccaagcaagcatgtacttgagccaaaacggtttcaaaacatagcaattctctcgaaagctctaaataccacagctgaacaaatatgcgaagccctgatactagggaaaggcttgtctttggaacaactagaggcactggtgaaaatggtacccacgaaggaagaagaggctaagctcttaagctacaaagcagatatcaatgaactagggtctgctgaaaagtttgtgagagcaatgcttagcgtaccatttgcctttcaacgagtggaagccatgctttacagagagactttcgaagatgaagtagttcacctcagaaactctttttcaacgctagaggaagcgtgcaaggaactaaggtcaagcaggttcttcttgaaattgctcgaagcagtgctcaaaacaggaaatcgcatgaacgttggaacaatcaggggaggtgccagagccttcaaactcgacgcccttctgaagctagctgatgttaaaggaacagatggtaaaaccaccttgctccatttctttgttcaggagattgttcgctcagaaggaatcaaagcttcagagaggatcatggggaaaacaagtgaaaacagaacagaagaagagaaggaagaagattataagagaataggactagaacttgtttctggtctgagtgccgagttatgcaatgttaagaagacagctacaattgacttggatgttcttgcaagttccatctcaaacctatcaagtggagtggctaacatggagaacctagtaaagggtctgttgtgtgaggatgaaaagagtgagagctttgtcatttctatgaagtggtttttgaattatgcagagagaaaggtacgggacttgcaaggagatgaagggagagtcatggctcgtgtcaaagaaataactgagtattttcatggggatgtgagtaaagaagagtcgaatccacttcgaatctttgtgatcgtgagggactttctggagatggtagataacgtttgcaatgagcttaaaaggtctacgaaatcacctcgcaccattcggatagagtag

SEQ ID NO: 93908 - DNA, 225 bp, Glycine max
  Peptide Sequence Number=SeqID_210686
atgtcgatttttttgaccattagaggaatgggattagatcgaggaagaaaaggaaagggggttgaaagtgtcacattaacaataggatgcacacctatggctatggataatgatctggttttgacagctgcttgcctgctacctaaaaccttatgtatgtcgcattcccaatctgtgttgcaattgcattcaagagggcaattcaattgtgtcaggctgaattga

SEQ ID NO: 93909 - DNA, 861 bp, Glycine max
  Peptide Sequence Number=SeqID_210687
atgcgtctgctctattcttatagagttagtccggttccatcgtctggtgtatctaaggaagcttctgcggctgctggtgatgagtctaagccacatgattgttttggcaaagatactattgcaaatgcagctgctaaagttggtcctgctgttgttaatattgcaattccacaagatttttttggtattactagcggaaagagtataggttctggaacaatcatcaacaaggatggaacaatcctgacagctgctcatgttgtggttgattttctaggcactagaggttcgtccaaagggaagattgaagttactttgcaagatggaagaacatttgaggggaaagtcataaatgctgacctgcattcagatgttgctattttgaagattaattctgaaaccccactgccagaagctaaatttggttcgtcaagtaggctacgtccaggggattgggtaatagccatgggctgtccactttctcttcagaatactgtcactgctggaattgtaagttgtgttgaccgcaaaagtagtgatctgggttttagtggcatgccaagagagtatttacaaaccgattgtgcaattaatatgggaaattctggagggcctcttgtcaacatggatggagaaattattggggttaacatcatgaaagtggccgctgcggatgggttgagtttttctgtgccaattgattccgtgtgtaaaattttagagcatttcaagaaaagtgggagagtaatacggccttggcttgggctaaagatgcttgatcttaatgagatgattattgcgcagcttaaaaagcaagatccttcgttccctaatgtcaacaaaggcattcttgtaccaatg

SEQ ID NO: 93910 - DNA, 1245 bp, Glycine max
  Peptide Sequence Number=SeqID_210688
atgttggagccaattttgatatcttttgacagctctcaggattgtttcaagtcttcatggagctcgcacaaatcagtgcatctgaaggcaaaactatccccacctggcacacaaaattcagactcacttgatgaaggttggttatattgtttgaagagagggcaggctcgaacgccaaagcttcctcactttgattggacaggaccactgcagccatatcccatttctagtaaacggattgtcccagatcaaattgataaacctgattgggctggtgatggaacacccaaaattgagcccaatagtagtctacagcataccattgaggtcaaaactccagatcaaatagagagaatgagggaaacttgtcgggggagaagtgttagtgaaagagggaaaagacagcataaagttaaacagagaagagaaaaaaatgaaacagagaacacagagaaaaagaaaagagtgcataaaaacaagaaaggaaacctgcaggagtggaagacagggaggattgcaagggaggtgttggatgcagctgctcggattattcagcctggtgtgacgactgatgagattgacagagttgttcatgaggcaactattgctgcaggaggatatccatcgcctctcaattaccatttcttccctaaatcttgctgcacgtcagttaatgaagtaatctgtcatggaattcctgatgcaaggaagcttgaggatggtgacattgtaaatgttgatgtcactgtgtactataaaggtgttcatggtgatctcaatgaaacatactttgtgggaaatgttgatgaagagtctctccaactagtaaaatgcacatatgagtgcctggagaaggcaatatccattgttaaacctgggatacgattccgtgagattggtgaagtcattaatcgtcatgcttcaatgtctggattctcggtggtaaaatcttattgtggtcatggaattggagagctcttccattgtgcaccaaacattcctcattattcaagaaataaagcagttggtgtgatgaaggctggacagacctttacaattgaaccaatgatcaatgccggtgtctggcgtgatcgaatgtggcctgatggatggactgctgttacagcggatggtaaacgaagtgctcaatttgagcacactcttttggtgacagagactggtgttgaagttttaacagggcggttgcagacatcacccaatgtttttccttggctaggttcataa

SEQ ID NO: 93911 - DNA, 202 bp, Glycine max
  Peptide Sequence Number=SeqID_210689
aactacgtaggtctgagttcctcattgaggatacgtaggagcaagagcctcgcatttgtcggccgccccacaatttctgtcatactgacactggagtcacgtgacatgcggagatacccgagtggttatccaggcggcgggcccgatgacatgcgggaaccatttggtctcacactttcttttgctatctataagactcaaa

SEQ ID NO: 93912 - DNA, 882 bp, Glycine max
  Peptide Sequence Number=SeqID_210690
tcatctcttcaagagatcactatcattgcaacagaaccttcttctctacctcttgatgcttcaaatgaaattggtggaaaggcagttgaacttcgaagttatatggacccaaccaaagacaatgatacgttgctgcacacccaactgtggatagatcctaaagaagaatttttgcagtatgttcatactggagatccaatagatgtgacttttagtgtaaaagaactgaagggctgtgaagttgacctccatttgcattttgagaaagctggcgaacctattcttatggcacctaaatttggtttggaagatggatctcactcaaattttgatgccacccttgtactggctaccatgttgatttctcagcttcatgagggggctgcctcagaacctcttgcgggggccaccagaacacaccctcatactgaagaaagaaatgcatcttacatgcagcaagagaactgcagagcaaatgtgtcatcagagcttccatctgatcacacccgtatttggtctgacctctcagcatttctatcacgatttactgtcctccatgatgctgtggctgcaaatgttataattgctttctttacatctgttacctggttgaattctcagagagcatttacaaagtatgggatgctcaaaccagacactaggtctaggatctctaccttgactgatattccagaccaactgaaaaggatcatggacaagaacctcaagtacatttatccagatgcgatgcaagataatggtcaagcaatttcacaacatcaccgcagtaattgggtagatgctgaagaggatgatgaagatgaacaggatgaagatgaccagtatattcagccaacacctccatactatgaagaacattaa

SEQ ID NO: 93913 - DNA, 492 bp, Glycine max
  Peptide Sequence Number=SeqID_210691
atggcaggaatgggtcttttaaaactggttgcaaataatgctgccgttactctgcaaaaccaaagcaagaaggaacattgtaatcgtaagctccgaagcttcatgatattccaacaaccttcaaagacagagaagaaagaagaaaacaacctcaacaaacaaacatcaatggcaaacacgtattcgtggctcttcctcgcgatttgtgccaccctcttgcttcttctgtcttcgtcgccgacagcggacgcgggagcgctgggcatggaaatgacatggataccctccatgcccatggaagaggagttccagctggacagcgagatcagccggcgcatcttagccacgaccaagtacatcagctacggtgcgctgcagaggaacactgtcccctgctctcgccgcggagcctcctactacaattgccagcctggcgcccaggccaacccttacagccgtggctgcagtgccatcaccaggtgcaggagctaa

SEQ ID NO: 93914 - DNA, 237 bp, Glycine max
  Peptide Sequence Number=SeqID_210692
atggacaaatggataataattgcatggatctactttctccttctcaacaagtcaagtgacttctcttgtatcaagtatctcaattttattgttggtactacaactgttagttggatgtcgcaaatacagaagattgttgttttatccactacagagattgagtatgttgcagtaacagaagccactgaagagttgatatggcgtcagggattgttaacggagttgggattcgtctaa

SEQ ID NO: 93915 - DNA, 318 bp, Glycine max
  Peptide Sequence Number=SeqID_210693
atggcggtgaagtgctccgccgtggctaaagtccgattgctcgctaaaaattttgtgccaacaaccgcgttccgacggagtccggtgctatgctggttctcgttccacttctccggtgcaacaatccgtgggcacaggaacacgcgatcaccacaatatatctctgttgggtacaacctgtccagcgccgccgcaactaccgtgccggtgcatgggaagactctagtccccactgatgtctcaatctggaactcgcctccgccgttgagcttgacgattacgagggcgtcaagactggatctggaactcgcagactag

SEQ ID NO: 93916 - DNA, 441 bp, Glycine max
  Peptide Sequence Number=SeqID_210694
atgggggagatttatccaggattatctcgattttcaaaatttaaccaacaaaaaggagactctaagaattgtgaaacacagagaaacaagcagaaagaaaagaaagctatagagggtcattcatgcaacaagggagtttgtaatatgagtgcagtacagaaagggcaaaacaataaggaaggtgcaacagaagggataagtagaagccaacacacagatatgcacgctagtgaagcaaaagaactttgggagaatgcaaaaagtctaggtgctggggtgaaaaaagatgaaaaaccagttctggaggtattaacagatatggaaagaagagatagagggagactacaaaaagaagacaaagtcaactcggaggggttgaaaaagttattctataaagatcctttcatacaacataagggtagtgccgggaggagaagttaa

SEQ ID NO: 93917 - DNA, 2002 bp, Glycine max
  Peptide Sequence Number=SeqID_210695
catggccatggtaggcggaaccatgatggctgcgtatttgcgtgtatccatgcccacttccccacagtcccccaccactacgaggaggagatgcagaaatctgaaaacttcttgctccgttaacagacccaaaattccaatgccccctctcaaccctaaagacccctttctctccaagctcgcttccgtcgctgcttcttcccctgaaacgctcctcaacactcccaaaaactccgacacccttccttatctcgacatcttcgactcccccaaactcatggcaactcccgctcaagttgaaaggtctgtttcatacaacgaacaccggcccagaaggccgccacctgacctgccttcgctgcttctccatggtagaattgtttacattggcatgcctttggtgccagctgtcacggagcttgtcgttgcagaattgatgtacttgcagtatatggatcctaaagagccaatctatatttacataaattccactgggactacgcgagatgatggtgaaacggtaggcatggagacagaaggttttgccatttatgatgcaatgatgcagttgaaaaatgagcagatacacacagtggcggttggatctgctataggtcaagcctgtttgctactttcagcagggtctccgggtaaacgctttatgatgccacatgctaaagccatgattcagcagcctcgtattccttcctctgggttgatgcctgcaagtgatgttcttattcgtgcaaaggaggtgataattaacagggacaatctggttaaactactggccaaacacacgggaaattcagaggaaacagttgctaatgtgatgaagagaccatattatatggatgcaacaagggctaaggaatttggggtcattgatagagaaaaggttatggcagatgttgcttctccagatgactgggacaagggtgctgggggcggatgcaaaggtgactgctgcttgaaatttggccgtaagaaccaagtagatgactgctgcttgaaatttggccgtaagaaccaagtagatgacatctccccattatccttgccaccattaccggtcttttcgaagcgttactctccatcatcatcttcacctatccccaaagccactccctctcacttattgtcactgttgggttccaaaactcagtcctcagccgtgaatcccgtggtagcacgcggcctcaaatcatgcttcaaattcctcgttcctttctctccagtgcagcctcgtcaccggaaattgggtttgggcctgcccaaactcactgtcccaagtcagagagaggagaacgagcttatttggtggccgccagagcccgttttggagctggcgcgtctcgccgtcgattctggcggcgaccccgccgctattcatcgccttcttgacccaaccattatcccgcataggtacctgattgtgaaggatcaaaggaagagcgctgtgagctcaccagaactcgctatggcagacgcttcgtttgaactgaacctgtatctgcagtttttgtttgaactcattgttgatcgaggtccatctgttgggttggatgttgccttgaaccggtttgatctgttccatggtcacctttttctagcgctagactctggaagacttgaatgcaacaatttcacatttggcagattccatgcgaaggaatacccagcatatgataagcaagtgttcccgtacaatatgggtttttgtcagagagggtccaatgtgacatatgatgattcaatgaatctgagaaatattctctggctggctccaatgcttggcgattctggtgaattttgggtggcaccaggtgttcttgtagtgctggatgcttgtcccgatggaatcatatacagagatctaatacccgattatgtaaattttgcaaggactatatatgaagatgatcttggggatgttgctgttgatgtgaactacttgaatgttggatctgaaaccagaaattatcaaatattcatatgctga

SEQ ID NO: 93918 - DNA, 1404 bp, Glycine max
  Peptide Sequence Number=SeqID_210696
atgccccttctcgatcgcggtgatgtttggaagagcaaggcgcgatccttgcagctacagttccgggaccgtttccgggtcgccgtcgaccaccattggcgccgccgacaccaccacacctttatcccctctgccgatggctacttctcctccaccattcaacgctgcctcagccgatttcgtgatttccgaagggattcattgccttcttccacctctttctatcgtaaacgagtgattaaggatttcagttctgaggaagattcagctcttgttcgtacgatgcaagctgttgcggttcctgttcttggaaatgtctgtcacgtgtttatgaacggattaaaccaggtgcaggtgtatggtttagaaaaactgcactccgcgttgctgcatagacctaagggcaaacctcttcttacggtcagcaatcatgttgcttccatggatgatccgcttgttatcgcttcgctgcttcctccgagtgttctcttggatgctaggaatctcagatggactctttgtgccactgataggtgttttaaaaaccccgtgacttctgcattctttcgatcagtcaaggtcttgccagtttctcggggtgacgggatttatcaggagggaatggacttggccctttcaaaattgaaccatggtggttgggtccacatattcccagaaggtagtcgctcccgggatggtggaaaaacaatgggctcttccaagagaggtgttgggaggttagtcctggatggagatagcatgccccttgttgtcccatttgtacatacagggatgcaggagattatgcctgtaggtgctaactttcccagaataggcaagatggttacagtgctcattggtgatccgataaattttgacgatatacttgaatttgacatggagaagggctcgaatgtgcccagaagacgactatttgatgcagtagcatctagaattggtgataggttgcatgagatgaaggtccaggttgacactatcgccattgaacaagaaatgcagctacaagataactcctcacacagcactgaccgaacatctgaaatattgcagcaggttgattgggaattatttggaatggatagcttcatgtctgtagaagatgattccaagcagagacaagaaacagttctcctccgaaatgttagtgtttctcagcatcatcaaaaatctcatagtgatcagagttggagagctgggttctcatacaggatgcgtgattatattgatcagatggagcttgtgtcttttgctgcgagaggtatatttatgaataatgaaacgaagaactctgctggccgtagcagagagatgggccccttaaaggcatggaagcagtttttggaagctaatctattaaggcagtggaattacgtccattactga

SEQ ID NO: 93919 - DNA, 204 bp, Glycine max
  Peptide Sequence Number=SeqID_210697
atggagggtgagcgttcgcggcggcgcagggtcgcggaaaagcagtggcacggggtcgcggcggcgagctgtgtttgtgagtgggttgcgggctcgcggcggagagtggatctttgtggcgctgtgcctgagtgggtcgcggcgtcgagctcgagagtgactcaagttggatccattgtagttcgagttgacacatcggtttag

SEQ ID NO: 93920 - DNA, 558 bp, Glycine max
  Peptide Sequence Number=SeqID_210698
atgcttattctgctttgcattctccacatcatcttgaatggcccaactctctgccttgggaataaggttgaggacaaaattttgaaagttggagaagagctttggagagaaactttgccattacaaggtggctcttgcttttatcaattacagggtctaaaaccccacacgtggtatgaagtgaagatatcatatccagcttctatacctgctagcttttccatacaactgaagagaaacaagtcagatgtggtgctgaacaataacaggagattgctcaacactgaaaagctaatttttaagaccaatagcaatcaggatgaattcctgttagtattagtaactgtggagccagaggggtttcctgcaaaactgcatgtagcagagaggcaatttattatcttcaatataggcataccccacaaagcttggtgggtagtggcactggctttactctgtctaggaattgctttcatcgtgccttcttttcttccattgcatttgctaccaaagaaccaagtcttgaggacagatgattatgtttctaaaatttcttga

SEQ ID NO: 93921 - DNA, 531 bp, Glycine max
  Peptide Sequence Number=SeqID_210699
atgaccactcttacacagatatggatgacgttgctacttagcaacattccgtccagcggccacaatacggatctcccttgcggaggtatcagttggtctgtgtcgtcccgacataggaatcacacccacaaagacacccagtggaccaggagaagtccaacagggccctggggtttccagctctggttacgggcctctgttagtcctacagggtgcccgttccccccagcaaggtcacgccatcatgacatagggatcgcgcccgcaagacacccagtggacccgaagaagtccaacagggtcttggagttgccaactctgattacgggcctctgtcagttctacggagtgcctgtcgcctccagcaaggtcatcaggcccactactaatcgagctttcatcaagaagtactacgcccccaggcaggcgcagggtgaaacaccacagcagcctggggatggccggcaacgggcaacagatgcaccgccaccacctctagagttcacctcagctcatccacaaaaaggttag

SEQ ID NO: 93922 - DNA, 438 bp, Glycine max
  Peptide Sequence Number=SeqID_210700
atggggacgctgagattcaacgcattggtgacaaaatgggtggtggtaccgatatgttggaagaggaggaatattcttgtgggatctggaagagggtgtggagaacgattctgccttttggattatggtgagaaattctttgacgcaatggctcattctgatgacgctaatgcacggaggaggaccttttccggcaacaatagagaaacaggaaggaggaggggtacacaaaaatactcttatccactggaaaatttacccaaccgagaaacagcactatatacaaaaaccattcccccactgctaatggtcattggccaaacaagcaaaagtgatcaacaaagagcatacaatttaggaatgaaaaatagggaacggaaggaggtaggcaaaggtaaattattcgagattgttgaaagaaacataatacaattttaa

SEQ ID NO: 93923 - DNA, 1155 bp, Glycine max
  Peptide Sequence Number=SeqID_210701
atgcagtgccccaattgtcgtaaggttgaaaaaggtcagtggctttatgctaatggttgtcgatcatatccagaatttagcatggatgaatggacacatgatgaggatctatatgatcttagctactctgaaatgtcctttggagttcactggtgcccttttggtaacttgacccgacttccttcatctttcgaggaaggggatttttcttcaactgcgtatgcagatcatgatgtactgggacaacatgctatatttgctgaacatacggctgtatcatctgctagtcatccttgcccatatattgcctactttggaccaatacatccctccacctccaattctggtggaactgtttccgaagcttctaatttcaaccactggaatggtccacctgtacctggtgacatgccaacctcctacacatttcctgcagtggatcttcattatcacagttgggaacacaattcctctcatttctcttctgccaacagccgtctaggcactgcagaacaggcctcagtatcacctggtagtcaaaggcctgccagggttggttcagaggtccctagatccgggtcttttatgcatcccttccttgttggtcacagttctgctgctagggctggaaactctgttgcatcttcaatgatccctccttatccaggcagcaatgctcgggcccgtgatagagtccaagctcttcaagcatattatcaacctcagcaacctcataattctaccacaatacggacacctgttgcttctagcactcgaagatccagtagtcatagtgggcctgttcaattagcaccagtggcctcgccaccagaccaaagtgctggcttcgtatatattccatcaggttcttcaggacgcaattttcaggaagaaacccatttgccaagtcgattccatgcttgggaaagagagcacttgccttcattggcgttaaacaatgttggtagagaatcaagttggagagcataccaccagactgccagtgtgtcagacccaactattgtggaaaatcaaaatttatgtatgattgagaaacgttacataatgcttttagcctggctggcgtgttatgacagactttatactctggctggccttggaattcatctttctggcagccgtgtggcagtgtga

SEQ ID NO: 93924 - DNA, 516 bp, Glycine max
  Peptide Sequence Number=SeqID_210702
atggaggttgatgaaaagccaacggaggactacaatgacattggtggtttagagaagcagatccaagaatgggttgaaactattgttttgccaattacccacaaggagcggttccagaaatttggagttggtccaccgaagggagtgctcttatatggacctccaggaactggaaaaacactaattgcccgtgcttgtgcagcacaaacaaatgccacttttctgaagttggcaggatataaatatgctttggttctagcaaaacttgtccgcgatgcctttcagctggcaaaagagaagtctccatgcattatatttatggatgaaattgatgcaattggaacaaagcgtttcgatagtgaagtaagtggagacagggagttacagcgaacaatgttagaattgctcaatcagcttgatggttttagtagtgatgatcgtgttaaggtgattgcagcaacaaaccgtgctgatattcttgatcctgcccttatgtgttctggtcgattggattga

SEQ ID NO: 93925 - DNA, 957 bp, Glycine max
  Peptide Sequence Number=SeqID_210703
ttaatgatcttggttgatgatgctggagggcaatggccaatgattggtcatgcgccatggaatggctgcaaccttgctgattttgtcatgcctttctttctgttcattgtggggatggccattccacttgctctcaagacatatttgtggggtgaaagacaaaacatcatgctttgttttgatataatggatgacctcaataatgaaggtggtttctctcatgctccggacaatctaacatatggagttgacatgaaacatataaggtggtgtggcattcttcagagaattgctctagcatatttggttgtagcactggtggagatattttcaagaagtgcacaggctagagatccagaacccacccacctctcaatattcaagttgtactattggcattggctagttggggcatgcatacttgctgtttacttagctttactctatggaattcatgttcctgactggcaattcactgtccataacccagacagcatatataatggcacaactttaactgtgacctgtggtgtcagagggaaactggatcccccttgtaatgctgtgggatatattgaccgagaggtgattggaattaatcacatgtataagcgtccagcatggagaagatccgaagcttgcaccgagaattccccatatgaaggtccttttaaaaaaaatgctccttcatggtgttacgctccttttgagccagaaggcattttaagatgtataacttgttcctctgttcctaatagcaatgtcatgtgcaactgcagttcaatatctgctattctctccacaatcattggattgcattttggacatgtactgatacacttacaggatcatccttccaggttgaagcactggcttctcctaggcttagctctccttacttcaggacttattcttcacttcactcatggtgtcaactctaaacttactgttgggtga

SEQ ID NO: 93926 - DNA, 1710 bp, Glycine max
  Peptide Sequence Number=SeqID_210704
atggtgaagcactacagacccccggggaagaaaaaggagggaaatgctgccaaatttgtcattaggtcacaagcaatcaagcagcttcaaatcagtctaccccttttcagggagcctaagaaaaagttcaagggaactcatcagacttattaccatgtcaaggatgtttccttccttcatcacgagcctttggttgaaatacatagagcaatacgagtgcatgagaggaaaataaagaaagccgaggcaaagaaaaaccatgaacgtgcaaacaggctgcgccagaaaacacccaaacccaagatcgataggattattcggcagaggtacccgagatttgtggatgcacttggagaattggatgactgccttacaatggtgcacctttttgcagcattgcctgcatcagagagtaaaaaaattgacgtggagtgtgtccataaatgtcgaagattggcacatgaatggcaagcattcgtatctcgcactcacaagttaagaaaaacatttgtatctgtgaaaggcatatactaccaggctgaggtcgagggccagccaataacatggttaactcctcattcactacaacaggttgtatccgatgatgttgacattactaccatgctaaactttctgcaattgtatgagtatccccccatacttgatccctcggttggaagctttggcagcaggtatgccagtgccaataccagaccctctgtactgaattctgaagcttctcaagctgaatctgaacaagtggagaccaagcaaaaggaggcagagactggaaatgaaacatctgaactaagacttgctcaacttcagcatcaacttccttctaatgaacctggtgcactaatgcatcttgttgaggaagtgactggtgaagatgaagaggatcaggatacaaaagactgtaaaaagctctttaaaaatatgaaattcttcgtaagcagggaggtaccaagggaatcgatgctttttgttattcctgcttttggtggcatagtttcctgggagggagaaggggcaccttttggggaatctgaccagagcatttctcatcagattgttgacagggaagcacaaggacatcggttcctctcaagagaatacgttcaaccacagtgggtatatgactgtgtgaatgcacgaattattttgccaactgacaattatttggtgggaaggactcctccaccacatttgtcaccttttattaactacgacgaagaaggagcatacattcctgattatgcaaagaccattaaacacttgcaagctgctgccagaaaggaaatccttccacttccaggtgttgggaaggatgctctggaagatcctcaaaatcttctggttgaaggtatcattgatcgagcagaggctaatgatgcagctcagagaaagcagaagatgatgattctggagcagcaataccgtgatgatttgaaaaaagaacttcaaggtattacatgtacctcagcaggttctatagaaacatctactgaagtggtacagactggagaatcaactaccagtgttcatgaaaatgttgatcatgatgacatgggtaaacttatgttgtcacgtaaaaggagggggctagtgaaagccattgagaaatctagggaacggaataaagctcagactgatctcattaaacaacggaaaaagaaaattgatgaagagcaacggcaaaggagttga

SEQ ID NO: 93927 - DNA, 1337 bp, Glycine max
  Peptide Sequence Number=SeqID_210705
gacttagctgtgatggaaagcatgcaattggctttagagaatgttgtaaatgcagcttttgatggatcaaatgactttaccaagacaaatgctgaagtccagtttgcattatgtagaacgtttgaagctgccttcatagcagtcaccttggcctgccttagttatggcttatttggactacttgttgcgttgaaggagggtattgctgatacaatgggatgtttgcaaagggagggtcgtttgcttcagggagagcataatcttttaggcgaagcatttcttgttatgtcttcttctgctgggatccaacagcaacaagatgttttaaggtggttactagaacctttaagcattcagtggacacaattggagtggcaggataagtatttgtcaggtccacacggtttggttcagttgtgctcagatgtgcctgttatgtggtcaatttttcatacagtgacattctttgagagggcacttaagaggagtggattgaagaaagccaattggaattcagaaaacagctcaacaccaaattcaattcctttaaatccaatggcctctcacatatcatggatggtgactcctctcttgaaactacttcgctgtatacattccctttggtctccatctgtaagtcaagctttacctggtgaggtcagagctgcaatggtcatgggtgatgttgagaggttcagtcttcttggagaagggaactctaaattaccaaagggtgtcacagatggatctaagattgacatgaataaagaaggatacgctgaacccaatgaatcagatattcgaaattggtttaaaggcatcagagacagtggatataatgtattgggcttgtcaacaaccgttggggattcgtttttcaaatatttggatgtgcactctgttgctgttgccctaatggagaatatacagtcaatggagttcaggcatataagacagcttgttcattccactttgattcctttggttaaaaattgtcctttggatatgtgggagatttggctggaaaagcttctacacccattttttgtccatgctcagcaagcacttagctgttcatggtctagtcttctacaagatggtagagcaaaggttccagatgctcatggcattcttagtggatcagacttgaaagtggaagtgatggaggaaacaattctgagggatctcacgcgtgagatgtgttcactcctctctgccatagcttctcctccccttaatactggaattccttctttggaacagtctgggcatgtttgtcgattagatatgtcttctctaaaaaacttggatacagttgcatcatgctctatggttgg

SEQ ID NO: 93928 - DNA, 393 bp, Glycine max
  Peptide Sequence Number=SeqID_210706
atgagtacctcatcctccaccgcttcaaccagaatcagatatgcaattgtgagaccacctgcaatcaagcaatttagagtagctttccacaatgaccagacattcatagagatacccccattttaccatgaacaatgggcacccaattacccagacaaagttcggttcaaatacaatggagcaacctacccaatacgggtccaacaacaccgaggcagatatttttttgcagacggactctcagacgtcagggcagatttaaaaatctatgagtctattatcatcaacttctttgcctgcaatgataacaccatctttgatctacattttacacctcccctgaatcaacagacatgtggtagaccaatacttcattcccgtgtacatgcttag

SEQ ID NO: 93929 - DNA, 663 bp, Glycine max
  Peptide Sequence Number=SeqID_210707
atgtgggcccatacgctaagcaatccttatctcgacgtgaacgccgatccatgtggccacgtcaaaggctccaactttgatcacaatcgacggttcagatctcccttaaccccaacaagttgttcgacttttaacgctctggcatcgttaaatatgacctctgtggggcgtagttgtatctcttactccgagatctggtcatcgttgggatctccatacgccggatctgctaaaatacgcttgatccatatgggcctcctcgaccacttgtgggacgacaccgtcgccggcccaaggccggaaaacggtctcggcaagctccgaaaacaccacaccttcactttccgacctagctccggcaaggaaacggagggcgggagcgtgagatcgtacggagacgaatcgtcggaggaagcgacgagagtgacgcgtagtatcatgatcgtgaaaccgcccgggtaccagagtggatcgcctccggtttctcccgccggttctactactccgatttctccgttttccgcacttcagctcaacccaagtgtccatttctcacaactaggaggaaaagattcgtttcggtttcgaagaaggtcggcatcagatgcgtacgagaagagagggcagaacagatcaggcccttcttctcctttcgatgtgtga

SEQ ID NO: 93930 - DNA, 687 bp, Glycine max
  Peptide Sequence Number=SeqID_210708
atgaaaagcaagactttttgtagagtggtaaagaagaaatcaacagagaattacaagggagctccatatataacgacgttcttgtgcacaagtttgtggacttcttatggagttcttaagcctggtggtttccaaatcgctatagtaaatggtgctggtgctgtctttcattgcacctacataattttgttcctcgtatattcacctcaagatcagaaggttaagacggcactttgggtggctattttggacgtcggttttctagggacagtcatttcagtaactcttttcgctcttcatggaacgatccagcttagtgttctgggaatgttttgctccggtttaactataatcatgtatgcttcacctctattatccatgctcacagtttatgtagtttacaaaaagaagcaaccagaagctacaaagggaccaagggtgggcctaagcctgggaaaaggagcatccaactacgaagaggcccagctcaaggatgagactgtgaaagtggtagtggtcgagaaggccctcaaaaaggttaaaagccttccaaagccagttctgaatcacgaacacatcctcaagaagacactctcttttggggtaaacaatttaccctccactttttggagtactaagcctcagcaggaggatgttgccgtggacgcagaggaagctcaagtttaa

SEQ ID NO: 93931 - DNA, 720 bp, Glycine max
  Peptide Sequence Number=SeqID_210709
atggattatactaatatttataaattaatgcatgcagccattctaggagatttcttcgttggcataggtatggggtttgagaactcagctggtgctgaaaaacatcaagcagtggccttgagggttcaagctgacaggtccatcttttacaaatgtcgaatggatgggtaccaggacacactctacgcacacaccatgcgtcaattctaccgtgattgcatcatttcagtggctgttctccaaaattgcactttcgtggtgcgaaaaccattggaaaaccaacaatgcattgtgactgcacaaggcagaaaagagaggaaccaaccatcaggattagtcatccatggaggaagcattgtgtcagaccccacgtactacccagttagattcgacaacaaagcttacttggcacgtccatggaagaatttctcaaggaccatcttcatggactcctacattggtgatttgatcacacctgatggttacatgccatggcaaacattggagggttttagtggaatggatacttgtttctacgctgagttcaacaaccgtggccctggttcagacaaaaccaagcgtgtgaagtgggaaggagttaagacccttgattcagatggaataacaaacttcttgccatccatgtttttccatggagatgactggattagggtcactaggattccttactactctggccaggtctcccacactaactga

SEQ ID NO: 93932 - DNA, 756 bp, Glycine max
  Peptide Sequence Number=SeqID_210710
atgaggaaggcccgggtccataacaaaaaccctagcatgcatagtttaaatttgaggtatagcattgacagaagtgtggtgctcgaagaagtcccattcattgcactgatagcagcgatggggatcgatcttaaggctgggggtaagagcaaaaagaccaaaagaacagcaccaaagtccaatgacatctacctcaaattacttgtcaagctttatcgattccttgttcgaaggacagacagcaatttcaatgctgtgatactcaagcgcttgttcatgagcaaggttaacaagcctccaatttctttgtcaaggttaattaagtatacgaaggggaaggaggataaaattgctgtagtagtggggactgtaactgatgatatcagagtatatgaagttccagcattgaaaattacagcactcaagtttacagagagagcacgtgcaagaatagaaaaggctggcggtgaatgcttgacatttgatcagcttgcccttagggctcctttgggacagaatacggtatgggtagataacaattttggccactgtaatttttggacggaattgttaaatcttgttcctgctgttgtgccagtccttcttagaggccccaagaatgctcgggaagctgtgaaacactttggtcctgctcctggtgtgccacacagccataccaagccctatgtacgagcaaagggaaggaagttcgagagggctagaggaaggaggaacagcagaggatttagagtttaa

SEQ ID NO: 93933 - DNA, 1053 bp, Glycine max
  Peptide Sequence Number=SeqID_210711
atggaggggatgatggacaagggggtgttggatgatgtgataagaaggcttctggaagggaaaggagggaaacaggtgcaactctctgagtcggagatccgtcaactctgcgtcaacgccagacaaatcttcctctctcagccaattcttctcgacctccgtgctcccatccgcatctgcggtgatatacatggtcagtaccaggacttgctgaggctttttgaatatggtggctaccctcctgcggcaaactacttgtttctgggggattatgtggatagagggaagcaaagtttggagactatatgtttgcttttggcctacaaaataagatatccagacaaaatttatctcttgaggggaaaccatgaagaagcaaagataaaccgtatatatggtttttatgatgaatgtaaaaggaggttcaatgttaggctatggaagatatttacggactgctttaactgtttgccagtggctgcactcattgatgagaaaatactttgtatgcatgggggactctctccagaattagaaaatttagatcagataagagagattcaaaggcctactgaaattccagatagtggtctcctatgtgatctgctttggtctgatcctgatgctagcattgagggctgggcagagagtgaccgaggagtttcatgtacttttggagctgatgtagttgcagagtttttggataaaaatgacgttgatcttgtttgcagagggcatcaggttgtggaggatggatatgagttttttgctaaaagaagattagtcacgatattttctgctccaaattatggtggggaatttgacaatgctggtgcgttgttaagcgttgatgattctcttgtatgttcctttgagatactgaaacccgctgatagagcatcaggaagtggttcatcaaaaatgaattttaagaaggaatccaatccagctaactcaacttgtacggagttgaaattgtcaagtaggagtttggcatgggagagccttccttccactttacgattgcagattgccaatgatactatattgtaa

SEQ ID NO: 93934 - DNA, 294 bp, Glycine max
  Peptide Sequence Number=SeqID_210712
atgaaacatctcaccgttcaaagaggcacaaaaagagtgacaggccaaagaagattgttcataaacttgattcagcatgttaatacttattactactggaagttttgctgcatggattcttttctaaatctaagatgcacccattttttagggcgtgacaaagatgatggtgtccgtcgcagtgctgtatctggcaagaagattcttctgaaacttgagaaaacaaaggaagataaggtagctgaaagcaagagaaatgaactgctgaactttttaaatgctagttttgattag

SEQ ID NO: 93935 - DNA, 698 bp, Glycine max
  Peptide Sequence Number=SeqID_210713
ccgtggttgcacaaggttttgtggcaataaacataacatttcgcaacacagctggagcaatcaagcaccaagcagtagccctcagaagcggtgcagacctatctgcattttacaattgtagcttcgaagggtaccaagacaccttatacactcattcccttagacaattttacagaaactgtgacatttatggcacggtggacttcatatttggtaacgcagcagttgtattacaagactgtaacatctacccaagactcccattgcaaaatcaattcaatgcaattaccgcacagggaaggactgacattaaccaaaacaccggcacctccatacacaattgtagcataaccgccgcgagtgacttggccactagcaatggcaccacgaaaacgtacctaggaagaccctggaagcaatattcaagaacactttatatgcagtctttcatggacgacggtttggtcgatccagaggggtggaaagcttggtctggggactttgctttggacacactttattatgcggaatttgataatcaagggcctggatctaacactagtaatagggttacttggccagggtaccatgtgattaatgccacagatgctgtcaatttcacagttgctaatttcataataggtgatgcttggctgcctgcgactggagtaccttactatgctgatttactcatctga

SEQ ID NO: 93936 - DNA, 645 bp, Glycine max
  Peptide Sequence Number=SeqID_210714
atggggggagatgcacagaagagaaacgtcatcattggcgtctctactttcttgttggtggccatggtggtagcagtcacagtcaatgtcaacttcaataacaagggatcaagcagtgattcaaaggaagaaagcaaatcccatgtagcttcctcgatgaaggccgtgaaaaccctttgtgcacccaccgattacaagaaggaatgcgaggacaatcttattgaacatgccagtaacatcaccgacccacgggaactcatcaaaatcgcattccacgtgaccatctccaaaatcggcgaaggacttgagaagacacaactcatgcatgaggtcgagaatgaccctataaccaaggaggcactcgacacgtgcaagcaactcatgaacctctccatcggggagttcacgaggtcactcgacaagttcgccaagtttgacctgaacaaccttgacaacatcctcacaagtttgaaggtttggctcagcggtgcaatcacgtaccaagaaacatgtttagatgctttcgagaacacaaccaccgatgctggtcaaaaaatgcagaagctcttgcaaactgccatgcacatgagtagcaatggcctctctatcatcaacgaactgtcaaaaactctctcggaaatgcac

SEQ ID NO: 93937 - DNA, 987 bp, Glycine max
  Peptide Sequence Number=SeqID_210715
ggtggaccctttggtactagtatccccaccttcagagggctacatgtcctcgcctacagagaactacatgtcctcgcctacagaggactacacgtcctcgcctacagagggctatatgtcctcgccttcagagggctgcacgccctcgtctttagaggactacacgttctcaccttcatagggctacacatcctcaccttcatagggctacgcgtcctcgccttcagagggctacacaccctccccttcagagggctgcatgcccttgccttcagagggttgcatgccctcaccttcaaagggctgcacgccctaaccttcagagggccgcacaccctcaccttcaaagggctacacgccctcatctttagaggactacacgtcctcaccttcagaggactacatgtcctcgccttcagagggctccatgcccttgtcttcagagggctacacaccctcgccttcagagggctacacgccctcgccttcagagtgctacatgtcctcgccttcagaggactacacgtccacgacctcgccctcagagggatgcacgccctcaccctcagaggggtgcacaccctcgccttcagagggccgcacgcccttgccttcagagggctacacgtcctcgccttcagtgggctacacatcctcgccttcagagggctgtacgccctcgacttcagagggccgcacattctcgcctttaaagggttgcacgcctttgccttcagagggctgcacgccctcgccttcaaagggctacacgccctcacctttagaggactacacgtcctcaccttcagaggactacatgtcctcaccttcaaaggactacacgtccacaccttcaaagggctacacgccatcacctttagaggactacacttcctcacctttagaggactacaagtcctcacctttagaggactacacgtcctcgcctttagagggctccacgccttcgcattcagagggctacat

SEQ ID NO: 93938 - DNA, 231 bp, Glycine max
  Peptide Sequence Number=SeqID_210716
atggagagggcaatgataacaatgatagtgcacacattattagtgttctactatgagaagatggtgggttacatgccttcgagctttgcagatttagtgcttgtgggtgagaggattggagtaggcctaaaaagaggcaaatttgattacgttgcttcgatgaattctggtgataggagccaatatcagtccttcttgttacccaccaccctaccagtcgagaaggcctaa

SEQ ID NO: 93939 - DNA, 980 bp, Glycine max
  Peptide Sequence Number=SeqID_210717
caagttacatatatgtggtcttatgaccttcatggctatttccgagctatccttgagcttattcatggtctatgttctaagcattttctccaactttgcgtctcttgcatcatcctcttcctccaccgataccatatgcaaccttacaccttatccaacattttgtgaatccaattcaccttctagtaacagccaaggcgacatacacgaatatggccggttttttgcaggcaaatccttgtcatcgtcgaagaagttcgtcgcattagtctctaaatacctttataaatctccatccaatttctcaaactccacaattcttgctcttcaagattgtcaccttctaggtgacctgaataaggacttttggcataagacccaacaaagcataaattccacaaacaccctcagtagctcagaaggtgaaaaattgcacaatttgcttagtgctacattgaccaaccacgacacgtgcttaaacagccttcatgaaactacttcaagccctgacaatgacctactaacccatctttcaaatggaaccaagttttatagcatatctcttgcaatcttcaagcggggatgggtgaacaatactgcaaataaggagagaaaacttgcagaaagaaattatcacatgtgggaacagaagctgtacgagattatcagaataagaggaagaaaattgtttcagtttgctccagacaacgttgttgtgagccaaagggtggtggtgaacccagatggttctggaaacttcacaactatcaatgatgcagtggttgcagctccaaataacaccggggttggaaatgggtttttcgtgattcacgtggtggctggagtgtatgaagaatatgtttctattcccaaaaacaagcagtacctgatgatgataggagatggaattaaccaaaccataatcaccggtaatcgcagcgtggttgatggttggactaccttcaattctgcaacatttg

SEQ ID NO: 93940 - DNA, 1725 bp, Glycine max
  Peptide Sequence Number=SeqID_210718
atgtccacttcaatcgtcactcctcttcctctcaaatccatctctgtcaacaccctcaataaaggaacactcaatcccgcttttcaatccttaaccctcctttctactcacccgctcgcaaccccctcgcgtctcgagcacgcgcattctctcctcctcgacctctgcgtcgccgtgaaagccctcccgcaaggccaacagttgcatgcccgtttgctaaaatctcacctttcggcgtttctggccaccaagcttctgcacatgtacgaaaagtgtgggtctttgaaagatgcagtaaaggtgttcgatgaaatgactgaaagaactattttcacctggaatgccatgatgggtgcgtttgtgtcaagtggcaaatacctcgaagcaattgagctgtataaagagatgagagttcttggggtggcgatagatgcttgtacttttccctctgtgcttaaagcgtgtggtgctcttggtgaaagccgcttgggggctgaaatccatggtgtggcggttaagtgtggatttggtgagtttgtgtttgtgtgcaatgcacttattgctatgtatgggaagtgtggtgatcttggtggggctagggtgttgtttgatgggattatgatggagaaagaggacactgtgtcttggaattctattatttcggcacatgtaacggaagggaagtgtttggaggcattgtcgctttttagaaggatgcaggaggttggtgttgctagtaatacgtatacttttgttgcagctcttcagggtgttgaggatccctcgtttgttaaactgggtatggggatacatggtgcagcattgaaatctaaccattttgctgatgtctatgttgccaatgctttgattgctatgtatgcaaaatgtggtcgaatggaggacgctgaaagagtttttgcaagtatgctttgcagggattatgtgtcgtggaatacattgctttctggtttggttcaaaatgagctgtatagggatgctctaaattacttccgagatatgcagaattctgctcaaaagcctgaccaggtgtcagtgttaaacttgattgcggcatctggccgatcgggaaatttattgaacgggaaggaagttcatgcctatgcaataagaaatggactggattctaatatgcagattgggaacaccttgatagatatgtatgccaagtgttgttgtgtgaaacatatgggctatgcttttgaatgtatgcatgaaaaagacttgatttcttggacaactatcattgctggctatgctcagaatgaatgccatctggaagcaataaatttgttccggaaggttcaggtgaaagggatggatgttgatcccatgatgattggaagtgttttgcgggcttgcagtgggttaaaatctagaaacttcatcagagaaatccatggttatgtttttaaaagagatttagctgatataatgctacaaaatgccattgtcaatgtatatggagaggttgggcacagagattacgcaagacgtgcatttgaatcaattagatccaaagatattgtgtcttggacaacgatcattagtgcactctctgccactgctaatttatcttcattgaagaaagggaaggagatacatggatttctgattaggaagggtttcttcttggagggaccaattgctagctcgctggtggacatccattcaggattgatggttgaaggtaaagaggttccttga

SEQ ID NO: 93941 - DNA, 402 bp, Glycine max
  Peptide Sequence Number=SeqID_210719
atgcatatgagatcctcaagaaaggtatttgtggagttattgtcaaagaacgatgaactccgactgcagttagaagctctatgtattctaaccagttttgcttccggaccagctgaacacagaagagttatcgttgaagttggtgttcttccccaattggtgaatcttctccactctagtagaaatcaagatatcagagaagagatagtatttggtttagggatcattgccagcgaatccccaagctatagggatattgttcttgaccatggtgctctatcgccattattacatcagtttggtaaacaatcaagattgaggaggtttgctacgttttgtttatgttctttggtccatggactacctccggtaaatcttgaacaggttggggacatttcataa

SEQ ID NO: 93942 - DNA, 678 bp, Glycine max
  Peptide Sequence Number=SeqID_210720
atgcctatcaaaccttcttctgaagtctggtgtgctcttcttggggcatgccacattcattctaataaagaattgggagagcttgcagcaaaggagctcttacaatcggatacaaagaattcaggaaagtatgcactgatatcaaacatctttgcagcagatggaagatggaatgatgttgaagaagtgaggttgagaatgaagggaaatgggttgaagaaaaacccaggatgcagttggattgaggttgacaacaagattcacaccttcatggcaagggacaagtctcatccacagactgatgacatttatctaaaattagctcaatttacaaaacttttgggaaaaaaagggggctatatagctcaaactaagtttgtattccacaatgttagcgaagaagagaaaacacagatgctatatagacatagtgaaaggttggcacttggttatggtctgcttgttaccccaaaagatagcatcagaagtctcccaacgggcccttgttgtaagggatgccaacagattatagcacacttctctggttccttcctgttgctggcagtcactgaaatttctccttcaaagttttactgtctctttatgatgtctcaatcaacagaacttgggaactggtaccaaatatgtaagcggagtttgggattacttggtagttaa

SEQ ID NO: 93943 - DNA, 1930 bp, Glycine max
  Peptide Sequence Number=SeqID_210721
atgtattttcagcttgttaatcaattgttcccgagtcttcacaaacttcttacgagtgactataacaaaagcatgtttaaacaagcttgcaggacaatctcaaatatcatagtagggactagagctcgaatacagactgtatttgatgctaatattattccttatcttgttcaaagtcttcaacatgctgagtttgacgtcaagaaggaggctgcttgggccatcttttatgtgacttctggaggatctcatgaacatatcagggttgatgaatgtgaaggaagggataagattgaaaaattgctgactcattggaatgatgagatttctgagagagctgcgaggattttgaaagaaatgacgaatgatggggatgatgccattccttcagatgaagaagtgtttattaatccctcagaagtccaaacccaagacatgcaagccttgattgcacaagcctgcatggacattgaaaaccaaaactcatgcctcacaaacatccacaacgagctcaccaaaataggccctccaagccccacttcagtggtgagtgcagcactcaagcacacgctcaacgaagcaagagtggccatcgacaacataacaaagatcacaacattctccgtcagttaccgggagcaacaagccatagaagattgcagggagctcttggatttctcggtttctgagcttgcatggtcgatgggggagatgaggagaatccgttcaggtgataccaatgcgcaatacgagggcaaccttgaagcatggctaagtgcagctctgagtaaccaagatacgtgccttgaagggtttgaaggcacagatagacgccttgagagttacatcagtggaagcttgacacaagtcacacaacttataagcaatgtcttgtctttgtacactcagttgcatagcttacccttcaagcctccgaggaacactactactcctctaacaagtcatgaaacccttgagtttcctgaatggatgagtgagggtgatcaagagttgctcaaagccaagccacacggtgtgcgtgcggatgcggttgtggctttggatgggagtggtcattatcgctctatcactgatgctgttaatgcggctcccagttatagtcaaaggaggtatgttatttacgtgaaaaaggggctttacaaggagaatgtggacatgaagaggaagatgaccaacatcatgcttgtgggtgatggtattggccaaacaattatcactagcaaccggaatttcatgcaaggatggaccacttttcgaactgccacacttgctgtatccggaaagggtttcattgcaaaggacatgtcattccggaacacggcagggccagtgaaccatcaagccgtggcactgcgtgtggattcagaccaatcagccttctacaggtgcagtgtggaagggcaccaagacaccctctacgcccactccctgcgacagttctaccgagaatgcgaaatctacggcaccatagacttcatctttggcaacggtgccgcagtgttgcaaaattgcaaaatatacaccagggtcccacttcccttacagaaggttaccatcacggcccagggaagaaaaagcccacaccagagcactggctttaccatccaagatagctatattctggccacccagcccacgtatttgggccggccctggaagcaatactctagaactgtttacatcaacacttacatgagtgggctagtccagcccagagggtggcttgagtggtttggaaacttcgccttgaacactttgtggtacggtgagtacagaaattatgggcctggtgcagcactggctgctagggtcaggtggcccggttatcatgtaattaaggatgcttccaccgctagttacttcacagttcagcgcttcattaatgggggcacgtggttgccaagtacag

SEQ ID NO: 93944 - DNA, 390 bp, Glycine max
  Peptide Sequence Number=SeqID_210722
atgggacacatccacggcctccaacacggggcacgcgcgaatcagcatctccaagcccacgtggtccaacccggtggcgcgactcagcacgagcctcctcagtccccgagtccaactcgccgatccctgactcagcacaaccgacacaaccccgtcttcgatccgaggacaaagcgacaggtccagcgtctcaatgttgcagaacctctccaacagcctgagcagaaactcgattcggaggatccgaatgctcttccgggtcgccgattcgacccggagaaattccttgcacaccagccgccacggtttccgatccggcccgagcttctcgaggacccggatgagcaggtcttcggtcaagaggcagaaaacggattcagacaacattaa

SEQ ID NO: 93945 - DNA, 795 bp, Glycine max
  Peptide Sequence Number=SeqID_210723
atgcttaaggagcaagatctacctgacatccctcattatggctatgattttacaaagtttgagactatcatcaataagaatgttgttgctgatgtgttaatagaagttattggtgagtttgttgatttggtccagtgtagccttgaaactaggcccaagaaattagtattcacaatgagagatgaagataagcttgctctatccattcaaaactccatgtttggttcaaagctatttatcaatgacgatagcattccagagatagagcattttaagaaaagtttgattgccagtaataccgataacatttctttaagtctaagattgagccaaaaatcttcaagttcccagctaacccatggaggaaaattaacgattaatgcaccagttaaatatttaaatgagcttggtcaagtggataagcaatattattttgtgactgttggagttattagtaaactattagttgcaaatggttggtgctttgaaggatgtcctaactgtagcaagaagaaagattccaccgagtctaccaatacatttgtcaagtctgtgaagataaagatatcatccaatcaattattgagaaaatcgccagtgaaaaggatgagacaaatgctgaaaaaagaaaagtcaatttcctttggaaaaaatgatcctgatatactacagtcacaaaccccttgcaagaagttgttttcatcaaacactcaaatggatgatgttggacaagaaaaacttggttctttccagttatcttcttcgaagttgtgcaagcacatcaaggaagagtaa

SEQ ID NO: 93946 - DNA, 1641 bp, Glycine max
  Peptide Sequence Number=SeqID_210724
atggatggggatcaaaatgagtttggttctgtgcatgaagggaatgttgatattggacctcagacgtcgaataacttggagttgaatgtggagcagaactgttgcagcccaaatgttgctcgtgctagtgactctcaatcctgtcctcctgcagcaaatgtacttagctgcgatactgtgttgggaattggtacggaatttgagtccaatgatcatgcatacagattctataacaagtatgccagattgttgggtttcaatgttagaaaagattggataaataggagtaaggtgcatggtcaggtggtgtctaggaagtttacctgctcccaagagggatggaaagacaaaagagatgctaatgtgaagaaacatcggaaggaaacaagatctggctgcttggcacatatgatcgtcaatcggcaaccagatggtaaataccagagatatggggaaaggagaagcagggtgtgtttgcttggttacttccaaaggcagcacttcgaaaatccaacatttttttatgccatacagcttgatgttgaagacaagttgtatgagaacactttgaaatacctcagccatgtcgttaaggatgctgaatcttttgcaaacgatctaaggagaagtatttatgatcccaaggatgaagaatttactcgtgcttgggaggctatgctggagaagtataacctccagcaaaatgaatggctgagatggatttatagagaaagagaaatgggctgttgtctttgccatgcactaaaagttcttgatcatacaaacataaaagtagttccatctcagtacatcttggatagatggacaggagatgcaaggttgggaaatcttagggagattaagcaactaacaatgcaaggtaatcctaacatggttgtcgcaagctgttacaaagatttgtgccacagactgctcaagttatcggtaagagcctctgaatctatggaggcttaccaattttctgcaaggcaacttgatgaagtgatggtaggagtggagaaaatcttggcattaaaagctgaggaaggtcaagttatcacctcaagtaatattgatgcaaatgcttcagaaaatgagcctgcagagatctttctgaatggacatgcaattgaggatcaggatgaaagtaacagagcaaatggaggaaaagacaggagagctacatcagataggggatatctaacaaccatgacttttaatggagctgattctgataggattttgaatgtagaagtatctccaccaaataccgttgtgtgcatttcaagcccctcatctgcatatgtttcatctcattctgcatcaccaaatcccattctgcagggtatgtacagttttgaagccaatcaagtggttcactgtatgtatgaacagactaatcatgtgctggaccatcaatctaattctaacacgttacaaccgccaaacatcttttctaaccaacaggattgtcctggtcaatctcaactattgcaggagcctataatccagagcacataccatgcgtccatgccctgcaataatcagatgcgacaggggatagatcttgacatccaaaatccacattcctcttcattcttgctgtatgaccatagatacagaagttccgagtctgcatga

SEQ ID NO: 93947 - DNA, 351 bp, Glycine max
  Peptide Sequence Number=SeqID_210725
atgggaagatatgctcatgctggtaagaaaggaagtcttattcttgtacgcataggagaccaatccaaggttatggtggtgactattgagcatgatgttggatgcaaatttatagaggaatcaactcaagcaggagttggagttgaaggtgttttgtattcagggtcgccaggcttgtctgtagaagtcaccatgttttgctttatactgcctaaacgttctacagctaaagctgctaaggaaaacccaactaaccttcaaaggaattcgatttctttaaggttcgacagggatcgagtcaatctgcccccgtgtttgttgataataaacctgatacgtgtaaaaaattaa

SEQ ID NO: 93948 - DNA, 315 bp, Glycine max
  Peptide Sequence Number=SeqID_210726
atgattcaacttctttgtgcagctcgtgatgatatattcagactcatcattcatgaaataacttgcattgagacagtccacaacctgttagccatcgagctcaaaggtgatttgatacaaaaaggattgaccattttgccattaatgttgcattttaaacaacaaacacaaggtggtgtccaacatcgattaccagaatcaagaatcagatgcaatgaagagtttatgttgttattgtgcatgcttccggtcagtgagattcaacatggccaaacgaaatgtgacacatactattttgtggataccatcccataa

SEQ ID NO: 93949 - DNA, 1284 bp, Glycine max
  Peptide Sequence Number=SeqID_210727
atgggttttctccggcgaattttcggcgccaaaaaaccatccgattccaaatccgccaagaaaagatggaccttcctcaaacacaccgtcaggaacaagtcactcccgccgccaccgccaccctccgccgtcacttactttgattcctcaactcccttggacgccaacaagcatgccatcgccgtcgccgccgccaccgccgccgtagcagaggctgctctcgccgccgcccacgctgctgcggaggttgtcagactcacaagcggaggcgtctccgccacaagcaccaggcccgccgctatggcggcgcgtgttggcaaccttgaaaccgccgccgttaggatacaatcggcgttccgtggttacttggaattgcaggactttgtggggattgaaaagaggaaaataggacgaggcaaagtagaatggccctgcgcgcaaaaaccatcaaaggcaaggagggcattgagagcgctaaaagcattggtgaagttgcaagcattggttaggggccacattgtgagaaagcaaagtgctgatatgctgaggcgcatgcaaacattggtgcgacttcaggcccaggcacgtgcaagccgtgcgcacttgtcggatccttctttcaacttcaactcttccctttctcactatcctgtccctgaagaatatgaacacccacctcgtggcttcagtacaaaatttgatggatcttctatccttaagagatgtagttccaatgccaattctaggaacgttgactcagaacgagccaggtttgattccaactggttaaaccgttggatggaattagataacaagagcagccaaactggagatgcttcattgaaaaatggacgccctgatgatgataaaagtgacaagattctcgaagtggatacttggaggccacacttcaagtctcaccacagtagcagctccttccaagcagcacattattatttgagttctgattacaataatgagaactttggagcggcacatgagtctccatcaaaacgttcagcaaaggctctaaaccaaagcttctcatcaagggaggtgttgcagctaagctcattgaagtttcacaaaggaaaagaagaagcaagttcaagaactgctgacaatagtccacaaacattttctgccaattctagaaatggaagtggtgcaagaagaggaggaggaccctttacacctaccaggagtgagtgttcgtggggtttcctcagtggctacccaggtcaccccaattacatggcaaacactgaatcttttagggctaag

SEQ ID NO: 93950 - DNA, 111 bp, Glycine max
  Peptide Sequence Number=SeqID_210728
atgggtagtggtgactacaatgaagacgacaatgatggtggcattgacgatgacaataacagtggaaacaacaataatggtgacaataagggtgagtgttggatcgagtga

SEQ ID NO: 93951 - DNA, 270 bp, Glycine max
  Peptide Sequence Number=SeqID_210729
atgatttattgtcaaccattagatacatgtaagggtctatatttttgctggagaggtgctgagacaaacacagcaggagagggtccaaatctgaaggctcctaggtactttaatgaagcatgcagccaccagggggagagggaagaaaaagggagaaagaaagaagaaggcttgggcggagggggagagagggaggttgaggcaccaatgggagctaattgttatgactacgtgtttccaggcttgaagatagaagatataagattgtaa

SEQ ID NO: 93952 - DNA, 1380 bp, Glycine max
  Peptide Sequence Number=SeqID_210730
tggtggggcggcaggaagccggcggagtcggccgaggcgacggccaactgggtgcgcatcatgatggcgtcggcaaagccgcgcagcagcatgatcagcgcgacgatgatgtacatcacgccgatgcgcttgtggtcgaccgaggtgatggcgccgaagaccgctaggcctcccaggcacacggcggccagcgtgaccatgacgatgggttcatggtacggaatggcctcgaggattattcgacgtgggggtgcacgtggcgtcatcgacgccggccatcttggacatggtgctgcccaggatgtagtcgaacatggacggcggcaccgaggcgtacctggcgaccgggttgtgttcgctgcgcttggtcagttcctggtacaccgccggggtcagcgcggtgccggaagccttggcttgcctgacccagttgtcgaagccttcctgcgacgtggcgatggccttgaagcgcatgccggagaagccggcgccgctgtagttggccgagataccggcgtaggtgccgggctcgcgcgcgttcaggtgcagcttggtctccatgcccgccatcgagtagatctggctgcccagctgggggatgaagaacgagttcatgaccgaggccgaggtgatccggaagttgaccgggacgtcgaccgggaaggcgatctcgttgaccgtggcgatgtcgtactcggggtagatgaacagccacttccaatccagcgacaccacctcgatggtgaccggcttgtgctcggagacgaacggcttgtagggatcgagcgcgtgcgtggagcgccaggtgatcacggcgaggatcgccacgatgatacatggcacggtccagaccacgacttcgatcgccgtggagtgggcccacttgggctggtagtcggccttggtattggatgcgcggtatttccaggcaaacgtcaggatcatgatgatgaccgggatcaccaccaggagcatcagaccggttgccgtgaacagcagggtcttttcctgagcgccaatgtctcccttgggggagaggatttccatgttgcagccgccaagcagcatgaccgcgccgacgccaaaaatgcgcgtaagggtcgcaaggagggggtgtttcacgtacagccttggatggaaggtgggaaatgctgcgtagcagcagactggaatgctgctaggcagcaacgtccatcctatcggtttgatttgggtcaaggctgcgacgaatggtcgcattgcctggcgggcttttgccctcaaggcttcccgttaagggttttcccaggcgggggcgggctttgctggaagggttggggtgcgatttcaagagtcaccagtagtgataaaagtttttgtaatcattggcatcttgtgtaa

SEQ ID NO: 93953 - DNA, 132 bp, Glycine max
  Peptide Sequence Number=SeqID_210731
atggcagaaaggagggagaatcacgtaataaagcgtcaaatcgcgattctcaaagacggcgtcgttgaatcgttcagagatttggatagcgaagaccgtgagaggggccacagagctccagtggaattttaa

SEQ ID NO: 93954 - DNA, 1005 bp, Glycine max
  Peptide Sequence Number=SeqID_210732
atgaagaaaggaggaaaaaatgggaaatgtggagggagggaaactgctgatgcaatggcaaaggaagctaagaagaatgacatgatgttgtgtagctcaggcattgttcatgtcgatggttcaaacaactttgcttccgttttctcaaaaagaggccagaaaggagtgaaccaagattgctgcatagtgtgggaggaatttggatgccaagaggacatgatattttgtgggatatttgatgggcatggaccatggggtcactttgtggccaaaagagtaagagagtcaatgccaccatctttgctatgcaactggcaggagacactagcccaaacttcaattgatcaggctattgacgtagaggaagagaaaagtaaacaatacagattcaacatatggaagcattcttacttgaagacttgtgctgccattgatcaagaactagagcaatatcgcaagatagactcgttttacagtggaacaactgccctatcaattgttagacagggtgaactcattgtcatagcaaatgttggtgactctcgtgctgtgttggctacaacatcagatgatggaagtttagtaccagttcaactaacaatcgatttcaagcccaatttaccccaggaggcagagagaataattcagtgccaggggcgtgtgttctgcttagaggacgagccaggggtgcatagggtgtggttaccggatgaagagtccccgggactagccatgtctagggcctttggtgactactgcatcaaagggcatggtctaatttctgtgcctgaggtctgggatgtaatctctaataaagaagcagtggatattgtatcttcaacagcagataaagctaaggcagctaaacgtttggtggagtgtgcggtgcatgcatggaaacgcaagagacagggcattgccgtggatgacatttcagctatttgccttttctttcactcttccctttcaacagagcaagttagccaggttgccacattaaaatag

SEQ ID NO: 93955 - DNA, 741 bp, Glycine max
  Peptide Sequence Number=SeqID_210733
atggtgttgagcacacaccaagcttcaaatttgcctccagatgcttgccatatgtccttccaggctagctctgccgtgctaagcgggctgcctcatcaacccaagtattcttccttccttattgatgcatcaagctctttaaatcacaaccaaaactacattattcgcaaaagtggaagttttgtttggtatcaggtgatggcatctttggaaataaaatctggtgcattggtttctttacaagacctgcgcccatcttctcctttttttaagcaaggtgcttcactcagaataactggaaatgagatgcttcactgttgtagtgccaatgtcgtatataacataatgttaaaattccttgcctttgggttttgttgccaatcatgtagtgaaggtcatgtggataccattagtagtgatactgtgcttggaagaattgtaaatggcatgctaactctaacagggttgcacgaatactctatagagacaggcctagcaacaattatcgatggtgatgacattctaaaagttagtaccaaacatctgagggaccttacttttcaagttggctctgtctaccaattcattggtgaactccttatccaacctgacaatgagggagttttgcaagcacgtgttggtagaaacgttgatgggattgatctcaatctttatcatcaatctctgctgcttttaagacagtttcaaaccaatcatttaaacaatccagcaacaatgtag

SEQ ID NO: 93956 - DNA, 2445 bp, Glycine max
  Peptide Sequence Number=SeqID_210734
atggcgaatacgataccagcatgttatgaggtatacataaccaatcccagtcgaatctggcgaactgataaagtcctacaaacacagcttcctgttctcgcttttcaaattgcctttgtcgttgtgttgtctcgtattttcttcattatcttcaaacctctccatcaaactcgtctcatttcacaaatctctgttggtttcctactaactccaccattacttgggagattcacaccaatttttgagttcatatttcctgtaaatggtgtccttaacgttgaacttctttcccaccttggtctcatattttatgcattccttagcggtttggagatgaacttagataccattctacgagtgaaaaagaaggctgctagcattgcggttgctgggatcgtctttccgatggtgttggcaccatgcttatatgctttgtaccgaaaaatttacggtagtaatggagtatttccccttgaagaaggttcagttaatgcttatttactttggacattaattctcaccgtcacaggttttcctgtcatagctcacacactttctgagctcaagctcatttatactggtcttggcaaagctgctttaacagcagccatgatcagtgacacctatggttggattcttttcactttactggttccatttgcaatcaatggtaaaggagctatgtacacggtgctaagcaccatattattcattgttgtatgcatctttgtggtgcgtccaatcattcaacggtttatggatagcaagacagacaaagatgagtgggaagataacgaattactatttgtggtgatgggggttttggtttgtgcaaacgttacagatattcttggtgcacatggcattgttggggcttttgtatttggattgattttacctcatgggaaatttgccgacacgatgatgtcaatttcagatgattttacgggaggctttctggcgccgctcttctttgctggcaatggaatgagacttatcttaacctcagttttccaaggaaattggcccttgacactactgattatactcttgttgtgttctctaaagattttaagcactttattcgccactttcttctttggtatgcgcactcaagatggtttagccataggcttgcttctcaataccaagggcgccatggcactgattatgctaaacattgcttgggatagagcgattttttttgtacctacctatgcggttattacttcagctgttcttctaatgactgtagtagtatctcctgtcatcaatgccgtctacagaccaagaaagagattcgaacagaacaagctaaagactatacaaaaactaagagtggatgcggagcttcgaattctagcatgtgtccacaatactcggcaagccacgagcatgatcagcatcattgaaacttttaatgccactagactttcccctatacatgtttgtgccatgtaccttattgaacttactggacgtgctgctgcccttgtggctgcacatatagagaagcctagtagccaacccggagaacaaaatctcaccaaatcacaggcagagttagaaagcattgccaatacatttgatgcatttggagaggcatatgacgctgtcagaattgagaccttaaatgtggtgtcatcctatgcaaccattcatgaggacatatacaactcagcaaatgagaaacacacaagcttaattatccttccattccacaaacaattaagttcagaaggtgcgcttgaagtaaccaatgccgtatacagagatataaaccaaaatgtaatgcagcatgccccttgctctgtggggatatttcttgatcgtgattttgggtcaattcccaaaatgaaccttcgtattcttatgctctttgttggaggccctgatgatcgtgaagccttagctgttgcatggaggatggcaggacatccaggaatcaaactatcagtggttcggattcttttgtttgacgaagcggcagaagtagatggttcagttcatgatgaagcacgagggatattgtcttctgtaatggatagtgagaagcagaaagagttagatgatgagtatataaattcattcagacttacggcagtgaacaataaggaatctatatcctactcagagattgatgtccatattggtgaagatattcccaatatccttaatgagctagaaaaaaatggttgcgatttatacatagttggacaaggtaattgtaggaactctcgagtcttctcaaatttgctagaatggtgtgaatgcttagaacttggagttataggggatattttggcgtcaaacaattttggttcgcgctcatctttgctagttgttcaacaatatgggtatggaggaatggtttttggaaaaaatctcaaccaaaaggccaccaataacgatggatttgagtcacttgttgtgaagacagagtaa

SEQ ID NO: 93957 - DNA, 592 bp, Glycine max
  Peptide Sequence Number=SeqID_210735
ctgtccctcctggtcagctactgacggggtggtgcgtaacggcaatagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagaattcgatcgctgagcgccatggtcgctcaccgaatgggctacaagcgcatctccttgatcgccggcggtggcgctggacatgacccgcgcatgatcggatacaagttctggcccaaggtgggtttcgatgcggagctcgacccgggagagacggacgctgcacctcacctcgctatgtgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 93958 - DNA, 300 bp, Glycine max
  Peptide Sequence Number=SeqID_210736
atgaaccttagggtagaggacgccggaaaaaatggcggaagcttggtgacgatgagccttccgaaagaagatcttccggaagatttccggaagaagggttcttccgtaggtaatgaaacgacttctggaagaacagatctttcggaaaactctcgaaacacctctttcggaatgttttcggaagatgtacttgttccggaaacattccggaagagggttcttccggatgacctttcagtggttccggaagcactttccggaagagccttcttccggaattgttccggaagaattgactaa

SEQ ID NO: 93959 - DNA, 249 bp, Glycine max
  Peptide Sequence Number=SeqID_210737
atggagcagtatttacagcacttggttcaccagcaggcggccaaccacagggggcagagccagggtttcactctttttgcatgccctactccagatcagttcagggcagaggttgcatggcccggagattggcctgaggcccaggcaggggaggcgctcacagaggctcccggtgatgcagatgaggcccgcatggatgaggagatgacagatttactcgatttcttgggagggagcagggccacatga

SEQ ID NO: 93960 - DNA, 465 bp, Glycine max
  Peptide Sequence Number=SeqID_210738
atggttggagatctggagggaaaaacaccattgataacgaagagcagactaacgcacgttgcagttgtaggaaacatgctagttaaattggtgcaacataggagacatagtacatgtttgtttttacgacgaagttgtggcagcacaaaggggcaatacataccaaaaggtgctttagtgatctttgatggtctgaacaaggaactctgtgtggggatccatcttgtttttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctggtgaagttttattaa

SEQ ID NO: 93961 - DNA, 3108 bp, Glycine max
  Peptide Sequence Number=SeqID_210739
atggcagcagaaccagttttaaccttctctcttgcttctgtggtgaaagatgttcttcaacaacatggtggccggttggacgtcaacttggcatcaagaaaagctgaagaagcttccttgagaaggtatgaagcagctgggtggctgcggaagacagttggagttgttggagggaaagacttgccggccgagccttctgaagaagacttcaggattgggttgcgtagtgggattattctatgcaatgttcttaacaaaattcaacctggagcagtgtccaaggtagttgaaggcccctgtgattctgttattattcctgatggggcagcactgtctgtgtatcaatactttgaaaatgtaaggaattttcttgtggctgtggaggaaatggggcttccttcctttgaagcttctgatttggaacagggaggaaagtcttcaaggatagtgaattgtgttttagcgctcaaatcccatgctgaaaggaaatttggaggaggaaatgggtcgtcgaaatatagcggggttgcaaagccacctaccactggtaaaacacttttgaggaaaaactcggaaccatttatgaagtctatgtggactatgccatcaggggacagagatggttatatgagtgatcccgggcatgatctaaatgaaaggatggtgagggtcgtatggctaagctttttgaattggtatccgcagggttctgtttcttccttaaattcactagttcgtcaatatttgtctgacaagaaaccagaagaaattcccactgtagtggaatccctgcttagcaaagtcatggaggagtttgagcatcacatgcaaatccgacaggaaatgtgtaaaacaactcaaggagataaagcaccgtctgaaacagaatgttcaatttcagaagctgcttcaattaatgaaaggatggaagaaaaggaagatgaacaggacgaacaagatgaacatgacttacaagatgaacaaaacatacaagataagcaagaggaaaattatgaagagaagtacaacaagcgtgaagactcaagccgccagattttgattttgaagcagcaaaacattgtcgaaacacaaaatagaagcatccaggaattgaaaagcatcgtccatcaaacaaaattagggatgcaattcatgcaaaatgaacatcagaaagagatcattaatctaagtaagcacctgcatagcctagcttctgctgcttcaggatatcataaagttcttgacgaaaaccgcaagctatacaatatagtgcaggatttgaaaggaaatattagggtgtactgtagagttcgacccttcttgggtgggcaactgagccattatagctccgtcggtaacgtggaagagggaagtatctcgatcataacaccttccaaatacggcaaagaggggaagaaaacatttaatttcaatagagtatttggtccttctgcaacccaaggggaagtattcgcagacacacaacctctgattcgttctgttctggatggttacaatgtctgcatatttgcctatggtcaaacaggatcaggaaaaacattcactatgtctggaccagatgatattaacgaggaaactataggtgtcaactaccgtgcgctgaaagatcttttctatctctcagagcagaggaaagacaccatttcttatgaaatctctgttcagatgcttgaaatttacaatgagcaagtcagagacctacttactacagatgaaattcgtaacagttctcataatggcatcaatgtgccagatgccgaccttgttccggtttcatgcacttctgatgtcataaatttgatgaacttgggacagaagaatcgtgctgttggttctactgccatgaatgatcgtagtagtcgctctcacagctgcctaacagttcatgttcaaggaaagaacctgacatcaggaagtactattcgtggtagtatgcatctagttgacctggcaggaagtgaaagagctgataaaacagaggccacaggggatagaatgaaggaggctcaacatatcaacaagtcactttctgccttgggagatgtcatttcttcccttgcccaaaagaatgcacatgttccctacaggaacagcaaacttactcagctgcttcaggattctcttggagggcaagcaaagactctcatgtttgttcatataagtccggagccagaagctcttggagaaacacttagcacactcaaattcgctgaacgagtctccactgttgaactcggtgctgcgcgagttaataaagataactcagatgtgaaagagcttaaagaacagattgctagtttgaaggcagccttagcgagaaaggagggaggagaagcagaacacttccaacaatctgccaatagtagcagtcatgaaatacccaaattgaaatcatatgcatcttctcctcctatgcaacgtagtttgataggtggtgcccgtaagctaccaaaagatgattctagtagcctgaatggccagaaaaatgctgcatcaaagttgaaaagacgaagcctagatctccatgacatgcgtaagaattcacctccgtggccacccgttagaagtcatagaaaggaggatgacaaagaatcaatttctggggattgggttgataagatttcgataaacagaaatgacagcttaactagtgatgatagtctcgtggggcagtgggaaacagaaagcaaacaatcttctccaatgttaagtcccacttttctctcagagccttctaaaatatgcatggaccactccttgcatagaaaggataaccaagaattgtttgatatggccatcacagatgaatctgatgagcttgagattgcaactagtgattcttcagaatcagacttgcattggccagcacatatacctaaaccaatcaccgtttcaagcggattaggcattaaagcaaggaagaaaccaattaatctcagaccaacaaagagcctagaagccaggagcatgatcccatcattaatccccattcccgtgccatcaaggaaacaaccaaccctagttactccagcaagaaagactcctgggtctattgatgtaaagagaaggattgggaatgccaagtga

SEQ ID NO: 93962 - DNA, 1059 bp, Glycine max
  Peptide Sequence Number=SeqID_210740
atgaagcacatggtgccttcaggaacaatccaagtcaaccatcaaaatcatttagctgctggtatattgacttgtaagaagggaaaaggtcctgttgaaaaaggccaacctgctgtacttagagagaagagattccgaaagcctacccagaggtacattgaagaattttcaaattcaaggtcaaaggaaaaggcaccaactgctgttacaaaaactgaacatttaagtgactcatcatgtgatgtacttcatataagaattaaagcattgaaaaagagtccaagcgagaagtctagtaatgaaaatagtgatgtgatgcttcctgagttgcaagttcgcaaaaggcgtctggagaaagagaaacttgagtatgacaaggagttatttccctcggaatccgaggatgaatgttcgacatcaaaaagatctagaaggaaagatcgaagaaagcatcagaagatgtggactctccctgaagtgttgaagttggttgaaggcatatctgaatatggagttggtcgatggactgacataaagaggtttctgttttcttcttcaagctaccgaactcccatagatctcagggacaagtggcggaaccttttgagagccagttctgcacagaaaacctcgagagaggctgagcaaaatgacgagcttgccctgcgtcccttgccatttaatgtggtacatcgtgtgcgagaattggctaaaattcacccatacccaaggcaacgtgggtcaaagaggttgcgtgttagccaagctggctcttctatcattgctaaagattctcctccccttagtcttagcaaaagaaattgtatagagcctggatacaaggctagaaatgttctcaagggcttctctactagacaaaagttctacagtagagaagctttcaaaattactcctttatgcagacaaccccataaagatcgtgtatttcagaggcccaaggttagggagaagtgggaacaaaatgataatgtgacagctcaagatagcacaggaatgcacgtgaaacggaagcaaagcaaagtgtgtctaatcaaataa

SEQ ID NO: 93963 - DNA, 1353 bp, Glycine max
  Peptide Sequence Number=SeqID_210741
atggagtcaaaaagacaatctcagcaggagggtgatgaaaggggtgttcaaattcttgttcacggctcaaaacggagacgtgaagattcacaacaatcggacaccttccgtatcgttagaagtttaaggtctctggttcacttaaagaatgacatagtgccgtgcttggaaaatttagttcaaagattggtacgagaggagttggaatgccaacttacaagaacaattaataatcagattggaatatcgggaaccaaaccctatcacctggtttttaagaatgaattgcctgctacaatttatactaactccaagatccaagctaaaggcaacactcctctcgaggttgctctttttgatattgaatctcagtctacagtcactgagggttcactgtcttcgatcaagatagagatatgtgtccttaatggtgagttcggttcaaatggccttgaagattggagttcagatcaatttaactccaaaatcttacctccaagagacaataaagggcagttactgaaaggagatacgattattacacttgaaaatggagttggttatatcaccaaccctgagatcactgacaactcaagctggataagaacccgacgcttcaggttaggagccaaggttgcacaatcaaatctgaaagatgcaattaatatcagggaaggtataagcaaaccttttatcgtcaaggatgccagaggagagaagaaacacgacactccatccctcaatgatgaaacatggcgtttgaaacacatatcaaaaagtggtgaagtttgtcagcggctgtctaagcacgggataaacactgttgaggatctgttgaaggagcatgaaaccaatccatcatctttgccagagaaatttggcaagatttcaaaaaagaaactggaacaaattattaagcatgctcagaaagcaaagcatgacaagacttgtgttgctgaagccacatttgaaggacaaaattatcattcagggaagaatattctcatctccgacgagagggagcattacaaaaatttgaaggatccggtaccaattgagacagtaacacatgagttagtgaaagcattgacaccagttacagcacaatacagtgctccatatcaagatgtgcaacagcttgactttccaattgaagaaatttctagactaatggactcactaaactggtcagtagaggggcagtttgttgatggaaacatatggcctgttgcaattgatgatcaaaatttaagttgctctatgattccacctgaagcagaatgtagcaatcgttcctcttttcccaactctgcgatgtataaatcagacaaagggaaaagcaagatggtttga

SEQ ID NO: 93964 - DNA, 231 bp, Glycine max
  Peptide Sequence Number=SeqID_210742
atgtatcaatcgaagtccagattgaggattgaggaagcaaagcaagggtacaacgttacacaggatggagcccgaaagaatctaggcccaaaagcctatatcaagaatatcctattaaaggatgaaccttgttacaaccgtgaagcaccggatgataacttgaaatttgccagaggtagtgattgttatgagaatcgccttgagaggaatttcccacctcaccgtgtgtaa

SEQ ID NO: 93965 - DNA, 201 bp, Glycine max
  Peptide Sequence Number=SeqID_210743
atgcatggaatagtgaagaacggggaagatggtggaagaagaaagaggaggaggaggaagggaaaaggtggcaatgagtttgagggagtgaaaggattggtttcgtcattggcaatggtggagattgagggaaatgtgaaaggaaaggaagtgaatatgtttaataatcatgcacaagtaaacatgagtgataaagaataa

SEQ ID NO: 93966 - DNA, 2763 bp, Glycine max
  Peptide Sequence Number=SeqID_210744
atgttaactttcactggaaaacgagaaatggagatggagaaaaaacgttccaaaggaagcttcctcagcttgtttgattggaactccaaatctcgaaagaagctggtctggaacgatcctgaggttccaaagcaagggaaggaaaatgtggagaacttaccgaagtcacagctcactaggaaaaaggtggatgaaattggagaaagtccaagtaacattcaaagttgtgatttcgacagcaccctttcaatttgtagtgatgaaggatgtgggagtaaagcccctgggttagtagcaagactcatgggtttggactcgttgccagctgcggcagtcactgagctctcctgcacttcattgtatggctctaaatctcatggagcttctcattgtaatgagggtgctcttcactcagcggatgacttttgccctgcagactacataaacacactgcttaagccagagaagtcttctttggatgccatggaatcaagggcacgaaaagtggaaagccttccaataaagagatttcaaactgaaatgttgcctccaaagtcagctaaaaccattccagttactcacaataaactgttgtctcctatcaagagtcctagtattctgccaccaaaaaatgcagatcacgtaatggaggcagctgctaagataattgaggcaagccctcggccatatttgaggaatagaacaacatcaaccgagccttcatctgttcccttgagaattctcaatttgaaagagagatttgaagctgcacaatatgcatccatgcctggaaagcttgtgaatctgagcaatgcctatcctgcaaatggcaggcttagtgagaggaacagtaatttgtataaatgcacttcagcagtcaagggttcaagaggttcagaaaagaatagttcttgccatttagccagtaaaggaaaatcagtttcacttacagccaaaaacaatgctcatagtagagatacattgatttcaaatgatgatattccatgcatgaaacagaaagagaagaatgagataaagtcaaatcaactctcaaggagccacaaacctagtacacaaaaaactatgcagcagaggccttgctcaagccggaatagcaatgtgcttgggcagaacaatcaaaagcaaaatagcatgactgccaagggtaaatcaacttcaaaaatagattctaataagctaacaacacgagcttcatcttcagaaacttctggaataaggaagacaacgaacaagggtactataactgcaaatattcaacctaaaaggtcaagcactagggcaactgacaaccaaaagcagttttcaagatccaaaacagtgagtatttcccagaagaaaaagattagcaaagatgttcatgagggaagaggtcctgataatgcagtaaataattttggaagtaagtccattaaatgcaattttacgacggatggaagttttgatcaggatgcatttaacatgatagaaagcaaggatgttatttcatttacatttacatctcccttgaggagaactatgcctgagtcatcatcctctaccgagcaagtgatgggaaccagaaatagaattgatgtcaactctcttgggcatagtgataatctttatcccaaaaaattatcattatctccgacagggcaacctatgatagatagtgatgctttaagtgtcctgttggacaaaaagctgcaagaattggcatctagaattaacttacctcaatgtaccttggccacagaggggtcttctactggtttgagatctagtgtgcaagatcaagttcccagtgtgtcaagcaccacgcctaaggaacaaaacaaaagcttttgcagtgacctgtctagtgataaactggatagcatgcataactctcattattgttcaagtgatgatccagtgcttaacatgaatcagcaactgcagacatcagaagtaagtgaagatcctagctgcagtagcaacagtgaaagaggaaatgatctagtttgttggcattccactgctgttgcaggttttgaaactccttttgtctgcgaaagttacttggatagtgaagacagtgcatatggcagcacagtttattcatccacacaagatgaagaagtatctagtttttcccagataagcgaacctgtatcacttgaaagtgaggtgaaagggtcagaggaaagctcttccccattgggggacggaaaaatgaccatcaaacaaataagtgaaatatcaaattctgttgattttaaaagatcaaggaacacggtacttgaatacgtacatgatattctttgcaatgcagagttcatggcagaagaatttgtcatgggtcaaacaagtgcactcataatgccaaatgtctttgatctgttggagaatcagcattatggaacagaaaatttcggagaagagtactctatgcttgaaaggaaggctatatttgactgtgcgagtgagttgctggagttgagatgtaaggaagcttttgttggaacatgcaaagcatggtctggatggatgatgttaattcagaggaagagctggatggcagaggaactgtacaaggaattgctgggttttagaagcatggaagaggtaatggtggatgagcttgtcaccaaggacatgagctctggatgtgggaaatggcttgactttgatgttgaagcatttgaagagggtttagagattgagggggacatactatctcatttgattaatgaattggtttcagatttgttacttgtctaa

SEQ ID NO: 93967 - DNA, 339 bp, Glycine max
  Peptide Sequence Number=SeqID_210745
atggaacctcgaagtgttgaattgaagacagagagagtgagagagaaattcgtgcgaatgttcgaaaccgaaaaaggccaaaaccgccaaaaaagcgtcacgaaacggagggatggaagcgtttcgacttggagtctgcagaacccgacacgtatcccacattcgctggttctgtttgtggtcgctttcttacccctgacgctgttacgtctcaacgctgtctgtcacaaactccgttactctccccacttgcctcttaaagcgacgtcgtttggtcccgtcactcactcgtccctcgcgtttttctcgtgtccatctgctagctgtcaacggttttaa

SEQ ID NO: 93968 - DNA, 1255 bp, Glycine max
  Peptide Sequence Number=SeqID_210746
atggtatcaaaaaggcaatctggtcagaggcacgaaggcagtggcaaagttccaattcaggagcaaaaacaaacatcaatcagtggccttagaaatgtgatcaacgcgctatggatgagtgaccactctgcctatttggaaaattttctgcgaagagtggtaagcgaggtggtggaacaaaaattcgaggaccaagctcatctatttccaagaaaaagggttggtgaggctggcatatccggagccaaaccctttaagttgtgttttattaataagctgcccgaaacaatttttactcggtctagtataatagcagaagataaatcaccccttcaaattgtcctatttgatgttagaacccagtctgtagtaaatgatggtcctctctcctcactaaagatagagatctgtgtcctggatggagagtttggatctcaaggcagtgaggattggactgaagaagagttcaattccaatatcttacgcgaaagagaaggtaaagagcctctattgattggagagaggtttgctagtctaaaaaatggagttggttgtatacctaaaattgccatctctgacaactcgagatggctaagaagcagaaggttcagcattggagtcaaagttgtgcaaccaacttccaacggagaaaagattcaggagggtagaagtaaaccttttgtggtcaaagataacagaggagagtcctacaagaaacactaccctccgtacttgaagttgaatgatgatatatggcgtttgaagaaaattgctaaggaaggaaaaatccacaagcagctgtcttcgcgtggaattcacaatgttaaggatcttttgcggttgtacataaccaacgaaccttcattatatgaaatgtttggaaatattccaaagaagtcatggttagtaatcactgaacatgccaaagcctgcgtgatagatgattaccagctttacagctatcattcacaagaactgcaaataggcttgctattcaattccatctacatccttgtgggagtgacatttgattggcaaaattattactcaccagatactctcaccccaagagaaaagcatttggtggaaatagtgaagcagcaagcttataaaaacgtcaacaatttggaattgattaatgacactaaattgaactatttaaatctagctgcatgtctaaaagcaagagaatctgatcctccagatcaaggtctgcaccatattaacatctcaactgtacaaggtatatttaaag

SEQ ID NO: 93969 - DNA, 2340 bp, Glycine max
  Peptide Sequence Number=SeqID_210747
atgcatgcttatggcgctttgattattgttgcattgagtactctcttgatcttcatttataattgttctgatcaagttctagttactcgagaaaggagaaaggctaaatccagggaatcagctgctagacaagtaagagaaactgtacaggctcgagaaaggtggaaaatagcaaaagatgttgctaagaaaggtagagggggattgcaagagcaattatctcgcactttttctcgcaaaaaatcagtaaagcaatcagatcattctagccaagctaaacgtggtacgggtgatacatttttgccaccaatgcctccaaattcttcaagcttatatgagcagccatctgcagctttaaaagcacaaaacaaggaacctaccaaccttactaaaatgttgaattccctcgaggatgatccccacagcaatgaaggattcaatctacaaattggagataaaaatattaaaaagcagatgccaaagggcaagaatttacatacacaaagccagattttaaggtatgcttatggtcagattgagaaggagaaagctcaacaagagaaaaacaagaacttgactttctcaggagttatttcaatggctactgaaggcgatgttcgaacaaggcctgtgattgaggtagcttttaaggatttaactcttactttgaaaggtaaaagaaaacatataatgagatgtgtgactggtaaactaatgccgggtcgagtttctgctgtgatgggtccctctggagccggcaaaactacatttctttctgccttggcagggaaggcaagaggatgcacgatgacaggctcaattctaatcaatggaaagcccgaatccattcattgttatcagaaaattattggttatgtgccacaagatgatattgtgcatgggaacttgacagtggaggaaaatcttcgtttcagcgcaagatgcagactgtctgcggatatgccaaaaccagataaggttctgattgttgaaagagtaattgagtccttaggactccaggcagtgagggactcccttgttgggacagtagagaagagaggtatatctggagggcaacgaaagcgtgtaaatgtagggatggagatggttatggagccttcattattaatcttagatgagcctacaactggcctagacagtgcatcttccactttactacttaaagcacttcgtcgcgaagcacttgaaggtgtaaatatatgcatggtacttcaccaaccaagctatactttgttcagaatgtttgatgatataatctttctagccaaaggtggccttactgcatatcatggtcctgttaaaaaggtagaagaatactttgctggcattggaatcactgtacccgatcgcgtgaatcctccggaccatttcatcgacattttggaaggtttagtgaaaccaaatggaaatgtgacccatcaacaacttcctgttagatggatgttacataatagttacccagtaccaccagacatgcttcattttgctgatcaaattgctgccacctcctcctcctcctcctcctcaaatacaaatcatgcaataaagggcacagatgaagttgttgatcaatcctttgctggagagttttgggaggatatgaagagtaatgttcagatgcaacgagatcatctagaggcaaccttcttaaagactaaggacttatcaaatcgaagagctccgggcgtagctcgacaatatagatattaccttgggcggatttgtaagcagacgctacgagaaggaaaatcacaagcagttgactacctccttttgttagttgctggtgctatattaggaactcttactaaagttaatgacgaaacatttggttcccttggatatacctatactgttattgctgtctctttactttgcaagattgcagcactcagagcattttctctggataaattacaatactggagggagagtgcatctggaattagtagtctggctcattttttggccaaagatacaattgaactgttcaatataatcatcaaacctgtagtttatctgtccatgttctatttttttagcaatccaaggtcaagctttgcaagtaattatgcagttttggtctgccttgtgtactgtgtaactggcatggcttatgcaatagcaatttattttgagcctgctccagcacaactgtggtcagtgcttctcccggttgttatgactcttattgcgaaccaaacaagagatactgtctttatgaaggtcctcataaagttgtgctacccaaattgggctttggaggcctttatcattgcaaatgctgaaagatgtgcgagctcaaataataacatttaa

SEQ ID NO: 93970 - DNA, 1148 bp, Glycine max
  Peptide Sequence Number=SeqID_210748
atggaacctccgtctgaaagtctaggccctcctccatcaccattcaccgcagttgcttctgccaccataggtgccctccataggtcaccgttcattgcttttgcgttgaagcaattgttcaagttgcaggcttttgcaccttcctctctctcgggacaagagagcagaataatggaggagctccaaaccccaagctataatggccaaaccgaaaacccagacactctcctcttcgaagacattgacagcacctgctccactccctacgtcagcgccccttccagtcccggccggggacccatctccgccgccggaggagggttcttctacagtgctccggctagcccaatgcacttcaccataaccgccgcttccacttacacacactcagcctcttcttcctcggaaaaaaactctggttgcgattttgagttctcggcccggttcgtttcgagcgggtttactggttccggttcgatgagctcggcggacgagctgttcttgaacggtcagatccggcccatgaagctctcgacccacttggagcggccgcaggtcttagctcccttgctggatctcgaagaagagggcgaagaaaacgaggaagttgaagccagtgtacggggtagagatctgaggctgcgcgacaaatcactccgcagaaggaccagatccctgtcacctcttcggaacacgccgttagagtggacggagaacgaggaaaaaacggaaaagaaggaaaacgtggacccttccgtttcgagcggaagtggaaggagttccaagaggtgggttttcttgagggatttcttaagaagcaaaagcgagggaaggagtaataacaagttctggtccactatttccttttcccccgccgcaaaggacaagaagccccaaaatcagggaaatgggccgcagaagcccaagaaggtcgccggaaagcccactaacggcatcgggaagaagcgagtgccggcggcgtcgccgcacgagttgcattataaagccaacagagcgcaagcggaggagttgagaaggaaaacttttttgccttataggcagggcttgcttgggtgcttgggatttagttccaaaggttatggtgccatgagtggctttgctagagccttaaaccccgtctcttccag

SEQ ID NO: 93971 - DNA, 756 bp, Glycine max
  Peptide Sequence Number=SeqID_210749
atgaggaactgtgcctcatggctccctcttctcttctcgttgatccctctcttcgcgtggcggattcagtgcgccgataacaattttgcaccctccttttactccgaagaaatctacaaggagcttgaaagcctcgcttccctgttaaacaaggacattaaagcaggtttaggtttctgcatcaaggatgtgaataaagattgggaggaagcatttgattttaaaggaaggttggatttcgtggattcttgtgttaagaaaaaaggagatttcagagatagaatatgtactgtggctgaaataaggtactacttccacggtttcttggcagaaggggcctcatctgccaattacgtaaaacctaacaagaattgcaatttgacctcatgggtttctggttgtgaacctggatggagttgtagtgctggaaaaaatgttgacctcaaaaaggacataaaggaaattccttttagaaccagtaactgtcagccttgttgtgaagggtttttttgccctcaaggattgacttgtatgataccttgcccactaggttcttattgtccacttgcaaaactgaacaattcgaccggaatatgtgacccatatagttaccagataccacagggagaaacaaatcatacttgtggcggtgctgatatttggtctggtgtggtgaacaatagtgatatcttttgttctccagggtcctactgcccgactacaacacgcaaagtttcttgtgacagtgggtattga

SEQ ID NO: 93972 - DNA, 339 bp, Glycine max
  Peptide Sequence Number=SeqID_210750
atggaggggatccaacaccactacgctcgatcctgctcctatctacacgaggtgaatgtgaagagcatgaacaacgacaacaaaatgtgggttgcgaggagcaccactactccctcagctttgtattccaatgaagtagcatctggagaacgttatggcccacaaatggcggtgacgaagccatcgagcacatggtggtggaatgaggctgaaaggaagagaaagcgtagagtgtttaaatacaagttgtacgcagcagaaggcaaactcaagcattctgtcaagaaagggtttcgctggttgaagatcaaatgcatcaagattgtaagcaatctctag

SEQ ID NO: 93973 - DNA, 1296 bp, Glycine max
  Peptide Sequence Number=SeqID_210751
atgtcccgtttcctaggaaaatcccttaggactaaggggcccttgtttctgcacaaaattttgggaatctcgtccgagtcgcataacatcctggccgctgctgccaccactgaaccctcaacctccgatgggctcacggtccaaggaattctggccaataattggaacattctcgacgaaaacgacggcgattggaagagtcatgccaccgccatagctcaatctattcacttgatcaaacgccgtttacattgggaaaaattgaaggtgaggttggatatgttatcattccagctgagtaaggaagacctttgggatgatccggtgcgtgcaggtaaaataagccgagagcacggttcgctcttgggaaaaatgaaagaggtaaatgcatttgaacaagagttgcttgagcacattgacatgataaagcttgcgcgcgaagagaatgatgcggatttggaatcggaatcactgaaagcgttgcttaacatgagaagaaatgcaaaagagaaagagctagaggcattgctttctggggagcaagattcttgttcgtgctacattgaggttcaagctggtgctgggggtactgagagcatggactgggctgcaatggtcatgcagatgtataagtcatgggcacagcaacgtggatataaagtaactgtagtggatgaaatgcctggtgagattgcaggaatcaagcgagctaccatcaaagtagatggtgagtttgcatttggatatgccaaagcagaaataggagtgcacaggctggtgcgcatatcaccttttgacagtaataagcgccggcatacttcatttgccgctgtggcagtgattccaatccttggtgatggatctacccatgtacaaattaatgaatctgatcttcgaattgaacgatttcgtgctggtggtgctggtggccaacatgttaacacaactgagagtgctgtaagaatagttcatattcctacaggagttactgcaacttgtcagaatgaaagatcgcagcatcagaataaggcttcagcaatggctgtacttcagtcaagattagaccaactggagatggcacgccaggcacagttcaatgcacaacatacacaatctctcaccgacataacatggggcagtcagattcgtagttatgttctccatccttaccgtatggtgaaagatcttagaactaactatgaggtttcagatcctgactctgtccttgagggagatctagacagtttcatcttaagctatctgtcagcttctttggataaagatgatgatgcttaa

SEQ ID NO: 93974 - DNA, 489 bp, Glycine max
  Peptide Sequence Number=SeqID_210752
atgaagtggaccttgaatcccgcttgggcaagactcaggtatgccactaagctcgatgctctagttgttacgccggttgcaccactaagtcagcaggctggatactactgctcagtttgtgagtgtgtggtgaaggactctgcaaactacttggatcatattaatggaaagaaacatcaaagagccttgggcatgtccatgcgagtagaacgtgcttctctccaacaggttcaggaacgatttgaagttcttaagaagcgtaaagatgttggcagcttcacagagcaagatcttgacgagcggattttaaaacagcagcaagaggaggaagaaagaaagcgactgcgtcgagaaaagaaaaaagaaaagctaatagcatgtgttaaattttggattcagaaggagaaggcagttgaagaacctgaaattgatcctgatgttgctgccatgatggggtttggaggtttccggtcatccaacaagaaatga

SEQ ID NO: 93975 - DNA, 567 bp, Glycine max
  Peptide Sequence Number=SeqID_210753
atgagtgaagcaacaacaagaaacgaacggcgggttctggtggcggtggacgaaggcgaggaaagcatgtacgctctttcttggagcctcaagaacataattttccaaaattccagcgatacccttatccttctttacgtcaagccccctcatgccgtttattcccccttagattccacagccaggatagatcatcctgaaactccaggatatttgttttcgtcggacgtaagtgcggccatcgagaagtatggccaagaagtggcagattgcgtgttagagaaagcaaaaaaattgtgtaaagatctccaaaacgtcaaggtggaaacccgggtagaaattggagacccaagggacgtgatctgtgacatgtctcaaaagttgggtgctgacttgttaatcatgggtagccacggctatggagttgtaaagagtgaaatgtgttttgggaattacatgaattacagggctttccttggaagtgtgagcaattactgctcacagaacgtgaagtgcccaattttgatagtcaagaagccaaaaccatctgctggtgctggaaaatga

SEQ ID NO: 93976 - DNA, 240 bp, Glycine max
  Peptide Sequence Number=SeqID_210754
atgtgggggaactttggtggcggcaacttacagttgtggggtctgatgggggtgattttcggcagcaaaaaggaaagggttgtaaggtggtggtggaggagaaggagaaagaggagtgtggtgtggtgttgttgttttgtggtggagggggttgttaaggaagacgacgggagtgtggtcagggacgaagaggggttcgtcagcgacaaaggtggagaggacaaagttagtgaggcgtag

SEQ ID NO: 93977 - DNA, 491 bp, Glycine max
  Peptide Sequence Number=SeqID_210755
aaatatcacaattgcagtctgctgttattggccctttcactgtcataggatctgacaccaaaattgggaataacactaaaatttcaaattctgttattggtgaaggatgtaaaattgggtcaaatgttatcatagagggatgctatatatgggataacatcatcatagaagatggctgtaaactccagcatgcaattatatgtgatggggtgactataaagtcgggggctgttctggaacctggtgttattttgtcttttaagcttttgatgcatccaggaattttatgcttccaggttgtagttgggccagaatttgttgttcctccctattcaaaggtatctctatttcagcagccaattgaggaagatagcgacgaggagcttgaatatgctgatagtactagtggtattgtttattctcctgctgttattgtttattctcctgctgttaaattagctttgcaaaatgtgatattcatagccatatga

SEQ ID NO: 93978 - DNA, 534 bp, Glycine max
  Peptide Sequence Number=SeqID_210756
atgggtggggctggacatgtgtggtcaacatgtgaaggcagccatgaagaagagtggaggcattcggtggcgcctattcctaaagataaaattctggaggcaattaaaactatggaagatgatctggagttaactcatgatgatagttttctcccaccttctggagagctgaaacctaattctaattattcagatgatgatgatcatgaagattctagagatgactcttattactttgataaagaggttgaagcaacctttctcagggctgtgcatgaaaacatacaagaaagccatctgatcttagagatcaattctttgaagttgtcatacaataagctagctgctgattgtgctggagctgtattttatgccatgatgaagtatgctttagataccccccatagttcagctgatggtttgcttcaaaatgttcaggctgtatttacaaaatggaaaaaggctcttacatcctatctgactgacatagatgagcaggtgcatatgtcaattctctcccctttacttgtttaa

SEQ ID NO: 93979 - DNA, 387 bp, Glycine max
  Peptide Sequence Number=SeqID_210757
atgggaccaggcagtctaggcccaggaggccctcctggttggggtgcacctggcccaccaggcccaggacatttcggtgggttttgcgatatcattagcacttgcaacaagcgccacgagaatgccaaagccttggaaggtgccttgatgttccacagagtactaataccttttggggtgatggcagtttgtattgtctatgttgctgctgtctcctggagagttgttgcggcccaatgcttggtggacctcctcctgggccccctggcccaggtttctgataatccatacttaagatccatttcaagaggaatcgaggaaattaaaaaaagaaaaacattctgtgtgagtagtattccgacttatttaaataccagtgccttttaa

SEQ ID NO: 93980 - DNA, 2085 bp, Glycine max
  Peptide Sequence Number=SeqID_210758
aactttaatggtttggaagagaaaaaattgatgttttcactacatccatcgcttgctgttggttgccacagtgatttggacttgaaagcgcccatcttttcatgtctattgatattgattgttgatgcatcacttggcttgttgatgtcctctttgaatcaatctctctttccatacgactcttcgtccttgactgtttcttcatctgtgttcaacccttatgcttttttaagcaaccgtcatcacactctcacactcacacttcacacttcacaacatagaagacagatgagttctttgctacctcaagttgccaagaacaaagcaatgtggctgaatcccaaggttttgggttttaatcctcctgaaagatggggccactctgcttgcttctccaaggggcttatgtatgtctttgggggttgctgtggtggactgcatttttgcgatgttctgactttggaccttaacaaaatggtttggagcaagcttactaccacaggtgaaaagccggggcctagagatagccatagtgctgttcttgtggggcataaaatgatagtgtttggtggcacaaatggcttcaagaaggttaatcacattcatatacttgatcttgttaccaaagagtgggttcgacctgagtgtaaagggaatcctccttctcctcgtgaaagccatactgccacacttgttggtgatgaaaggatagtgatatttggtggaagtggagaaggtcatgctaactatttaaacgatttgcatattcttgatcttcgaaccatgagttggacttcccctgagttgaaaggtgatttgcctatccctagggacagtcatagtacacttgcaattgggaacaagcttattgtgtatggtggagactccggtgatcagtatcatggcaatgttcatatgcttgatatgacaacaatgacttggtctaaattgtcaattcaaggttctccaccaggagtcagggcaggtcatgctgcagtgaacattggaaccaaggcaagttatgtctatatcattggaggagttggagataaacgttactataatgacgtttggatctttgatatatgcaatttttcatggactcaacttgatatacgttttcaccagccacaagggcgattttctcatacagctgttgctgctggcatggatattgcaatatatggcgggtgtggtgaagatgaacgtcctctcaatgaattgttagtgttgcaggttggagcagagcatttaaatggagtttactacattcccatgtgcaaaccttttggaacttattggaatcaagaaaagaagattatcccaggagaagcagatgccaactcgaaaactttactcgtgaggaataacgtggaagcttttggcaaaggagcttatgaagttgcatcagaaaaattgccaccttatcactttgattcaggtgggttgagttttatgccttatttggataaacttcttagtaggtattcctatacttcacgacagaagaggaggagaattgctgctgcaaagattggtgctgaagttcgggggagagttgatggaccctttgactcagtttcgctctctcctgcagctgtgaatggaaggattttcaggggggtcatattttcacctggagcagcaggagttgtctcaaaagggggcagtgtcgaaccaaagtgttctctaacaagttcttttcctttttcctctcaagcatatttgaactccaatcatgtgggtaatttaacggcttcccaacaagcacctattcgtttgcatgcagagccatgccatggttcatggcaaacgccagttgcattaccatttccaatcattcgaggcactccaagtgttgtttccaaggagaataaaatcaatagtgaccttcaagggttggttttaaccctcggaggacctgctagtggacaccctcaggatgcaaatggtgttgggcacgcccaagtagctgcattaccaaaggacccattgctggccatggccatgaagctgacaactgctagcccactagcccctttgactatttcctcaaggttgcttggttcaatgcttcaaacttga

SEQ ID NO: 93981 - DNA, 204 bp, Glycine max
  Peptide Sequence Number=SeqID_210759
atgggggcgaaagggggctgttctaaggatctctcatccccgtggctatgcatttcagctgtttttggtgaaaaaaattgtttccgtgaagaaaatccaagccgaggtgcttccgtaacgcttccgagacatttctgtgagcaaattcgtgaagatttttcatcgttcttcaccgttcttcatccgttcttcgttcttcagctg

SEQ ID NO: 93982 - DNA, 294 bp, Glycine max
  Peptide Sequence Number=SeqID_210760
atggttggaggtgtaggtcatgaggaccccatgagtttcattaatatggagctaccaaaggacaaggacgtatctatttatgggttttggtctgtttctgagataggtgctgcttgcttaattggaatcgttttcggtgtaaaacgtgggatgcaaatctctggtcaactaggtcatagaaacaggtggaacctctgcactagaaatctagaatatgtggatatgaattttagggtaggcctacttagctggttgagtgaatatggagaagcaataaaaggaaaatcaatctaa

SEQ ID NO: 93983 - DNA, 849 bp, Glycine max
  Peptide Sequence Number=SeqID_210761
atgtttgggtttagaaaaacaccagcaccaactgaatcagataagaagacaacccttactgcagaaaaaagaactgcttcagaacctgtcctgccagttccaaaatctaaaggaaactatttcgactacgatgacgacgattgggggaggaagccttcctcatccacagcatcaaaggacaaagacaggtacaagaatggtttcagcaactctggggggctagagaaccaaagtgttcaggagctggaaaactatgcagtgtacaagtctgaggagacaacaaagagtgtcaacaattgtttgaggattgctgaggacatcagaggggatgccacaaggacccttgacatgttgcaccagcagggtgagcagataaccaggactcacaatatggttgttgatactgagaaggatttgagccgggtagagcataggttactttgctccataatagtatatacctatgatgccaccaaggttttgaattatggttacagttgttgttttgatatggaccaatacaataagccatccaaaaagaatgtacatagtaaggaagacagggagaagttgggcttagctcctttgcctaagggacgctcagcccctaccacacctcctaatgaatcatccgatgcctatcagaaagttgattatgagaaagctaaacaagacgatgcactggaagatctaagtgacatcttgggtgatttgaagggtatggcaattagcatgggatctgaacttgacaagcaaaacaaagctcttgatcatcttgctgacgatgtggatgagctgaattctcgagtcaaaggtgccaaccagcgtgcacgcaaattagtagggtga

SEQ ID NO: 93984 - DNA, 504 bp, Glycine max
  Peptide Sequence Number=SeqID_210762
atgcagaaaacaaaagtgtgctgcatcttttcattctcttctcccttggccaaaaagaattcaacaaggactaatcgcctgaattctttttgtgcctctcttctcccttttccaaaagaacgaaggactaaccgcctgaattcttttgtgtctcccttctctctttccaagagaattcaaaggactaaccgcctgagaattctttgtcttaacacattggagggtacatcctttgtggtacaagtagaggagaacaagggagggtacatcccttgtggatctttgcttgtaaaggattttacaaggttgaaagaaatctcaagaaccggtggttgcttggggactggatgtaggcatgggtgtcgcaacctacccttcggcgggagggcgatgcgtgactcgcgggtgagtcttccaagaaaggaatacgcgcggagtcgccaccaacgtttatttgaggaaaacgtcggaaaaatcggaaaagacgtggtctacaaattttaa

SEQ ID NO: 93985 - DNA, 144 bp, Glycine max
  Peptide Sequence Number=SeqID_210763
atgagcccattaagaatgcggcttcacaagatggacttcatgggttacagactttgtcgtacaggcttcgcaggatggacttacccacatgccaactctatgaagcataagatcatagaccacgggtgtcctctaacccactag

SEQ ID NO: 93986 - DNA, 978 bp, Glycine max
  Peptide Sequence Number=SeqID_210764
atggtgatctaccttactgcttcatctttagcatatgctgtggtttccagaagtgctcacgaaaatctccttcaggctcccttattgtctagatcaaatagcactgaggcttcattggcaaaggataattcctctaatgatgtaaaaaatggtcaagggtacaaaggtcatagtatgcttgctcctttcacggctgggtggcagtcttctgatttgcaccctctgatcatagaaaagtcagagggaagctatgtatatgacattaatgggaagaaatatcttgatgcacttgctggtctatgggccacttctttagggggaagtgagccacgccttgttgatgctgccgttgcacaactaaagaagttgccattttaccattccttttggaatcgaaccacattaccttctttggatctagcaaaggaactcctagaaatgttcacagccagaaaaatggggaaagctttttttgttaatagtggatcagaagccaatgacactcaggtgaaacttgtatggtattataacaatgcgcttggaagaccagataagaagaaattcatagctcgtgctaaatcgtatcatggttcaacattgatagcagccagtctttctggccttccggctctgcatcaaaaatttgatttgccagctccttttgtattacacactgactgtccacattactggcggtatcatcttccaggtgagacagaggaagaattttcaaccagattagccaataatttggagcagttgattctgaaagagggaccagagactgtaatacattcagatacatgcaaagtggtttctactactggaacattgattgctgcatttattgctgaacctgtaatgggggcaggaggtgtaatacctccaccatcaacttattttgagaagagttgtcaatttatcccagcccagagcctcagggcctcatccctggcgcctatgtgggtcagagcctaa

SEQ ID NO: 93987 - DNA, 1128 bp, Glycine max
  Peptide Sequence Number=SeqID_210765
atgtattcccagtgcattgttatagaagatgcgctagctggagtggaagctgccaaagctgcacaaatgagatgcatagctgtaaggaccacattatcagacgaggctctagaaccagctggcccaacacttatccgagataacataggaagtgtttcgcttgatgatattctcagtggtggctctgttggatatatgctcaagagtgtagatattatattgcatgaggtcttatatagacatgccattgcagataagaggatgcagggctctgaaacactaaatgattttgcggagtcttcatctactgtgcttgctggagggttgcagggttctcggcgagatatactgagatttggaagtctgggaattgctatctcttgccttttcttcaccataagtaactggaaggcaatgcaatatgcttcccctaaagcagtttggaataagttgtttggtgttacccagccacccttggagcagaaagaagataactcaagagatgataggatccagcaatttgtgaactacatatctgatctggaaagcaggggaaatgctcagattgttccagaatttccgtctaaacttgattggctgaatacagctccacttcagtttcgcagggatctgaaaggaaaagttgtattgctggatttctggacttattgttgtataaactgtatgcatgtgttgccagagctagatgttttggagaaaaaatacaaagatatgccgttcgttgttgtgggtgttcattctgcaaaatttgataatgagaaagattctgaagccattcgcaatgcagttctacgctatggcatttctcacccaaaaaatttaacactggttgtcaatgatggagacatgtatctttggcggaagttgggtataaactcatggccaacatttgctattgttggccccaatggtaaggttcttgcacaacttgcaggagaaggtcacaagaaggaggcattacatcaagagtgtttggttgttaaactcacaacagtgagtgatttagcgttttgtcatgagagccttacaattgcaaagagggtgaagaggggtgaaggaaggggagaagaatggagatggaaggaaggaatgactcctaatggttga

SEQ ID NO: 93988 - DNA, 2406 bp, Glycine max
  Peptide Sequence Number=SeqID_210766
atggagctcaacctctctactgtaccatgcactgtttactattaccaaagttctaaaccagcaagtaacagcagacttattgggttgattagtaaagcggcaagacagtctggaatacatgggcaaagagggccggacaacaacaacaaaaagccttacctcactaggaaagtcggtcttgcctcctggagtttgaaaactagtatttatcccatcatacatgtcttgtatggctatgatgttgttgcgatcactgtattctgcttattggtgattgctttctatgctttccttgctcccttcattggagggggtcatatatgggaatataccttcattgctatttactctcctgtggctctcattgtgttcattctttacgtcagatgcactgcaattaaccctgcagatccgggcattatatctaagtttgaccctagagtgggaaataagttcagttctgctcatgatttatcagggaagcatcatggttctgaacatgaacgcattgctgctagagagcaatattctccgtcatctgctgcttccaaaaggtctatgagcaagaagagctcagtggaagatcttgatagagtagataattcaaggaaagagaataaccagaactcgtgtaatgcaattggaggaattttctgcatattattttcacatgaagattgccggaaacaggaagcaacagctgatgagcagggtggtggtgaagatgctttgttctgcactttgtgcaatgctgaggtgcgcaagttcagtaaacattgtagaagttgtgataaatgtgttgatggcttcgatcaccattgtcggtggcttaacaattgtgtgggtcacaaaaattacagttcttttattgctctcatggcttttagtcttgcgtggctagttattgaagctggagttggtgttgctgtttttgtgcgtttctttgttaacaagagaggaatggagtctgaaatcattgatagactcggaaatggattctctcggcccccatttgcagccgttgtggttgtatgtactgtagtttctatcttggcttgtgtgcctttgggtgagcttttctttttccacatgatactaattaggaagggcatcactacctatgaatatgttgtagcaatgagagccatgagcgaagcacctgctggagcatctgttgatgaggatttgccaaatatactttactctccaacaggctcagccacaactggattgagtggaggaagttcacttggtttgcagtataaaggggcttggtgtacccctcctagggtattcgtggattatcaggatgaagttgtgcctcacttggagcctggaatgctaccatcaactgttgatccagatgcagctgggattgcagaaagagggcaaaagatgccaaaaagacctgttcgtattagtgcttggaagcttgctaagttggattcacaagaggcagtgagagcagctgcaaaagccagggcatcttcttcagttttgcgacctgtagataaccaccgtctaccagatggagaattgagctctagtggcaacatgagcatcagaagtagtttgagcacagagactggaactaacaaggaaataaaacacgagttgagattgtctccagtgagaaattctattgctcctagtcaaggaagtcgtgatgagtatgagactggaactcaaagtatgagtagttttagtagtcctagccatgttcaagaggcagttacactcagccctcttccacaggaccacagtttgggtggcttcagggcaggtacctcaattcctagtttggtgcctgagcgtcctttaacttctaaagcaacattgtcaaacttcaggaacccaatatctagtccttctcttggatttgatgggaggacagcaatgccaaaaggaattggtaatgatccattgttgctttcaacttctaacacttctattctaagagacgtgaaacgggcatcagttgtttgggatcaagaagctggcagatatgtttcggttcctttattgccctctgaagctcgaaataggtcatccatgcgcatagaatttccaaatgtaaatgctgaaacaagcagtattgggagaaaatcagtgattcctcagcaggagttgtcatcatctgcacccaaatctcctgggcagcacatacagaatctgatgtatacaggagattctatcttttatggaggtccatttttgagtgcccctgttaaagatggtttgagaaatgaaagacatttggcatcaactgatgcccaagagggcagcatatcggtgaacttgcctcaagagccaagatataaaaggaatttactctcaaatcagcttcctgtgtttgtccctggtgggtttgagaatatccttcaacctcgatctggcatgaattag

SEQ ID NO: 93989 - DNA, 1065 bp, Glycine max
  Peptide Sequence Number=SeqID_210767
atggctgtggccaatcttaaatatgacaatagttctacaagcacatcatttgcccaaccttctggtctttcgttgtctcaagatctaagggagatctacattgctgatagtgagagtagttcaattcgagctatggatctgaaaacaagaggatctcagttgttagctggtggtgacccaatgttcgctgacaatttgtttaagtttggtgatcaagatggaataggctctgaggtacttcttcaacatccattgggagttgtgtgtggaaatgatggtgaaatttatattgcagatagctacaatcacaagatcaagaagttagatccaaccagtaaaagagttagcaccattgcggggaccggaaaagctggtttcaaagatggaacagctgtaaaagctcagctctctgaaccatcaggaattgttgaagggaacaaggggagattattcatagctgacacaaacaacagcttaattcgatatctagatttaaacattaatgaaactgaactccgtacgttggagctcaaaggaattcagcctcctaagccaaaatcaagatcttttaaacgtcttagacgacgagcatcagctgacacaatgccaattaccattgacaccatttcatcaaatgagggaaacttgtctattaaaatatcattaccaaatgagtatcatttctcaaaggtcctcatcatccccctttctttcaaacacactgtaattcaattcttggcatacaggcgggaagcacgcagtagattcagcgttgatattgaacctgaagatgctgtgaatattgatccactcgatggatttcttagtccagaaggatctgcaactcttcactttaaaagatcctctaacaatgcttcagtgggaagaattaattgcaaggtttactattgcaaggaagatgaagtttgtttgtaccagtctttgctgtttgaggtccccttccaagagggagtttctaaccctgccgaagcagacgtcactcttgcacattttgtgaaacccaaaacttcaaccagcaacttcctgcagtcagttgccccttaa

SEQ ID NO: 93990 - DNA, 231 bp, Glycine max
  Peptide Sequence Number=SeqID_210768
atgaaagtaaaacgagttagtaaggagtgtgcatgcgcatgtgatgaggacatgacaaggattaagggtaagaaacttttagaaaaatttgaaggacctatggcaaggactagaataaagaatgtcaaagaaattcttcaacaagtgttaatcatgctatttgaatttaggttcaagttacaagtggagaaactttggattgtcaattacgccatgtttcaagaagaatag

SEQ ID NO: 93991 - DNA, 213 bp, Glycine max
  Peptide Sequence Number=SeqID_210769
atggccgtaagactaaagtcaaattctctcatattttggaacatgctcaagcctagcgttcagggtgataccattctcgttgatttacttggtcatgatattccgaatgattttttacaggctaagattgttgagttctgtgatgaccgcggtggttgggattatcctttgttccaggggtttctttctaatgagataattgtggagatctag

SEQ ID NO: 93992 - DNA, 316 bp, Glycine max
  Peptide Sequence Number=SeqID_210770
atggcaagttatagcacttatttgtccttggcaatattggtggttgctggatctttaatgtacaacacaaaagaggtttcagctcaatgtggaggaagtcttacggatctcatagcacagtgctcacagtatgtgcaaaagtcgggaccacaaatcaagccttcagcggcgtgttgtgcagtgctgagaaaatttaatgtgcaatgtgcatgcaaacttattactaaggaagttgcaagccttgtgagtattccaaaggccgtttttgttgcacgcacttgtggattcaaccttcctcccgggatgcattgtggag

SEQ ID NO: 93993 - DNA, 5238 bp, Glycine max
  Peptide Sequence Number=SeqID_210771
atggagttcgtgggaaaaaccgttaggaaagaggtgaagggggttgggtttatcactggaacagtgaaatcctacgacccttcctctggttttttcgagatcgtttacgatgatggtgattctgaggaattggagtcttcccaggtggcttctctacttcaatttcaaccggggagtgtcaaggccaagccccgggttggtcggaaacctaagaagcggcgccgccgcgttgagcagaagccggatgctgaagccagttcaggtaatgttggcgataatttggtggaggagggtagtgcttttaggggggatttggatggaaatgtttcttctgctagtggtggggatttggatttagggtgtgaggggattgatagaaccattgatgttgatgttgggaatggagggaattctattggcaatgttaatgggagtgtgaaggaaaacgggggtggagaggaaattggttttgagtatggtttgaacaagagtgtctctgctaatggtagttgtgtcaaggatgggcttgatttgaatgctaggcttaatctcaatgaggattttaatctgaatgatgcttgtagtttacctcttgacaccgaggatggtttgaatagaagagattgtattgatttgaatttggatgtgagtaatgaagatgatgttggcgtgaattcgggttacctgggtcgtttgggtggggaggcattgcagcgggaatgtaattttgatttgaatgtcgaggtgtgtgaggaaggtagggaaactcggtgtgatgatgacggaaatggacattctgaggtaggtgatgctttgtttagtaggatggggcagctccaaaatgaagaagaggtaaatgttaataatagttctgtagaagatgacggagttaatggtaatttgaatcatgtgtctgatgctgtcaaattggagggagttcacgtttctgctgcccatgcagctaaagatggttctctgtgtttggttgaggaaaatggagctgatgatggcaaagaggatgaggcagctattgattctcatcagatttcaattgcaatttctgttagggattctgattctttggaggctcagcgagttcattgtccttctgaaggtggtgttgccataattcatgaacaccaagatgatccaagaagtccgtgcaaacaaggaaatagccgaaggaaaagaagaaaagtatcagataatccagaagtcacgccagagacagttttaaggaggagttctcgtcgggcatcagctagaaagcgggtttcaagcactgtactagtggaggtgactgatgatcctttgttgtccttggaaaccagtgccttaacagaagaaaagcctctaatccctggttctcagaaatatgagcaatgcagtgatcctcttccaaagctgcaattgcccccgtcttctacaaatttgaatttagatggcgttcctgttcttgaacttttttctatttatgcttgtttaagatcattcagtactttattatttttgagtccatttgagttggaggatcttgtagctgccctgaagtctgaaatcccaagtatattatttgacagcattcatgtttctattttgcaaactctgagaaagaatttggaatacctttccaatgagggttgccaatctgcatccaattgccttaggaatcttaactgggattttttggacctggttacatggcctattttcatggctgagtactttctgattcatggctcaggatttaaaactgattttgatcttaaacatctaatgttcagaactgattactacaaacaacctgtaattgtgaaagtcgagattcttcagcatctatgtaatgatatgattgaatcagaagccataaggtcagagcttaacagaagatctttggtaactgagtctgatgtgggttttgatcagaatatgtattttgacactggcaagaaaagaagagctgtaatggatgtgtctggtggctcttgcttgactgaggagaatgtggatgacacaactgactggaacagtgatgaatgttgcctgtgcaagatggatggttgtttaatatgctgtgacggttgccctgcagcattccactcaagatgtgtgggaattgccagtggccatctccctgaaggtgactggtattgccccgagtgtggaattggcaaacacatagcttggatgaaatcacgaaggtcacttcgaggagcagacttattagggatggatctggatggccgtctctattttaacagctgtggttacctgttagtgtcaaactcatctgaagcagggtcattgttcaattactaccacagaaatgatctacatgtagtaattgaagctctaaaatctatggatcctttatatgaaggcatactaatggctatctataagcattgggatatcagtgctaacttgagtgtgggggatagtgtctttagtcaaagttcctgcaagaacatgcagatgaagggagaatattctactatgcatacatttttagcaccttttacttcagagacatgtttggacaagaatcgggctaatgatcaaagtaagttggacgaaaattcaactattgttggttgtatgcatcttggccaagagtatccaaaagctgggaaccgcctagactcaacgaccaccatagaaagtccttgtgttgcttctgatggatcagctgataccacacagattagaacaggtgtcgacaatgttcagataaatgggctcagtgattcccatagatgtgatgaatccttgaatcagccaggaataccagaaagacaccatcctgttggtgactgttctaggttagatgtgggacgtaaaataaacttaagatctgtaggtgctagtattaccccctccacggacaataaggatacttcagaagtaccttctggaattgactacataaactattacagctttgcccgaacagcttcatttgtagcacaggagttgatgtgtaaatcacctgaaaagatgaataagatttttgcaatgtctgaagaagaaattatgtcagaccaagcaaaggtcattatgaagaaatctactaacttttgttggccaagtattcaggacctgaatgcagctgcccacaaagaaaaatgtgggtggtgctttacttgcaaaggtgaaaatgaagacagggattgcttgtttaattctgtggtgaagcctatttgggaagtgcctaataatactttagttgggcttcaacccaggaagatccagaatggacgtcttagagatatcatatgtcttatcttctctcttgaggttcgattacgtgggcttttgttgggtccatggttgaatctgcatcaaactgatctttggcataaggatcttttgaaggcatctgattttcttcctgttaaacgattattgcttcttttagaatccaatttgcggcttcttgcactttcagcagattggttaaagcatgtggattctgttgctacaatgggatctgctactcatattgtggtcagttcatcacgcacatcttcaaggcatggtattggaaggaaaagggccaggaatacagatattgaaacaagttcatcttcaaacactgctagtggtttggggatgtactggtggagaggtggcagactctcccgaaagttgtttaattgtaaggctttgcctcactccctggttaccaaggctgctagacaaggtgggtgtagaaagataccaggcattttatatcctgagaattcagattttgcacgtagaagcagatttgttgcctggcgagctgctgttgagatgtcaacaagtgccgagcagcttgctttacaggttagagagctttattcaaacataaggtggcatgatattgagaacaaccattccctatatgtgttggacaaggaatctagaaaatcagtgaggctgttcaaaaaatcaatcatacgcaggaagtgcactgaagggcaatctgtgaaataccttattgattttgggaagagaagggctattccagatgttgttattaaacagggttctttgttggaacaatcctctagtgagagaaaaaaatattggctggaggagacttatgttccattgcatcttctaaagaattttgaggaaaaaagaattgtccgcaagtccacggataagaaacttggaaaaattcttgagattggtagagtaaacaagaaaattcctcaacaaaagggattttcatatttgtttaccagattggaaagatctgattgccatcaatgtgggcactgcaacaaagatgttgcaatgagggatgctgtgaggtgccttcattgcaaaggatatttccacaagaggcatgtcaggaaatcaagtggcacaagaaccactggaagctcttattcatgtcacagatgtcaagatgggttgcaagcaaagactaatactaataaaaggaaagttgactcaaaactgcagaagattcaagcaaagaaacgtaaaattgtgccttcagtttgtaaatcattgaacctcaagggcaataaaaaggcatcgagtaagaataagattcgacaggtgagatctcgaaacagtaagaatatcccatcaagtatacctcttcgccgttctactaggaaggccaaatcgttgtatatgcatagtcaattgaatgggggacataaaaaaggaaagtcaactaaaaagaatgtggggcggaaaaagggaaagcaaagtcaaaccaagaaggtgacccctcaaaagtccaaggaaactactgatcaatataagaagttgccagttactactgcacataagaagagaacaagaacctgcaacagttattggcttaatggtcttcagttgtctagaaagtcaaatgatgaacgagtaatgctgtttaaagagaaaaagtgtgttgtctcatctgaagatttctctggctctgttgattatcctaaatgctgcctttgttgtggaaatgaatgcaccttgaattatattgcgtgtgaaatctgtggagattggtttcatggcgatgcttttgggctcaatgtggagaacaccagacaacttattggatttaagtgccatgtttgtcttgatagaactgctccaatctgtccccatttgaagattaatgcattgtctcgcactgaaagcaatgctgcaattgagtgtgcggaggagttatctaatcctgtttctctacaacctttaagtgaggatttgatgctcgagttggctatagatttagcctag

SEQ ID NO: 93994 - DNA, 1050 bp, Glycine max
  Peptide Sequence Number=SeqID_210772
atgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggctttttcttgccttgctgagagtctacaaaagaagaaaatgcatgaagagaaggagagaagatcacaaaaaggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacgaagggacgcggcagagtgagattcctcgcaagatgctagtagctaaggattga

SEQ ID NO: 93995 - DNA, 2082 bp, Glycine max
  Peptide Sequence Number=SeqID_210773
gaaaatagtagtagacccatctttgagctcactagtagcacactctcaaagctcctcactgctttaaatgaatgtacagaatggggtcaagtttttatactggatgctctttctagatacaaggcagctgatgctcgtgaggcagaaaacatagtagaaagagttacaccgcggttacagcatgccaattgtgcagttgtactatcagctgttaagatgatccttcaacaaatggagctcatcaccagtactgatgttgtccggaatctttgcaaaaagatggctcctcctcttgtgacattactctcggcagaacccgagatacaatatgttgccctgcggaatatcaatcttatagtacaaagaagaccaacaattcttgcacatgaaattaaggttttattggaatttaaggagtatgctactgaagttgatgtagattttgttagaaaagctgtccgtgcaattggtcgttgtgccatcaagttagaaagagcagctgaaagatgtattagtgttttgcttgaattgatcaagataaaagtaaactatgtggttcaagaggctatcattgttatcaaagatatatttagaagataccccaacacatatgagtccataattgcaacactttgtgagaacttagacaccctggatgagcctgaagccaaggcatcgatgatctggataattggtgaatatgcagagagaattgacaatgccgatgagcttcttgaaagtttcttggaaagtttccctgaagaacctgcacaagtccaactacaattgttgacagctactgtaaaacttttccttaagaagccaactgaaggcccacagcagatgattcaggtcctgccacataatgcatatagggttaacaagcaagatgtactgacctttctcaagcaaaaccaagatggaaataccctttttaccaagcatgttgttttgaacaatgccactgttgaaacagataatcctgatttgcggatcgtgcatacatatattggcgtctcctctcaactgaccccgagagaagcagctaaggatgttgtgttagctgagaagcctgtgataactgatgactcaaaccaacttgatccttctctacttgatgagcttcttgtcaacattgctacattatcttccgtctatcacaagcccccagatgcatttgtaacccgcacatacttgtctgcccagaaaaccgaagacgatgactatcctgagggaagtgaaacagggtattctgagtcacctggaaatcatgctaatggccctgcttcacctccacctactgcacctgtgcctgatttacttggtgatttgatgggcacggataatagttctattgttcctcccgatgagccaactactactactggacctccattgtctattgtacttcccacctcagttggtcatggttttcaagtcagtgcacagctgaccaggcaagatggtcaaatattttacagcatgttgtttgagaacaatactcatgttccacttgacggcttcatgattcagtttaacaagaacacatttggtctagcagctgctgggcccctccaggttccacaattgcaacctggaacctcagcgaggacactccttcctatggttatgttccagaacatgtcccaaggtcctcctagctcacttttgcaggttgctgttaaaaacaaccaacagcctgtgtggtattttaatgataaattctcattccatgtactttttactgaggatggtataatggaacgttccgctttcttagagacttggaggtcccttcctgattcaaacgaggtttccaaggacttcccagccattgtgattgacagtgtagaagcgacactggatcgactagctgcatcaaacgtgttctttattgcaaagcgcaaaaatgcaaaccaggatgtgttttacttctctgctaagatccctcaagggataccattattaattgaacttaccacagtggtcggaaaccctggcgccaaatgtgcaatcaagacaccgagccctgaaatgtcagcatttttcttcgaagccatcgagactcttctcaggagctaa

SEQ ID NO: 93996 - DNA, 1119 bp, Glycine max
  Peptide Sequence Number=SeqID_210774
atggcgccactttcattgcctctgaatttgaaatggacgccgtcgaatgtgaaggccaccgctcccgccaccaccaccggcaaggtccccgaggtgccgctgccggagaagatccgcaactcgagaatcctcgtcctcggcggaacgggtcgggttggaggctccaccgccactgcgctctccaacttatgtcccgatcttcaaatcctcgtcgccggccgaaacagggagaaaggtgaagctctcacagcaaaacttggcggcaattcagaattcgcttgtgtcgacatcgacgacgtgaattcgctggaaacggcgttgaagagtgtagatctcgtagttcatgccgctggtcccttccaacaagcagaaagatgtagcgtgctagaagctgcaataaatactaagactgcgtatcttgatgtttgtgatgatacgagctatgcatggcgtgcgaaatccttgatgaatatggcgttggatgcaaatgttccggctataacaaccggaggaatataccctggagttagcaatgtcatggcagcagagctagtccgtgctgcaagtgaaagtgaagataagccagagaggctaagcttcatgttgactcagccacttataaactactatggtcaactcagattctactactacacagctggaactggtggtgctggcccaaccatcttagctaccagcttcatgctgttaggagaggaagtagttgcatataacaaaggagaaaagatcagaatgaggccgtatagtggaatgctcaacgttgactttggaaaaggaattggcaaaagagatgtttatctattgaatttaccagaggttagcagtgctcataagattctaggagtgccaagtgtaagtgctcgatttggaacatcaccatttttctggaattggggaatggaagctatgacaaaacttcttccttcggaatttctgagagacagaaataaagtccaaagtttggttcagttgtttgatcctgctgttcgagcaatggatgggatttcaggagaacgcgtatcaatgagggttgatttggagtgcgcaagtggacgcaatactgttggtatattcagtcataggagactttcagtgtaa

SEQ ID NO: 93997 - DNA, 228 bp, Glycine max
  Peptide Sequence Number=SeqID_210775
gggcaggatcatcttgagctaccttctggggtggggacaaaacatgaacagcagaaaccaatcaaggtacttaggaacggatgcaagtggggatggggtcacgaccgaccgatcgttgcccctttctctgcgctaaacaagcagagaacgtcgcgcaaggccgcccagtatcctttgaattcacagtattttactatcattgtttgttttttagtaattaacgcctaa

SEQ ID NO: 93998 - DNA, 288 bp, Glycine max
  Peptide Sequence Number=SeqID_210776
atgtgggtacaagccattggtctgtttgctcaagcaacctgtgctcctgagtttggacttccaagaccgttcaatcagagattactcgtcttgcacgttggtgggggtgctgtaaaacaacgaggacaacccttcccttgtgttcaagaatcctctacaacaagagacccacggtctcttaatcccttttcagaaataagaagaagagaagaagagatctctcttaaaagagatagattgtacaatgaagatcaatcaaaattccttattgaatatgcaagtggttga

SEQ ID NO: 93999 - DNA, 789 bp, Glycine max
  Peptide Sequence Number=SeqID_210777
atgagcgatcatctggtgctgttcgtggaccggctggtgcgacccgtgccgatggtccagccgctggcccaacagccccccgagcccgcgacgcccgttgatgaggcggcggcggggccatccgggtcgtctccggcggcggaggaagacggtgacgacggcggagaggatgcgccgctgctgcagctggcggagtgtcgcatttgccaagaggaggacagcgtcagcggtttggagacaccctgctcctgcagcggtagtcttaagtcctatgaacctggttatactgccccaccacctcgtcctcagcctgaagaaactacccttgatataggtggaggctggacaatctctggcacgccattggacttgcgtgatccccgactcttagcaattgcagaggctgaacgtcaattcttggaagctgaatacgatggatatgctgcttctcatgctagtggagctgcattttgtcgttcagttgctttgattttaatggcccttttactcttgaggcatgcactttctgtcacagattctgacgctgaagatgatccatccacttttttctctcttttcttgcttcgtgctgctggttttcttttaccttgctatatcatggcttgggcaatcagtattttgcaacgccggcgacaaagacaagaggcggcagcactagcggcaacccaagttgctttcgttctacaatccgggcagcgtaggggtctgcagtttgcaatagcaccaggaccaccaacaatgaatacacaccagcaggaacaagtgtaa

SEQ ID NO: 94000 - DNA, 276 bp, Glycine max
  Peptide Sequence Number=SeqID_210778
atggttattctgcgccctttgtcattcaggagcaacaagtcgagtgataaacgcgcagagacaaattatggtcattctgtgccctttgtcattcaggggcaaggcgatcgtgtccgatggcgcgcagagactaattatggtcattttgcgcctttccatccaagcccgatcgtgtccaatggcacgcagagacaaattatggtcattctgcgccttgtgtcaaccaagaggaatgaattcagcagtatcaggatgatgttggtcgttcggtgctga

SEQ ID NO: 94001 - DNA, 366 bp, Glycine max
  Peptide Sequence Number=SeqID_210779
atggaaggagagaattcttcttcaattgagcgatgggaccgatccaaccggcttaacgtgatattcattaagaccaaaatctcggtcgggattcgtggttctgtcgaccaacatgataaggttcaagacttgcttaaggccattgatgaccagttcatcacttcagataaggctttaacaaacaccctgatcataaagttctcatttctccggctcaccagtgtgaaaggagaagaagaaaggcttttaatggagatcggtgagagtgcattgctaacaactacttgtgggaagaacaaagcagctaagtctcaagctaatcagaaagggaatggtaaaataccacctctagctaatattaagaag

SEQ ID NO: 94002 - DNA, 624 bp, Glycine max
  Peptide Sequence Number=SeqID_210780
atgaaaagagaaaaacatacctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaacaagtatacttcaaaatcttatagctctcactcttatccaaagaaagaccaaggtcaaggcatcttaggggtgacaccttctaagcccaaagatgataaggggaagacaatagaaaagcaagcccctaagacatttatagtagccaagatgaggctactacttccaccttcctctagtgaaagtgaaaaagccaaaaggggaagaaatctagtgaagaaatctaaccccaagaaagaaggacaaccattagtggttaaagagaactgtaaaggaggccctaggatcttcttcatcaaatggattcctttgcttcttggaaagatgaatggcagcgggaatggagaaaaggaagagagagaggagatgccacttcaaggagaaagatga

SEQ ID NO: 94003 - DNA, 186 bp, Glycine max
  Peptide Sequence Number=SeqID_210781
atgtggctgaaaggggtgaagaccctgtggttctgtttggaaatcgcgatgaacgcactaagcgcgcctgctgcgtttagcatgttcatcacaactgttaaaattttggatttccagatgaacgcgctaagcggaccatgtcgcgctaagcgcgctaagcgccagtctgttgcgcttagcgcctga

SEQ ID NO: 94004 - DNA, 399 bp, Glycine max
  Peptide Sequence Number=SeqID_210782
atgtcgcatactttcgcagttgccgccgtagccgtcgtcgccatcgccatccgttcgtcgtgtgcgaggctggagttctccgtcaccgtcatcaaacatgccgtcgttgcactgaagctttgctgtcgctggagtaagcctgttgctattcgtggctttgtgcttgcgctcctcgtctccttttgcatgcgaaatttgggtagggttgggtcaggtcagcctaacacgacgtgttgcgaaggtccaccttctggcccgaggcatgctcatgcatcctcaacaggtttcatcacaaatagtgaaaagatagagagacaagggatctccctgtctaaggcctctattcagatgaaaaaccttatgaggttgaacattcaccatgacttgttaggaaactga

SEQ ID NO: 94005 - DNA, 546 bp, Glycine max
  Peptide Sequence Number=SeqID_210783
atgctgaagaataacctgttcagtggtgttgcccatgaagatcctatgcaacacctatggaagttcatcaagcttaccaacatagtgagacataatcgaatatcagcagaatacatcaaactctatgcatttcctttctctctaaattggatggcacgagaatggttacgtgcattgctagaaaatagtatcaccacatggaaacaatgtacaagtagcttcttaaagaggacaagtttagatgctgcttatgggggcaacctcatgttaaaaccccctagtgacgccatcaagatcattatagatatgtgctccaacccctataacaactcaggggataggaggattatgaaagctctaacattgaagattgagacactcatgggagctcaagcccaagtccacaccactacacctttattcctaaactatgatagatgtgggattgtgcatgggtcagaagaatgcaccattgatggcatgctagcgacaaccatggatgcaatcaactttgtcaagggaggaaacatttcttacaatcaataa

SEQ ID NO: 94006 - DNA, 504 bp, Glycine max
  Peptide Sequence Number=SeqID_210784
atggcggatttttggctttctgccatgaaccgccatccgccattaacaacattggtccctacagccatggaagctaataggggccacaacctagctatgcgtgggctagcttatgttctacttgaaccattgttgaaagggacccctatcctaatagccatagacagatcgttttgggttattcccgtttctcaagagagacaagggcatgacaacatgacccatcccattcaatggacccctccttctgcccagcagagatttaaagtcaattttgatgcttgctttgatcagggtaggccaacttgctttggcatggccttgaaaactgctaaggacttgttattggattttgtagtggaaactgatcgccttcaatccctctctagggatattggtcactttgatgttctctttgtaaaaaggcaaggtaatcatgtagatgatgccttagcccatctagctttatcttccattgaaaatgtttgggttcaagaggactaa

SEQ ID NO: 94007 - DNA, 174 bp, Glycine max
  Peptide Sequence Number=SeqID_210785
atggtgattgaggggtttgctatcatagccctcgaacgcagcggcaacggaacaggcatagtgaagcttctctggcatgggggtgttggtgaagaaggaagcaaaaaggaaggtgcaggaagtaaaatccaagcaggagttgtgttaactcattgtaaggacagggagatttag

SEQ ID NO: 94008 - DNA, 1266 bp, Glycine max
  Peptide Sequence Number=SeqID_210786
atggaagggatgaggattccggataattttctgagaaaatatgggacccagctttctacaattgctaccctcactgttcctgatggtagtgtttggcccataggattgaagaaagcagacaacagaatttggtttgttgatggttggcaagattttgttcaacgctactccattggtgttggatactttttggtgttcatgtatgaagggaattcatctttcattgttcatatttttaatttgagtacgtctgaggtaaactatcaatcggccatgagaaaccataatgaagggtcttgctttgccaattatcatcatatttttgatgaaatggaagatgtagactcccttggtttgtcggatttgtcacctcagtaccttactcccggtgcattgcaaagcaagggttttgctggatctgtggatcaactgacacctgggaagagtcatactccagctttgcagaatttgttcaatggtggatcaaaactcaatcgcgtaaactggggtgatggtgggagtgctttttctttgaaggatgcgaattcacaaggcaatcagtcaaccagagacataggtgttcagtttaatgctgttgagtttaaaaggtccactgaagaattgaaattgcgttattctaattctaacgaggaagcagttaataaaaccgcaaaaaagaagcggaaatcagaaccctatggcgaggaaccttctggtgaaaatgaagaggaggcagaaatgcgctataggttttatgaaagtgcatctgcaaggaaacgaaccgtgacggcagaagaaagagaaagggcaattaatgcatcaaaaacatttgaaccgactaatcctttctgccgagttgtcctgcgaccctcctatttgtataggggatgcataatgtatctgccttccacctttgctgaaaagaatttgaatggggtttcgggattcatcaaacttcagctgtccaatggtagacagtggtccgttcgctgcctctataggggaggtcgagccaagttaagccaaggatggtttgaattcacagtggagaacaatttaggagaaggtgatgtctgtgtgtttgagctccttagaatgaaggaagttgtgctgcaagttacggtgtttcgcgtaaccgaggatgcagggttgttgaaccagcttcctatgcaacagcagcagcagagcccaaacatcagccacactaaactcttgaaccctcacttgcagcatcgcatcagtacaaccaaattgattagaaattag

SEQ ID NO: 94009 - DNA, 378 bp, Glycine max
  Peptide Sequence Number=SeqID_210787
atggcggatggcggaaccggaacatggcagaaggccaaaattccaccatataaacacgccattgcgccttatggcgccgccatgggaggggctacaggctgtctggcaacagcacagattgtaaagcctttgttggacttggagcagccaaatcatcgcatctatccttccacccccatcaataatgcacaattcgctttgcgatttgggcctctgatagcaaactgcaatgcgacaacattaggagaaggaaggggtgcccacaacaatgccatagcggtgtgttcgcacatgattgacaactacggtctagaggacaaccacactagaatggaagaggaggtgcttgatttcctgagaatggaagaaccttactga

SEQ ID NO: 94010 - DNA, 360 bp, Glycine max
  Peptide Sequence Number=SeqID_210788
atgcgggataggctggtccagtctgctgttaatgtaggcttatgcaggtgggccttacacggggcagatcaatccgcttacccaccctcgtgttatttcccacttaacattttatcatgcaatagcgtttacttgctagaaattgaagatctacgcaaacaatataaaagtaatttggaagaaactatcattcttcaactgatgcgtggcaagattcatgctaatgctgtggagtgtccggaaactagcaatgaaaacgaagccatagaggtccatcatttgaactccatcacctatttgttgaatcattcaattgaagtgcttaggttcttgctaaatggtagtatggcctttgtgtag

SEQ ID NO: 94011 - DNA, 132 bp, Glycine max
  Peptide Sequence Number=SeqID_210789
atggtagttcttaatgtctggtctgctcttcaaatggaacctgcgctccttcccgcatctcgtgcaatgcaggaactcatccctgtgaaaaggtgtctccagagtggaactttgtcttcatctgcgcaataa

SEQ ID NO: 94012 - DNA, 243 bp, Glycine max
  Peptide Sequence Number=SeqID_210790
atgtatattgttgtggtaaaacaggggcaggatcaccttgggctaccttctggaggggagacaaaacatgaacggcagaaaccaatcaaggtagggtacttaaagatgaacgcaagcggggatggggtcacgaccgaccgatcgttgcccttgctctgtgcgaaacaagcagggaatgtcgctgcaaggcagccccgtatcctttgtattttgcagctttcttttactatttgcttgttttaa

SEQ ID NO: 94013 - DNA, 300 bp, Glycine max
  Peptide Sequence Number=SeqID_210791
agaattcaagggactaaccgcctaagaattctttgtcctaacacattggagggtacatcctttgtggtacaagtagagggtacatctacttgggttgttatactgagaacaaaagagggtacatctcttgtggatcagttcaagtggagggtacatccacttggttgttcaaagagaacaagggagggtatatcccttgtggatctttggcttggaaaggattttacaaggttgaaagaaatcttaagaaccgttggttgcttggggactagatgtaggcacgggttgttaccgaactag

SEQ ID NO: 94014 - DNA, 3437 bp, Glycine max
  Peptide Sequence Number=SeqID_210792
atggcagaagcgatggttgctggggcatttctctcagcctcccttcaagtgacttttgacaggctggcttcaagtgacatcaaagattacttccatggaaggaaactcaaggatgagatgctcaaaaagctagatattgtgctgaattctatcaaccaagtgttggaggatgcagaggaaaggcagtacagaagccctaatgtgatgaagtggcttgatgagcttaaagaggctatatatgaagcagagttgctgttagacgaggttgctacggaggcgtcacgacagaagctggaagctgaatttcagcctgctactagcaaggtgcgaggcttcttcatggcttttattaatccctttgacaaacaaattgaatctagggtcaaagaattactagagaacatagaatttctggctaagcaaatggattttttagggttgagaaagggaatttgtgctggcaatgaagttggaatcagttggaaactccccaacagattgccaactacatccttggtggatgaatctagcatatgtggtagagagggtgataaagaggaaataatgaaaattttactttcagatagtgtcacatgcaatcaggtgccagtagttagtatagtgggtatgggagggatgggtaagaccaccctttctcagcttgtatataatgacccgagggttctggatcaatttgaccttaaagcttgggtctatgtttcacaagattttgatgttgttgctcttacaaaagcgattcttaaggcacttcggtccttagcagcagaagaaaaagacttgaatctgctccaacttgaattgaagcaaagactgatgggaaagaaatttttgcttgttttagatgatgtttggaacgaaaactattggagttgggaggcactacaaattcccttcatttatggatcttcaggaagtaggattcttattaccactcgtagtgagaaggtagcatcggtcatgaactcctcccaaatacttcatttaaagccactggagaaagaagattgttggaagctatttgtgaatcttgcatttcatgacaaggatgcctccaaatatccaaatcttgtatcagttggcagtaaaattgttaacaagtgtggaggattgcctttagctataagaacagtgggaaatatcttgcgagcgaaattctcccagcatgaatgggttaagatattggaaagtgatatgtggaacttatcagacaatgatagcagcattaaccccgctctgagattgagttaccataatcttccttcctatctgaagcgttgttttgcttattgctccttatttcccaaaggttatgagttttacaaggatcagttaatccagttgtggatggcagaaggtttgttgaatttctgccagataaataagagtgaagaagagttaggtactgagttcttcaatgatctagtggcaaggtctttcttccaacaatcaagacgccatggttcttgcttcactatgcatgatcttcttaatgacttagcaaaatctgtctcaggagatttttgtttacaaatagacagcagttttgacaaagagataacaaagagaactcgtcacatttcatgctctcataaatttaaccttgatgataaatttttggagcatatttctaagtgtaacagactgcattgtcttatggcactaacatgggaaattggcagaggagttttgatgaacagcaatgaccaacgtgctttgttttccagaataaaatatttgcgcgtattatcattcaataattgtcttctcacagagttagttgatgatataagcaatttaaagcttttacgttatctagacctttcctacaccaaggttaaaagattgcctgactccatttgtgtgctgcataatttgcagacactattattaacatggtgctatcatttgacagagctccccttagatttccacaaacttgtcaacttgcgtaaccttgatgttcgtatgagcggaataaatatgatgccaaaccacataggaaacctgaaacatcttcagaccctgactagttttttcatcaggaagcatagtgggtttgatgttaaggagttggggaatctcaacaatctccaaggaacactttcaattttcaggttagaaaatgttactgatcctgcagatgccatggaagctaatatgaaacagaaaaagcatttagaaggattagtgttggattggggtgacaaatttggaaggcgcaatgaaaatgaggactcaataatagaaaggaatgtgttggaggctcttcaaccaaatggtaacatgaaaaggcttactgttttgcgttatgatggaactagctttccaagttggtttggaggtactcatttacccaatttagtatctattaccctgactgaaagtaaattctgttttatcttgccaccgtttgggcagctcccctctctgaaggagctttacatatcatccttttatgggatagaggtcattggtcctgagttttgtggtaatgattcctcaaatcttccattcagatctcttgaagttttgaaatttgaggaaatgagtgcatggaaagaatggtgcagttttgaaggtgaaggtttgtcttgtcttaaagatctttctataaaacgctgtccttggttgagaaggaccctgcctcaacaccttccttctctgaataaattggtaatttctgattgccaacacttagaggattcagttcccaaggctgctagcattcatgaactagagttgcgtggatgtgaaaaaattttgctgaaagatttgccatccagcttgaaaaaggccagaattcatggaactcgcctcattgagtcctgcctcgagcaaattctgttcaacaatgcctttctggaagaactgaaaatgcatgacttccgtggtccaaatctaaaatggtcctctttggatttacaaacacatgattctcttggcactctatctataacaagctggtattcctcctcgttcccttttgcactagacttgtttgccaatcttcattctctacatttctatgattgtccatggcttgagtcatttcccaaagggggtcttccttcaaccctgcagaaactcgaaattgagggttgccccaagctggttgcttctagggaggactggggattcttcaaactccattctctcaaagagttcagagttagtgatgagcttgccaacgtggtgtctttcccagagtatctgttgctaccatcctctctcagtgtgctcgagttaattggatgttcaaagctaacaacaacaaactatatgggttttctccacctcaaatctctgaagtccttccatatttctggttgccctcgtctccagtgcttgccagaagagagtctccctaactctctttctgttctgtggattcatgattgccctttacttaagcagcg

SEQ ID NO: 94015 - DNA, 300 bp, Glycine max
  Peptide Sequence Number=SeqID_210793
atggagggtatacaacaagacgaagagattcgaaggattcaaagagaaaataaggccagctccacagggaatgtagtagcttgcaatttgacatgcaagtgcttctctgagtatcccagggtgttgcttgtttacaatgagtattccattgatgttgtggagtgcaatggggagatgctagttgttttgctatcagaattcttggaaaccgcaacccttagggtgtggaaatatgatgaggctaatagagggtggcatcagattgcaacaatgcctgcaacaaattctcatgagtggtaa

SEQ ID NO: 94016 - DNA, 1479 bp, Glycine max
  Peptide Sequence Number=SeqID_210794
atgcctcgcgccacaacaacccaatcgcagaacataaagcagagggtactcacgtgcctaacaaagctctcagatcgcgacacacaagtcgcaggagccaacgagctcgagtccatcgcgcgcaccctggacccgcactctgttccagtcttcctctcgtgcatccactccaccgacgcctccgacaaaacccccgttcgcaagcaatgcgtgcacctcgtggccacgctctcccacgcccacggcgacgcgctctcccccttcctctccaaaatcctcgcctgccttgtccgccgcctccgcgacccggactcctcgatccgggccgcgtgcgccgactccgtcggcgcactctcggcgcgcgtcacgaggcaaccgttcgccgcggcgttcctgaagccgctggcggaggcgctgttcactgagcaggacccgagctcgcaggctggagccgctctctgtctggcctccgcgattgaagcggctccggatccggacccggccaggctggccaggttgctcccgaggctcgagaggctgatcaagagcaaggtgtttagggccaagccagcgctgctggcgctcgttggaagcgttgtcgaggcgcgcggcgcgacgagcggcgccgcgttgaggagtttggttccttgtcttctggaggcgctggggagtgaggactgggccactaggaagggcgcggcggaggcgttgaagaagctcgcgagcgtggagagggacctcttggcggagttcaagggtggatgcttgaaagtgtttgaagatcgccgatttgataaggtaaagttggttcgggaggttatgaatcagatgttggaggcatggaagcatattcctgatgtttcagatgagttctctccacctcctcaattgcagttgtcttcaaaagagaatgcaagtgatgggcgctatcctcctgtctctcaaaattcatgcagtccaggttctgtaatgagtaaattgaggaagaaatcgagcccagctagcaaatcaactccaccagatagatctgctgttaggaatgcaaaaaagagtgcattaagtggcgataggatgggttcaggtgttttgcagaaactgaaccataaccattgggatgttcgaattgctgtgtcaaatgttcctgatcgtggtgaacgccggcagaaggatgaagatgttttggaaagaagcaaaaaggataaaagcagattttttaagcaggaaacaaaacgggctctatttgataaaaattctgatgacaagatgcataaatctggtgggtccaaagctggatctcgtgtggttccttgttctgaagagagtcaagactcaggtcctgtctgtaatgtaactaaggatctccataggaatgacaaagagagtgaagaattatctttgattcgtgctcaattagttcaaattgaaaagcagcagtcaagtctgcttgatcttgtacagagtatgccaactctcgaatga

SEQ ID NO: 94017 - DNA, 225 bp, Glycine max
  Peptide Sequence Number=SeqID_210795
atgaaagacatcaaggcgtttaaggaagccaccaaagtgggaaaggtggtgaataaatgttcaaagccaccgaattttatgctgaaagatcagaatgggaagaatgtgagcctctccaacttcaaaggaaaaccagtaattgtgtatttctacaaaggagggaaaggggctttgacttcagcagatgatgataaaattgatgatgatgatgatgatgaggcctaa

SEQ ID NO: 94018 - DNA, 387 bp, Glycine max
  Peptide Sequence Number=SeqID_210796
gtcttccagaagttaccaaggcctattccggaagaagtgcttccggaaaacactttcggaagtccttattccggaatgggcttctttcagaagttactaaggcctattccggaagaagtgattccggaaaacacttccggaatggaccttataaaaggatatcttccggaagaagcttcttccagaaacattccggatgacgttcttccggaaggagtttctgagtacttccgaaaatcacaaattcttcttccggaagagggttcttccggaaagtttccagaaaaagggtattccggaatgtttccggaaaaagtgtcttccgaaagaagaattcctgaagggcagtttcgccacttcactgtttgttgggtaccccagcaataa

SEQ ID NO: 94019 - DNA, 2049 bp, Glycine max
  Peptide Sequence Number=SeqID_210797
atgtcagcacctagtcatgcaattgtaaaggctgtggctgccacagctggtgctatgttacttattgctgcgatatttgtttaccttttttacaaacatgttcttgctagataccaccagagacacaaagttggtgcaagtttgcttcgagaatcaggagtgaaccttgagtatataaacaaagttggtggcaatgtgaagggactaattgttgaagaaaatggggttgattctttatgtgatggacacagaaagaaggccattgattactggtccaaagtatccaagcctgaaattccacaggcatgtgaatctccaagtgttgttggtcatgagaatcaagttaagccagtgtcacaaacatcatcagtttcaacatcactagcaccaagacaaaacttgccacaatcacctcagctagcacctccacttcaaccacttccacaatcttcaccaatgattcttgagaacaagaaaactcaaccatcatcaccaccacctcctcctcctcctcctcctcctcctccaactcgccctccgccaccaccacctggtccacctccacttcctaaagccagtggcttcatttcatcactgaaacccccacccgctcccaaagggaaaacaaacataagaagcactaaagagggtatgataggggagagttcaagagagaagggtgttggtcaaacaaggctgaagcctctacattgggataagattgtagcaaatgttgatcattcaacagtgtgggatcagatcaatgatggctctttcaggtttgatgatgaactaattgaatcactctttggatattcaagcagctacaaaacccaagaaagaaacagaacactttccactttggccaagtccaattccaatgcgccaactcaaatattcattcttgagccaagaaaatctcaaaacacagcaattgtgctaagatcacttgccatttctcgcaagggaatcttggaagcagttcttgatggtcagggactaagtgttgagacactagaaaggctcagtaaaatagcccccacccaagaagaggaagccaaaatcatccaattcagtggcaacccggatcagctcgccgatgctgagtctttcctatactacattcttaaatcagttcctacagcattcaaccgtttgaaagccatgcttttcaggtcgagttacgattgcgaagttctgcagctcaaggaacacctacaaacacttgaaatgggttgcaaggagctgagaactagtggcctgtttttgaaactccttgaggccattctcaaagccgggaaccggatgaatgccggaacttcaagaggcaatgcacaaggtttcaacctgagttctcttagaaaactttctgatgtgaaaagcacagatgggaagactagtttgcttcacttcatagtggaacaagtggttcaatcagaaggaaaaagacaagcaatctatcaaaagcacaaacttcacataagcaatggtgaaacaagcaatgtgaatagaccttattcatatagcctcatacaacaagaggcagaaaaagaatatgtaatgcttggtttgcaagtgttgggtgggctaagtgaagagttgtctgaagcaaagaaagcagctagtattgagtatcataatttcatcactatgtgttcaactctcaatgctcatgttagtgaaattagacagattataacttgctgtggcaacactagaagtggcgaatttatcaatgaaatgaaagggttcctagaggaatgtgagggagaacttgaggtggtgaaagaggagcagacaaggatcatggagcttgtgaagaaaacaaacgagtactatctagcaggagcatccaaagacaacatggcttgcatagaactaaaaaagaaggtagaaaagaagaatattgtgggaggagaggctgtgtcaacaacaccacctttgtcaccatcaaagaggacgccactcagattccctaactttgatttgtattttctgtcaaatgtgtcagaatctacatcttctagccaatcagaagatgatttctga

SEQ ID NO: 94020 - DNA, 135 bp, Glycine max
  Peptide Sequence Number=SeqID_210798
atgggcattctatttcgaccccttcaagctaagattccgacatccttccctcagtgcaatgcaacagctggagcaagattgagcctcacaagtagtaaccatattttcatagacggcaagcaagacacaacatag

SEQ ID NO: 94021 - DNA, 1690 bp, Glycine max
  Peptide Sequence Number=SeqID_210799
atgagggaacgtacaccactgaagaatgatcttgaagagctaaactctcttctaatagagctatgcaacattgatgtaaagatggaagataaagatctgacaatgattttgttagcctatcttcctccctcctatgacaattttgcatatgggaatagcggcgaagcctgtgcgtctgaattattggtgaccgattatgctaaatggaaaaagaagaaaggcaaaggtggcaagaaaagcaatgttgatcctaaagacatttgcaattactacaaagaactgggtcattggaagagagattgtctaaagaacgtaaagaaatattttgttgatactcttgttcagaataaatcctcatcagaaaacaatttggttctgactgttggtgaaccactacaacaacattctaaacagtgggtgctggactcaggttgttcctatcatatgtgtccacatagaaattggtttgtgacatatgagaagtccggtggtaacattctcatggataatgatgctccttgtaagtctgtcaatataggttctatagaaatcagaatgcatgatggtgttgttagaatcttaacttatgtttgtcacgtttcagagcttaagagaaatcttgtatctgtgggtgccatggttcaaaaggggtcaactatgacaagctttgtctctactatttcacaacctagaagccatgcatccaatgactcgtttgattattctttgtggcatccacatttgggccacatgagcgaaaaaggtttagatattttgagcaagcgacacttacatggaaatcacaaggtggaaccccttcagttttgtgagcactatgtctacgggaaacaacatcagatgaaattcccaaaggttctgcacataacaaaggacatgttggactatgtccattctgattgttgtgggccttcaagagtttcatcactgggaggggcaaggattttttgggataaggcaaccatcacaacatgctatctcgtgaaccactcatcgtccacttccatagatttcaagacccctattgagccaagaagggattctttatgggctatggagatggagttaaagaattctgaatttgatttaggcaaggttaaggatgacactaagcaggtggaatttgagagctccacaatcagaaacattgctgaagactggatgatgactatgaatgaagagatgaaatcccatcaaaagaaccaggcttgggatttagttgagctacctgaagtggcaactttggacatggagttagagcaacttgatgtcaaaattgcctttctccatggaagactggaggaagacattctaacgcaacaacttgaaggtagtggtacaagagtttcgatgagttcattgtcagaagttgctaaaatgattctaggcatggagatgaagagggatcgattccagaagcatgtcagaaggtcccttaaaggtatatctaatattggacttgtctaccataaagacatgtcccgtgctgtcgttggttactcagattctaactatgctacagatttggatgcaaagagatctatgaataagttcattgagcttgagagtgctttgaaccttattcctggtcatgaagaagagtgtagaagagtttgggaaacccaggaactgcttcctacttctcttaacaacaaaattgtttgctttgcag

SEQ ID NO: 94022 - DNA, 384 bp, Glycine max
  Peptide Sequence Number=SeqID_210800
atgcgtctcgggacttcacatattgtgcaacaaagggttctaagtacttcaaagcggtcaatcaaaggttgcatgccatcaagcaatagtccccggacgaaattaggaattaagcctctacacactgatgaagaaatgacaaataaagtgtttgaatgtttgactgcgtgggaaattgatagaaaaatatctttcatcacattagacaatgcttcttccaataactgcatgcaagaaattttaagtacatcttatccaacttctaatgaatattttatagaaattcaaaagctggaagacatggattctgtggaagcaatgccttcaaaggttattttgatgatgccaaagaattcaagaatcaagagaaagattcaagagtag

SEQ ID NO: 94023 - DNA, 144 bp, Glycine max
  Peptide Sequence Number=SeqID_210801
atgaatcatatactcatgtaccttaaaggtacaactgatattggactcgtctaccatggagacacatcctgtgatcttactggcagagtacatggctttggtagaagtagtaatgaaagggatctagctaaaagttctgattga

SEQ ID NO: 94024 - DNA, 258 bp, Glycine max
  Peptide Sequence Number=SeqID_210802
atggcttctatggatacctctgctaaggtcaactctaagatctttccatgcaatctaggaatgcgggggtccggggaatttgtccccttcctagatacgacgtctaggggtagcaaaatgccccaacgtacgtttttaagaaagcgacacggaccctccgttggtttgtttacagaagggatcaagacagaacccatatgcgatgcctatgcaaaagacacaatgcgggaatgtacacagtatgacaatattcactga

SEQ ID NO: 94025 - DNA, 333 bp, Glycine max
  Peptide Sequence Number=SeqID_210803
atggctgggaagccacagttgaggagtcaattctcaaagtttgggatgacctcacggtgtggtacctgggctgatttagcaatcctgaaaaatgtgaggcatagtcagccaatgagtgcttgccattataccatggggaaggatcagatggcaacacccgcaaagattatagagatctcatattctccaacttcactagcctcatctttctcaccacccatgttaaacacacctacaaagggccaccttaggccagggatagctctcctcagcacgtgccagggccaccttatgtcaagaaggactctccttagtatattccagagccactga

SEQ ID NO: 94026 - DNA, 357 bp, Glycine max
  Peptide Sequence Number=SeqID_210804
atggctgccgagttagggcaacaaatggtggagctatccaccctcgtcacatgcgctgctaatgataagtccgctgacatgcagagtgggccccaatatgatctgtttgatgtagaaatgggagattacttggaggatatgattcgtgaccttggacaagagtcttttcagcaagcacatgcccctatgtatgatacattacaaagtgattcaaagaatcctttatatccggggtgcaacaattcattgacgttgttgtcggtggtgttaagtctggttaatgtgaaggccagatatgggtggagtgacaaaagctttagttcactgcttcaagtagtgcacgatatgcttccatag

SEQ ID NO: 94027 - DNA, 699 bp, Glycine max
  Peptide Sequence Number=SeqID_210805
atggagagcttaggttctacattacatgaagtatctgcagaagctagagaagccaaagaaaatctactacacatccaacctgaaagtgaaagctatgatgcccagattgaagacttaaagttattcttaaaatctactaatgaaaaatacaattccatgcttgatgaggctgagtgggagcagagagaggttcaactagtcagctgcataaagaaaaatgaagaagcgaaggaagttgaggctgaggcaatccaactacaggaagctcttaaggaaacaatagctgacaacatgaaattgaaggagaacttattggataaagaaaaattagttgcaaatggaatgcaacatgtagggaagctaataggtagcaattggggaggtacaatggattttgaacctaaacgatggagactattagctgatgcactctatgatataggcactggcttggaagtgctttctccatggtgcccacatctttttcttgaaatggcaggcttgggaaattttgcaaagggaatggcagttgttgcagcaagagcaacaaggttgcctatatattcttcatttgccaaagaaggaaatctcagtgacctatttgctaaaggagaggcattttcaactctctttaatgttattggaattggagttgggattcaattagcatctaccatctgtgcatcaatgcagggaaag

SEQ ID NO: 94028 - DNA, 438 bp, Glycine max
  Peptide Sequence Number=SeqID_210806
atgcaatctatgtccctgacgctgagcaagaggctctccaattcaaagcctctcttcagaatctcttccagcctcgtcgctcacgcatcctccgccacaacctctccgccgccaccttcgccgccagtcccctctccctccgccctcaacagcctcctcaccgctccgtggtccgccactcagtcacgcggaatcacgctttccggatctgatattagagtcgggaatctcattggaaaccgaggacgcgctcacgaggttctcaaactgtatcgccctcttgaaggaacgggcaaagccactcttgagctgctacagtgctattgcatagcagaatttcttggacctgcaattgcgattccctccgctattgtggctgccatcaatgttgtggttgtggcatgcatcctgcatccttgcgagtctccagccaattga

SEQ ID NO: 94029 - DNA, 354 bp, Glycine max
  Peptide Sequence Number=SeqID_210807
atgtcaggcgcaccgaatgcgaatttaccaagtgttaagaagttggttgaggatatcagagctactaacacttcatctttgccttttagaaagcataattattgttggaaggtgtttggttggtgcttgcctcaggaaggatggattaagatcagtgtggatggctcagtgagacaaggaggcaaccaagtagcttgtgaaggggtgtatggagatgaacatagtaagtggttaggtggttttgcaagaaatttgagtttgggaaatgtgcttatggctgagttatatgccacattgatggctttggatttggcttgggataaaggttttcaagtaggtgtggatagagtttga

SEQ ID NO: 94030 - DNA, 348 bp, Glycine max
  Peptide Sequence Number=SeqID_210808
atggatataagcaacaacagcaatgaaaaaatagaaacaggcattgagttgagtgggtttttgcataatgaagataatttgattcttctctatgaagatgagagaggtctgcttgaggatgaactacaggtcgaagatgatctccagattgatcaaagcagcccatatcccatagagaacaatattaatcttctaggaggccattctattaatgctggttctgaaaagggaattctgcctagcctagatgttgaacagatgaaaccttttgacaaagtgaagggcattggattggatgaggaagctatttctattagtacacacaatacaagcgatttgattttctga

SEQ ID NO: 94031 - DNA, 951 bp, Glycine max
  Peptide Sequence Number=SeqID_210809
atggcatcaaagaagagaaaggcacctgccacaccttcccaagttcgatatgatagatcaaggttcacttctccagaggcttgggaaagaggtcatctagtgaagtttgacgaagacgccctcaacacattcttgaagaaccctatgatcattgaggaaggggaaacactacctgtttattctaggttcgcactcctaaggcttgatcctcaggaattggcagccaagctctgtatcccagggagaggatttgagcttaatgctaatggcttgccattgaagatcctcagaaagaacctgactaccattgctcagacttggagcatgctttctttctcaaacttggtccctacctcacacacatcagatatcactctggatatggccaagttgatttatggaataactcagaggatggacatgaatgtgggctacttaatttctcatcagatctctatgatcgctcagcatgactcctctaggcttgggtttccagccttaatctctgctttatgtaaagctagagaagtcacttctgattctaagatgctggagaggtctaggaaggccatggggaagaaatctgagactctcccatcttctgaggttccccttaccacatcagcttcttccacatcaacaccagcttattcccaactacttatagatgctacatgccatgatgcagagcctacaccaagggtaggtcattattatgcagagcttctagagcttgggcctgccatctatcatgagcatggaagactttcacacttagcccaagagcctgagcccacagcggagcatacaccagcagcagaggatgagctcacttctcctgagcccttttcatttgcttttgattcagttgtggctcaagaggaagtaccttcaccagagcctattccaaagccatcccctgcacctatctctgaggataccctgccatcc

SEQ ID NO: 94032 - DNA, 213 bp, Glycine max
  Peptide Sequence Number=SeqID_210810
atggatataagcaataacagcaatgaaaaaattgaaacaggcattgaattgagtgggtttttgcataatgaagataatttgattcttctctatgaagatgagagaggtctgcttgaggatgaactacgggtcaaagatgatctccagattgatcaaagtgatgacactcttcctgaacttttgatcaacaaaaagttcaggaagatttcttga

SEQ ID NO: 94033 - DNA, 168 bp, Glycine max
  Peptide Sequence Number=SeqID_210811
atggctcccagaaaaagaaatgttattagatacgaaggggaaaataaaaagaggataaggcatccttcaaaccacaatacaaacacgacccaaggagaaaatcccaaaactctactaggaaactccattcacaaaatacatgcaacaaaagcgataaactattgctag

SEQ ID NO: 94034 - DNA, 363 bp, Glycine max
  Peptide Sequence Number=SeqID_210812
atgcaatctatgtccctgacgctgagcaagaggctctccaattcaaagcctctcttcagaatctcttccaacctcgtcgctcacgcatcctccgccacaacctctccgccgccaccttcgccgccagtcccctctccatccgccctcaacagcctcctcaccgctccgtggtccgccactcagtcacgcggaatcacgctctctggatctgatgttcgagtcgggaatctcattggaaaccgaggacgcgctcacgaggttctcaaactgtatcgccctcttgaaggaacgggcaaagccactcttgaggtttattcaagattctctctctcactctcttatatagctctgcttgaatactga

SEQ ID NO: 94035 - DNA, 242 bp, Glycine max
  Peptide Sequence Number=SeqID_210813
atgcggggttaccttatggttagccgcacctttcgtcaaccagggggaaacgagcccgttgacgcgcagagactaacatcgtcctctgcaccttttgtcgtcctgacccgtgaattaggtgacatgcggggttaccttatggttagccgtacctttcgtcaaccatgggcaaacgagcccatagatgcacggagactaacatcatcttctgtaccttttgtcgtcctgacccgtgaagtcag

SEQ ID NO: 94036 - DNA, 618 bp, Glycine max
  Peptide Sequence Number=SeqID_210814
atgactgagcctatgagtactcagtgtgatgatgcagctgatgttgaggcccattctgcagtggaccagaggcccaaaaggaatgtattggcaccaaagaaatgggatgagctcttctacagcactccgcagctcgatcccaccttctgcgccagtgataccgcgtaccacgccgacatgaagtcgttcaagaaacacttcatcaagttccacatattcgcgaagatcttcaggaccaaatcgaagaagttccaatcggatccatcatgcgagcaagccttgtacgtatcaccgtcgtggttctcgaccatgtgtctttcccttgggttgtcggaggtggcgaagagcttcaatttcaagctcgctgagttcgggaggattgcgtcggcgaaccagagaaggaagcaggagctgagggttgggttgttgaggaagccgtttgtcagatttgcgatgttgtttttggaggtcgagaagccgtggttgttgcggtgggttttgcagcagagagagatgtattccggccttctgagaaggggtgagaataggtcaggtcaggccttgaaaggcttgagcctagcctacgatgaatctttgaggcctaagtctggcctatag

SEQ ID NO: 94037 - DNA, 966 bp, Glycine max
  Peptide Sequence Number=SeqID_210815
atgggtaatgaaaacgcattggtatacgaaagacacgactatgttaagtatgctatttctgattggattgctcacatgttgtgctcacatgtgctagctagaaaagctaagaatcaatgtacctggaaagggttttctgcaattcatgtagccttgcaagaacttaaggtacatgatgatgaggacgaagaagaaacgtttcccaacattaatactgggagtcagaatgttatggtcaaatcctcctccaagaatgaaaacagaagggaaaaatctctggcattgcttacacagaattttgtcaagctttttgtctgctctaattttgaaatgatctcccttgatgaagctgcaaagttgttgcttggaaatgccaataatagaacaaaagttagacgcctatacgatattgcgaacgttttatcctccatgaacctaattgagaaggtgatattctcctcagttcactttaaatttccccatagagcattacaatggaagtgttgctttctgtattctgttctaataaattacagtaagcttatgatgagtttacgaaggttgcagacccatacaacaaacacaagaaaaccagcatttaggtggttgggtgtgagagggaaaacatggagtgaatcagctcagacaaatgttaaagagtcacagaaaaggatgtttggatctgacataacaaacataaattttaaaaggaaagttgatttgtccatggatggccagaactttaaaacgcaaaaccaacaggaaaatattagtcccagagctcagctggagaaaaaaagcttaaaaaaagatgcaaaacagacttcaatgagctatcagtttggccctttcgctccagcttatgtgcacaaagttggaacctctgaaaataatagtgtgaaacaggtgcaagactgggaaagcctcgcacaggagcatcgtcctcaatatcaaaaccaaggttag

SEQ ID NO: 94038 - DNA, 600 bp, Glycine max
  Peptide Sequence Number=SeqID_210816
atgggatcaagtcaaacaccttcgcttaaaaagaggttctatcaagtcaaggtcaagagcctagggatcacctgtctaaaagagctagggcagttaatggggcagctccagcggcaagctttttgcaaagcatacgataaattctgggacctagccatggttgaagtctccatagaggccattgcctccctcgcccagtattatgatcagccactaaggtggttcacctttggggacttccaactgtcacctatggtagaagaatttgaagagatcctaggatgtcctctagggggaaggagaccatacctcttctcagggttctatccctcattagctagaatttctaagattgtccaaatctcggcgcaggaattagaccacaggaagcaagtcgaaaatgaggtggttggaataccgagaaaatatttggaggcaaaagcaagaatcttggcaaataatcaaggagttcctctcctcacaaaagcctctccttctgggaaaggttatacaacttttgtcctattattgggaccccataaaggggtttacaccaattttaaagacctttgcttggcaaaggagggtattcaaagctga

SEQ ID NO: 94039 - DNA, 207 bp, Glycine max
  Peptide Sequence Number=SeqID_210817
atgtcttgcctaaaggggggaaataatgagaaagagaaggctttagctaagctagcccatagagatcaagaaaaccaggttattaatgaagttgttttcacgagagagatggcgaaaaggaaagtgcggattctaaatctcgagaaagacaaattgttaccccattcatgtgacattaatgcccaacctcgcaatcaattactttag

SEQ ID NO: 94040 - DNA, 225 bp, Glycine max
  Peptide Sequence Number=SeqID_210818
atgatgtgtttaacttggtatgggttttcaaaattggataggtcatcgactatcgccacaaccagtcagagaaaaggggcaagatttagggtgaaagtgaaacggcaaagagaaccctacacgggtcatccttgtgagaaaattatgtgcttaacccggtctagattttcaaaatcgggaaggccaccaactgccaccacaaccggtcaggttggtttggtctaa

SEQ ID NO: 94041 - DNA, 768 bp, Glycine max
  Peptide Sequence Number=SeqID_210819
atgactttcatcagtgggaaggctcaaggagcgtcacaatgtcattgtttgtttgacacaaaggttgtttgtctattgttctttgaagggctaacacatcatgttggagaaaagtttggtgtgccaaaagatggctttggaggagtggtttggctaggcatagaatgttggaaaatccattctggagtgttatcacgagtactagagagcttcgtatcaaacattgttgcacatattgatgttatgctctatgttgatgacttgacaaaacattttgacccaatctcatctctccccaaagttagtgtaatttctcataagagcatttttgtttcatactcaatgtttgcccaaatcactcatcttaaacaatctttttgcacaccaagcttttctccatcacgatgtattagccctacaaatgaagctaaatcaccgttcatcaatagaaataaccttcctttgagaggggtaggagtcaatagagttttgacttattttggtagtattgagaggaaagagaactttgttccaacattggaaacatttgaggaagttccaacatcaacaacatttgatgaagtggaagtttcttactttctttcttttctcatcctgcaacttctgaaggactacatgtttgaacatagttctgaccgggctgggttcttgaagctctccaagagaatcgagtacacaattcgagcttggtaccttccacagtttgaggacttgatgaacattgttctggccgggttgagttcttga

SEQ ID NO: 94042 - DNA, 306 bp, Glycine max
  Peptide Sequence Number=SeqID_210820
atgggaaaacgagttttcttgcagatgcctcaactcctcaattcaacttttcagctatatctcttgaaagaagaagaagaagaagaagaagaaggagaaatgggatccaacggaacatcttgggctgaccagtgggataacgggcctgacccagtgactgtctccaacgaatcgaagaaaaagaataacgccctcggcaagaccaaggcagtggcttccactggcgtcaagaagttgaaggagggtacctccgttggcttccaatggatcaagaccaagtaccacaaaactacccagaaacattaa

SEQ ID NO: 94043 - DNA, 339 bp, Glycine max
  Peptide Sequence Number=SeqID_210821
atggatactagtttaatgcagctcaaggttggattggtgtccgtcctctttagtgaaaagcaccacaaagacattgttttggtcaccgaggttacgaaggtggatggggaagttgtcgatgatgatgatgaaaacgtctatgtggttgtcccacttagccaaaatgatagagaggcttgtggtttgacaaagatgacatgcatttgtggatctcgtcaaaagatgacactaagtagcaagagtttgatggaattggagttgaggatcacgaagatgattctgagggcgcagagggagtccacgtcaaaggttgaggggaaaatgagaattgaagaatag

SEQ ID NO: 94044 - DNA, 381 bp, Glycine max
  Peptide Sequence Number=SeqID_210822
atgacttggggaaagcaccaacgaactcttggccctctctacaaccatctcgacaactcgcgcactagatctacattttgtacattgttcgttttcaagtgtaacatgcgaccaagacctacaactcagtgttatcaacgtctcgttgttcaactctttgagcgcattccattagagttcgaagaattggacaaatcgaaaaacttcaccattgttgtaaatcttagtttcaagagcacgaagaaggagacatatcaccaaaagcaaggagaagtcactcttgtggcggtcacggaggctatgtgtgttgtgctttttgacgacactagcgacacacacaagagggagaacaaaagcgataaagagagagcaatccattga

SEQ ID NO: 94045 - DNA, 546 bp, Glycine max
  Peptide Sequence Number=SeqID_210823
atggtggtcgaaggttcgccaaaaaaactacaagaagggagtgagaaatttgctctaaaaccctatgcgcctcccaacagcgacgtcgctttttgtttcgccatctttctctctcaagactcttcatcaccaaagcgcttccactatctcacccctcctttctctctttccctctcccgaaatccctactctctctctccacgtgccaccgcaccttcactgcccgttccgaatcccagattgacgttgacctcgttcccgcccactaggacttcaacctcttcaccatcgacgcaggcagcggtagggtccgagccgcttgcttcgctgccaactacgacgcttctgtcgccatctgcgaacttcctttctccattatctccttcgaaaccactggaggtgtcggcgaaacggtttgtcactatggaggccagtgaaatagtgttggagtttgctggtatctttaatgatttgaaaagtgaggttcatgtatttatacggcaaaataaggttttgcggggatttgatgaagagattagagattag

SEQ ID NO: 94046 - DNA, 216 bp, Glycine max
  Peptide Sequence Number=SeqID_210824
atgactttgaaacataggttgtctacatcagaaaatctacttgtttcaattcaagagaaaataaaatgggctgatgctatgagtgaaattgagaagaagcgcaggaaggatgtggaagagaaggtacaagaactaaagtctgttatcaagaatagatgtatctaccctttgcttctttgggaatcacgattatttggtgtaaagggtttgtactga

SEQ ID NO: 94047 - DNA, 603 bp, Glycine max
  Peptide Sequence Number=SeqID_210825
atggcgagggcgtgtagtcctctgaaggcaaggacgtgtactcctctgatggcgagggtgtgcagtcttatgaaggcgaggaagtctagtcctatgaaggcgagggcaagaagtcctctgaaggcaagggcaagtagccctctgaagacgaggacgtacagtcctcggaaggcaaagacgtgtagccctcagaaggcgagaacatgcaagaggacaagtagtcatctaaaggcgatggcatgcagccctcttaaggcgaggacgtgtagtcctctgatggcgaggacgtctagcccgcttaaggtgagcacgtgtagtcctctgaaggcgaggacgtctagccctctgaaggcgactacgtgtagtcctctgaaggcgaggacgtgtgctcctctgatggcgagggcgtgtagtcctatgaaggtgaggacgtctcgtcctatgagggcgaggccgtgtagccctctaaaggcgaggccgtgtagacctctgaaggcgaggacgtgtagtcctctaaaggcgaggacatgcaagaggacatgtagtcctctaaaggcgagggcatgcaaccctctgaaagtgaggacgtgtagtcctcagaag

SEQ ID NO: 94048 - DNA, 255 bp, Glycine max
  Peptide Sequence Number=SeqID_210826
atggaaactttgctccctccagcttggaagaacttgaacatagaccgttacgtcaatgacaccaatctaggtgctgagagtctgagattgagtgagcaatggcaaggtctagtggcggcgcagcggtgtggagaatggacatgcgaagagaaagagagtggaggtgcgagaggcggtgatgacgtggagacagagaagcagagaggcgctgtgagagttttcattgctagtggtgagggagtttcagggtcgtga

SEQ ID NO: 94049 - DNA, 564 bp, Glycine max
  Peptide Sequence Number=SeqID_210827
atgtggttagcctatctgaatctcatcgaaggacaagacattaagaaagaagtaaattttgcattcgttggttcaactgcacttgataagaattttttggaacaaaaaagaatcaataaagaggaagttgcttatttagaattgattgaagaaggagcaataaagctagtggtaccaaagaactttctaattgggtgtaattctgttgttttggcaacattgaatagtgataagaaagatgactatgatcaatttgggtgtttgaaaacttacaatactttcattgagtactataatgagcaaataaaaaaggctatagagacattgagacaaaataaaaccaagacttttagagtatgttgtgaaaagagtgaaccttacaatattagtttacaaatagcctatggaagtcctgctacaatagtttcctcaaatccttcaaaatatgtaaatagggatgaaccacattttattgaagcaacatataggctaatagcaaaaggactagttgaggggtcttttgccaacccttctctcaaatctcttcctttcaagatagtttag

SEQ ID NO: 94050 - DNA, 978 bp, Glycine max
  Peptide Sequence Number=SeqID_210828
atggcgagggcatgtagccctctgaaggcgaggacgtgcaatcctctgatggcgaggacgtgtagtcctctgaaggtaagtatgtgtattcctctgatggcgaggacgtgtagttttctgaagctgaggacgtgtagtcttctgaaggcgagggcgtgtagccctctgaaggcgaggacgtgtgctcttctgatggcatgggtgtgtagtcctatgagggcgagggtgtgtagtcctcttaaggtaaggacgtgtagttctctaaaggcaaggatgtgcagtcctgtgaaggcgaggacgtgtgctcctctgatggcgagggcgtgtagtcctatgaaggtgagcacgtctcgtcctatgaaggcgaggccgtgtagccctctaaaggcgaggccgtgtagccctatgaaggcgaggacgtgtagtcctctgaaggcgaggacatgcaagaggacatgtagtcctctaaaggcgagggcatgcaaccctctgaaagtgaggacgtgtagtcctcagaaggttacgacttgtagccctctgaaggcaaggacatgtagtcctctgaaggagagggcgtgtagccctctaaaggcgagggcgtgtagccctctgaaggcgaggacgcgcaataggacatgtagtcctctaaaggcgatgacatgcagcactctgaaggcaaggacgtgtagtcctctaaaggtaaagacgtctagtcctctgaaggcaagggcgtttagtcctcggaaggcgaggacgtctagcccacttatagcgaggaggtgcaagatctcatgtagtcctctaaaggagagggcatgcagccctcttaacgtgaggacgtgtagtcctctgaagttaaggacgtgtagtcctctgaaggtgaggacgtcttgcccgcttaaggtgaggacgtgtagtcctctgaaggcgagggcgtgttgccctctgaaggaaaggttagggcgtgtagccctctaa

SEQ ID NO: 94051 - DNA, 249 bp, Glycine max
  Peptide Sequence Number=SeqID_210829
atgatgctcaagttggagggggtctgttattttactacaaagcgcctacctgaggagcacgttccaccagaacgcgacacgtggcttgactggacaagacgatgtgacaggggtggtcgtgcctacctgccaggcgctaccagtcgtgcctacctgccaggcgctaccagtagtggtggggcccctggcacgtccctgttccctataaaaccatctaccctccgtttcattttcacacaaaaatcttga

SEQ ID NO: 94052 - DNA, 336 bp, Glycine max
  Peptide Sequence Number=SeqID_210830
atggcttgtgttatgaaagctagttgggtctttggagatctatggaaaaagatatggaaagtgactatagtgcctattgcaaacatttcatttggtacaatgatgctaattggatctccgattcacatcagacaaaatccactatgtgttcatatttggcctggtgcggttgcaaggagatcaaccaaacaatccataattgcaagatcaactatggaatcagagtttatagctctagagttggctagtagtgaggctaagtggttgaaaaacttcttagtctacattcctttgggaatgaaaccaaccccgtcagtgccaatgcaaaaaccatag

SEQ ID NO: 94053 - DNA, 1332 bp, Glycine max
  Peptide Sequence Number=SeqID_210831
atgtccaatcgtgttgaatttggaatgaccggccctctcaatgattcaatctcttgcattttcataagggtggacccttgggctacacgccctcgcctagccttcagagggctacacgcccacgcctatagaggactacacgtctacgccttcagagggctacacgccctcgccttcagaggactacacgtcctcgccttcagagggctacacgctctcgccttcagaggactacaagtcgtcgccttcagagggctacacgaccttgcctacagagggctacacgccttcgccttcagagggctacacaccctcgccgtcagaggactacacgtcctcaccttcagagggctacacgccctcgccctcagaggactacacatcctcgccttcagatggctacacgtcctccccttcaaaggaatacacgtcttcgctatcagaggaatacacatacttacctttagaggactacacatcctcgccttcagagggctatatgccctctccttcagaggactacacttcctcgccttcagaggactacacgtcctcaccttcagagggctagacgtcctcgtctttagaggactacacgtccttaccatcagaggactacacgtcccagccttcagagggctacataccctcgccttcataggactacatgtcctcgtgcacgtcctcgccttcagagggatacacgccctcgccatcagcgaactacacgtcctcgccttcagagggctacaggccctcaccttcagaggactacaagtcctcgccttcagagggctacacgccctccccttcagagagctacacaccttcgccttcagagggctacatgccatcgccttgccttcagagggcttcacgccctcgccttctgacggctacacgacagtcaatctatggtggacccatgggctacacgccctcgtcttgccttcagaggcctacacaccctcccctttaaaggactacacgtccatgccttcagagggctacacgccctcaccttcagaggacaacatggctggacacccttgccttcagagggctacacgccctcgtcctgccttcagagggctacatgccctcgcctttagaggactacacgtcctcgccttcagagggcttcacgccctcgtcttccgaggactacatgtcctcgcctacagaggactacacgtcctcgccaatagagggctacacgacctcgccttcataggactagacgtcctcgccttcataggattgcacaacctcgccatcagaggagtacacgtccttgccttcagaggactacacgccctcgccttcagatga

SEQ ID NO: 94054 - DNA, 819 bp, Glycine max
  Peptide Sequence Number=SeqID_210832
atgtctagtcctatgaaggcgagggagtctaaccctatgaaggcgagggtgtgtagccctctgatggtgaggacgcgtagtcctctaaaggcaagggcgtgtagccctcggaaggcgaggatgtgtagtcttctgattgcgagggtgtgcagccctctgaaggcgaggacgtgcaatcctctgatggcgaggacgtgtagtcttttgaatgtaagtatgtgtattcctctgatggcgaggacgtgtagttttctgaagctgaggacgtgtagtcttctgaaggcgagggcgtgtatccctctgaaggcgaggacgtgtgctcttctgatggcgtgggcatgtagtcctatgaaggcgagggtgtgtagtcctcttaaggtaaggatgtgtagtcctctaaaggcaaggacgtgcagtcctctgaaggcgaggatgtctagccctctgaaggtgactacgtgtagtcctctgaaggcgagagtgtgtatccctatgaaggcgaggacgtgtgctcctctgatggcgagggcgtgtagtcctatgaaggcgaggacgtctcgtcctatgaaggcgacggcgtgtagccctctgaaggtgaggacgtgtagtcctctgaaggcgaggacatgcaacaggacatgtagtcctcaaaaggcaagggcatgcaaccctctaaaggcgaggacgtgtagtcctctaaaggttaggacatgtagtcctctgaagccaaggacgtgtagtcctctcaaggcgaggacgtctagcccaattaaggtgaggacgtgtagtcctctaaggcgagggcgtgttgccctttga

SEQ ID NO: 94055 - DNA, 177 bp, Glycine max
  Peptide Sequence Number=SeqID_210833
atgaatgcggttctgccatgtgagggtctcaaagtaggagtgaggccaagagttagtgaaaatggcttggtggaaagggaagaaattgtgaagaagatggatcttctacaaagacctattctcaaagaagatggatcttctacaatgattcttggcaccaatggatgttacatgtaa

SEQ ID NO: 94056 - DNA, 1190 bp, Glycine max
  Peptide Sequence Number=SeqID_210834
aggactacacgtcctcgccaacagagggctgcacgccctcaccttaagaggattgtgtgtcctcactttcagaggactgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccttcaccttgagaggactacacgtcctcaccaacgtagggctacacgccctcacctttagaggactacacgtcctcgccaacagagcgacacacgccctcacctttagaggactacacagggctgcacgccctcacctccagaggactacacgtcctcgccttgagagggctacccgccctcgccttgggtacttttacctatcccctccagaggactacataggactgcacgtcctcgccttgagaggactacacgtcctcaccattagagggctgcacgccctcacctccagaggactacacgtcctcgccttgagagggctacacgccctctaccttcagaggactacacgtcctcgccttgagagggctacacgcccgcaccttggagggctgcacgccctcaccatcagagggctacacgccctcgccatcagaggactgcatgtcctcaccttcgtagggctacacgccctcacctttagaggactacacgtcctcgccaacagagggctacacgccctcacctttagaggactacacgtcctcgccttgagagggctactcgccctcaccttggggctacatgccctcatctttagaggaccacacgtcctcaccttcagagggctacacgccctcgccatcagaggactgcatgtcctcaccttcgtagggctacacgccctcacctttagaggactacacgtcctcgccaacagaggcctacacgccctcacctttagaggactacacgtcctcgccaatagagggctgcacgccctcaccttgagaggactacacgccctcaactcccgaggactatacatcctcgccttgagagggttgcacgccctcacctttagagggctacgtgtcctccatttca

SEQ ID NO: 94057 - DNA, 477 bp, Glycine max
  Peptide Sequence Number=SeqID_210835
atgaagaccaatctaaaacaaactgtcacagtgcaaaaatgggaagaatcaactcacacaactaatagattgacgtggattagatgctacaatatcattttctctacatggaacacaaagtgcctctcaagtataatttctaactttggaaaggtcctagacattgacaaagattctctattactcaagaaagttgagttcatgaaagtccttatcatgacctctacccaacagacaatctcaaaaaacttcaaaatcagcatcaatggagtcattacacaagtcaagcttgtggaggaaatgaaagttttcgaaaatcactgcttctataaaggcgatagaattagcgatgaggaagatacttgcagtaaagatagtgaaatgggtatgtgtttgggatcttcaagctcagagtgcttttttgatgcctggcatgcgacaaagcacgatgttgttcggagacaggattgtagatag

SEQ ID NO: 94058 - DNA, 1257 bp, Glycine max
  Peptide Sequence Number=SeqID_210836
atggaataccaatacccatcatcttatagcgtctcttcctcttctcactccaaccaccatcagcaaggctcaacaacgaaatccctctcttcatcacaacgcagccttatctcagtcccctccctcaaccaccaccacctccacaccccaaatccctccgtctaccaccactgcctcacaaccctcaagggccacacctcctacatctcctccttaaccctctccggcaaattcctctacaccggctcctccgaccgcgaaatccggtcctggaaccgcatccctgaaaactcatcaaccgacaacagtaataataataacaataacagcaccgtactcgccggtaagggtgctgttaagtcgttagtaatccaatccaacaaactcttcagcgcgcaccaagacaacaaaatccgcgtctggaaaataagcaacaacgacgacgaccaccaccaccagaaatacacacacgtggccacgctccccaccctcggcgatcgcgcctctaaaatcttgatccccaagaacaaggtccaaatccgaaggcacaagaaatgcacgtgggttcaccacgttgacaccgtctctgccctcgccctgtccaaagacggagccttgctatactccgtctcttgggacagaacactcaaaatctggaaaaccaaagacttcacgtgcctggagtccctcgccaacgcgcacgacgacgccatcaacgcggtcgcagtctcctacgatgggtgcgtctacacgggatcagcggacaaaaggatcaaggtgtggaagaaattcgcaggagaaaagaaacacaccttaatagagaccttggagaagcacaactctggggtgaatgcgttggctctaagcagcgacgagaatgttctatattctggtgcatgcgatagggctattttggtttgggagaaagagggtgatgatgggaaaatgggggtggtgggtgcgttaagggggcacactatgtccattttgtgtttatctgttgctgcggatttggtgtgtagtggctctgcggataaaacgattagagtttggagaggttctgttgatgcgcatgaatattcttgtttagctgttttggaagggcacaggggttcaatcaagtgcataagcgcagtggttgaccactgcaacaacaccaacacatggtcgcagtcggaagcattatcttttctagtctatagtggcggtttggactgccacattaaggtctggcagattttagttcctgctatctaa

SEQ ID NO: 94059 - DNA, 1521 bp, Glycine max
  Peptide Sequence Number=SeqID_210837
atgaccgaccctctcaacgagtcaatctcttgctttctcataagggtggacccttgggtacatgccctcaccttcagagggctacacgcccttaccttcagagggctacatgccctccgcttcagaggactacacgtcctcgccatcagaggactacacgtcctcgcctttagagggctgcatgccctcgcctttagagggctacatgtcctcgcctttagagcactgcatgccctcaccttcagaggactacatgtcctcacctttagaggactatatgtcctcgccttcagaggactacacatcctcgccatcatagggctacatgccctcaccttcagaggactacacgtcctcgccttcagagggctacacgcccttgcctttagaggactacacatcctcaccgtcattgggctgcacgacctcacttttagaaggctacatgccctcaccttcaaacgattacatggctacacacccgcaccttcagagggctacacgccctcacctttagaggactacacagggctacacgtcctcgccttcagaggactacacgtccccaccttcagagggctacacgccctcgcctctaaaggactacacgtcctcgcctttagaggactgcacatcctcaccttcagagggccacactccctccccttcagagggctgtatgccctcgccttcatagggctacacgccctcaccttcagaggactacacgtcctcgccttcagaaggttgcacgccctcgcccttagaggactagacgtcctcgccttcagaggagtagacgtcctcaccttcaaagggctgcacgccctcgccttcagagactacacatcctcgtctttagagggctgcacgtccttgacttcagaaggcgacacatctgcgtgttcagaggactcaagttccttggccacccccctgatcttagaggagtgtcaactgtgcgagcacaaccagagagggaggctatcgtgcagctactatgcataccggggcaagatttctcccagaccactacagggagacgagtgtggatcttgtgtaccaccacaactccgatctccccctactgaagtgtcagttggtctgtgccgtcatgacatagggtgtctgtcgcccccagcaaggtcatcagacctcccatcaccagagcctttgtcaaaaagtactacgcccccagacaggcgtagggctggagtgttgcctacgacatgtggccgactagctggcggccaaccaccggggcaggatgtcctggacattgtatccgacatcgtggatcctgcagcttcaatgcttttagcaattccagtattttcaggcaggatgtcctggacattgtatccgacatctccaggaaaggcaccattgaagagggttctagtgtggccccacaagctgacacaggttttgacaaccaccgactccagagcgtggaacattagtagcatttcgaggccactgagggatggtcattcctcaggcagagacaaaggcagctaa

SEQ ID NO: 94060 - DNA, 216 bp, Glycine max
  Peptide Sequence Number=SeqID_210838
atgacacatccctttgatattactgtgactttcgacgagatgatgcgtactcttgggcataccccctttgtgattccttataggactactgatgctcgtgattataggagtttgttccgtggacgcgaacgtgctcatggctttagtcatggacgtggcagttttggtggccctgttggcaatggagagccatctattcctccttgttgcccttag

SEQ ID NO: 94061 - DNA, 294 bp, Glycine max
  Peptide Sequence Number=SeqID_210839
atgatatgttctctcacaaaacaaggtcttctcagcaggactctacggagcatccaggaaaatggttgttccagagggcagcatgtcatttcaccagacaaggttcgcctaacaggactttatgaaacaccagcaagaatttcgaaggcgacatgtcctttcactggacaaggccctttcgacaagactctacagaatccccaaatggattttcagagggtgacaagtcctttcataggacaaggtcctcttagcaggactctacgaaaacctcacgtccctttgatatcttaa

SEQ ID NO: 94062 - DNA, 258 bp, Glycine max
  Peptide Sequence Number=SeqID_210840
atggacggacccgcctcgtgttggtaccagtggatgacccgcaacaggttcctcacctcctggccagccatgctccaagctctcgaatatcgcttcacacctaccttttacgatgacctttggtctcgcctcgccatccttgctgagttgcttcatctcagggttgtcccccgaactccatcgcgaagtacaggcgttccaacctctgcccctcccgcaagttgccgcccttgcaaagttgcacgagaaaaaacttaa

SEQ ID NO: 94063 - DNA, 774 bp, Glycine max
  Peptide Sequence Number=SeqID_210841
atgtcgttcgggctttgcaatgctccatcgacatttcaggccaccatgaatgacctccttcggccgtttctccagaaattcgtcatgggagtggccccaaaccccaacaaaatccaaaccatgttggactggcctactccatcatcccctttagacttgcggggttttctcggcttaactggtttttaccgaaaattcattcgccactatgccgccatgacagcaccactaaccgcgcttttacggaaataccaattttcatggtcatcatcagctcaagctgtgtttgaacaattaaagttgcttatgactcaagctctagtgttggtgacgttggattttacaatccttttcaccgtcgaatctgatgcttctaatgcggcgatgggcgcagttctttcaaactcagctacccatcctggtttcactatcaacaatggtcttttattcttcgaaggaaagatatggttaccctcaagcaacaccttccttaatttgatcgtggatgaattccacacaactcctttgggaggacatatgggtgttttgaaaacactttgttgcctgcaagacaacttcttttggccccacatgcgccaggatgtcagttgctacatggctcaatgttctatctgccaacaaatgaaatatgaggctaagaaactggcgggcttgctacacccactaccaattccatcggctatttgggaagatttatcccttaacttcatcactgggttgccattatctaatggttacaccacgatcatggtg

SEQ ID NO: 94064 - DNA, 174 bp, Glycine max
  Peptide Sequence Number=SeqID_210842
atgtcattctttgatggtgatggtttgcatcttactcaaagtggcaatcaagttgtttttgaggaagtaatcacaaagctaagagaagaaggcttgagtctagaatctataccagttgatctcccacttattgctgatattgaccctaatgacccactgaagtcatttctgtag

SEQ ID NO: 94065 - DNA, 4380 bp, Glycine max
  Peptide Sequence Number=SeqID_210843
atgacaagactggacgagttggaggatcgggtaacatccatggagaagacgtttgaagagcgagtatcggcgttggaagaaacttttcgtcaaacgtttacagaattccgtaacaccttgacagaagagtttgcaagttttcgccgtgagcctgaaacaactccggtgtcgtcggcggcggaagagacgatgtcagaatatcggatggcagtgaagaaggtggaattaccatcgtttgatggtgaagacccagtgggatggatcacgcgtgctgaaacgtactttgaggttcaaggtacatcagaagaagtgaagattagactggcgaagctaagtatggaaggagctacaattcattggttcaacttgttaagggagacagaggacgacctgacgtggttgaagctgaaacaagccttaatggagaggtatggtggaaggcaaagtgataacccgtacgatgaaatgaaagatttgcagcaaacagggacggtggatgagtacatcactgcttttgagtatgtgtcgtcacaggtagggagactaccagaggagcagtacttgggttacttcatgggaggactcaagacggatattcgactgaaggtgcggacactgaatccacgttcaagaactcaggcgatgaagattgctcgtgatgtggagacggagatgcgtgggtcgttattgcctaggggtggtgttggtgggccacgcaattggaaaggaagtgggcccagcaatggttctatcattaatgaagaaggtgaggtaatagccattgaagttaaggaagatgaggaagaagtgctagattgcaactctatgggattgtgtggaatcactgaatcaaaaacaacattgagcaataaccctcctactacactacgcctcaagggaagtttgaatggaatatcgattgtggtcctaattgatagtggcgccagtcataatttcgtttcacctcatgtggccactgcattggggttaaatgtggaacatggaagatccatgggagtaaaattgggtgacggtcaccgagtaacaacaaaggggagatgtaggaatatggaagtacatttgggtaagtttaccactcaaattgatgcttttgttctggaattgggtgatctagatatgatcttgggagtggcttggttacaaaggtttggaaaggtgactttcgattgggagaaaatgaccattagttttgtttgggaaggagaaagggtagagttgcagggccaatttttcaccacccaggatgtatcaacgaacaacacaattcatacttcaatggattccttgcacagcttgttagaagcagagatggtaccagcagtgaataaagacacaccagagttgattggggcacagaaacaggaacttgatgaattgttgagcaaattcaaaggagttttcgaagagcacaaagggctgccgccagaacgggagattaatcataccattgaactacaaaaggaggcaggaccagttagtgtaaggccctatcgttaccctcatcaccacaagggggagattgaaaggcaagttcaagatatgttgagtcaaggtatcattcgaaacagttccagtgctttttcaagtcctgtcattttagttaagaagaaagatgattcatggaggatgtgtatcgattatagggagctgaataaggtcacagttccggaccgataccctatacctgtggtggatgaactattggatgagttacatgggactaagtatttttctaaactggatttaaaatccggttaccatcagattagagtgaaggaagaagacgtgcagaaaacagcattccgaacgcatgaaggtcattacgaattcttggtgatgccgtttggattgacaaacgcaccggccactttccaatccattatgaatcagattttcaagccacacctccgtaagtttgtcctagttttctttgacgacatcttagtatatagtaaaagttggcaagagcatttagcacatttgtctcaagtgctagaagtgttgcagcatcactgttttgtagttaatcaaaagaagtgcagttttgcgagtagaaaggtggaatatctgggccatgtaatttctgaacagggggtggcagtagatccagctaagactaatagcattttagaatggccaatccctcacaatgttaaaggagtgagaggattcttggggttgaccgggtactatcggaaattcattgttggttatggcaaaatagctaaaccgttaaccgagttaactaagaaagatgggtttcattggggaccagaagaacagaaggcctttgagaatttaaagagcgttatgattcaagccccggtcttaacccttccagattttacacaacctttcgagattgaatgtgatgcatctgggagaggaattggtgcggtattaatgcagaaaaagaaacccatcgcttacttcagcaaggctttatctaaaaataatctgagcaagtcagcatatgagaaagagttaatggcattggtgctggctgttcaacattggcgcccttatttgttgggaagaagatttgtggtgtattctgaccagaagagcttacgtcacttgctacaacaacgtatcactacagctgatcagcagaattggatagctaagttactaggctatcactttgaagtagtttacaaacctggtcctgaaaataaagccgctgatgcactatcaaggattcatgaagaagtagaattaaaaggaataacttcattccctatatgtttgcaagagcaacaaattcaacatgaagtcaggaatgatccttatttgcaaaaagtggtgactgatttacaacaaaatcctacctctcaaccggggttccaattgataaaaggaaggctgttttatcataacaggttggtgttgtcttcaagttctgattgcatacctttaatgttgaaggaatttcattcttccgctactggtggccattcggggtttttgcgcacgtatcgaagaatagctggaaatctttattgggtagggatgagaaaatcagttcagaaatttgtgcagagttgtgatgtgtgtcaacgccaaaaatattctgcatcttctcccatgggtctgttgcagccattaccaattccggagcggatttgggatgacatctcaatggacttcataactggtctaccaaaatcaaaggggtatgaggctatttttgtagtagtggatagattatctaagtatggacactttattcccttaaagcatccatacaccgcaagaaaggtggctgagattttcaccaaggaggtggtgcgtcttcatggtatgcctcaatctattgtcagcgaccgtgaccccttatttgtcagcttattttggaaagagttattccgtttgcaagggacggtgttgagtatgagttcttcctatcacccggaaacggatgggcaaaccgaggtggtaaatcggtgtttggaagcatatcttcgttgttttgcatcagaacaaccgaaggagtggtcacgatggatttcttgggcagaattgtggtataataccacatttcatgtgtctacgggtacaacaccgtttgaaacagtgtatggaagaaaaccacctactgtggtgagatttcttcaaggagaaactaaggtggaggctgtagctacagagttgattgatcgtgacgaggctttacgtcaattaaagtatcacttgattcgagcacaggaacagatgaagcgatatgctgacaagaacagaaaggagtattcgtttgaggttggtgagtgggtatttctgaagcttcgacctcatcgacaacagacggtgacacgacgcattaatcaaaaacttgctccacgatactttggcccttttcctatccttaagaaagtaggagctgtgtcctataagctgaagctgcctgaaggaagtagaattcatgctgtgtttcatatatctcaacttaagaaggctatagggaattattcagctgaaccacaattaccagaaggattagaggtggagccagaggacttagaagagccggaagaagttttggcttcaaggtcggtcacggaaggtggacagcgcgtgcgacaatggttagtgcgttggaagggacgaacgatagaagacaccacttgggaggacgaatcagttctgaaaagtcaatttccctccttcagtcttgaggacaagactgttgcttctgggggaggcaatgatagaaccactgctgggcctagtattaatgaaaggcccaatcctgctgaaaggcccaatcctgctgtgtggagagtgtacgttcgtaggagtaagaaggtggggaaccattctgttagtggtgtggcaaagggaatccgtgaatatccctga

SEQ ID NO: 94066 - DNA, 582 bp, Glycine max
  Peptide Sequence Number=SeqID_210844
atggggaagatggatgtgcacataataacaagggagacccctaagggcaaagggtcactttggggcagttgcagctcacccaggcgagctgctttcttcaccatgaagctatttggtggcccaggcgagccagagactagcctgagcgagctagggttcaggaaaaccaaggaaaggaccctttttgccctcttttttttggtatttttcacattcttgatcaaaacacttaatgatcatgtgtttcgcactgtaactggcgttcaacaccagatcgtgaagaaaggcaagaaagactattcaatgactacttctccaacaatgcggtatacacaaatgaacaaatttgacgaaaatttagaatgcaaagggatattttccttcgcattgtacaagccattggcgatcaaaatccgtattttcagcaatagattgatgcaattggaaggatgggcctttctccgatgcaaaaatgcacaacttctattcgcatattggcatatgaatcatcaactgatagtgtcgatgattatgttcgaattggagaaaccacgactttactatgcttggaaaagtttgtaa

SEQ ID NO: 94067 - DNA, 432 bp, Glycine max
  Peptide Sequence Number=SeqID_210845
atggtgactttgaaagggattgtgatttttcctttttcattctctttcgatggtaccttagttatctttgaatctcccttgaaacaacttctccttcaaatctttgttcctctctcaccttccaacatcgtgaatcccacttgcactctcgccccccaacaaccgctaaaactctctatcaaggtaagaacccctctctcgcacccttttctcattcttcttcatttgtgtggtgaggaggtgacggtcttttggggaggagtcatgatcgaggtggagggcatagcgattgcagggatggtagagggaggagaaggtgcaaaggagggtagtaatatcgctggaggagctgaagatgaggtaggtgaggcgcggcgagagagtggaggggggggggtggggtcgggagagaaaatagcttggactcgatga

SEQ ID NO: 94068 - DNA, 243 bp, Glycine max
  Peptide Sequence Number=SeqID_210846
atgtcaacaactgaagcagagtacatggagatagcagaggctagcaaagaagttgtgtggttagcaaggttggtgaaaaagttaggcattgagcaaggtggagctcagttgcattatgataaccagagtgctattgacttggcaaagaatcagatcagggagttgatgacatctcactactgcaaaaaggtattcaaagatggttattttacgctttccatgacggttatgaaccatccttga

SEQ ID NO: 94069 - DNA, 1586 bp, Glycine max
  Peptide Sequence Number=SeqID_210847
atggagtgctacaaatgcaaccagaaggagcatttcaagtgcgattgccctgagttgaagaaatctggtgaagggacatctcgctcagcaaatgtggtagagactgatgatttagactactacgtcgagggagatgtcactacaaagtgggagatgttctctttgattgctatgtatgatgatggaataagaaccttatgtgatgtccaacatatccctaagttgaggaataatttgatctcacttgcacaacagactataggaaatatttacaggattttggggagcacagtagtaagccgagttgcatatgttgagtctaatgatgatgctaccaaattgtggcacctacgtttgggtcatctcaatgagcataagatgacagagcttcataagagaggactcttgaaaggagttcagagttgcaagttagacttgtgtgactattatgtgcttaggaaacaaactagagtgttgtttaaagttgcagagcataccaccaaagggattctagattatgtgcatattgatgtgtggggttctactagagattcatccttgggtcgttctcactattttgtgacattcattgatgatttttctctcaaggttattccaaaaggtgtgaaagggttcaagttttgggatccaagttttaagaagatggtgattagtagggatgtagtgtttgatgagcagtccatgttgccaaagatagttgatataattatgctagtgtttgatggagcttcccctaacaccatggagattcagtctaggtggaccgcattaggagtacaatcttttcatagagatcatcacaccattaaactcgttgttcgatatgagtttgaagaattggctaaattggttgcttttgcacttctcattagtgttggagatccttctacttttcaagaggctatgaacagcctagagaaagacaaatgggagctagttaagcttcctgcagccaagagagccataggatgcaaatgggtgtacaagaagaaacctccagtatcaaaaaaagaaagggaaaagttcaaggctcgcctagtagcaaaggggcatgcttgtgacatgcacttggagcaaatggatgtgaaaacaacctttcttcatagcgatctagaggaacaaatttacatggagctaggtctttgtatgaatcgaagcactcttcgaggaggtggtacaagcactttgattccaacatgtttcagattggctacaggacttgggtcctacaaagaagattcttgggatggagattcttgggatggagattcacagggacaggaaatccagcggttatggctcttacaacaaagttatgttgagaaggtgctagacaagttcaacatgagcaatgcaaagcctgtgagtactctattggcaaaacactttaagctttctgtagatcaatgttcgaagatagatgctgaggtggagtacatgccaaaggtactctatgcaaatgcagttggttgcttgatgtatgctatggtgtgcactataccagatttggcatatgctataagccaagtttacaagtttatgtctaacccagccattgggaagca

SEQ ID NO: 94070 - DNA, 162 bp, Glycine max
  Peptide Sequence Number=SeqID_210848
atggagatgaaaggctccgtacgcgggacgctaggatgtatgcggtttataggcgttcagaatccagacgatgtcaaatccagagaggttgagctgcgaagacaaaaagatgaggagatgaaaaaacgtgaagaatggagtctggagagtgagatacgttag

SEQ ID NO: 94071 - DNA, 243 bp, Glycine max
  Peptide Sequence Number=SeqID_210849
atttacggtgaagttagtagatcatttgctgtgaggtggaaagacgtacttgatcatttctggcatttgcttgacaatgatggaaatttgcataccattctctacaaccaagatttgaatagacaagccattgtagcagggtggacaacactaagagatttctattacatgaccggagatcatcaagtgttgttaacccattatggtaagattcagggtcgtgcaagatgtaaggaaaattag

SEQ ID NO: 94072 - DNA, 402 bp, Glycine max
  Peptide Sequence Number=SeqID_210850
atgggtgataaaggtgcagagacaaattctgcgccctttgtcattcataaacgggcgatcgtgtccggtggcatgcagagacaaattatggtcattctgcgtcttgtatcaaccgagaggaacaaattcgacaatatcaggatgatgttttgttggcagggaggttcactggctgaagggtgtttcgctcgaacgaaattagtgtcttatccttacttcccttttatctccaataaaagacaagtaaagaggggcaattgtcataccctaatttcgtctggggaccatccgttgttgggatacgaccctcgtttgaccacttcgaggtacttggcacccatcgttaggcaattcatgaagttctgtaacgttccggaaggccaaaaggggatgattacgtaa

SEQ ID NO: 94073 - DNA, 554 bp, Glycine max
  Peptide Sequence Number=SeqID_210851
atgggtggcaacggcaagcacaggtggaaattctccttccaccgttcctcatcccaaacctccaatcccgacccgaaccaagttcccaaggagttcacctgccccatttccggctcactaatgtccgaccctgtcgtcgtagcctcgggccaaaccttcgaacgcctcgccgttcaactctgcaaagacctcaacttctccccgaagctggacgacggcacccgacccgacttctccaccataatccccaacctcgccatcaaaacgacgatcctccactggtgcgacaattcccgcacccaacccccgctcccaccggattacgcctccctcgagcgccacgtcagagaagaaaaagaaaaacaagacctaattagggtttccgaaaaggagcttctcaacgcggtggccgacaaccctcctgtcatcttctcccacgccgccaccgagttaggcccccgagtcaatcacttcaactccggatcctcctccgaggaatccgtcatcatccctccgagtccgggaacgccgttgccgttaacgattcgtccaac

SEQ ID NO: 94074 - DNA, 291 bp, Glycine max
  Peptide Sequence Number=SeqID_210852
atgggaatatgtaagttgggatcaagttcagcaaatgctctcataggagatgatgagatggtcagggtttgggggaatgcttgggtgcctgggaattggaggctgattgatgtagccgaagatatcatttggcaaaacagaaacaacttcatatttcaaggtctcacatttcaacctgatgacattgtcaagcacattttgtctaaggtggaggtaattgataatagcttgcagcagtttgctaatttacattgtactgggagtaatgggagggctcaagctgaattgtaa

SEQ ID NO: 94075 - DNA, 156 bp, Glycine max
  Peptide Sequence Number=SeqID_210853
atgttggaggatggggtgggctggctcgatgagaagtttaaggaaagtgaagaaatggtggggtggggtagcattggaagtttgaggacggagtgggtgcaaggagtgacatatgtaggaatcacaaaaagtataacgaggaccacaaaaagataa

SEQ ID NO: 94076 - DNA, 560 bp, Glycine max
  Peptide Sequence Number=SeqID_210854
atggatgaaatagagaaggtgcaagagcagatgaaggccgacccggaggccttgaaagagaaaatggccacaatggtagaggccatgatgagcataaaggagatagtggtggtcagtgcggcttaccaaacccgtgctagaactaaaataatgggtgaagtagagaaggtgcaagagcagatgaaggccggcatggaggccatgaaagagcaaatggcacatgaaattccccaccacaatctagccgacttcgagccttgcctcggatattccgctgaagggcaagcaattggtggtatacccctgcaaaacactttggagggccctcagtatcatccacaaccacaaccttcacattccacagcggttaaaaaaccctcatgctatggcagaaatgggaaagaggaaaggcttagggccattaaaggaggtgaagattatgtctttgctaacctagaagagttgttcctagtacccaatatcatcacccctcccaagttcaaggtgctggactttgacaagtacaaggggactacttgccccaagaaccatccaaagat

SEQ ID NO: 94077 - DNA, 1078 bp, Glycine max
  Peptide Sequence Number=SeqID_210855
atgaggggttttggtggagaaggagaggaagagagatggggaggggtgagcgtggaagaaggcaagggggatgaagggatgcatggaattattgtgcctattgtgggacttttcaagcgaaatgaaggtgacgagaagttgttgctgctggaaatgtacaagaaccagcttcaagagctggcccagcggagctgcttcaacttaccttcctacacgtctcttcaggaaggtcccgatcacgcgccaaggttcaaggccatcgtcaactttaacggcaagatcttcaagacccctcactactgctccactcttcgtcaagctgaacactctgccgccgaaggttcaaacaaccggttcttcacggtgggattggtggcggcgtggtactcctccaacattggcgtgcttctcctgaacaagtacttgctcaataactatggcttgaagtacccaatcttcctaaccatgtgccacatgacgacgtgctcattgttcagttacgtagccatagcgtggatgaaggtcgtgcctttgcaaacccttcgatctagggtgcagttcttcaagatctctgttctcagcctcgttttttacgtctccgttgtcttcaggagcatctctctctactacctccccgtgtcgtttaaccaagccattggcgccaccacgcccttcttcactgccgtttttgcctaccttatgacgctcaagagggagacttggctcacttacctcacgcttgttcctgttgttactggagtcatccttgcaagtggggaacaaatggctagagtgataaaggaggaagaaaggagtagtcctagatggggtgcttcattttttacgcagacaacacaggatgtggctagagctgttgtcgcagctatgaattctcagaggccatgtgtggaccataagtcttggaaggagctgacaaagctgtttgaaagcatcgtggttgctggacttcatcctagtaagcttactccttatcatgagagtgatgcgatagggccaattcatagtaaggagagtccaagttctgaattgcagtcccgtattgatgcagaggcaagtg

SEQ ID NO: 94078 - DNA, 399 bp, Glycine max
  Peptide Sequence Number=SeqID_210856
atggattatggatggttccaaacagaggcagaggaacttgtgccattgctgacaaggaaatgtcagcagcgaggggaccatgaatgcttgatcttccaatgcagtatgagcaatattgatccgaattgtttgttcttcaaagccactttattaagcaattcaatagtccaaagagttgtatctctgttgattcagatagaatatgacaagttcaaagagttaaatttgctgaatggatttgactcctctaaagtgagaagagtgcacttagaggataaagtgacacatctcatggagccaacttctggaaaaaggcaagcaaaaactacttcagatcgctgcagacttcaccaaggtccttcatatatgcatcatttggaggcatgggaactagcatag

SEQ ID NO: 94079 - DNA, 198 bp, Glycine max
  Peptide Sequence Number=SeqID_210857
atggagtatcggggtggtgaaaaacagccatataggagaaggaattacctgactgaaactgcagtgttggtgttagtgttgaatgctaaagtcggactccaatggaccacagcgatcacaaaccccaacggtggtcacaaaccccgacggtggtcacgaaccccatcaacgacgatagtgtggaggagaccacagtga

SEQ ID NO: 94080 - DNA, 768 bp, Glycine max
  Peptide Sequence Number=SeqID_210858
atggcatgttcttatctcaacaacactacattcgggatatcttgcaaaaggctagatgtcgcattcgccatacacaagttgtcgcaatacatgcaatcacctacgactactcacatgcaagcactcaagcgtatcctacactaccttaagcataccatctcacatggtttacaactcgttgcaaccaaaaaccttgatctcactgccttttgtgatgcagattggggtggtgatacaattgacaaaaagtctacaggtgcctatattgtctatcttggtccaaatgctatatctaggtcttacaagaaacaatccacagttgcaagatcctcaactgaggctgaatatcgcaccattggattaacggcttctgaacttctatggctacaacaactactattagaacttggcatcaaattaaccaagcaaccaactatcttttcagacaatattggtgccacatatctttgtgcaaatctagtttttcactcaaggatgaagcacttagctatcgattaccattttgttcgtgacattgttgtcaagggtgaactcaaagtgtctcatgttccttccagtcatcaactagcaaacttgctagctaagccgctctcccggccaggccatgagtttctcatcaccaagattggcatcgttgactcctcctccatcttgcagggacatattagcgagggacatggactcgttggcgacatttgcagggaggctgccgaggtactagtcgacgttgaagatggcatggagtag

SEQ ID NO: 94081 - DNA, 261 bp, Glycine max
  Peptide Sequence Number=SeqID_210859
atggaggaggtgactggagataacaaggcaagcaaagtggtagtgaaaggaaaggcaacagaccccatgaaggttattcaacatttaacatcggtgcttacatcaccaccgatgttaaaacacacaagttattcaacatttaacatcgatgcttacgtcaccatcgatgttaaaacacacattttttacatcgttcacgaatacaacagcgacttagaaggtataatttctacatcggtggtcaggatagcaccgatgtag

SEQ ID NO: 94082 - DNA, 300 bp, Glycine max
  Peptide Sequence Number=SeqID_210860
atggtgagtttgctctgcgaaagccacgtggcctggaaaccgccggtggtgacggcaattcaggcgcaggtgcaagtcgccatctatgcaggcgagaggttcaaacgtaggcttagggtaggcggtgcagctacggtgctgcagggtggtgcaggaggcgcagaaggccaaatcaccagtaatggtgacgatttggctgttcaaaattttttttataaagcaatgcaggagcaggtgaagtttttgttcttgtttggcctacactttttggttgcttgtcttaatacgtatttgaggtaa

SEQ ID NO: 94083 - DNA, 276 bp, Glycine max
  Peptide Sequence Number=SeqID_210861
atggcgttcttcttgaaccaaactagtatcgcttcccattttcgatctcactctcagaagactgaagatttggcttcttttcctcgccgtcgattccacgtcgaaccaggggctcgtgaaaaagctctcttggcagaagatgcaactctgaaaccgttcaaatcgtacaagaagagtgtaaaaaagcttagaaaaattgggaatgcccttacaattgttgttgttgcaggcaaagcacttggtgatttggaaatccagtacacctctgcagtttga

SEQ ID NO: 94084 - DNA, 252 bp, Glycine max
  Peptide Sequence Number=SeqID_210862
gcggcattctcgccgagcgctgccgctttcctcgccgagaaacccgtcctggggaaaacggcggctgatcatgcggcggatcagcgcttcgacgcggcgatcggcctcgctgaccacgtcctgcagcccctgtttgaagtcgacagccaggctttgccgccgttgataaaagctgaaggcgagatcggcggcggcgcgggcgatctcacgcgcgaagcggtagcgcgcctcgatgtcccgtggggagagtga

SEQ ID NO: 94085 - DNA, 180 bp, Glycine max
  Peptide Sequence Number=SeqID_210863
atggaagaaaaggacgaattgcctgatgttgctgaatttttaaacaaagacaaagcagcgagggagaaagaaaagaagaaaaaaaatgttaaaaagcgaaaggtttgtgaaacaaactttcatgcgcaggaagtgcacgagtggagtgagttgttgcaattgtcttatcctagcagctag

SEQ ID NO: 94086 - DNA, 282 bp, Glycine max
  Peptide Sequence Number=SeqID_210864
atgaatgggaatggaagtggagtcgtcaccaactcaattgcacctctaaaccctcaatatgcagggttatctgaattttatagcaatgatccgccatttttttggggtagctcatatcctgtggaaaaggtggactttgccacctacatgctggagtctgatgcagaacattggtggaacagcactcgagggagtttggcaactcaaggagctcctatcacttgggaggagttcaaggaagttttcctggataagtactttcctcacagtgttcatatctaa

SEQ ID NO: 94087 - DNA, 2106 bp, Glycine max
  Peptide Sequence Number=SeqID_210865
atgggaagtggagtttcaaccctctgttggtgctctcggatcaacgaacccgacgttattttcaccgccaccgacccattggacgaaaccctaggccactccttctgctacgtcagatcctccgcgcgcttcctttctcccactcgctttctcagtccttccacttccctccgtttctctccgactcacgagccccgaacccgacccgaattccacgaaaccggttttaaggccatttccggagcctccgttagcgccaacagctcccttccggcaacagtcattcgcttagatgaagaagtgaatggagtttcctccaggggtaatatcataaatggcttcgagagcacggcgtcgttttccgccctcccgctccagcccgttccccgaggcggcgagcctttcgaggtcagcggcttcttcctctctggtcctattgaatccaacgccgtctccggtcctctccccgccgccgccgacttcgtcggcggcggcgagattcctttctcggcgcctctggccggactttacggtaagaagaacaggaagaagaagatgatttcggggttccggaaggcgttcaaccggaacgcgccggagaagaagcggccgtgggtggtgccggtgctgaacttcgccggaagaaaagaaagcgaggggaagccgccgccgctgccggaagaaaagagcaatgttcagtgggcgttggggaaggccggtgaggatcgagtccacgtggtggtgtcggaggagcagggatggttgttcgtcgggatttacgacggtttcaacggcggcgacgcgccggagtttctgatggggaacctctaccgcgccgttcataacgagcttcagggtttgttttgggaactcgaagaagaacaacaagaacaagaacaacaacaaccgttaccgcaagagagcaatcccgtggtggaaggaacggagagtaaacggcgtaagctgtgggagcttcttgccgaggacggactcgacctttccggttcggataggttcgcattttccgtcgacgatgcgctgagtgttaacaatgccaatgctggtagtgctgtgagtagaaggtggttgttgctatcgaagctgaagcacgggttgaggaagcagaaggagggtggagggagagggtggaatctggggaatgaagagaaagagaaggagaaggagaatcaagagaagcattgtgggaggaagagaagagtgggaccagtagatcatggactggttttgagtgccttgtctcgggcgcttgagttcactgagcttgcttatttggacatgacagataagcttctggacacgaatccggagcttgctttgatgggttcgtgtttgttggttgctttgatgagggatgaggatgtgtatctgatgaatgttggagatagtcgggctattgttgcacactatgaacagaaagaggttgattcatgtgttgaattgggaagcaagggaggtgttgagtccggaggtgccgagagcatagttgaggagcccctgggtttgggtcaaattgggagtgctcagcaacagaggttggtggcattgcagctgtcaactgatcacagcaccaacattgaagaagaagtcatcaggattaaaaacgagcatcctgatgatgcccagtgtatactcaatgatagagttaaaggtcgccttaaggtcaccagagcatttggggctggatttttgaaacagccgaagtggaatgatgcagtactagagatgtttcgtaatgaatatattggcactgctccatatatatcctgctctccttcactacgtcaccatagattatgccagagagatcagttcctgatcctctcatctgatggtttatatcaatatctaagcaatgaagaagtggtttctcatgttgagagcttcatggaaaaatttccagaaggggatccagcccaacatttaatagaagagctgctcctccatgcagctaagaaggctggaatggattttcatgaattgctagatatcccacaaggagatcggaggaagtatcacgatgatgttactgtcatggtgatatcacttgaagggagaatctggaaatcatcagggaagtatccatga

SEQ ID NO: 94088 - DNA, 2145 bp, Glycine max
  Peptide Sequence Number=SeqID_210866
atggctactccactgtctaccgttgtggatgtgtatttcacagacaccaaaagaacaagatttagcatcaccaccaccccttgcaggcaaaaaaccaatagaaaattcttcatacactgtgctacttcaaattccactccagaagctcctccaacaccaacttcagacaacaacaacaagaagaaaaacacttccctatccgaccaactcgcaccccttgccaacaaaaccctatcttccgccacaagagaccaatcctatgcgttatctaagccaaaatccacatgggtcaaccccaccaaagcaaaacgctctgtgttatcctctgagagacaaaaacgtgccacttactcttatagtccgcaattgagagatttgaaacgctttgctcagaaactgaacgagtctggttcctctgaagacgcattcttggcttgtttggaggagattccgcgcccaatttcaagagaaaacgcgttgctgatactcaacacgttgaagccatggcaaaagaccaatctttttctgaactggatcaggacccagaacttgcttcccatggaaaccatattctacaatgtcacaatgaagtctctgaggtttgggaagcagtttgggctgatagaagagcttgcacaccagatgattgataatggggttccacttgacaacatcacttactccaccatcatttcctgtgccaagaagtgcaacctctatgacaaagcagtgcactggtttgagaggatgtacaagaccagtttgatgcctgatgaggtaacttactctgctattctagatgtttatgctaggttaggcaaggttgaggaagtgattagtttgtatgagagaggtagggctactgggtggaagcctgaccctattactttctctgtattggggaagatgtttggggaggctggggactatgatggcattaggtatgtgtttcaggaaatggagtctgttggggtgcagcctaatttggttgtgtacaacaccttgttggaggcaatgggaaaggccgggaagccggtgttcgccagggggttgtttgaggaaatgattgagttgggaattgtgccaaacgagaagaccctgacggcggttattaagatatacggcaaggcgaggtggtcgcgagacgcattggagttgtggcaacggatgaaggagaacggctggccaatggattttatcttgtataatactttgttgaatatgtgtgccgatgttggactggtggaggaagccgagactttgttcagggacatgaagcagtctgcgcattgcaagccggacagttggagttacacggcgatgctcaacatatatgggagtcagggagatgttgataaggcgatgaaattgttcaacgagatgtgtaagtcgggcgttgaactcaacgtgatggggtttacctgtttgattcagtgcttgggaagggctacggagtttgatgatttggtgagagtttttggcatttcagttgagagaggaattaagccagatgataggctgtgtggttgcttgctatctgttgtgtctctgtctcagggtagcaacgatgaggaaaaagtcctcgcttgtttgcagcgagcaaacccgaaattggttgcctttattcatttgattgaagatgaaaaatccagttttgagagtgtcaaggaagagttcaagggtatcatgagcaatgcagctgttgaagtgagaagacccttctgtaactgtttgattgacatatgtagaaacaaagatcttcgagagagagcccatgagctactctacttgggaaccttatatggattatacccaggtttacacaacaaaactgacaatgaatggtgtttagacgttcggtcattatcggttggtgcagctctaactgcgctggaagagtggatgtggacactcaccaaaatcgttaagcgggaggagacactgcctgagctattcctagcccaaactggtactggtgctcataagtttgcccaaggactcaacatttcttttgcctctcatttgaggaaactagctgctccatttaagcagagtgaggaaaaaattggctgttttattgcaagtagagaggatttagtctcttgggtgcaatcaaagtctactgcagctgctactgctacatag

SEQ ID NO: 94089 - DNA, 387 bp, Glycine max
  Peptide Sequence Number=SeqID_210867
atgatttgggagacatatcagcatcccaactttctcattgatgagatgcaaagaaggatcatctttgaggagagggaagtcacacatttgatggaaagtcaccaagagactgtggctgatgctccaattgtggagttgtctcatcttagaggagaggttggtgaggataaggaaatagaggagaaggttattgaatcagcactggtgccattgatggaaggtttggagcagatcttgttgaaagctgatgagctaaggttgagaacactgaaggctattgttaatgttttgactccaaaacaggccattcacttcttaattgctgatgcagagttgtacctgaggatgaagtggtataaagtgcttagagagttcacttgcatgtga

SEQ ID NO: 94090 - DNA, 219 bp, Glycine max
  Peptide Sequence Number=SeqID_210868
agccaggttcgacttggtgaccggctcgggcgagtaagatggcgacagtggatccttggcctaggaatctcttgtatcgaaagtcttcccggcgatggattcaggtggcatgtcccgtgggtggagcagcaatgcaagtatctagagcatgtgggctctaatggtcaccttggaaatactgatgaaaatggctaccatgtgaatgagactcatacttga

SEQ ID NO: 94091 - DNA, 363 bp, Glycine max
  Peptide Sequence Number=SeqID_210869
atggtgacagaaatcaactacctggggcagctcagtcatcctaatcttgtgaaactaattggttactccttagaggatgatcaccggattttggtgtatgaatttgtggccaagggtagtttggataatcacttgttcaggaggggttcttactttcaaccactctcttggaacatccgtatgaaggttgctctagatgctgctaagggtcttgcatttcttcacagtgatgaagtagatgtaatatatagagacttcaaaacttctaatatcttactggattctaattataatgcaaaactctcggattttgggttggcaaaaaatggaccagaaggtgataagagccatgtctctacaagg

SEQ ID NO: 94092 - DNA, 1167 bp, Glycine max
  Peptide Sequence Number=SeqID_210870
atgacgaaaaaatggctgtttgccgcgctgaccgcgctggtgatgattctggttctctgggcatattcggcgtcacgcagtaaacccaatccgctgatgaccgccgcggtgcgccagggcgacatcgaaaacgtgattgccgccaccggcaaaatggacgcgattgagcgcgttaacgtcggtgcgcaggtctccggtcaggtgaaaaagctgtatatcaaagccggcgacaacgtgcgtaagggccagctgatcgcggagatcgatgatcagccgcagcgcagcgatctgcgtaatgcgcaggcggcgctgagcgtggcgcaggcggatttacagacccgtcaggctacgctggtacgccagcaggcacagtttcagcgcctgcagcagatggttaaaaccaacgccgtttcccgccaggattttgataccgccgccgaagcgtggcgcatcgcccaggcagagctgacggcgcagcaggcgcgggtgattcaggcgcagatcgaagtggataaaaagcagctcgatctcggctacacgcgcatcatggcaccgattgacggcacggtggtggcgatcgtcacgaagcagggccagaccgtaaacgccgtgcagagcgccccgaccatcgccaaactggcgcagctcggcaccatgaccatcaaagtgcaaatctccgaggcggacattaccaatattcagcccggccagcaggcgtggtttaccactttcgccaacccggataaacgctacaacgccacgctgcgcagcatcgaactggcccctgagtcggtgatgaaagatgatgcgctgatgggcaacagcgaaagcaataccgtgagcagcacgaacgcggcggtgtattacaacgccctgcttgatgtgccgaacccggataatgcgctgcgcatctccatgacggcgcaggttaatctgctgcgtgaccaggcgaaaaacgcgctgctggtgccggtacaggccacgaaaaaggccagcgatggtcgtacttacgtcgaaatcgcggatcaaaataatcagccagagaagcgctacatcaccaccggcatcagcgacagcgttgacattcaggtgctgagcgggctgcgcttaggggaaaaagtgatccttgccacgcagcagccgggcgcggacaaggtggtgatgtga

SEQ ID NO: 94093 - DNA, 216 bp, Glycine max
  Peptide Sequence Number=SeqID_210871
atggagatcggggttggatttgacacttcagttatcgaggagaagagcatgataatgggatgggcaagtgcaacacgatattttggcatggaaaatagtacttccaagtgttcgcgtgttttcagttttcacttatcagcatgggaaggagatcctccactttggtaccattttcaacaatgctacaaacgtcaaaccaagcttttaaatacataa

SEQ ID NO: 94094 - DNA, 723 bp, Glycine max
  Peptide Sequence Number=SeqID_210872
atggcgctggtgaagaaggcgatggaggcgctcgtcgacgccgatccgatgaagatcgtgacgctgtcgaagcggcattcggagctggtcgacgagctggtgaagcgcccacgcctcgaaagtcgtcctgacgcggtcgcgtcctatggcgagctcgctgtcgatttcgtgtcggcgtgcgggatgcgcctcgaggactggcaggagtacgtgctgcacgcctggcatgacgtcgacagcgacgggaactgggcggcgtccgaggcgggtctgctggtgtctcggcagaacggcaagtccgaggacttgatcgggttcgacctggtgcggctgttcctgttcccgatgcctgacctgcggcggcggacggtgctgcacacggcgcacgaggtgaagacggcgacggagtcgttcgagaagctggcggcgatcatcgcgtcgcaggaccggctgatggcgatggtcgaccacatctacaccgcgaacggcaaggaagcgatcgtcctgaagcgccgccccgggcagctgctcggcgaccgggtccggttcatcgcacggtcgaagggatcgggccgcggattcggtgcggcggacatcgtctatgacgaggctcaagacctctcgacgcaggctcgctcggcgctgacctacacgcagtcgacgatcccgaaccggcaagagatcttcgccggcactgtcccgtctgaggaggacgacggcgag

SEQ ID NO: 94095 - DNA, 162 bp, Glycine max
  Peptide Sequence Number=SeqID_210873
atggtgtgtgaagagcatgagggaaggtctcaatggaatgaaggtgcaaagaaaatggtggtgatttggctactacgaaggctgaaaggttttctgaaagtatcttccaaaatttactttccaagtatttttgagaaaaagataacaaaaataaaagtataa

SEQ ID NO: 94096 - DNA, 309 bp, Glycine max
  Peptide Sequence Number=SeqID_210874
atgaaccttctttcatgtgatatctcgcggaagaacttcttccataggaatccacgtaagaaggttctttcgtggcttcctgtggaagaaattattctacgagatggcacagaagaaggttcttccgtagttaatgttacaaatgtggaagaaccttcttccgtgcaatctcgcggaagaagttcttccgcaagaattcttacaacagtggaagaacttttttctgtaacattaactgcagaagaaggttctgctgtagaaacattgaggggtaagcaagctccttcgatccacgatctcttcctctga

SEQ ID NO: 94097 - DNA, 529 bp, Glycine max
  Peptide Sequence Number=SeqID_210875
tctgaatctgagtttgaatttgatcctgtggctgacttttatgctgagagtgaatttgaatttaagtctgatgttgtacctcttgatgtcaattttttagagtcagaatgcactaaccatgttgcaggaagtacatatacttctgatttgctttatcagccaccacccacaccaaagttgaagcccttaccagcaaccctcaaatatgcttacttggagtacaaggaaaattttccagtgatcatctctgcatcccttgctgctgagcaagaggagaagttgttgctagatgggagcttagccagtgaggcagccacagcggcgactcaaccccgtcattctagatgtgtccaagtggttcctaagaagacaggtctcacagtgatcaagaatgaaaaggatgagcttatcctcacaagagtgcagaacaactggcgagtctgcattgattataggaggctgaaccaggtaaccagaaaggatcattttcccttgccattcattgatcaaatgcttgagcgcttagcag

SEQ ID NO: 94098 - DNA, 248 bp, Glycine max
  Peptide Sequence Number=SeqID_210876
ggagagctttgggagtaacatttgaaggctatgaagaggatattgtttcaaaatttgtgtccatggaagaaagggataagaaggaaaatagagatgaaggggtatgtaaggaaggttcatgtggcattaccattgttaatgcctactcgctgtatgatttgcctaatttcaattgtataagaaatgcaagtgagaggaacgacaaagtggtggataatcttggaatggagggagagaaaagagtttga

SEQ ID NO: 94099 - DNA, 583 bp, Glycine max
  Peptide Sequence Number=SeqID_210877
atgtcgttgactcacctgccccgtttgattgtactagccagcagcctttggctgccggtcacgacgtgggcagcgtcgcaaagcctggtcgacatttaccaggaagccaaagccaatgacccggtgctggcttccgcgggtagcgccaacctggcagcacaggagatcatagaacaggccaaggcaggttaccgtccttcagtaaactttaccgcaggcgcgaatgccaaccgcacagatttgaaaatcgtcggcagccaagcgcctttccccggtggacgcaatacctatgaaggctatcaggcgcagctacaggccaggcaaccaattttccgcaaagaaaacctggagcgcatcgaccaaagcaaggtacaagtgagcattgccgacaagcaatatcacctggcccagcagaacctgatgctacgcaccacgcaggcctactttgatgtgttgctggcgcaagaccgcatgacgctgattgaggcgcagaaaaaagctatccaaagccagttgcagcaagccaaggccaactttgatgtgggcaccgccaccattaccgactttaatgaagcgcaagccc

SEQ ID NO: 94100 - DNA, 434 bp, Glycine max
  Peptide Sequence Number=SeqID_210878
atggcaggagctggtgatggtgatggtaaatatcatgaactggatgaatctcagcgtttgttattggatgatctggagaaccaaatgaatcataatactagaagacattatggtaggaacagagtggccaatgttggacctaagcaaaacaaagtggaggggaagaatagaattgagggagtaaaactcaatgtacctcctttcaaggctgaattctcagactatgcccttgtttggtggaataaaaatcaaagagagatgatgagagaggaagggcaggagatagatacatggactgagatgagaaaggagtactacaaggagatggagatggcactagtgagagtcaacattgaagaggaaattgaggacacattggctcattttctaagtggcctaaatccttaccttagagatgttgttgaattacagga

SEQ ID NO: 94101 - DNA, 165 bp, Glycine max
  Peptide Sequence Number=SeqID_210879
atgtcgttcatgattttttggaattctgaaggggcattcttcaaaccgaatggcattacattccactcgtattacccgaaagcggggtgttcctcgttcaagctcagcatgtttgttaacataaaaagccgcacaagaccatgggcttttacttttccgaattag

SEQ ID NO: 94102 - DNA, 599 bp, Glycine max
  Peptide Sequence Number=SeqID_210880
ctgataccgctcgccgcagccgaacgaccgagcgcagcgagtcagtgagcgaggaagcggaagagcgcccaatacgcaaacccgcctctccccgcgcgttggccgattcattaatgcagctggcacgacaggcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacatgacatcaagttcaacgtagtctctgagaaggctccacaggatgatgagcttcgtgatgcagagtttgcatggttgtgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 94103 - DNA, 945 bp, Glycine max
  Peptide Sequence Number=SeqID_210881
atggtgacgtatttgtcccgtttccacgcaattttcattgaaaagaaaagaagcaccgagcgaagccagccaggttgtcttccgattccttcagttaccctgatcttgtcccttgttgatttcaaagagttgaactgcacatactgtatggagttcattgggagaatatcaaactattctaaacatgagattagaggaaacatgagaggttgtttgcaaggttgttacagtgatgtgggagttgacttcccccattggaagtatgggatttggatttgtgattatctgttcaagctccttcttattggagactctggtgttggtaaatcatgccttcttctgagatttgctgatgattcgtacatcgagagctacataagcaccattggagttgattttaaaatacgtactgttgagcaggatggaaagaccattaaactacagatctgggacacagccgggcaagaacgatttaggacaatcaccagtagctactatcgtggggcccatgggatcattgtgggtgatgattttcttggcatgggcttttggatattgatttcccgtgtagatggatccttgcatgctttactaactgatgaagagagcttcaataatgtgaagcagtggctcagtgaaattgatcgctatgcaagtgataatgttaacaagcttttggttggaaacaagtgtgatctggaagcaaatagagctgtgtcatatgaaacagctaaagcattcgcagatgaaataggcataccttttatggaaacaagtgcaaaagatgctacaaatgttgaacaggctttcatggcaatggctgcttcaatcaaggatagctgtgagaagcaagcccaggaaaaattgttcccaatttactcaatgaataattatactgtgtatctgatgttgtcagtttccttagctgagaaaagtcaattgtga

SEQ ID NO: 94104 - DNA, 282 bp, Glycine max
  Peptide Sequence Number=SeqID_210882
atggtaatgctaccatttattttatcattgctcaaattcaagttccgtaacttgggtaattccacaacttctgttggtattgtgccactcaactggttatcaccaagatccaaatcttcaagattttggaatgtttccagaaagatggttggtgagttttgtcaagtttcaatggtggaaggaatgaatccagaaagctggttgcgatcaagcccaagatcctctaaattggccaagttttctatggaagcaggaattgatccagaaaatttattggcataa

SEQ ID NO: 94105 - DNA, 810 bp, Glycine max
  Peptide Sequence Number=SeqID_210883
atggaaatgtttgagaatatcattgaagcaaccaataacttcgattacagatatctcattcgagtcagagggcaaggtactgtttacaaggctgagttgtcttcatgtcaggtttatgcagtgaagaaactttatttggaaacagatggagagaagcccaatattaaagcttttcaaaatgaaattcaagctttgaccgaaatctggcaccgtatcattataaagctttgtggattttgctcacgttcatggttctcatttttggtttacaagttcttggaagggtgtagcttggatcaaatactaatcaatgacgcaaaagcagctgcatttgactgggaaaagcgggtgaatattgttaaaggtgtggccaatgctttatcctatttgcatcatgattgctcacctccaattattcaccgtgatgtatcgagcaagaatgttcttttggattcacaatatgaaacccatgtctctgattttgggactgctaaaattctaaagcctggtacaaacaattggaccatgtttgcaggcacctttgggtatgcagctccagagcttgcgcagactatggaagtgactgagaaatgtgatgtattcagtttaggagtgctttgtttagaaatcatcatggggaagcatccaggacatctgatttcctcattgttatcttcaacttcagcaacagtaacttataatttgctactactcattgatgttttagaccaaagaccatctcaacctctaaaaatcaattgccggggatgtcattttggttgcaagcttggcactttcttgcttgagtga

SEQ ID NO: 94106 - DNA, 498 bp, Glycine max
  Peptide Sequence Number=SeqID_210884
atgggggtttcaatgcatattctttttcaaaaagcaagaaagaaaagagcccaggctatagaaaaggcacaatctgaagaagtgtgttccatatggggccatgatggaaaaattatgttcgaaaatatcattgaagctaccaacaatttcaatgacaagtatctcattggagttagagggcaaggatctatttccatggttgagttgccttcaggtcaggtttttgcagtgaagaaatttcatttggaaacagatggagaaatttcaatgacaactctatggattttgctcacatccacggctctcgttgtttgtttatatgttcttggaaggggagcttggatcaaatactatggcacagaagcagctgcattagactggaaaatgagggtgaatgttgttaaaggtgtggccaaagctttatcctatatgcatcatggttgctcacctccaataatgcatcgtggtatatcgatcgagaatgttgctaggatgtaa

SEQ ID NO: 94107 - DNA, 3162 bp, Glycine max
  Peptide Sequence Number=SeqID_210885
atggtttctttggcctctgctgccaccacagttactgcagcttcggacagtgaagcaaatgcattgttaaagtggaaatacagccttgacaagccaagccaagatctcttgtcaacatggaaaggttctagtccatgcaaaaaatggcaaggaattcagtgcgataaatccaactctgtctccagaataactcttgcagattatgaactgaaaggtacacttcaaaccttcaacttctccgctttccctaacctcctcagcctaaatatattcaacaactccttttatgggaccattccaccacaaattggtaacatgtccaaagtaaatattttgaatctttctacaaatcatttccgtggttctatccctcaagaaatggggagactaaggagtttacataagcttgatctttccatatgtctattaagtggagctattcctaataccataacaaacttgtccaacttggaatatctagatttcggtagcaacaatttttctagccacattcctccagagattggaaagttgaacaagttggagtatctaggctttggggatagtcaccttatcggttccattcctcaagaaattggaatgttgacaaatcttcaatttattgatttgtcaagaaactctatctctggtactatacctgaaacaataggtaacatgagtaacttaaatatactttacctttgcaataactcccttctatctgggccaatcccatcctccttatggaacatgtctaacttgaccgacctctacctttttaacaatacactttctggatcaatccctccttccgtagaaaacttgatcaatttagagtatcttcaacttgatggcaaccacctttctggatccattccttccaccattggaaacttgacaaatctcatcgagttgtatttaggactcaacaatctttctggatcaattcctccctctatagggaacttgatcaatttggatgtccttagtctccaaggaaacaatctttcaggaactattcctgccacaattggaaatatgaaaatgctcaccgttttagaattgaccaccaacaaacttcatggcagcattccacaaggcttgaataacattaccaactggttttccttcttaatagctgagaatgatttcacaggccatttaccacctcaaatttgctctgctgggtatctaatctatttaaatgctgatcacaaccatttcacgggtccagtgccaagaagcctaaagaattgcccgagtattcataaaatcaggctggatggcaaccaattggaaggagatatagcacaagattttggtgtatatccaaatttggattacattgatttgagcgacaacaagctatacggccaaatttcaccaaactgggggaagtgccacaatcttaatacattgaagatatccaacaataatatttctggtggtataccaatagaacttgttgaggcaaccaagctaggtgtccttcacctttcttctaaccacttgaatggaaaacttccaaaggaattagggaatatgaaatcattaattcaactcaagattagcaacaacaatatttctggaaacattcctacagaaattggatcactgcaaaatcttgaagaattggatcttggagataatcagctgagtggcacaataccgatagaagttgtgaaattacccaagttatggtatttgaatttgagcaataatagaataaatggaagcattccctttgagtttcaccaatttcagcctcttgaatctcttgatcttagcgggaatttgttgagtggaacaataccaagaccacttggagacttgaagaaactgcgcttgttgaatctctctcgcaataatctttctggaagtattccctccagttttgatggcatgtcaggtttaacttcggtgaacatatcatacaaccagttagaagggccacttcctaaaaatcaaacctttcttaaggctccaattgagtcgttgaaaaataacaaggacttgtgtggcaacgtcactggcttgatgctttgcccaaccaaccgcaatcaaaagaggcacaagggcattctattggttttatttattatcctgggtgctcttacactagtattgtgtggggtgggagtttcaatgtacattctttgtttgaaaggtagcaagaaagcaacccgtgctaaagaatcagaaaaggcactgtctgaagaagtgttttccatatggagtcatgatggaaaagttatgtttgaaaatatcattgaagctaccgataacttcaatgacaaatacctcattggagttggagggcaagggagtgtttacaaggctgagttgtcttcagatcaggtttatgcggtgaagaagcttcatgtggaagcagatggagagcagcacaatcttaaagcttttgaaaatgaaattcaagctttgaccgaaatcaggcaccgtaacattataaagctctgtggatattgcaaacatacacggttctcatttttggtttataagttcttagaagggggtagcttggatcaaatactaagcaatgacacaaaagcagctgcatttgactgggaaaagagggtgaatgttgttaaaggtgtggccaatgctttatcctatatgcatcatgattgctcacctccaattattcatcgagacatatcaagcaagaatattcttttggattcacaatatgaagcccatgtctctgattttgggacagctaagattctcaagcctgattcacacacttggaccacgtttgcagtcacctatgggtacgcagctccagagcttgcccagactacggaagtgacagagaaatgtgatgtattcagttttggagttctttgtctagaaatcatcatggggaagcatccaggagatctcatgtcttcattgttatcttcatcttcagcaacaataacttataatttgttactaattgatgtgctagaccaaaggcctcctcaacctctaaactcaattgttggggatgtcattttggttgcaagcttggcattttcttgcataagtgaaaatccaagttctcgcccaaccatggatcaagtgtctaaaaagcttatgatggggaaaccacctttagcagaccagttccctatgattagacttggacaactcctctaa

SEQ ID NO: 94108 - DNA, 138 bp, Glycine max
  Peptide Sequence Number=SeqID_210886
atggcagtggctagctacgagatatggggaatgggtttgaagcttcattatatctatggaatgtaccgaaatgatctagtgaaggagattaagaaaaagagactgcagaggagatatgtatctaaccttggaggataa

SEQ ID NO: 94109 - DNA, 405 bp, Glycine max
  Peptide Sequence Number=SeqID_210887
atggaaccagaagctcttgataccactgtcagacccgatacttacaacatcctcaaaccagaaacaaagaagttgaccccacttcgttgttcttccattctacccgacgacgtggaggagtcttcccagctcgaagttcatttgaatcaaggagtggcagttcgtgaagagcagggctttgtccatgggaagacgcaggtaatcaatgagttctttgtgaccaacaactgctacattgttgacttggctacaaactgggttgcacccagcactgaagctagtgtgggccctttgtcatggattggcatctgtgaaactaattcaacatttcctcagaacttttccctcatgatcttccatcgatttacttttgtcacaactgatatgggattaaaaggttcataa

SEQ ID NO: 94110 - DNA, 1067 bp, Glycine max
  Peptide Sequence Number=SeqID_210888
atgcaagacgcaattgggattccagcatgcttctcttctgcattgaaatcgagtgatgatcacacaaccgtgacccgttcaggccagagcgtgcacatgtccgtgtacagaacaaagattgctgaccagtgccgcttgatcaccatcacatggtgcaaaaacatgatactccatgggctttcggtgtcagtggaaggcccagaaggaaaggcccaatactgctgcaaggtggagctgaagccatggtatttttggagaaaacaaggttccaagcgcttcatcgtacacggtaacaaacccgttgacgttttctgggaccttaaaggtgcaaaattcaacggcgagacagaaccaacctcggagtactacgttgccgtggtgtgcgaccaagaggtcgtgcttctgatcggtgatttaaaaaaagaagcttatagaagaactgggtgcagaccagcactcattgacccaattctggtttcgaaaaaagaacacatttttgggaagagaaagttctctacaagagccaagtttcacgagaagggtaggtgccatgagatctcaattgagtgcaagagcaacaatattggaggagatggagataagattcagccagagatggagataagactcgatgggcacgtggtgatccacgtgaagcgcttgcaatggaagtttagagggaacgagtcgattcatctcaacaagatgagagtggaggtgtattgggacgttcacgattggctcttcagccctggtttgaaacatgctttgtttatttttaagcccgttttatcatcatccaatatttctatgtcatcgtcacattcaatttcatcatcatcatcaccattatcgttatcattatcatcatcatcgacacctttatccactcaaacgggtcgttctgggtcgctggaggggtgtagtgtcagcgaggcttcagcgttttgcttgtttctatatgcttggaagggtaacggtattcttattattgtatcatcaacggggaaaataacgttggaaaatgacttgggggctcttcaagttatggaaaagaatgcaaaatg

SEQ ID NO: 94111 - DNA, 273 bp, Glycine max
  Peptide Sequence Number=SeqID_210889
atggatcaaagctctaaagtctatataaagcttgaagatgttcgtgatgaagttgtcgaatcactagagaatcatctaactttcaaagttttcgaaaggcaaagcttttatccttcacattattcaacccctcccctttctagtgtgtttcgagtacttcatgaagaagaggcaaaagacaagaaaagtatgagactacctttcaaatcagcaataccaactagtgatgatagtgaaagagaagatgtagaaggatcagaagctgaaaattga

SEQ ID NO: 94112 - DNA, 630 bp, Glycine max
  Peptide Sequence Number=SeqID_210890
atgagtaatgttgaagttagggtgagtgaaattgagggtccagttgagatggatgataagagtgacagtgagagtaagtcggatgtatacctcgatgatagtgaggaagatatgattttaggtttagatgatggttttggtgattatgcaactatgaacttgactccaaaagaagtaattgagaagttgaataatgatttgcaacatggagtcaatcctacattcactaaagacatggagggagactataaaattgactttaaggatgcaatgagagagtatttgattcttattagaatggaggttaggttcccaaaaaatgacaaaattagagttagagttatgtgtaagtcaaaaggttgttcatttaaagttttgctcaagcttggagagcaaagaaaatggcttaagaggacgttgatggagatgcagcaaagccatgttgcttgttgtatagatgattgcaagatgggctttgtagcgggatgtcagccatttattggtgtttatggttgtcatttgaagactaagtatggaggtatattttttattgttgtcgggagagaccataatgaccaatattatccaatagcctttgttgtgattgagtcagagaccaatgagtcttaa

SEQ ID NO: 94113 - DNA, 2532 bp, Glycine max
  Peptide Sequence Number=SeqID_210891
atggataaggtttggtgtttcaccattctttatgtttctcggtatgttgaattgaaggttagccatatctatgaagcacggatacttctccctgttcaaaatgtcacccatggggatgttgttgatgcaatctctatagttctacatgcaactaatgtgctcatagcagtagcaccaaactgcttgttgaagggtaaggctgcgtacaacatccctcccccataccttcgcatagcgaagagcctctgggcaatgggaggctcttcgttatgcgaaggtatgggggagggatgttgtacgcagccttacccttgcatatgcaaagaggctgtttccggattcgaacccatgaccaacaagtcaccaaggcacaactttaccgctgcaccagggctcgccctcttttctgagtgtccacgtgtccgtgtccgtgtccatgtccgtgtcgtgtccggtgtccgtgtccgtatcgattttgggtggcagcagagatatgctcgtttctgtggaagagtagttgtcctttcaatccttgtgttgcttctctatccatttctttgggcttggactgtaattggtaccctgtggttcagcagtgccaagaactgtttgcctgaagtgggtaaaaaatggggctttctcatctggttactttttagctactgtggactcttttgcattgcttgcatgtctctggggaagtggttgactcgaagacaagcacatttattgcgtgcccaacagggtatccctgtatctgaatacggggttctggttgacatgatccgagtgcctgattgggcatttgaagccgcaggccaagaaacaaggggcatgggccaagatgctgctgcatatcatccaggactttacctaactccagctcagagagaagcagttgaagctttaattctggaactaccaaagttcaggttaaaggctgttcctactgattgcagtgaatgccccatctgcttagaagagttctatgtagggaatgaggtccgtggcctgccctgtgctcacaattttcatgttgaatgcattgatgagtggcttaggctcaatgtgaaatgtcctcggtgccgttgctcagttttcccaaaccttgatcttagtgcactgtccagtctccgtgctgagcctgaacaattttctgccagtgttgtgacaacagccagatatgtgagaggccaaccatctagtctaagttaccggctaagattgcagggtcttctgtgtccagtccgtgctgaaattgcaggaccagttggtgacatagataatgcgttgaaaaatgctcagaatggcgttgtatcaattgtgactcaaaatgcatcatcatctggagaccaagcctcttctgtcgaatgcatgcctgttactgtctgtcattcctctgcacaaagagaagagaattggcttggtaccatgtttgagtcatggagtccagagatagcattgggtagcagaatgctatggatagagaaacagaaatgctttccagagtctcctatgctattcttggtgagtgttccgctgagcaaggaaataagtggatttgagaagttgtgcattattggccgcattttccccttaagactattggaggaaacagaaatggttgaagagaggagttgttgcaaagaaagtggagggtttgatatagaatcaagggcttcatcggtggacagttggaggggggaggaaggagattcagatgactcaagaagtttaatggatgacaatggttggcctccaccacaggatgaagggagtgtgttatttggttgtgacggtaagggatttgtgaatacttccaaagaaatggaggccagggatacgaacgaaattcagaagattaagggagaagaaatcagtagggatattgctggaaaaaaaaggcaacaaatctcagataagttgtgtatgatactttggggtgatcatttagtggagtggaaggcttatccgtctaggaatacaggcgattttaatgttgttagagagaaagatagagacaagagaagcaaaggggattcagggaagcaattcacttggtttagcccagcaggatcaacaatcagtagaattgatatacgtttgggcaagaaaacattggtgattaaggagatgggggagttggataggagggcagagttatggttacttacaaatcctgaaattcaaaagtggaaaatatcaactgaggagctatggaatatttctagaagacatgagtcattgctatataaaaagtctagagtaagggtctttattaatggtttatgggttgaggaattgaatcacatcaaggaggaggttaagagattcattgagctaaaatataaggagcaggtggagaaggtgaaacaagcagtatgggaatgtgatggaaataaatgtcttggccctgatgtgctacaaaaagttattcatgagtctcaatccgcatttcttggtggtagaaatatattggatggcgtggtcattgcaaatgaagtcatacaggaggccaaggcaaaagaataa

SEQ ID NO: 94114 - DNA, 228 bp, Glycine max
  Peptide Sequence Number=SeqID_210892
atgctcaacagcgaagggagcgattgtttcaaggttaaaaattttattcccgaaagtgaaattgggaatgaattgttcatgccctgggaaagtaacaatacattcttatactttatttttactcccatggtgagcgacgtagaagttatctatgaagcaccgatacggacacggacaccggacacgacacggacatggacacggacacggacacgtggacacctgtaa

SEQ ID NO: 94115 - DNA, 1050 bp, Glycine max
  Peptide Sequence Number=SeqID_210893
atggaaagacaaaccaatgaaacagtaaaagttgaactgggaggagaagaaatacatgatgaagttcagattgacaatgagcaatatgtgaatgatgagcaaaatgtgaatgatgggtcagatgtgattggggttgtacctttgagaaggtcactaagacagatatctccaccagtgaggtttcaagactatgttgtcttccctgatgctgctagcaatgttaatggtgagttgatgaaggccatggaagaggaatttagatcaattcagaaaaacaaaacttgggaaatggcaaggctagttgcaaaaggtttcttgcaaaagcctagtcttgatttcaatgaagtatatgcccctgtagctagaattgaaacagtgagactcatagttgcaattgctagcatgaggaaatggacagtgagtcaactagatgtgaagtctgattttctcaatggtccattagaagaagaagtatacacaaggcaaccacctggctataagaagataggcatggaagatagggtaatgaagctgaacaaagccctatatggcttaaagaaagctccacgagcctggaataagaggattgatggatttttgcagaagcaaaagtttctaaaatgcaccactgaacatggagtgtacttgaaggactgtggagtaactggtgtagtgatgctatgcttgtatgtggatgatcttcttgtcactgatatcacctatggagttggtttggttagtatattcatgaagaaaccttgcaaggatcatctacttgcagctaagagaattcttagatatgtgaagggcacactagaatgtggaattttgtttcctacaacaaaagaaaattttgagatagaaattattgactacacagatgcagattggagtgaagacattggtgatagaaagagcacatatgggtacatgttcatgcttggaaatgctcctatatcatggtgttcaaagaaacaagaagtggtggcattatctagttgtgaagctgagtacatctcagctgcttttggtgcaaggcaagccctttga

SEQ ID NO: 94116 - DNA, 732 bp, Glycine max
  Peptide Sequence Number=SeqID_210894
atgccctccatgaagacctcatcgtccaaaacctccgagtcctcgactcagttcgactcgccccactcgcctctccgatccttcccgctcttcgacaacgccgaccccttccactcgccgcaaaatgacaactcccgcgccatcgtcatcgtcgagacaacttcgactcaattcgcccaggccgcgccccccgcgccggagtccgagcaccggaacccgcctccggaggccgtggtcacccgccccgtttggccggagacgaagtcgtcggccaccgttggtcggacgcgaccgaggccggtggcgccgcccagttcggtggtgccgaagagagaaatgatggcgaaaaaagttgcattagggtttcggttaagcgaagtagtgctgtgtctgatttcgttttcggttatggccgcggacaaaactcgtggttggagcggtgattcttttgatcgctacaaggaatacaggtattgtttgtctgtgaatgtaatcgcatttgtatacgctgcgtttcaagcgtgtgatctggcgtatcaggttttggcgtatcttttggtatcggctgcatcatctgctgctacacgcgttgatgactggcaatcgaattggggaaaagatgatttcacagagatggcgagtgcttcaattgcgttgacctttcttgcttttgttgcctttgctattagctcgttaatctctggctacaacctctgcactctgttctcatag

SEQ ID NO: 94117 - DNA, 600 bp, Glycine max
  Peptide Sequence Number=SeqID_210895
atgaaaaacacaaacactaatactagtggttcaccaaaacttgatcgcaaaactattgaaaggaaccgcaggattcacatgaaatctctctgcttcaagcttgtttccactattccttccaattacctcaaaacctccaaggacatgctttcccagcaggatcagcttcatctagcagccacgtacataaagcatctgagagaaagaatagagaaattgaagggggagaaggagaaagccatgaacatgatgatgatgtcaaaccaaagcaataataggattttcaatactggctctgagttgcctctacttgaaataaaggacttgggttcgggcattgaagtgatgttgataagtgggttgaataagaacttcatgctctatgaagtaattagtgtccttgaggaagagggtgctgaagttgtcgctgccaacttctccaccgttgctgataagatctttttacacgtttcatgctcaggtacgatgacatttccacatatatgtatgtatgttaaaatatcaagagttggtgttgagccagcgagggtataccaaaggcttcaggagttgattgcaccacttgaaagctgggaataa

SEQ ID NO: 94118 - DNA, 780 bp, Glycine max
  Peptide Sequence Number=SeqID_210896
atggctaaaggaattggcaaggtggccataagaaaagtagatgggagcaaggtgactatcagtgatgtcctatatgttcctaacatggaaaacaatctgctaagcttgggacatttgctagagaaaggattctcaattcacatggaaggtgaacacatggaagtagtttattctaatgggacatgtgtcttgaaagttgttgtgtataagaacagaacattcaagctgggtgtgagcaccattgagcagaagtgcttgactgttcaaagcaatgacaatgtgtggaagtggcatagaagacttggacatttgaacttcaacagcctaaataagctgcaaaagaagaacatggttgtgggactaccttcaattgaagtaccaaggcaagtgtgtggtagatgctgcgaaggaaaacaaccaagtaagacttacaatgcagtagttccaactagggccaaagagaagcttgcagtgattcactctgatgtgtgtggcctatttgaaatcaaatctcatagaggaggagagtacacttcacttgaatttgagaatttttgcaaggaagaaggaataattcacgaggtaatggctccatacactcctcaacacaatggaactactgagagaaggaatagaacactgctaaatatggttagatgcatgttgagagagaagtatcttccacatgatttctgggcagaggcagtatccactgctgctcacatcttgaatagatgtcctacaaagaggcttaacaattttacaccagaagaagcttga

SEQ ID NO: 94119 - DNA, 1287 bp, Glycine max
  Peptide Sequence Number=SeqID_210897
atgccggttgttgccgcaaaaataaaattcaacgaacaagcgcgttacacaccggaactaaccgagcttgaagaaaatggagagaccgaagcatgtgtccttaagcggcgagttctcgtccttgctgaggaacaggaagttctctggcttgagatccctgtgcatcactcccatggtgtggcaatcgtggaccaccgtcacaatctggcggcacaggttggcggcggcatgctcggggtaatggcccttggcgatgatccggtcgaaaagctcaccgctgccgcagagctccatgatgttgcggtgaccggtgaggtggtgcatgatctttcacctctcaccgaacatcctccaagttgtcgtgggtcacaagagagtgtcacggccctgttcgttggaaatcctaagcacaagagacgtatggcgatgttgaagaacaacaaccaaatcccagcgaagctaccaatcttcgatggaaccaactatgagaggtggacgacgcaaatgaaggcacacaaggcaacccatcgtgaacagatgaagaaagatgataaagcaatcttcctaattcatcaatgtgtggattcaaatgtcctggagaaaatcactgactatgagacgaccaaagaagcatgggatgtgttggctacaacttatgccagtgacaagcaaaccaagaaggtgagattgatggcactccggtgtcaactgggtttgcttcaaatggaatcaaacgaaaaggtggcgcaattcataaacaggttagtgattcttgcaaaccaaatgaagagttgtggtgaggtggtgatcgattcgatgaaggtggaaaaggtactcaccggtttaacaccaaactttgatcatgctgtctctgtaattgaacaatcaaaggacctagaaacgttgaaattggagcaattactgggttctttggaagcacacgagttaaagatgaagaacagagaagatattaagaaaaaggagaaggattccaagaaaaataagaaagggaaaggcaagtggaagtataacaaacaagaaaacaatggttctaaaagtgagaatcaaaagaaagaaagagaaaacaatggaaagggaaagaagaaatcaaaggagcacattcagtgctataactatcaaaagtatggtcattatgcagatgagtgtagtaatcctaaagtgcctagaaagaggggtgaagaagcacaactcgtgcgtgactctgttgatgaagaagaaatgttaatggccattgttaacagtgaaacacacaatgaggaatggtga

SEQ ID NO: 94120 - DNA, 438 bp, Glycine max
  Peptide Sequence Number=SeqID_210898
atgagatttttcctctgccttcatctcaccactctccaatcttccattctcccctcttttctccaattgcactgcaccgaatttctcgaccttcacttcggtttcaccaatttgattgccgctttcttcgagtattcttcggtgtggaaggaatctctatggtctgagttggatcagtttctccgggatgaggatgatgtaaatactgtatctactccttataaggctgctattcctgaatatccagtggttattcatgattccaccgtcacatcttgcaatgataatcacttaaatgtggcaaatggtaatgttgtgtttgatattcaccatccttgcaaggttaatattgccgctcaaagagaacttcacaaacctgagtttgatcgttcttgcatacatttggagtttgacatatccgggactggcataatgtaa

SEQ ID NO: 94121 - DNA, 960 bp, Glycine max
  Peptide Sequence Number=SeqID_210899
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattggagaattagccacaggactcaccatcagaaccatggccatgttgagaaggatgaatcatgggttccgtggagcagaagccctggaaaagaaggctctcatttcaacccttacagcaacttgttctctcctggtgagagaagagatgtgctaacttcaactctgtgttggggcatcatgctttctgtgcttctctatctttccctcacaatgggtccactttttatgctcaagctctatggggttccctatttgatcttcgtcatgtggctggatttcgtcacgtacttgcatcatcatggttacaagcagaaactgccttggtaccgtggccaggaatggagttatctaaggggtggtcttacaacagtagatcgcgactatggttggatcaacaacattcaccatgacattggcacccatgttatccatcaccttttccctcaaattccacattatcatttaatcgaagcgactaaagcagcaaaggcagtgctaggaaagtattatcgtgagcctcagaaatctgggccattgccacttcatctaataaagtacttgctccacagcataagtcaggatcacttcgttagcgactctggcgacattgtgtactaccagactgattcccagctccacaaagattcttggacccagtccaactaa

SEQ ID NO: 94122 - DNA, 159 bp, Glycine max
  Peptide Sequence Number=SeqID_210900
atgtgtaagtgggggagaaagagaaacgagggggtgttgggagaggagggagtgtgcgacgcaaaggttgtggtcttgtcgtgcgagtctgaagtgagagaacactgcgcgataagcggcgcgcgacatcaacggggtggcgacgcctgtaaaacttaa

SEQ ID NO: 94123 - DNA, 297 bp, Glycine max
  Peptide Sequence Number=SeqID_210901
atggaggttgggaagaagggtggtgaagtgaatgatgttgattttgaatctccggaagctaaaaaacaagttcgtggttctacatctacaaaaagatctcatgccgcagaagtccataatctctccgagagggtgaggagagtttcatattgtatttccctgcagaggcgtcgagatagaattaatgagaagatgaaagctttgcaagaacttatacctcggtgcaacaagtctggcaaagcttcaatgctggatgaaccaattgagtacttgaagtcactgcaattacaagtgcag

SEQ ID NO: 94124 - DNA, 2481 bp, Glycine max
  Peptide Sequence Number=SeqID_210902
atgagtgattcatcagaagaccctttgacaccctcgcctgagaatacccatgtccaaactatgagccttggatcagaacctgcagccatcccctacagtgtgaagcttaatggtgaaaaactccagaaccccttacatggcagatggagtatggagaatgctattgtgaaagattggctcattggtactatggaacctgatttgatgaatcggtatacttattatgaaggggctgacaggtcagttatttatgacttatctcgacgagtaatgcaaatgaggcaagatggtaggcctatttccacatattatgctgacttgcgtgcaatatggcaagaattagacaatcgcaagccaataacattttctcagcctgatgtcatgcaagctcgacaaaaggaaattgatgaagaacgtgtttacatctttttagttggtctgtacgacttgtatgatggtgttccaagtgatattctttgtacggaaccttttcccaatccagagaatgcatttgctgttgtcaggagtgaggagcaaaggagaaatactatgctgcatagtcaaatgactcctagcgtggcaatggcaactaaaactgctctaactcagaatcgatcctcctttccttctaaaaatcaaggtggtagtgagagtggttttagtcattctcgtaatcctaaacatgctgctgtagataactgcttcaagctctctggatatccagattggtgggataatcttaatgaacgaaaatctctaacaactatccctactggttccaactcaggtttacaacaaaatactcaatcttcatgtaatgttggacttgctcttatgagtactgatactatcaaggacaccggatggattattgatttaggtgctactgatcacatgacattgatcaatctctcttgcgtactacaagatctcagcagcaaagagattattgggcgtggtactaagaggaggggactctattatgtggatgatatctgcttcggcaatgcgttaactagtcaaagctctacatgtgccaagaaacatcaaatttggatgtggcatcgtggctttggtcatgggtcttttggttatattaagcatttgtttccatctttatttttggattgtagcctttcggattttcattgtgatgtatatacgctggctaaaagccatcgtgcaaactacccaagttttaataagtcaactgagccttttactttgatgcattctgatatatggggtcctccacctgaccctaccttatctggatgttgttggtttgtgatgactaatagaagtgatgtgtatgaatgcttctgctcttttcataagatgatactaacacagttttctaccgaggtgaaagttcttaggtctgataatggccgtgagaaaaatcagcatatccttgggattacacgtgcgtgtctgattgatgctcatatgtcatctacatctcagggagatgctattctgtatgcagtttaccttatgaatcgagtacccatttttggttgtgttgcgtttgttcaccttcataaacatcaacggttcaagcttgatccttgtgccttaagatgtgtgtttgttgggtatcttcctcataagaagggttacaagttctatcatccacctactaagcagttttatgtgactatggatgttactttatctgaaacagaaatgtttttctcatcaccctcatccacttctactcttcagggggagacatactctaaagagatgaatttgatggttgtccttcccgacgttgtcatgactagtaaaaatccttccaatatgggcacaggttctgcccaagagttatctgctcatataggttctgcacctcaatgtgataccaccagctcattggcacctcagagtcccacaagatccccttctacttctattgtacccaccaatgattccattgttgctgatgtccctgagaacacgtatcaactacctcctcgtagcaatcgaggaaaaccaccaaatggcaaacatgaatcagccttggagcatcttgttttggccagcatggcaatggtagcaaatgcccaagacgtggaagtagcatctgttgattgcaacattggagacacaaacttatccttggctagatatgatgaggccatctttgcatatgagagagctttgacagtttacaagactcacaaaggtgagaatcatccttcggtgggatcagtctatgtaagcctcgccgacttgcattgcaggacatggaaggtaagggaatcaaaatcatattgtgagagtgcacttaaaatctatgagaatcccatgcttggagtccctccagaggaggttgctagtggttttatgaatgtctcggccatttatgagtcaatgaatgagctagaacaaacacttaagttgcttcacaaggcactagagatacttaatgaaggctctggtcagcaaaacacaatagcaggaattgaagcatag

SEQ ID NO: 94125 - DNA, 983 bp, Glycine max
  Peptide Sequence Number=SeqID_210903
atggagggttcccgtctgaccatcgaagggataacaacaggacagcgtcaatcctacatgcgagcgaattggagagaccataaggacgtcatttctttctattttacgaggatccctgaagatgcaacagtagaagagttatggttccattttaaacagaaaggagatgtgcgagaggttttcataccccagaaaagaaacaaccaaggaaggagatatggtttcgtgaggtataagggggtgagagatatgcatcagcttcaacagcaattggacaacatggtgttcggaggattgaagatgaatgttaatgtttccaaatatgggagagcaaagaagggagagccacaaacagtagagaggggaagagcagagaccagacaaccacaaaaggggagaagagaaatgtacctgagcaggatatcaggaacgaagatgggagtccagcgacagtcgtatgcggaggtggtcaatcggaataccccaacaccagcacaaaggagaataccaaccaaactcgaatatacaagttccaattccacatctgaatggctcaaggaggcctgggtgggtagactgaaaaacctagcaggttttgataggatagaagatggcatatggtgggatggcggacaaaacatatcaccaaagtacatcggtgatgatatgatcttgttactggccctcacaaaagagaaagcggagagaatgttcaacgaagaagatgaaggatggggcgatttgttctactcaatagagaagtggaatccaaatctacaccctggctttagactgacttggctccaatgttggggaatacctttgatagtcgcgggtataggtgagctggtggatgctgatgagagtatagaggaacaaaggaggtttgacgctaatcaaaacgtcatggaaaccgctgatccaacacacggtaaatgtccagatacagggagagactttttcggtgcacataacgaaggaga

SEQ ID NO: 94126 - DNA, 1731 bp, Glycine max
  Peptide Sequence Number=SeqID_210904
atggctctcaatatctcttctcctgctgaagtcaagtccatttttttcgctgattacttcaagtctaactgcatcactgcaaagttcacaggtggttttgcttttaagagaaaagagcgtggagctgcatctggagggcgagtttgttgctcagtgctggcaccaccaccaccggcctggccgggacgagcggttccagagcaaggcagcaagacttgggatggaccaaaacccatttcaattgttgggtgtactggttcaattggaactcagacactagatattgtggcagagaatccagataagtttaaagttgtggcacttgcagctggttcaaatgttactcttcttgcagaccaggtaaaaagatttaagcctcaacttgttgctgttagaaatgagtccctaattgctgaacttaaagaggccttgcatgacgttgaagaaaaacctgagatcatccctggagagcagggaatcattgaggttgctcgtcacccagatgcagtcagtgtagtcacaggaatagtaggctgtgcaggactgaagccaacagttgctgcgatagaagcagggaaatacatagctttagccaacaaagagacattgattgctggaggtccttttgttcttcctcttgctcagaagcataatgtaaaaatacttccagctgattcagaacattctgccatctttcagtgtatccaggggttgccagagggtgcacttaggagagttattttaactgcatctggaggtgctttcagggattggccagttgataaactgaaagatgttaaagttgctgatgcattaaaacatcctaactggaatatggggaaaaagataactgtggactctgctaccctttttaataagggtctagaagtaattgaagcacattacttgtttggagctgactatgatcatattgagattgtcattcatccacaatcaatcatacattcaatgattgaaacacaggattcatctgttcttgcacagttggggtggcctgatatgcgtttgccaatcctctatacattatcatggcctgacaggatttattgttctgaagacacttggccctgccttgatctttgcaagattggttcacttacatttaaaactccagataatgtaaagtatccatccatgaatcttgcctatgctgctggccgtgctggaggcacaatgacaggagttcttagtgcagcaaatgagaaagctgtagagatgtttattgatgaaaagattagctatttggatatattcaaagttgtggagctaacattgaataggagcctaggaggttggttgcctatgaatgtgtcaaagtcaagaagggggcattcctcagacttggagatagaaacggacttggtggttgctctcttgtttaggacctggttctccactttgccactcgtcagtctttcctttcgttctgctctcacccagtgttgtgccttcattttgctcgaagaaaaacagagtgagcataatggacttgcgccacagcgccgcggtcgccgatctgttagttgtcacaacgtggcagccacaatcagcttcccactttctcgcacaaaatcaatgaccttgagggtcttgctacagaatgaattagagtccttaggagatcacattttcctcatcgcgggatctagtttggtggtggtgatgttggaatttgatgagcgtttacaaatcgaggagaggatccgatga

SEQ ID NO: 94127 - DNA, 1143 bp, Glycine max
  Peptide Sequence Number=SeqID_210905
atggacccaccaattcaccatccacttgggaaacgccctgccgccgaggacgattccgtaatttccgattgcgagagcggggtttccgggggcgacacggcggctggctttgtgccggccgacgaaaacgccgacctcgtccggaccagattcgttcgtggcctggccgcgcacgggttgaaacccgaggttttggcggttggcagaaacgcgtgttcctccgttatggcgcaagcgcgtcaacattcctttcacgtttttgcacgtgccgtggccaaattgcgcgacggcaatgccaacgtcaagttcgcctggtacggtgcgtccagtaaggaagagataagcgacatcgttcagaatggttttttcggtcacgctcacggtaacggcctgcgtctctttccacaagattctccacttgaaagtgtgaagagttctgttgtggacaaagacggtttgaggcacttgttgctgtgtcgcgttatcttggggaagacagagttggtgccacgtgactccaatcaatgccgttcgagttctgaggagtttgattctggtgtggacgatctttccaatccaaaggagtatgttatttggtgtaaccagatcaacactcatgttttgcccgaatatgttttgagtttcagatttccttcaccattgaaagggcatgtgaagattggggaacctttgaggccttcttcgccgtggatggcattcccagctttgatttcggtgctttcgaagattttacctccccctgacattgcctacattgccaagttccacaaggattatagagaaaagaggatttctcgacatgagctgatacagaaagtgagagttatagctggcgacaaattgctattttccgtcatcaaatctttcagagccaaggaagttacaaacatcgtgcatacttgtcttgttttagatcaaaatcaatgtcttgcattatgctttctgaatgcttttgaaattgctgagcattcactaagtacctattatttctttttaaactacgggtgtaaaatacctgcaagctttaaagcaaacaaggggaatgaatggcaggcggaaagccagcagctcgaacggtatgattgttcatatgggagttctattaactattacaggaagtga

SEQ ID NO: 94128 - DNA, 531 bp, Glycine max
  misc_feature (518)..(518): n is a, c, g, or t
  Peptide Sequence Number=SeqID_210906
atgtctgctcacctcaccccatctttttcttccttcttattcactgtcacttctcaagcaacactcacattgtcgcataacacaacacaatatagtaatattccactccctcaacgtaacaaacttgtttatcacaagaggagaagtgataaattcccagctgctggtttgtcaatgggtttttcctctctccacgtctgcatggactcatcaaatcactggatgcagggaataattcacgaggagtgtggtggggtggattcttcttcaccctctggcgacatgcttccatgctcgaggccaatgacagagagaaggctaagacccccgcaagagcaatccctcaagtgccctaggtgtgaatcaacacacaccaagttctgctactacaacaactacagcctcactcagcccaggtacttctgcaagacatgtagaaggtactggaccaaaggaggcactcttaggaacattcctgttggtggtggttgcagaaagaacaagaaagtttctactanagaaaatcattaa

SEQ ID NO: 94129 - DNA, 1115 bp, Glycine max
  Peptide Sequence Number=SeqID_210907
atgcaatcatcaaaacttggcaagaggtggaaggagtaccatggcatgagcaattgggacggtttgctagacccattagacgacaacttacgtgctgaaatcctaagatacggtcatttcgtggaaaccgtttacaaatccttcgagtttgacccttcttcacccaactatgcaaactcgaggttccccagaaaagatcttttagaacggtgtggtttacataacactggctacaaggtaaccaaatacctacgtgcaacctcgggtattcagctacctagttgggtggacaaagcaccaacatgggtggcaaaacaaacgagctatgttggatacgtagcggtgtgtcatgacaaggaagagatcaaaaggcttggtcggcgcgatgttgtggtggcatatagaggaaccaccacatgcttggaatggttagagaattttcgtgcatctctcaccaacctccctattccatgcaacaccaaaagggcctttgaaaaaaatggggtcatggacagaagtggggccatggtggaaagcgggttcttgagtctctacacctcatcacttcccagaaagacgtttaggtctttacaagaaatggtgaggcgagagatttcaaggatcctcgagacctaccggggggaacaattgagtctgaccgtcaccggtcatagtcttggggcagcattagccacgctcacggcctatgatgtcaagaccgctttccctggactgccggtgacggtcatctcctttggtgggccccgcgttggggacccgaggttccggaggatgcttgagaggcaagggaccaaggtcttgcggatagtgaactccgacgatgtcatcaccaaggttccggggtttgtgtttgatgatggcttggccagcgatggaggggtccacgtgccgggatttccgagatggatacagaagagggtggaggaggcacagttagtgtatgcggaggttgggagggaactacgcttatgtagcaaggattctccgtacctaggaaacacgaatgttgccacgtgtcacgagctgaacacgtatctgcacctcgttgatggctttgtcagctccacgtgtcccttcagagcctccgcaaagag

SEQ ID NO: 94130 - DNA, 262 bp, Glycine max
  Peptide Sequence Number=SeqID_210908
gagagggcatagagacaatgaaaaaatattgagtctttggttcaacgatcaagctgctaaaatcatgaaaggagtctttgtgctttcttcaagaattgacaaaccattttgtaagtacgatggtttcactacacgaaagtgtgtagcgaaggtttacatcaatattgtggacttatcattggttgaaagtgtgaggattccatacatgaaaaatttacctccatattacattttggatgcatgtggttcggtgtgcatttga

SEQ ID NO: 94131 - DNA, 270 bp, Glycine max
  Peptide Sequence Number=SeqID_210909
atgggtggctccgtgatttcttatgggcacaggcatcccagtttaatgtttctattcagcgggcgtggttattggcaagaacttattgaatccattgtttgggctcataataaattaaaagttgctcctgctactcagcctagagccttgagcattgtacaaaggacgtgctgtaggagtaacacattaccttctaggtggaattgccacaacatgggcattcttcttagcaagaattattgcagtaggataatagctaggaggatttga

SEQ ID NO: 94132 - DNA, 516 bp, Glycine max
  Peptide Sequence Number=SeqID_210910
atgtgcatcaccctgtgcttgcctaggcgtgcagtacttctcgatgaaggcccggctggtcgacggtcagattactttactggggctgacgggaactccgtaggactgacagaggcccgtgatcagcgccggaaaccccagggccctgttggacttatctgggtccagagggtgcctggtaggcgccatacttgcaaacaaataaatggcgtcagcaatcacctgggccacgtggacggtcatccgtgtcaggatgacatacaccaactggcacttaggcagagggagatcggagttgtgatcgctaggcaagacattgctaagcagcagtgtcatccatgtctaggtcaaagtggtcatgctggtgcgcatgatccgcacccgcctccctgtagcggtccgggcgccatcttgccccggtgtgcacaacagctggacaatggcttccttattgaacccgtcgaccgtgttcctcctctggctgaactcacactgctggccttccttcaaaactag

SEQ ID NO: 94133 - DNA, 294 bp, Glycine max
  Peptide Sequence Number=SeqID_210911
atggcagaggatcactctaagcgagggaaactatgggcaaagttgattaagagaatggcagaggaaagcgagggaccagtagaggaaagagagatcatacatgtttggttctctaatttggatctctggttcgctggtgatggctgcccaacgaggactcgaggagacagagtgaaagagaggagccactcttgtccccaatacgtccctgccaaggccagccgtacccaagaaattgacaccttccttgggacattcccttaccatcccaattctatccccatccccatgtag

SEQ ID NO: 94134 - DNA, 1335 bp, Glycine max
  Peptide Sequence Number=SeqID_210912
atgaagaagctctcatcaacttcttctcatgcatccccatcttctttatccaccacaagtttggacccaactatgtgcacctccaaaagcaccacttcagggtgtctcactgctatcttgcgcaaaattctttgctctgatggccttccaagggaccaaattagagaacttgattcatcaaatgctatgttgagtggcaaagatcaaaacttgaaggctaagcagaatactgagatcgatactactactactactacttctgctactagtattattactactactactactcctgggatagtggcgaggttaatgggtttggaaacaattgagataccttgtggatcaaaaccaaattcactttcgcgtagcagatccatgaattctgtggactatttgggagtatgcaatggaatggaggaggttctgcataagagggttaagtccacattgtcttttagggaggctccaacttttcttctacatgaaagtgacaagtttttggagctaaattttgaaggtgaaggtggtgagggtagagaattcaagtccaatgggagaaagagggaaccgggttgtgcagaattgaagcagaaagtgcgatcagagagaggtgagttgagggaaaacaaaagagaaaaagtgtgtgatgagaaggttttgattgagaaggggaaacttggaaaaaaaagggtctctgatgtgtctagtgggagtgttggaagtggtggtaagcttcaagaaatcaccaacactttgcatccttccaaggcttcttctgaaaagaagaagtgttttgatgattatgaagcagtgaaattgtctcagaacatgaagtgcaaggaagttgcggttggtgaaaagcagaagaggaggaggaaaaagaagaaaacaatttgtcagaaagaaaacaagatagaagttgaaaccaagtcagaagattcaagcccagtttctgtccttgattttgagcgtgaagcttgtgcaacagttggtttgagtgcaagaagaaaattgtcaccaaagcttgacaatgatcagcaccttcctgtgagatctgatggtaacttgatgattgatgatgagagtaaggttgaggcaattgacaacaacaaacatgaagggtcaaagaaaaaagagatgaatggccaggagtatatagatatttgggttgaagtttgcagaatagttgaagatgaattggctgaatcaaataagatacatatatggaccaataaacaaggtgatttaggtagcataagtgcggattttgagtcagaaatatttgatcacttgctaaatgagcttgtggatcaacttgctggcatccactga

SEQ ID NO: 94135 - DNA, 249 bp, Glycine max
  Peptide Sequence Number=SeqID_210913
atgtgttgtgtctgtacctccgtgccatcatgcaccaccttcttgcatcaacctagggtcgccacatggaacggtagggaaggtacaaacgacaatgattttggtgtagtcggtgatgatttgacagtcgtcgggaagggggagaacgtgcagactttcttttcgtcgtcattgaagtcgttggtttggatgagggtgccattaggtgcttgggcggcacatggaagagggagggacaggcggtgttaa

SEQ ID NO: 94136 - DNA, 1527 bp, Glycine max
  Peptide Sequence Number=SeqID_210914
atgggggatgagtatggaagacaagaagggttgcatcatgaaatttctgctttgctcgagttttcggccgccgatgatgtaagggctttcagagatgctgttgaaaaagagggtcgtgattttgatgaggtggggttgtggtatggaaggagggttggctcaaaggtattgtgttttgaagagaggacccctcttatgattgcggccatgtttggaagcaaaagtgtgttatcttatattcttgggacgggtcttgttgatgttaaccgggctagtgggtcagatggggctactgcccttcattgtgctgtcgctgggggttcttctgcctcccttgaaatcatcaagcttttgctcgatgcatcggcagatgttagtactgttgatgccaatgggaacaggtcgtgcgacttgattttctcggtgtctaatggtgtattcaattcaagaaagaggatactacaagccatactagaaggtgcagatggtattgatgaggcttgccttccatttgaggaagcggttggccaaatggagaaacagcaacagcaagatgtagatgcatttcaggtttccaaagatgggactgagaagaaagattatccggttgacctctctcttccagacataaaaaatgggatatatagctcagatgagtttaggatgtatacattcaaagtgaggccttgttcaagagcttattctcacgattggactgagtgcccctttgttcatcctggggaaaatgcaaggcgccgtgatccaaggagatatcaatatagctgtgtcccttgccccgagtttcgaaagggatcctgcagcaagggggatgcctgtgattatgcacatggtatttttgagtgctggcttcaccctgcgcaatataaaacacggctttgcaaggagacaggatgcaccagaagagtttgtttctttgctcacaatgtggaggatctccgccccgtgtatgcttccactggttctgctatgccttcgcccagatcatattctgttagtactccttcgttggaccctttcacactgggttctccatcttccttgataccacctgcctcaaccccacctttgactccatccagaggttcttctcctgcgggtgaaaccatgtggcactctcagtctcatgctacagttcctacccttcagctgccccaaagcagattgaaatctgcactaaatgctagagatgttgaattggatatggaattgcttggaattgaaaatcatagacttttgatgcagcagcacctaatgatggaggggatggctggtctttcatcaccttctaactggaataactccatgcctaatagtccatcagttggtgattataccggggagttcaataggcttgcaggagtgcaacctactaacctcgacgacatttttgggtctcagatacagtatccagccagaattcaagtgcatcaaaatgtgaatcagcaactgagaggctatccttccaacccttacaattcaagtgtgattggatcaccctcattcagg

SEQ ID NO: 94137 - DNA, 1741 bp, Glycine max
  Peptide Sequence Number=SeqID_210915
gttccaagctacttcccacgaggggtttcaatttggtccaggaagtagcagcaaaggtccactccatagtgaaatccaatatcctaatcaaatttcctacatgtctaaagtgtcacagagtgcatttccatttaaacagatattaccagtttcagtaccttttgacactgttagtatcactgatgaagcagaccacataccaaaagtttcaaagagtcatatgcatggtacttggatttctccttcccctaaggccaatatgagccttcttgatcccacaacatcttcttccctgactcctgtgaccacagatttgggattgggaacaatatacacatcagctgctcatgagccagacacaccaaaactaagtgatcataagaagcctcttcatcacttgtcagactccctttcaaccgattttgatgctatgaatgagagtacttcacaccaaatcgctagatcttcttcctgttctggtccaaatctagaagggagatttgaaactgtagatttcaagtcattttaccatcttctcactgaaaaggttggctggcaggatgaggccatatatgctatcaatcgaactgtgtcccgttgtagatcctgcgctggaaagcgtagtagtggctcacatgttagagcagacatatggcttgcatttctcggaccagatagacttggaaaaagaaaagttgcatcagcacttgctgagattttatttggaaacaaacaaagcctaatcactgtggatttgagctcccaagacaggtcttatccaacaaactcgatttttgaattccaaaatacatattgtcatgatgtgcttatgaggaagacagtgttggactatgttgctggggagttaagtaaaaagccacattcagttgtctttcttgaaaatgtagatcaagctgatttcctggtgcagaatagtttgttccaagcaataaaaacaggtaaattcccatactcacatggaagggaaatcagcatcaacaatgcaatgttcattgtaacctctagtgtgtttaaaggtagtggctcttttagtttggagggggatcctaaaatgtttccagaggaaagaatcctagaagctaaaagatgtcaaatgcaattatcacttggacatgcttctgaggatgccaaaaggagcggttgcacaaatgtgaaggttgcacagagaaaagggacctccaaaacaacatttctgaataaaagaaagctaatagaaagtggtgattccaaagagaaagcatcatgcaaaacattgaaacaggtcggggaggcatcgaggtcctatctggatctgaacatgcctcttgaggaggttgaagagggcaacaattacaatgattatgaaagtgacgcctggttaaatgatttgtgtgatcaagttgatgaaaaagttgtttttaagccattcaactttgattctattgctgagaaagtaataaaaagcattgacacgcaatttcaaaagatgttaggatcagagtttatacttgaaattgagtatgaggtcatgacacagatacttgcagctgcttggttatcagacaagaaaaaagcagtggaggattgggttgaacatgttcttggcagaagcttagctgaagctcatcagaagtaccgctttgtacctgaatttgtgatgaaactggttaactgtgaaagaatttttttggaagaacaatctcctggagtatgccttccagctagaattaacttgaactga

SEQ ID NO: 94138 - DNA, 625 bp, Glycine max
  Peptide Sequence Number=SeqID_210916
atgccgacgccggttagcaccgcgaggcaatgcctgacggatgaggcggcgcgtgctctcgacgacgccgtctccgtcgcccgccgccgcagtcacgcccagaccacctccctccacgccgtctccgccctcctctccctcccctctgcctccctccgcgacgcctgctcccgctgccgcagctgctcctactccccccgcctccagctccgcgccctggaactctccgtcggcgtctccctggaccgcctccccaccaccaaatcctccggcggcggcggcggtggcgaagaaggccctcccgtctcaaactccctcatggccgccatcaagcgctcccaagccaaccagcggcggcaccccgacagcttccacctgatgcagatgatgcagcagcaacagcaaacgacgtcgttgctcaaagtcgaactcaaacacttcattctctctatcctcgacgaccctatagtgagtcgcgtcttcgccgaagccggtttccgaagctacgacatcaagctcgccctcctccaaccccctcccccaccctccagaatcttctctcgcctaaccccaccggttttcctctgcaacctcgaaccggttcaaaccggttccttccaacccg

SEQ ID NO: 94139 - DNA, 219 bp, Glycine max
  Peptide Sequence Number=SeqID_210917
ccaaaccctaagctgttgtcccttgaatggcaagatcatcagggttgctctggtgctgaaaaagtgtcattgggatatcttgatggatcaggatacatgatcaaaggtggtgataagctctctccaggcttgggtttgggttcattatgcttccttaactattcatttgctaactccttgtacgtgagaaatttgagtaatatcttccatggaacctaa

SEQ ID NO: 94140 - DNA, 768 bp, Glycine max
  Peptide Sequence Number=SeqID_210918
atggatgagatcttggaggactctagatgtaactgggaaaatgaggcatcacttgctgtcctacctgatttgttgatggagcttgatagcatggatgaggaaacaagactacttactctcattgaaggtgttcttgctgcaaacatttttgattggggatctcgtgcatgtgtggatctctatcataaaggaactattattgaaatttacagaatgagtcgcaacaaaatgcagagaccttggcgtgtggatgattttgatgcctttaaacaaagaatgttaggaactggggacaagaaaccacccccacatagaagagctttactttttgtggacaatgcaggtgctgacattgttcttgggatgcttcccctggcacgagagctcctccgccgtggaactgaagtggtcctggttgcaaactcccttcctgctttgaatgatgtgaccgcaatggagctccctgacattgttgctgaggctgccaagcactgtgacattcttaggcgagctgctgaatctggtggcttgctggtggatgcaatgactaataccttggacagtcctagagaaaattcttcttctgttcccttgatggttgttgagaatgggtgtggtagtccatgtatagacttgagacaggtcagctctgagctggctgctgctgcaaaagatgctgatttgataattttggaagggatgggtagagctcttcataccaacctcaatgcccgatttcagtgtgatgctttgaaggtggattcttga

SEQ ID NO: 94141 - DNA, 318 bp, Glycine max
  Peptide Sequence Number=SeqID_210919
atggcacgggttgggtgttcacctgggattgcagagagtgaagcggaaagtgaggttgttggtttggggcggagggagagtgtgcgaagagagagtgagagagatgtgagagcggacattccgtatcggaagggcgaaaaccctttgcagttgggaagggtttacaagttggaaggagctccacctcgaaatcgaagcagtagcgtagcgggaaatggagttttgttcactcacgccttcggaaatatctttttatcgacttctctattatggaacgtgcgttgcactcgtgtgccaagatcccttatcccttattag

SEQ ID NO: 94142 - DNA, 188 bp, Glycine max
  Peptide Sequence Number=SeqID_210920
atgttaaccctgtgcgttataacccaaagatagaaattaagttgcctcacggatggtggttggtcctcaaggtcaacaacacctcaagatggatgtccaatacgatcgtattcttgtgttttgcttgtttcatgacttctatgtcacgacaattaagagaaatcgcaaggaaaaaacttgaaaagtaa

SEQ ID NO: 94143 - DNA, 150 bp, Glycine max
  Peptide Sequence Number=SeqID_210921
atgggtccaattattctagcccaacataaatacgaacgaagcgtcgagtataggaggcggaggaggctgctcttcgcgacgaaggcaaggcaagcggtaatgtcaaagatgggcatggcggtggtggacggaagtggtggaatgttgtag

SEQ ID NO: 94144 - DNA, 354 bp, Glycine max
  Peptide Sequence Number=SeqID_210922
atgcagttcccttattatcaattcgtggatcgcgactctatgtataaagttggatctttgttttatgccatctactttattgtgagcttcccaatgtttttaaggatagatgagaaacctggcgataaatgggacttgcctagagtggctgttgatgctttgggagctgcaatgctggtcacaataatacttgatttgtggcgcatctttctgggacctattgttccgatagcagacacaaaacagtgtcctcaagctgtagacaaggcaggatatactgtattcattgcgggtatggagattcatgtcattgaaaaagatagctttgtggtggtggacttcgtgatttgttaa

SEQ ID NO: 94145 - DNA, 186 bp, Glycine max
  Peptide Sequence Number=SeqID_210923
atggaatctgggcataatatatcaggaaaggatcaccgtgttcattgttccataaatatcaacacagagactggacgtttgtcagcaagaaggccaaatctgcagtttttagcacaaagtatatggttgacctgtgcatcgtccatgcttcaagctcaaaggacttactatgacaagccaagttaa

SEQ ID NO: 94146 - DNA, 531 bp, Glycine max
  Peptide Sequence Number=SeqID_210924
atggtgtgttctcctataaggttgattcaaacttggtggcgtgcgactctgactggtggacgtggcagcggtgcgcgtttgaggcttgatggtcagtggcgggctcatctgggtggtgatggtgaaacagatctgaagaaggatggagatggtggctgcgaagggaataacaatgccgagacaaagggtgagccagaagggggtgtagagaaggaagaagagttcgccccatcttttgctggggtttggagccagccacaggctggaagaagtcaccattcagtggatggctctgatgatggtaattggttagatatcaagcttgggtgggatgggacagtggaagatcacagacaacagtacaccacaacaggctcagtgactttgaaactctacaaaggttcggctgctgtggtggggaggaaaagcccctatgccctctatagggaagacatttcatcgtttgagagtggggagatatatgatcatgctgatgctttggctttatcaagctttatgatcttccaatga

SEQ ID NO: 94147 - DNA, 2856 bp, Glycine max
  Peptide Sequence Number=SeqID_210925
atggcagaatcaaacagcagcaaatatgtgcaacctgcaatccctagatttgatggacattatgatcattgggcgaaactcatggagaattttcttcgctctaaggagtattggcatttggtagagcatgggatcttagttgttacaaataaaacatcagaagctgaactcaaggccatggaagaacaacaactaaaagacatgaagataaagaattatctttatcaagccatcgatcgtgaaattttagatactatccttaatgatgatacgtccaaagacatttgggactctatgaaacaaaaatttcaagggtctacaagggtgaaaagggcacaattgcaagctttgcgtcgagaatttgaaatgctgcaaatgaaggaagatgaaacagtgaattcatactttgcctgcaccttggaaattgctaaaagtatgaaggcgtgtggagaaagcatgcgagagaacattattgctgcaaaaatcttgcgatccatgattctgaaatttaactatgttaggagtgacaagcaccgtagattacgcatgaagataggggaggaagaggacgaggatgaggaaaaccaagaggaagaggtagatcaggaggatgaactcttgctaatggcttatcttgattttaagcaaggaatgacagaggaatggtttctcgactccgaatgcagcaaccgcatgagtggtaacaaagactggttctcggaattagatgaaaactttagacatgcagtaaaacttggcaatgacactcatatggttgtaacagggaaaggaagtgttcggttgaatgttaatggagtcacacgtgtaatctcacatgtgtactacattctagaactgaagaacaatttactaagcataggacaactccaagagaaaggcttgtctatactaattcagaataggaagtgtaaagtctctcatcctgaaagaggacagattctggaaatagaaatgaagggaaataagatgtttgtactaacagctaccaagccacccttgaattcaacatgttttcagatggaactagaggaagggtcacaactttggcacaaccgatttggtcacttaagctacagtggtttgaagacactttcctccaaacaaatggtgaatggactgcccactgtcacagttccaagacaaatctgcacacactatttggctgggaagcagcaccgaaagcctatgcctaagaaaagcctatggagagcatcaaacaaacttcaacttgtgcatgcggacatatgtagacctatcaatccaatatcaagcagcaacaagaggttcaaggtgctggttgaaaaagaagctagtgtaagcattggatgtttgaggacagatagaggaggagaattcacttcaaaagaatttggtgaattttgtaaaaaccatggcatacgtaggcagttgactgcagcctacacacctaagagaatggagttgctgagaagaagaacagaacgaagtcctataacagctatacaaaacaaaaatcccgaagaagcatggagtggaatgaagcccactgttgattactttcgagtatttgaatgtttggctcatgtccatataccagatcaacagcgagtaaaactggatgataaaagcaagaaatgtgttctccttagagatactctagagtggggagataatgaagagtatgtgagtggttccgaagagcagtctgaagaaaaagttgtggaaagtactgatacttatcctaatgactctcatattattaatcatgagactccggttgaaggaagggttataaggaataagagagaaccaaattggatgaaagattatgaaagaggagaaggactatcagctgataatggcctaaatgtaatgatggtcaccaaggatgacccaatctcatttgaggaagctattaagagagtaaagccaataggagtcaaatggatctttaaaaccaaatttaaagagactggagaaatacacaagttcaaagccaggttagtagctaaagggtatgtgcaacaatatggagtggattacacagaggtatttgccccgatggccaggcttgacacaatttgcttaatacttgctatagcagcacagtatagttggaatgtatttcagctagatgtgaagagtgtctttcttcaaggaaccaaagttgatgcaactctgttcaaacaagcagttggtagtcttatgtatttgactgcaactcggccagatttaatgtatggagtaagcttgatcagtaggtttatgtccagtcccactgaatctcactggtttgcagccaaaagaatactaaggtacttgaaaggaacaactgaactaggcatctactacaagaaaggggaaaacgcaaagatagtagcatattatgacagtgattttgcaggggatatagatgatagaagaagtacttctagatttgtatttttatttggctctggagcagtctcatggtcctcaaagaaacaaccagtagtcacattatccaccacagaagctgagtatatagccgctgcctattgtgcgtgtcaatgtatttggattcaaagggtgttagagaagctgagccttgaagaacagaagaacacactgattctatgtgacgacaattccacgataaaattatcaaagaatccagtgtttcatgggaggagcaaacatatagacattaaatttcattttttaagagacttagtgaaagaaggaacgatcaagttaagttactgtagctcacagactcaggttgttgatataatgactaagccactcaagttagagcaattctcaaagctacgaatgatgttaggcatgctggaagcttcagagataaactactaa

SEQ ID NO: 94148 - DNA, 1878 bp, Glycine max
  Peptide Sequence Number=SeqID_210926
atgagttgcagtgctcagttgcaatcttctcagacccaagtgcttctccagctgaaaaagcacttggagtacccaaaacagttggaaatatggagagatcgttggacagatctttgctctatttcttcttctgggcaagtgaatgtcacatgcaaggacaattttgtcactgagctcacaatcttgggtgataaaccaacaaagggtagagattttgatgggtttgccaatccaaatcaaacactatcagagagcttctccatggagtcttttgtggctactctggcaaggttaaccagccttagagtccttagtcttgtctctttgggcatgtggggaccactccctgatagaattcacagactctatgcacttgaacatttggacttgagttccaattatctttatggatcaatccctccaaagatttgcacaatggtgaaccttcaaactcttagattgggtgataacttctttaatggtaccatctcaagcttgttcagttcatcaaacaatctcacagttcttagtttgaagagtaacaggttgaagggtccatttccactttcaatccctagtgtcatcaccctaactgaaattgacatgtcatgcaatcaaatatcagggagattgcaagatttaactgatttgagtagcttggaacaactagatttaagggaaaacaggttagactctaaactacctgcaatgccaaaagggttgataagtcttttcctcagcagaaactctttctcaggtgaaattcccgagcactatggtcaactagataggcttcagaagcttgatgtttccttcaattcactcacaggcactgctcctgctgaacttttttctttgcctaacattagttacttgaatttggcatccaacatgttgaatggaccactccataatcacctaagatgtagcagtcaactcagatttgttgacatatcatacaatagattggtgggggacttgccttcctcactcagcactaaatcagaaaatagagttgttaagagtgatggaaactgtttatctgggagagtgtatttcccttggggggtgtcagagcagcacctattgcataaaacagttcaagatagcagctatgcagcaggaatctcctctgagcttctcacaaatgcaaggtatgtttctgaagccgcaaagttaggcagagaggacctccccacatgtcggtcatattccttggaagagctaaaggaagccacaaataactttgacaactccacttttatgggtgagaatatatatgggaagctttacagaggaaaattggagagtggaatacaggttgtaataaggtccctgcctttgtcaaaaaagtattcaattaggaatttcaaactgaggttggatttgcttgcaaagctgcgtcaccctcatttggtatccctcttagggcactgcatggatggtgctgtaggagagaataatgaggctaatgtcttcctcatttatgaatacgtgtcaaatgggacttttcagacttatctctctggagatagtccaggcaaggttttcaattggtcagagcgattgtcagtactaattaacattgctaaggctgtccacttcctacacactggcatgatacctggtttcttcaaaaaccgacttaagaccaacaatatcttgctgaatgagaattggatggcaaagttgagtgactatggattgtccgttatatcagaagaaactgatgcaagtggggtaaaaggagaaagtcccgattcatggcaaatgaaaatgttagaggatgatgtttatagctttggattcatactactcgaggcacttgttggaccttcattatcagctaaaagtgaagtaaatgtgctgaatgtaatg

SEQ ID NO: 94149 - DNA, 507 bp, Glycine max
  Peptide Sequence Number=SeqID_210927
atggtctttatgatgattaagttggatggggaagccaccaacgagagctttgagctcgaggggccttgggcctatgccttgcatgatggagagagtagagaactcacctatacaccttttcttcaaaggatgattgtgaaggaatggagaccaatgtttaggatgttaatccacccactgaacggccagtggaaccgtgatccatggtttaaggatgatgattgtgacagtgatgttagattttgtctctcaccgatggctgaggagccacacatttcaccattttatttcgatttacatctagtacttactcaggatctagtgctcgattacatgcgtattctgtcaaatctattttcttcaccttcctgctcttcatcattggcatggtctatggatgatatcacaatgatggtcgaggagatatttgctcagtcaattgtgaaggagtatatttcgccatctcccaacaacaagattcccttgtctgcatattttcatccttag

SEQ ID NO: 94150 - DNA, 1146 bp, Glycine max
  Peptide Sequence Number=SeqID_210928
atggttgagaaccgggaaaacaacaacagccactcaagaagatcactcactcttcatttcatttcagtaatggctacccaaacccaaacacagtcacatccaaacaccaccatcgacccaaacagcggcttctgttcccattccagaaccttccacaccctccgtccaaacgtccctctccctccgccctcccaccccctctccctcaccgactacgccttctccctcctccccgccgccgccaccaccacctccgccctcatcgacgccgccaccgaccgccacctctcttactctctcctcctccgccaagtccaatccctcgcctcctctctccaatccctcacccctctctccaaaggccacgtggcactcatcctcaccccatcctccctgcacgtccccgtactctacttctccctcctctccctcggcgtcaccatcgcccccgccaacccgctcagttccctatccgagttgactcacatcgtcaaactcgccaaacccgccatcgcgttctccacctcgaacgccgcgaaaaacattccctccctcaaattcggcacaatcctcctcgattccccgttcttcctctccatgctcgacgacgacgaaaccgttaacagagactcgcgtgctcaccgagtcgaagaagtgagtcagtctgactcggcggcgattctattctcctctggcaccacggggcgcgtgaagggcgtgctcctcacgcaccgcaacttcatcacgctgatcggagggttctatcacctcagaaacgtggcggatggtgaccctcacccggtgtcgctcttcacgctgccgctgttccacgtgttcgggttcttcatgctggtcagggccatcgccgtcggggagacgctcgtgttcatgcagaggttcgatttcgaagggatgctaaaggctgtggagaggtatggaatcacgtacatgccggtgtcgccgccgctcgtggtggcgctggcgaagtcggaactcgtgaagaagtatgatctcagctcgctacggtatttgggctgtggcggcgcgccgctcgggaaggaagtcgccgacgacttcagaggcaaattccctaacgtggaaattgggcagaatcttagatccagataccagatatcccacctttag

SEQ ID NO: 94151 - DNA, 1172 bp, Glycine max
  Peptide Sequence Number=SeqID_210929
cggcgtcctcccggcgcagctctccaacgccaccgcgctccacagcctcttccgtcacggatactacctctccggcgcaatcccctcctccctctgcaccctcccccgcctccagaaccttgacctctccgaaaacgccttctccggccacatcccggagcacctcagaaactgcaagaacctccagcgcctcgtcctcgccggcaacaaattctccggcgagattccggccggcgtgtggccggacctgcaaaacctcctccaactcgacctctccgataacgagttaacaggctcaatccccagcgaaatcggaaccctaatttccctctccggcacgctgaacctctccttcaaccacctctccggtaaaattccgtcttcgttgggaaaattaccggcaacagtgatctttgacctcaaaaacaataacctcagcggcgagattccccagacggggtcgttttccaaccagggccccaccgcgttcctcggaaacccagacctatgcgggtttccactcaggaaatcgtgttctggttcggaccgaaatttttcttccggttcggaccagaacaaaccggacaacggtaaccggtccaaggggctgagtccggggctaattattttaatctcggcagctgatgctgctgtggtggccttgattggtcttgtgattgtttacatttattggaagagaaaggatgatgagaatgcttgtagttgcattaggaagaggagatttggtgaagagaaagggaacatgtgtgtgtgtggtgggttatcatgttttggtggggtgaagagtgatgatgatgatgatgaagagtttgaaggtggtgagggtgagggtgaaggggaattagtgaggattgataagggtttgagttttgagcttgatgagttgttgagggcttcagcttatgtgttggggaagagtggattggggattgtgtataaggtggtgttggggaatggggttcctgtggctgtgaggaggttgggggagggtggggaacagaggtataaggagtttgctgctgaggttatggccattgggaaggtcaagcaccctaatgttgtgaggttgagggcttactattgggcacatgatgagaagcttctcatcagtgatttcatctccaatggcaatttggctcatgcccttagag

SEQ ID NO: 94152 - DNA, 195 bp, Glycine max
  Peptide Sequence Number=SeqID_210930
atgtggaccaccactggtctctttgccccaggtggtctagtgaccaaggatcatagccgtgtcactttgcgtgtccgcgtcaaggtggacggagacgctgatgctactgcaagagaaggaggaggagaaggaggaggaggaggaggcgaggcagcttcttctccgatggagtcatttgtgtggacaaaggactaa

SEQ ID NO: 94153 - DNA, 978 bp, Glycine max
  Peptide Sequence Number=SeqID_210931
atgaacctggtagtggtttgtgtcttattcggcaggagaagaaaaagtctttggaagattatgaaaagtctcaagggtttgggtgagattgttggaggaggatatggtttgactgaaagtggaggaggggcagctagagtgttagggcctgatgagtctaagcgccatggttctgtgggtcgactagcagaaaatatggaggccaagatagtggaccctgttactggagaggcattacctcctggccaaaaaggggagctctggttgcgaggtccaacaatcatgaaaggttatgtaggagatgagaaggcgacagctgaaacattggattcagaagggtggctgaagacgggagatctttgttattttgactctgatggcttcctctacattgtagatagactgaaggaattgatcaaatacaaagcttatcaggttccccctgctgaattggaacatatactacacaccaatcccgaaattgctgatgctgcagtagttccgtatcctgatgaagaggcagggcagattccaatggcctttgtagtaagaaaacctggaagcaacgtcactgcagatcaggtcatggagtttgtggcaaagcagatacagattaatgtacctcgcctcgaaactattgtgacctgttcagatgcaacaaatgcacgatatcgtgtgaagcacctggcttatcatgaggcttgttcacaaaatattttttttctaacagcaaatgctaatgttagtatggttagtataccggataaggtgctcagtcaagccaagaagacacctaatacactcaaaccgaacatatcattcggccacgtatccactcgctcttccagacacttaacgcactcgagacttcaacaaggaactacaggaaaaagatcctctgacacagtagaagaccataaagcaaaaagacaagtatctgatccatttgtgacaagaacattttggcgcccaccgtag

SEQ ID NO: 94154 - DNA, 2439 bp, Glycine max
  Peptide Sequence Number=SeqID_210932
atgacaccacccttcactctctctctctccctctttgtcattctcaccataaccgccgtccacggcctgggctccgccgccaccactgccgtcacctacggcaccgccaccgtgtgcggcatcgtcgccggggagccccagcaccgcatccagtgttcccgcagcggcaggcgcgtcgtccccctcaccctccccaacgtttccttcgacgccatctccggcggccggagcttcttctgcggcctccgctccggcggccgcagcctccactgctgggacaccgccgccccaaacgcctacttccgctccaagagactcttccacagcgacgtggtgcagttggctgacgtggcagttggcgactctcaggtgtgcgccagagaggtgcaatccggtgttgtgcggtgctggagaggaagcggtggggtccagttcagttccccttcggaggggttaaggtttcgtagcaatagcatcacatgtggttgtggtttttcatgtggggtgataaaagagagtggaagagtcgtgtgttggggtgatggtgatgagggtgcaaatacaaaaagtattagcgatgagattcaaagaaagtttgagaatttcactatgtcaagtttggttgctggggtgtctcatgtgtgtggtttgactcttcatggggctttggtttgtagagggaacaatgcttctggtcaactaggaaataatgatggtgttttgagttcttctttggagttttcaggtcttgctttgggagaagatttcacgtgtggaattaggactaggaatggtgttgttgtgtgttggggtggtggttttgaaagcgatgtggtgaaaggtgtttcttttgagtcacttgttgctggtttggattatgtgtgtgggttgacaactaggaatttgtcagtggtgtgttggggtaaaggcaggttttttcatgtgcctagtgagcttccattgggtgtgattcttccaggtccatgtgttgagggtgcttgtagcggctcttgtggtacatatcctgattctggtgctctttgtcatggctctgggagtatttgttactcttgtcaaactgaggttccactagcagttccattgcttccaccatcaacaacacaagttgttccaaaacaagaacattcttcacgtggaggaagaagcttgagggagtttttgattttttttattgttggatcagttggtgtttttgtggggttatgcactattctttatttcatttggatttgtgcaaggaggtttttgttgagtagaaaagaagtaggaggtaataattctgtgaaacctacaagctcagagagtgatgcatatgtggatataatccccatgcctaatgttggttctaatgggacaacattcagaactttttctagcaaaagtcaggcatcaagaagatttgggaggcataggagtggttcatcatcgaagcatgtcgacagaaccgagagtttctcattgtctgaacttgcaatggccactgacaactactcgctgtttaacaaaataggtgctggtagctttggctgtgtttacaaaggcatgctaagagatggtcgtgaagtagcaattaaaagaggagataccagtgccatgaagaagaaatttcaggaaaaagagattgcttttgattctgaattggccatgctgtcacggcttcaccacaagcacttggtgaggctaattgggttctgtgaggagaatgatgagaggctcttggtctatgagtacatgagtaatggttcactttatgaccatttgcatgacaagaacaatgttgacagaagtagcaacattttgaattcttggaagatgaggatcaagattgcattggatgctgctaggggaattgagtacattcacaactatgcggtgccacccattatccacagggacatcaagtcctccaatatactcttggattcaaactggaatgctagagtttctgactttggattatcaaaaatttggccagagactgagcaagaattgatgtcctccaaagcagttggcactgttggatacatagaccctgagtactatgtgttgaatgtgctgaccacaaagagtgatgtgtatggtttaggagtggtaatgttggagcttctcacaggaaaaagagcagtgttcaaacctgaagatgggtcaggccctatgggggtggtggaatacacagggccaaagatagcatcaggagagctttggagtgtgttggattatagagttggtcaacctgaagtgaatgaggttgagtcccttgagatcatggcttacactgctatgcattgtgtgaacttggagggaaaagagaggcctgaaatgactggcatagttgctaacttggagagggcattggctttcattgagggaacccctactagcctctccatagcttcattctctgcccctcttgaataa

SEQ ID NO: 94155 - DNA, 504 bp, Glycine max
  Peptide Sequence Number=SeqID_210933
atgccttctctctcacctacagtgacagagggtgacattgcaagatggttgaagaaagaagatgacaaaatctctcctaatgatgtgctctgggaagttgaaactcttctggtgctaaagaagttttggcatcctccaaggccaaggttgcaacagatgcaacattggattatatcaacattccagtctcttagatgcggaaggagcatgtacttggcagatacttactccggcgacagttatgagaagtacttccatgactcacaaacaaaaaaactgataaaaccatctttcatcatctctagaagttcaattcatcttgatgtagacttttcttaccagctcaaagtcaattcaggagtttctatggttgccaataacccatttgattcttctttcatgtctacaaggaatcatgatgcttatcagtcaaactcaggatcaaattccaaatcagcaacatcatcaacaccaaagaaatatcacaaatatctcaaaccctaa

SEQ ID NO: 94156 - DNA, 318 bp, Glycine max
  Peptide Sequence Number=SeqID_210934
atgccctcttcctgttatctaccatcccttactgccaaggaagtggctgaagttttatcagaaaaattctcaaacttcatggatttccatcataaaaagttattgagagatacagggttttctcagtcagttatgtatggactgaataatcaaggaaatcaggaaccaaactcaagttctgttctacctaccatccttaatccaaggacattgacaggttttccatcagaaaattggagagctcagactgaaaccaaagagggcatgactgaagccctaatcaaatggcaagacctacagaactttgaaaggatgtag

SEQ ID NO: 94157 - DNA, 309 bp, Glycine max
  Peptide Sequence Number=SeqID_210935
atgttggaatgctatgatccatcagagtcccagattgttgttatagtgtgctacataagggcattaatagatgctacatcctctgacagcagtcttgaggaagagtcaggggttagaatggtggctttatttgatcacgaggaagttggatctaactctgcacaaggagctggctctcctgttatgctaaatgctgtgacaagggttaccaattccttcagctcaaatcccaaccttctggagaaagcagtacaattaagctaccttgtatctgccgatatggcacatgcactagacccaaattacatg

SEQ ID NO: 94158 - DNA, 258 bp, Glycine max
  Peptide Sequence Number=SeqID_210936
atggccaacgacgttaacaagtgtaagggctaccttttccatcacctgaactgcacttatggccttggtcgaaaccaaaagataaacaatcaacttcttggtggtatccagtttcaacaaaacggatggtgtcgccagcgttaccttcagttgccgaaaaacttcttcacaatttttatcctagacaaaaattttggccttcttgaagaggttcataatgggtctagccttcttggcaattcttggttaaaaccttga

SEQ ID NO: 94159 - DNA, 120 bp, Glycine max
  Peptide Sequence Number=SeqID_210937
atggggtgcgacggtgaagggaggtttttggtgtcggagtgcgactgtgcaagttcatcttcagggctgcaagtttttgtattagaccttactccatctgcagtcaaaactcataagtaa

SEQ ID NO: 94160 - DNA, 537 bp, Glycine max
  Peptide Sequence Number=SeqID_210938
atggctgttcgcgaacttaccataggactaatgtcagaaataaacatacgaccctggcaggaagagttcccagatatcaaacaaggttctcgaaatgttagttggaaaaataagtttccatgggcatactggaaaggaaacccagatgttgcatctcctattcgtactgaattaataaattgtaatgattctaggaagtggggagcagagattatgcgtcaggattggggggaagcagctagaagtggttttaagcagtcaaaactttcaaatcagtgtaatcatcggtataagatctatgctgaagggtatgcatggtctgtgagtttgaaatatattctctcatgtggttctgttgcattaattatatcaccccagtatgaagattttttcagccgtggccttattccaaaccataatttttggcttgttgattctctaaatctatgtccatctataaagtatgctgtagaatgggggaaccaacacccagtagaggaaatcggaatgaatgttcaatttaactgctcaaaatga

SEQ ID NO: 94161 - DNA, 498 bp, Glycine max
  Peptide Sequence Number=SeqID_210939
atggaaaagcatgaagcaaaccatcagcccaaactacatggaggacttgtcattaaaaccaacgctaaccaacgctatgcaaccaatgttgtcacatccttcatattcagggagatagcatcaaaacataaacttcccgttcaggactttgtggtgcgcaatgacatgggttgtggttcaaccattggtcctattcttgctagtggcataggtattcgcactgttgatgtaggtgcaccgcagttgtcaatgcatagcatacgagaaatttgtgctgttgatgatgtgaagcattcatatgagcatttcaaggcattttacgaagaattttctcatgtcgatggtaggcccacagactctttgaaactgagtccatgcagacttacgcaacacacaaggcaaatgtatagaaatgcgaccgtggatcaaattaacgcaaaggaaaaagatgttattgagagagtaaaccgcaagaagccaagaaggatggctaagtaa

SEQ ID NO: 94162 - DNA, 732 bp, Glycine max
  Peptide Sequence Number=SeqID_210940
atgacggcggcaggtcaaaccagtgttagagcagagagcgtggggaaggagaagagaacatttgagatctgtggagcatcgtgcaactttcgctctgccaactacgtcctcctccaccagaccgcaacttcttcaccgacgactacgacaacgacttcttctccggcggcgacggtggctgcttcttttccacctccttgctggcgacaactcccaccaccaccaccaccaccgtcacgccaacaacctccctgcgtcgctgccactcttctacttccttcatttttcctctccctgcttagagtaggacttgatagattggtggtgtgggatgacgttgctgatgctgggtttgcagaaagggacaaatttcaccaggatatgcttccaaatttcatatctaaatcagatctatatcgcgaggacgatgtgctggagcatcatgacagagaaggggttgtcagcgaggacaaagttgaggatgatacgttggagcactgcaacagagaaggggttgttggcgaggacgaacttgaagatgatgcgctgaagcaatacatcaaagaagggtctgtcaatggtgaggaggaagttgaagacaatgtgctcagatccaatacacataagcttatgaaacctctgttggccgtgtgttgtctagtgaagaatcgggagaataaaggagatagaagaagaagaaaaaaaaatgatatattttgtgacagtttttaa

SEQ ID NO: 94163 - DNA, 3570 bp, Glycine max
  Peptide Sequence Number=SeqID_210941
atggccctcgcaaagctccaagaagataaactgcgtgatcatagacaaacatcctcacgccctcacccttcaccttccccactatataatcctcccaataccagccagaaacagaaacccacatatgtccagagaacccccgacgagattgccctacgtcgtgagaaagggctatgttataattgtgatgagaaatggagctcttctcatcgctgcaaagggcgcgtactcttgttcatagctgacaactccgacgagcccacattagacacaccatcactagacatggaaccacctacacccctcactctagacccagacaccaacccaccccacataagccttcacgcactttctggcctccattcctcagaaactttccgtctcaatggtatcatcaaccacactaacctcaccattctcatagatagtgggagtacccacaacttccttcagccccgcatagctcagttcctacgtttgaaacctcagagcacgagcccacttcacgttttggttggcaatggatccgtacttgactgcaaccaagtgtgtccagagacttcgctttctctccaagtcttggggatagagtggttacggcaatttgggctgataaccactaattacacctcattttctatgaagttcacctacatgggtcgtccaatcgagcttcacgcggacatctcaaatgggcctcgctctatttcagcaccccaggtaaaacgtttaatccacaccgggtcagcttcggccctgttccatttgagtatcatacccacccaacccgacccacaaacccttcttcctcacccgataccagcaattgaagccctcctcactcagttccaaaaactcttccaaaacccttcaaccttaccaccaccacgccaaatagtccaccatattaacctcctcccaaacacagctcccatcaatgtacgtccttaccgatatccacagttccaaaagtctgaaatagagaagcaagtaacggagctcctatcattgggattaatccagcccagcaccagcccatgctcctccccagttctcctagtaaagaagaaagatggcacctggagaatgtgtgtcgactatcgtgcgcttaacacggccactctggatcttagacaaggctttcatcagattcttatgcacactcctgacattgagaaaacgacgtttcgaacacaccaagggcactacgaatatcgcgcaatgtcgttcggcctttgtaatgcaccgtcaacttttcaggcagccatgaacaaccttctaactccattcctccggcgattcactgctgtcttctttgatgacatcttggtttatagcaagtccttgtcttcctatattcaacaccttgagagcatatttcagacgctgttacagggtcaattctacctgaaacggagcaaatgcctcttcgcgcagaaccaggttgaatatctcggtcatgttgtctttggcagaggagttgagccagaaccatcaaaaatccgcgccatggtgcaatggcccacccctgcttcatccaaggacctcagggcattcctcggactcaccggtttttaccgtaagttcattaagaactacgccacgattccagcccctctgacttctctcctgggcaaggacgcgtttgagtggtcatcaactgcacaatctgccttcgagcaacttaagaaggccatgacctcagctccggttctcaccttaccagacttcaacgagccattcgtaatcgagaccgacgcctccggtaccggcatgggcgtcgtcctcatgcaaaagggtcaccctcttgcattttttagcaagaaatttggtccacacatgctccactcctctacgtacgttcgcgagcttcacacaatcgtctccgccgtacgaaaatggcatcaatacctcttggggcattcgttcaccatactcacaaatcacaaaagccttcgtgagctcatgtcacaagtcgtccaaaccccagaacaacattattacctctctaaactcttgggctttgattacatgatccaatataagacaggatcatccaacgccgtcgcagacgctttatcccggacgaactctggttcttctggtgcattgttgctcctctcggtaccccaccccgacttcatggatgaccttaggcgcaccttgaactccagtactgagtttcaaacactgatctctaaagtacgttctcaactcgaagaccattctgaatatcgcattcacaacaaactgctattcttcagaaaccgcatatggatcaaccacgataatccatacattcctaccctaatgctcgagttccacgccaccccattaggaggacacttcggagtcaccaaaacaactcacaagatcgaatccagcttctattggtcctccctccgaaaagatgttaaacggtttatcagggaatgcaccacctgccaacaaacgaagatgatcactcaacggccagctggtttgctccaaccactgccaatcccttcaggagtctgggaagacatctccatggacttcattactcatctcccacagtctcatggatacaccgttatactggtagtagtgaatcgatattccaaagttgttcacctcggagcattagccactaatcactccgccttcaaggttgcgaccctgttcatggatatcgtgtgtaaacaccatggattccccaaaagcatcgtcttcgacagagacccactcttcttaatctccttctggcgtgagcttttccggttgagtgggacgcgcctccgcatgagaacggcctatcatccgcagtccgacgatcaaacggaggttatgaaccgtatcttggaacagtatttgagagcttttgtccatgaacaatcggccaattggtaccgctacttcacattggcagaatggagttacaatacctcactccattccagcgccggtctcacccccttcgaaatcgtttacggcaaaccaccaccaactttggctcattatctccaaggaacatcacccaacgaagccgtcgattcaatgataacttctagacaggagattcatcacaaactacagcgtcgccttaccaaagcccaagacaacatgaagaagttagctaatacaaaacgctgggatatatcttacaccgtcggacaatgggtctacgtcaagctacggcctttccgtcaacgctcagtcacggggtcactacacccaaagctatccaagaggtacttcgggcccttccaagtgatggaacgcattggacaggtttcctatcctcttcagctaccagaaggggcctgcatccaccctgtcttccatagttcgatcttacgagagcatcacggccctcctccgccgtcaccagacacttcaccactacagtttattgcccagaaaccttgggaaggacaaccacctaaagacacgacgtgggaggaatgggcacgggtttgcgatctttacctccttgaggacaaggtggtgttcgcgggcggaggtattgatagcagcagttcacgtatgggcgaaggcaccataaacattgcaccgaggacagcataa

SEQ ID NO: 94164 - DNA, 489 bp, Glycine max
  Peptide Sequence Number=SeqID_210942
atgctttgctcttgctcttggcttttgtgggtctgcaaatttacaattgggaccctactgctcacgtttgataaaaatcaactcaatgttagtgcagtctatgaaggtgtggtacccgtgctagtcttacttgccctgaaaatcttcaaaatgttccaaactaatggcgaagaaagggaagaattccaacaagtgcaactgattttagaacaagctccactactgcctagtaaagatgatgttcttccaagttggggttcatctgatgaatctctctctaatgaagaagaggatctcacaatgtggcttgcattgcagggaattcttctatggaaggaaagtcatcaagggaaggggagactagcaatgacctctagcatttgtatgccatttgctttgatgctcaaagggattgcttctttctcccatgtggtcattgggtggcatgctttccatttggaactagttacacattacttttatatttag

SEQ ID NO: 94165 - DNA, 693 bp, Glycine max
  Peptide Sequence Number=SeqID_210943
atgtggcatgacaaggaggaagaagagaaaaagaggatgaacgagagaagtgaagataaattacgaaaaataataacaaaggaaaccgcgcgaacgaaggggaaagaagaagaactgaggaggaatcagaaacgaagaagaagaagagagtcagtgcagaaaaccctagaaacaaaacatggcggaaaaattagcccccgaaaagcgtcacagcttcgttcacaacgtgaatccgaatcaaacaaacccgtgtgtgtgattttaggtcaaaaggtgttcgagtgggatcaaacccttgacgaggtcaatatttacataactcttcctcctaacgttcattccaagcaattctactgtaagattcagtccaagcacctcgaacttggcatcaaaggcaatcctccgtatctcaaccatgatcttactagcccggtgaagacagattcttctttttggaccttagaggatgacataatgcacataacactgcagaaaagagataagggtcagacatgggcttctcccatattaggtcagggtcagttggacccttacgctactgatcttgagcagaagcgactcatgcttcagagatttcaagaggagaacccaggttttgatttttcacaagctcaattttctggaaactgtcctgatccaaggaccttcatgggtggaatccgatcagattga

SEQ ID NO: 94166 - DNA, 1668 bp, Glycine max
  Peptide Sequence Number=SeqID_210944
atgaagaaccccaggaagaagaagaggccgaagccggcgcagaagaaggtacttgaggagaacaacaaaggtgttgttgttgctgggaatgaaaacgaagaagaagagaagagaaaacgcagcgttttggaggcactggttgaggctttctccttgtcttcaatcagggaagcttccatggcctatgagattgcagggggagatcccgacagggcttcggagatcctgaggaagggttcttcggacagattcgaggattcgttctcgtgtttttcttatggttcttcttctagcggcggaagcagcggtgggggcggttcttcttcttgttcggggttggaattgggttcgaaaggtgggaggcagcagaagaagaaggtggttgcttcaactggcactgtttcaacggttttggggaaggaatatgtgaggaggaacaatataaggaacaaggggtttagttctaatggagtttttgaaatggaggaggcagagcaattcctctgctctatgctgggggatgattctgatattaacttggctgttgttagagacgttctttgtcagtgtggatatgatattgaaacggcctcagatgtattgcttgatttagctgcttccacaaatgacaaaccgaatactgatagacatcctaactacagagtggacaacattgatgatgagaggttctttgctgaccccaatgacagtttgatagacaggagatcagagtgcacatctctttcatcggaaggttatctttctgataatccatggccttttggaaggaaatatgtggaggttctcaatagttctaaagctgattctgctattagcccaggatgtacaaagtctgaaattcctcagaaggtgttggaatctttgtttaatattcccaaaagcactgaacatgacaaagataccatgaattggagaaatgtagtaaagaaaatccagtctttgggacctgggttcaatgtttctccgcatgttgcagaatctcagcaacatacgcttgccttaaacagccttaaacagtatttgttggtggcttgggggcttgctgtcctaggcaacctgagtcagagcgaggaggatacatcatgcaattttggcaagattacctctgctacattggtagagtttgctaagaaagctaagggagatgaatatcatgtgtttagggaagattcaaagcagcaatgggattcagtgaaatcttattatacgaaagctgcaacagcatataccaaacgggaacgagcttatgctgcatatctttctgaccagggtaaagaacaaactagattagctcagaaagcagacactaaggccagccatgacatatttattgctagaaacaaaggtatagaaaatatgataactattgacttacatgggcagcacgtgaaacaagcaatgagaatgctgaaactacaccttctgtttggatcatatgttccctctgtccagactctaagggttattacaggatgtggatcacatggtgttggaaagtctaagctgaaacaatcagttataaaccttttagatagagaagcaattgaatggagggaagagaaccagggaactgtattgattaaactcagcggatggagagagtatagctttctagacaccagcagtgacagtgacagtaatgattaa

SEQ ID NO: 94167 - DNA, 1744 bp, Glycine max
  Peptide Sequence Number=SeqID_210945
ggtttcggaagagagctctaaggaggaagatgatctcctccttatgagtgctagaaaggtaaaaaggaaaaccgatgagggtgatgagatggagtgtgacaacgggaatataagagaggagaataagactccttataaggagaagtgttatggtagccaagataaggagataccaccaccacctatatcaaaggatgatatggagagattcctagaggttcctatatctgatgaggaattttttgatcgatgtaagccttggaagggttctcttatggttatagtacttgagaagagaatagggtttcaccaccttgaagcaaagctgaaccgtgattggcaaggaagggatgaggactacaatcatgcttttatgaaagggccatggatgattgttgatcactacatcgtggtgcaaatatggagacctttatttttggctaacactttaatggggagaaaactgatgctaaagatagataaggtaacaaccattcaatctcgaggcaagtttgcaagaatttgtgtggaattggatctagataaaccattacaaccaaaggcaattgttagagaatatctacttaatatgcagtatgaagggttgcatgtagtttgcttcaaatgtggtcgatatggacatagggagagagattgtgttcatggtgcggaaacagggagttcagacatgatgtttggaagcccaaaaggagatgaaaaagaaagttgggccaggagagaagctaaagtgattgaaacatgtgggaaacaacacgctgatttatcagataaacaatcatcgaaatatgcaggagtatcaatagccttgatgaacgatttaattgataattataaggtgtctttatgtttcctcttagaaaatcatgctaatgtgcaaaaaccgaaatccattatcaaaaggatgaagtttaatgctcatcatgttattgcttcaaatggccagtcaaggcggttgtggtacatgtggaattctgatgtgtggcaaattaaaatattggaggaaaatgctcagtttatgtatttagaagtgaagaaagatcaacaagctagagctctagactttaatacaattttacatgaatcagacagaaatggtggtgttgaatatcctagccatagggtggtgagggcatttagaaaagtcatggaatattgtcaccttttggatgctcggtttgaaggacctaattttacatggtcaaggggagatttatctatgagacttgataggttgattatgaatcaggcttggaggttgcagtttcccagagccatagtcacccacttgtatcagtacaagtcagatcataaacatcttcttctgaaccttgatgttgggggtattgacaagaagctcaatgagagtcctaatatttttttatccttgttgcaaaaaagatttgtggaaaaagctagaggatgttatgttccaagaaaaacttttatggttccgaaaattcaagtgcaaatggttgaagtacggggatgggaactgggtggcagattcaactttaatggaggggatgacaatgagattgatattttgagcaaagagatatcagatgaagaaatgaggagatttgtgttccttatgggtagttataaggctcccggtgaagatggtttccaagctttattctaccagagccaatgggaggagacgttttgtggcactgccaaaaattgtgcaagcagactatcaaccacgacgtccccaggataa

SEQ ID NO: 94168 - DNA, 1185 bp, Glycine max
  Peptide Sequence Number=SeqID_210946
atggtttcaatttggaagggagggtcagcatctagagccccccatgtggcaatggcagcaaccatagagacaagcagctatgttgctatcatctttggggtcactggacttgttgggagagagttggctaggaggcttcttttagaaccttcttggaagaaggtttatggcatagctagaaacccagaaacaccaccaacccttattataagcccttgttaccatttcatttcttgcaatttgctgaaccctttgaagactcagaagaagctgtctggcttgcaagatgtgactcatgtgttttgggtaacatgggccagccagttcccatcagagacacaagaaagttgtgaccagaacaaggccatgatgtgcaatgctttgaactctatggtctcagtagctaagaatctaaagcatgtttcccttcaaacaggaaccaagcactatgtgtcactgcatcccccctttgatgaagagaagttccactattactactaccatgaagagttccccagaatgagcagatcccttaacttctactatgccttggaggatttgctcatggagaaattgagtggtaaggtgtcttggtctgtgcataggcctggtttgttgtttggtagttctgttaggtcattttataacttcatggggagcttgtgtgtttatggggctatttgtaaacatttgaggctcccttttgtgtttggggggacaaggaagtgttgggaggagtcatatattgatggatcagatgctaggcttgtagctgatcagcacatttgggcagccacaaatggtgacataatttccatcaatggccaagccttcaactcaatcaatggcccaagtttcacttggaaggagatttggcctattgttgggaagaaaatgggagtgcaagtcccacaagacatggttgtggagagcttttggttttcaaaagccatgactgggaaggaggaagtttgggaagagattgtggaggaaaacgggttggttcacacgactgttgagaatttggccaattgggagtttttagatgccttgtttcgtttccctttgaaactcttgggatgcagaaataaagttgatggacttggttttggtgcaaggtacaagacattgaattcaatattgtattggattgattgcatgagagatgagaagctaattccctag

SEQ ID NO: 94169 - DNA, 639 bp, Glycine max
  Peptide Sequence Number=SeqID_210947
atggacattcaaaatctgaccaaccattacctacacagaataactcaactcaagagcttaaaatcctgtgtaaacggttctggagctgaagcggtcgcgcttcgcggactcgaagaactcgatggcgagatcgtcgaggctgatctccgggaagccggagccgcggacggtgttgacgaaccggcctctcggagtgcggcgatcgccgccgtcttcgtcgttgcgggaggggaaggaagggcgggcgggacggctgaggctccgggagcggcggtggtggagggaggaggagtaggcggagtcgtcggcggaggaagctccgacgagggttctcttggtggtggatttgaatgccgcggtggccataggagaaagggggaaatagaaatgccgaattctaggagaaatggaagagcttttgaagaattgacaacctcactcaacgagttggagtcgcttagtgcaaggaagcttcattggaagataattgccataggcaagcatgctaagcgcgcaaactcacagcttagcgcaaggaagcttcattggaagacaacttccataggcaagcacacaaactcgggacttagcgctaatccacttgatccacttgcaatccagctagacatgcgtgcttag

SEQ ID NO: 94170 - DNA, 1683 bp, Glycine max
  Peptide Sequence Number=SeqID_210948
atggccaccgcggcattcaaatccaccaccaagagaaccctcgtcggagcttcctccgccgacgactccgcctactcctcctccctccaccaccgccgctcccggagcctcagccgtcccgcccgcccttccttcccctcccgcaacgacgaagacggcggcgatcgccgcactccgagaggccggttcgtcaacaccgtccgcggctccggcttcccggagatcagcctcgacgatctcgccatcgagttcttcgagtccgcgaagcgcgaccgcttcagctccagaacctccaagtcagaggccagtcctgccggcgccggctccgccgcgtcgcagcggcgagggaggtccgtatcgaggaagagctccggtgtcggcgacgatagaagaagcagtgttggcgggggaaggccgttctctgatgcgaattcgagaaggaggagatcggtatcggtggttcggtaccaaattagcgattctgagagtgacctggaccgttctcagaattctagaagtcgttcaaatctgaaaaatactgatgttgggaacaagttaatgcacaaaccagttgcttcagatcaaagaccagtgctaagaaagtccctaagcctgaagggtttgagggcatatgatggctactctagtcattcttcagttctcactgatgatgaaggaacaagtgctcactctaataaaaatggaattgagaaactacgatcagtttatgcacaaaaaaaggtggcacttactgacacggataaaggatcccacaaagcaaagcaaaaagaattgacgcatatggaaactgagcaggctgtggtgaaaccaagaacctccactttatccacagttgattgcttgttattaaacaactctgatgttattcagacagtttcttcaatcagaaggagctatgaaactgaactggaaaagtcagagaagcggaaacaagatttattagctgaaatggtgtttgaggagcagcgaggcagagaactttctaagattgttaacgaattgattcctgctaaggaggacaatcttatacaaaatccatcaagagccaggaagagaagtaaagacagaagccgaatgtctatgcgcttgactgaggaggctgagaaatatattgaggattttatttcaaatgttgaagatacagatatttcatcacttgatggtgaaaggagtgatgcaagctcatccattggaggactaataaaaccagaaacatttaatagtcttccagtacctagatctcttcctgttttgacggatggggttacattgccatggttgcaatgggagacaaataatgatgcttctcctatgacaaacctcaataagacacatatgacgatcactccaaaaactgaaaacatcaaagtacaagatcaaggtgacaattctatcagcagtcgtggaagttggagccctgattaccttcaggagtatgttggaaaggatgtgtacagtaaattaggagaaggttgtggttacccagaccattcattatcagctaaatccaaaggattgaggggtcctgaagtgcattctttacacttttcaagcagaataaatcactcagtcccagggaggaagagggactcgcgggcgaccgataatgatggcggtggcgggcggcaaacggcaacagtcagaaacgagagaggccactag

SEQ ID NO: 94171 - DNA, 198 bp, Glycine max
  Peptide Sequence Number=SeqID_210949
atggcgacgtccccacaaaccaacacaggatcgaggggagcacctagggtttgtttgggttttcttgggagaggcagggatgctaggagtgaaagagcttttcgtttccttgtcgcttggagtactcacaatgatgtggttaaaaaagcttgggatcctaatgtgcatgatttagtggctaaatataggagaacatag

SEQ ID NO: 94172 - DNA, 2352 bp, Glycine max
  Peptide Sequence Number=SeqID_210950
atggcaccaactgtacctatagagtttgctggacaaaaggaatccagaaagtactctcattcacagaatatggggaaatctagaaaatactccaagggttatgctactggctttgttcctgattttcggcatgctgttgagactatgggtgaatcagaagggctaggtagcttgggaagggttgatacagaactgacagcattggcagattcttgtgcaccgaaagggaaacgccctggcttaaatgcaggtgacggtggttatggtagttttgatgtaccatttcaacatttctcattatcagcgatgtcgggttttgagagaaaggatttgaaagtgaggttaacttgggaacttgaacaagtaagggaatttcggaagaaaattgatggtatgaactcaaatgttgttggattgtctctctccagtgacataatgagctgcagtgcagggcagaagaggcctaagctggagagccagcataggacaatggaagtatcagtcccacatggtaagaaaaggcccttaccgggacatactggtcccaagttaaagaaaagtatgtctgggcatcttgaatatgcaaaacctgctgcaccagtgacttcatatgctacgttgatgaaattatgtgagaatgtactaaaccgattgatgtctcatcagtttggttgggtttttaacactccagttgatgttgttaaattgaacattccggattattttactgtcatcaagcatccaatggatttgggtactgtgaagaagagaataacctctggcgaatattcaaatcccatggattttgctgctgatgtgcggctgactttcgaaaatgcaatgttttataatccagctggcaatgatgtacacatcatggcagagacccttagtaaattttttgaaacaaggtggaaggccatagagaagaaaattcctgctattgatagtgtcgcatctgagccttcaagacctactcacgtggaaacagaaatttctgatcgagttcctcccacaaaaaagaagaaaataacaccaaatgacactaatgtcaagccagagcctgttaaaagaatcatgactgtagaagagaagcaaaagttgagtctagagttggagacaatgattggagagctgcctgatagcattagtgatttcttgagggagcaaagttataatgaagggcaaatcaatgatgatgaaattgagattgacattgatgctcttagtgatgataccttattcaaactgcggaagcttcttgatgattacatgctggagaagcaaaaatccctggcaaaagctggacaatgtgaaatggagcttctgaatgaatcagggttcagcaattcatcaatgcaacctcacaaggatgcaggcgaagaacaggttgaggaggatgttgacattattggtgggaatgatcctcctatttcaaattatcctccattagagattgaaaaagatgttaccaatagaaacagtaaatgcagtagcttgagcagctctagtagtgaatctggctcttcatccagtgattcagactcaggcagttcatctggtagtgagttggatatggctaaaacatcagaacctcttagtgccaccaaggaaaacgtaggatttgatttgacttcagatcaaaacaaaggggatcctggtaattcagaaactggaaaggattcaacaaatgtgggaggccaagttgagcagagttcccagagtgggcatgttgctactgagccagaaagtcatcaagacggggagagtgctgcatctaagaggcaagtctctcctgaaaagctctaccgtgcagctttgttaaggagccgttttgctgacaccatacttaaagctcaagagaaagcccttgaaaaggatgaaaagcgggatcctgaaaaacttaggattgagcgagaagatcttgaaagacggcagaaagaagagaaagctcggttgcaagcggaggcaaaggctgcagaagaggctcagaggaaagctgaagcagaagctgcggctgaagccaaaaggaaaagggaactggaaagagaagcagcccgccaggctttgcaaaagatggagaaaactgttgatatcaatgagaacagtcattttttggaagatctagagatgcttagtgctgtacatgatgaacatctgccaagtttcaaagaggagacaagcgcagatcaacctcaagatggattgggtgggatcaagctacagggaaatcccttagaacagctagggttgtacatgaaggaggaggaggaggaggaggaagaggaggagccacctccgagtggtgctgcaggaccatcaaatgatgtggaagaaggagagattgattga

SEQ ID NO: 94173 - DNA, 506 bp, Glycine max
  Peptide Sequence Number=SeqID_210951
atgatgcccttcttctctttcacacactacaaatccttttggagatcttcaattgcatttgcatttgcatttgcatttttcttaacctttctcttgattgcaaactcactcactctccaaacccaatccactacaatcccatgcaacaaagacccctacaaggaactaaaccttatccctaacccaaacggcaccgtcacgcgccccaacaaacccccccagagcccgcccgcaccggatcccaacctcaacaccctcgtactctccaaagacctctccatcaaccaatcaaaaagcacatgggcgagggtctacctaccccgcgtagcactggatcacagctccaaactcccgttattggttttcttccatggtggcggcttcattttcctcagtgcggcctcaacaatcttccacgatttttgcttcaacatggcaaacgacgtcgttgcggtcgttgcgtccatcgaataccgtctcgcaccggaacacagactccccgcggc

SEQ ID NO: 94174 - DNA, 1050 bp, Glycine max
  Peptide Sequence Number=SeqID_210952
atgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactggagctgacatcattgttgagtccaccggagttttcaccgataaggataaggctgccgcacatttgaagggtggtgcaaagaaggttattatttctgcccccagtaaggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactggtgagcctattgcttgctatttgtatttcctgttacctattatgatacaagttgctaattcagccaaagactggagaggtggaagagctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgatagcagatcaagtatttttgatgcaaaggctggaattgcattgaataagaactttgtgaagcttgtttcttggtacgacaacgagtggggatacagctcacgtgtcattgacctgcttgtattcgttgccaagaagtctttttaa

SEQ ID NO: 94175 - DNA, 996 bp, Glycine max
  Peptide Sequence Number=SeqID_210953
atgccatggagaaaggtggacaagattgctagcacccttggctttcaaagtactcaaaatattaacaactaccttgattttcctcttgttgctagtagggtcaagaaatctcgtttctccttcattgttgataaagtcaatgtctgtcttgcaagaatgcttctgaatttcttcaacccgggttcaaatttcgagtggatcaaggatatttggagaaatagggcatggtgttggtgtgatgcggtctccaatatccctcaatggctcaaattagaggtggagaacttatttcttaatgatgatattcatgatgttgttgcatggggacatgagtctaatggtatttacactacttcattcacttatagatggctcgcaagagctcgttcatccgttgtgttcaataaggggagaggatcttgggtttggccactccaaatcccagagaatatcaaacacttccttggcttgtgtggcagtagtgaagaatccattcttcaccttcttcgtgactatcccaaggctatccatgtatgggacctctttcaattggatgtgcatggcaatcctcctgaagatggcgtctcgatttggattaagaagcatgcgaccaacatcagtggttctctttttgttgcaacaacgtggtgggttgggaagactcgcaacaaggagtttgccgctgacaatggcatttgcaagttaaaaacttatggcagtactctaggtaacccaggaaaggcaggttttggaggtgtagttcatgattctaatggtgcttgggtcgtgggctaccttggctcgtgtgtgtgtgaatctgactcactttgtgcactcaaatttattaagaatggagtagagcatactctgcaagagggaaatcaagtggctgattatcttgccaaggatggtggtgctcaaggagatgatcctctagttattctagatatttgtcccctaagtcttaagcccaagcttcttgctgatgcattagga

SEQ ID NO: 94176 - DNA, 1254 bp, Glycine max
  Peptide Sequence Number=SeqID_210954
atgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaacttaatgatttggatagaagtatgaagctgaaatcacaaagcaaaaaagtggaatggggatttgataagaaaaattcattaagcatagtgttttcaactctagtttccaattcctctaacatgcttccaagtgctccttccaaggattttttcaattctaggatcaagtcgtctccaaggaaacttggtgtcacttggttgtggcaaattaatgtagctgagcaaatgattttagatgatatggcaattaatcctgataaatatgaaggcaaaaagctgtcagatttggttgatgaagaagattttgatgaacaaaatgctgttgaatatacaaaagttcaatataagaatactatgctaccacaaactactctgaaaacaagtgtcaaagagcttgacttagaggctgcacttgctgagcgtgagctccatcttaaactaaggacagaagcagaggacagaggtgagaaatacaaaattaccaaactgaggcgcaatgttgagatggatgagtatgactacatgcattggcgtagatcatttgaggaaagagaaacattgattagagacatcagctgtcgcaaagttcttggtctgccattggaagagccaggaagatatatggatgctagcttttttggtaaagaccaatatgatcctacaagtcctctgtatcgttatgactactggggggagcccaagaattcagagaagagcatgcaagagcggatgacagatatccataacaaaaaaattgtgggcaagggcaatgtttggtacgaaatgtcttatgaagattgcatcaagcaacagatggaaagtgaagcccagtctaaggagcaagaaaaccatgaagatacaaggcaaggccatgctgatgaagatgaggatgacaacgatgacgatgattttgacttcagtattctgagcagtttcggtagtaatttctcagaacagcctcatgttaatgggaccgagtcttctacaatatcaagtgggggcatgtttgaggattga

SEQ ID NO: 94177 - DNA, 1332 bp, Glycine max
  Peptide Sequence Number=SeqID_210955
atgcaagtcctgcaaacctcttatctcttcactttccctaaacccctaaacccttcccctcagcgtctccaccaccgtcttcagccattcctccaccaccgccaccgccgccccctcaccatctccaaatccttcagctccgacgagttcccggtggatgagaccttcctcgagaacttcggccccaaggacaaagaaaccgaggacgaagcccgccgccgcaactggattgagcgcgggtgggccccctgggaggaaatcctcactccggaggccgatttcgcccgcaagagcctcaacgaaggcgaggaggttcccctccgctccccggaagccatcgaagccttcaaaatgctaaaccctaactaccgcaagaagaaaagagaggaaatgggactcaccgaagaagagttctacgcgaagcagttcgagatcaagggcgagattccggaccctctcgtgacgacgtgggcggggccgctggtggtgcgcctcgtggcgccgcgcgactggccgccccgcgggtggtgcgtggaccgggaggagctcgcgttcatccgcgaggcgcacaggatgcaggcgaggagggtgaggctggaggaggtggagagtggagtgaggactgacactgatgacgcgggcttggataggtataaggtgtttctcaagcagtataaggagtgggtggaggctaacaaggataggttggaagtggagtcttataagcaagaccaagattactaccctggtagaaggaaaagagggaaggactacaaggagggcatgtatgagcttccgttctattatcctggccaaatttgtgtagggaaggtgacaatgttgcatctctatcaaggggcatttgttgacattggcggtgtacatgatgggtgggttcctattaagaacaatgattggtattggcttcgccatcacataaaagtgggtatgcacgtcattgttgaaattacggcaaagcgagatccttatcgcttccgctttcctatcgaacttcgtcttgtcgatccaaatatagatcatctaatctttaacaaatttgacttcgcaccaatatttcatcgtgatgaagatactaatgaagatgaaatacggcgtgactgtggaagacctcctgttcctaggaaagatccaggagacaggccagaggaagaacccctattgtctaatcatccatatgtcgagaagtttataacctggttgcacttgaccctcatttttaatttgttcaaggaaccaatacaagatcctattcaaacctgcataaatgtgaagccaagcaaaaccttctacttgtttcatatccactcatag

SEQ ID NO: 94178 - DNA, 3039 bp, Glycine max
  Peptide Sequence Number=SeqID_210956
atgggtgacaagggagacacaaccaagaaacaacaatctcaacagcagcaacctcaatctcaccaccaccatcaacaacaacaacaaacacaacagcaaatttcatcttctcccaaagccccacatgaggaacccatcacagaagttaggccaatccaccaccaccaccaccaacaactttcaccagttgtcgttgcaactggagcaccccctttcattccaagtcctttatatgtttcaagtggtgcaagttcctcaccctttgagcctcagtttgagacactgaacccaaagaggcccagatacagtggacaatggaagcagcttctaccttctcctcctgcacaacaaaaacagtcccaaatggccatgcttcccacctcagaatcaagcccttcacctactactcacacttcatcaaacccactacaacaacaacaaccccaaacacaaacagcttcttcatcagacacttcctcatctccaacacactctctcccgttgctctcaggagaagggaccaagcaagagggagagcaaattcaccagcaactcagaaaagggaaatacgtgagtccagtttggaagcccaacgagatgctgtggctggcaagagcttggaaggaacaatacaaaggtggtggtggtgttggtggatctgatttttcttcaagagcagaacaacaagcggaattgggaatcacaagagcgaaaactagggctgataaagataaagaagtggctgagtttctcaagaggcatggggtgaatagagatgctaaaactgcaggtactaaatgggataacatgttgggagagttcaggaaagtgtacgaatgggaaagagggggtgagagggaacaaattgggaagagttatttcaggctttcgccttatgagagaaagttgcatagactcccagcttcttttgatgaagatgtttttgaagagcttgcacagttcatgggttccagaatgagatcctctcatggcagagctgtttcctctttagggtcaggagatgaagctagaacagctcttgctgctacaagagcacttccaccacctcctcgaccttttaaagatgatgaaatccctctttcagctaggacaaagcaattggctttgacaagtgggggtgaacctttctttcatgggtcaagagggggtttattagggttagacactctcttagacgttacaggttcttcttcttcttcatccaaagaactccgaagaattgggaagataagaatgtcatgggaggaatcagtgagtttgtgggcagaagaaggtgaagtccatagagggagagtgaagcttcaatcttcaagctttctgaacgcagacgaactcacttgcttcgatgatgccatggtgccatgccccatggaatatttcgaagatggcccactgaagggtttctctgtggacagattcgtttcgggtcagcaagtcaaagtttttggcagaagaaagtcttctccagcctcagattcttcttctgctggttttgctgaaagagtccaatttccctccaaagcacttcccataagatcaattgctacattggatttccgagacccaagcgattactacatggaatgcttcctacgtgcgtccccgcaaaccctcccaagcctcttggagcttaagcgtcacttgcaagaacccccacccgaagacctacgttttcctctccgaagagacgtgtacgaggatcttcctcaagggaaggaactcttcttcacgacaacatccgaacccttggactgcagagccatcatgttcgaaattgtgggccccatcatccgcccctccctcaaccctacgtcatccagccgcgactccttcattcccctctgggacgattgcatcaaccgcgtcatccaaaaattctgccccgaaaatctcaccctaatccgaaaacccacgtcatcacccccaccaacagcaacaacagcagcagcaacagcaacggaatccacgaatttgttattacaagaccaatggccgaacataacaggttttgtcaacaactattgcttatggagaggcgaagaaacgcaccagttaacagagacgcagccaaatccatcaaccacgttagttgctaaattactatggacctacatggatttaccctacatactcggatactatgcagttgccaatacggtgacgttttgcgcgatgagtaggtcccaagaaggaataatcaaccgcactgatttactagaactgaatttaaccaccccaacggaaaggttaaaggctttagttccgtgttttcggatcggattgttgctgccattgctgagtaagcgttgcagtagtattataagtaactccaagggctttgcttacagtgattttgagagggtttgttacggtaacggggtggtgactgaggtgacgccgaacacgtgcacgaggatgttttcggaaaagagaaagtggatggcggttaaggaggtttatgagatactcgatcataggattccgcatgcggaggttttggttggggtttcggagagggaactggggttgtcgtttaagccaagggggtgccgtgtgaggccagggaactgcgaggagctggtggaggcgttgaagtacgtgacgaaggctttggtggcgctgcacgacttgtcgtttatgcatagggatttgaagtgggagaaggtgatgaggaggatggatagtagggaggaggagtggtttgtgtgcgggtttgatgaggcggcgggggcgccggagctgaaggggtggcgcgtgacgggggagcgtgaggggaacgcgccggagatggagagagggctgcatggggttaaggtggatgtgtggggggtgggaaacttgataaggacgtgtgggttgggaggggtgcccaagatgcttagggagttgcagagtcggtgcatggagcagaacccggagcagaggcccacggcggcggactgctaccaccacctgctgcagctgcagtcgtcgctgtcagcagcaaccgcagccgccgggggaggcatcatgatgtga

SEQ ID NO: 94179 - DNA, 780 bp, Glycine max
  Peptide Sequence Number=SeqID_210957
atggagggtacttgggaaagaccaaagcttgatggagtcaatttccaaaagatttctagtcatgataattttgtgctcatagcgaatttcaaagaagatgaagtcaaggacatagtgtgtgattgtgctagttcaaagagtcttgggcccgatggtttcactttcctattcatcaaggaattttgggaacttcttaaggagaatattaagagatttttgtcaaaatttcattgctttggcgtccttctaaaaggaaagtactattggtatgatgggaggttggaggcctccaaccttggtatatatgctgggagttcaaatggagaagtaaaaaatttggagatggactcatggtggtggaaggcatcttcttcgggttgctactccaaaattttagtttacagactgtgtatggaggaggactctatggatgaggcaccaaatgtcattttccaagatttgtggcagatcagttttcctaagaaggtctttatgttcctgtggaagacctttaaaaatagactcccatcaaaggaaaacttgaagaaaagcaatattattgttcgtgatgaggatatgttgtgcccttgccttcaaaagagtgagacaatacctctttttttctattgtgagttggcttcgaaagtgtggaatgagtgttattcttggattgcccctgattttgctactacatcacctggagatatggaggctcactactggtacatcaaatggctgggaagatctaaactagaacgagaaatatggcaatacatttag

SEQ ID NO: 94180 - DNA, 375 bp, Glycine max
  Peptide Sequence Number=SeqID_210958
atgacaaagggatacaatggctcacctctccctcaagctgatcaactttgtttcagctgcttccagctttatagaattctcagcattgcctggtgtttctcttacttttgtctggcgtttggaaacttcaatagcatgtgtagtgctttaaaaggtcttgatgatgctccacaacctaaatcaaaggctgctgctaggtggattgtcgtcaagtgtaatagacaaaaaggaagcactgagtgcggctattatgtcatgcactggatgtccaccatcatattaggaaatttcaggaataactgggaagcatattttaacgatcctagaccattggagttagagagattaaagacgcttcggatccagtgggcatag

SEQ ID NO: 94181 - DNA, 135 bp, Glycine max
  Peptide Sequence Number=SeqID_210959
atgacaaatgtgctagcaacgtatggagggattgtcaatggtggaagaggaggccatgacggttttgttttcaacgtgaaggattctggcaatcagagctttaatgcagaattgtgtttttgcccttacagataa

SEQ ID NO: 94182 - DNA, 246 bp, Glycine max
  Peptide Sequence Number=SeqID_210960
atggaacttcaattcgagaccgacagtgagagaattagtaaggagaatcttaagaagcttcttgaaaacattaaagttaaaggtggcttcaacccaaaaaggataggatctgaaatccctgtcctatatgatgacttgagagtgcagagtgaaaaatcagtaaggaaaagattcactctcaaagcaacatcagcattgtaccaaaaggaagataatgaaagagtacaaatgagtaaagatcgatga

SEQ ID NO: 94183 - DNA, 225 bp, Glycine max
  Peptide Sequence Number=SeqID_210961
atgtccaaatatccgaatattagtggacactttgaagagttcttgaatgtcaaggttgttagcgtgcaagtattcagcatgactaaatacccaaacattggtgaaagctttgaagagttcttgaatgacaaggttgtcagtgtgcggatattcgacatggctaaatatttgaacactgatggaagttttgaagagttcttgaatgtcaagatatcagtttattaa

SEQ ID NO: 94184 - DNA, 4364 bp, Glycine max
  Peptide Sequence Number=SeqID_210962
atggcaattgcaggatttagtttcgacatgacatcggaaagggagtcctttgcaagggcttccaatgccgaatgggtggaagaagacgaggaggagcttcaaatggctgcattgttgaggttgccaacgcagaagcgtgtcaacacggcgttggtgaggaagccgtcttcggacacgagcaacagaggtgactcagggaagaagaaggccaaggttttggagcagattgatgtgaggaagctgaatcgctcccaccgtgaacgcctcgtcaaggatgctttggcaaccaatgaacaagacaattacaagctcctctctgccatcaaggaacgctttgacagagaaatgagacctagtgtgcgtttggaaacccatttgcatcattgcaacaagaatttccacttttcaaagcataaaaatgagaagcaagaatatatagtttttctgttgagcagaagacatttgcaaggtttccaactagaaaccaaacacacggctagggttggattggatgtaccaagtatcgaagtgagatacaaaaacttgacaattggagctgatgttcaaataggttcaagagctctgccaactttgatcaattacacgcgagatgtctttgagggtatgataactggcatgggaataggtcgacctcaaagacattccttgaccatcttgaataatatcagtggtgttgtcaaacctagaaggatgacgttgctgttaggacctccaggatcgggcaaaactaccttacttttggctcttgcgggaaagcttgaaagcaacctcaagaaaagtggtagtataacatacaatggccatgagcaaaacgagttctgtattcaaagggcttctgcatacactagccaaactgataatcacatagcagaactgacagtgagacaaacttttgattttgctaacagatgtcaaggttcaagtgatgtagaaattgtgaaaaatcttgaacgcttggagaaggagaaaaacatactgccaagtccagaaattgatgcattcatgaaggcaacacttgttggtggcaaaaagcacaatgtgatgacagattatgttttgaaagtgcttggtcttgatgtatgttcagatacggttgtaggaaatgatatgttaaggggggtctctggtggccaaaaaaggagagttacaacaggagaaatgattgttggaccacgaaaagctctatttatggacgaaatatcgactggacttgatagctctaccacattccagatagtgaaatgcataagaaattttgttcatcaaatggatgctactgttctgatggctctacttcaacctgcaccagaaacatttgagctctttgatgatcttctgcttctgtcagaggggtatgttgtatatcaaggccccataaaagatgcgctggagttttttgaatcattaggcttcaaacttccatcccgcaagggagttgcagattttcttcaagaggtgacctctaaaaaagatcaagctcaatactgggctgattcttcaaagccatataaatttatttcagtgccagagattgcagaagcctttaaaaattccagatttggaaaatctgtagaatccatgtgtactgctccctttgataaatcaaagagtcatccttcagctttgcccacaactagatttgctgtgccaaaatgggagctctttaaggcttgtttctcgcgagagttgaccttgctcaacgggcataggtttctctatatttttaggacctgccaggttacatttgttggaattgtcacatgcacaatgttcattcaaacaaaatttcataataaggatgaggaatatggcaatctctaccaatctgcactatttttcggactcgtacacatgatgtttaatggctattctgagttgacactcatgatagctaggctacctgtctttttcaaacaaagaggcaatttattttatcctggatgggcatggtctttggccacttggattcttggtgtaccttattcccttgttgaagctgttatatggtcttgtgttgtatactacactgttggatttgcccctgctcctggaagatttttccgctacatgcttttgctatttatgcttcaccaaatggcattaggtctcttccggtttatggctgctcttgcacgcgatatggtcattgctaatacatttggaacagctgcattgatgattatcttcttgctgggaggatttattatcccaaaaggtatgattaagccatggtggatttggggttactggttgtcacctcttacctatggtcaaagagcaatttcagtcaatgaatttactgccacaagatggatgcagcattcggcttttgggagcaacacagttggccttaatattctcaagggattcgatataccagctgaggattactggtattgggttggtttgggagttttaacactctacgctcttattttcaactgcttggtcactttgggcttgtcctatctgaatccactccaaaaagcacgtgccattcttcttggtgatgaagacgattcaaaagagagttctaataaaaatggatctaaatctagtggtgatgatggaaaagccaagggaatgagtcttccttttgagcctatgacaatgacattccacggtgtcaattattatgttgatatgccaaaggagatagcaaatcaaggcatagcagaaactaggctaaaactcttgtcaaacgtgagtggcgtttttgcacctggtgtccttacagctttaatgggatcaagtggagcaggaaagaccactttgatggatgttcttgctggaaggaaaacaggaggatatattgagggtgaaattaaaatatctggctatccaaaagtgcaacaaacatttgccagaatatcaggatatgtagaacaaaatgatattcattctcctcagctgacagttgaggagtccctgtggttttctgcatcattaaggcttccaaaggaagtaagcatggagaaaaagcatgaatttgttgaacaagtaatgaaactagtagagcttgatagtttaagaaagggtttggttggaatgcctggtacttctggtttatcaacagagcagagaaagcgactgacaattgccgtcgagcttgtagcaaacccttccataatttttatggatgaacctacatctggacttgatgcgcgtgcagcggccattgttatgagagcagttcgtaatacagttgatactggtagaacagtggtttgcaccatacatcaacccagtattgacatttttgaagcatttgatgagttacttctcatgaaacgtggaggacgagtcatatatggagggaagattggcaggcaatcagatataatgataaaatattttcagagtattaaaggaacctcctcaatccccagtggctacaatccagctacttggatgcttgaggttaccacaccagctgtagaagagaaacttggtgtcgacttttccgaaatttacgaaagttctgaacaattcaggggggtgttagcctctattaagaaacatggacaacctcctcctggctcaaaaccattgaagtttgacacaatatattcacaaaacacatgggcacaatttctcaagtgtttatggaagcagaatctagtgtactggaggagcccaccgtacaatgcaatgaggatattctttacaatcatatgcgccttcatattcggtaccatattttgggacatcggtactaaaaggcaaactacgcatcaagtgtatgtcataatgggtgcacttttttctgcatgccttttccttggagtcaataatgcatcttctgtacaacctgttgtttcaatagaaaggacagtgttttatagagagaaggctgctggaatgtactctccaatctcatacgcaatagctcaggggctggtggagatcccatatgttgctcttcagacaatagtatttggtgtaatcacatatttcatggtcaattttgaaagggatgttggaaagtttttcctctatcttgtgttcatgttcctcacatttatgtacttcaccttttacggcatgatggctgttggcattacacctacacaacactttgcagctgttatttcttctgcattttactctctatggaatcttgtatccggatttcttattccaaaatctcatatacctgtatggtggatgtggttccattatctctgcccagtttcttggacactacgtggtattatcacatctcaacttggtgatgtggaagaaatgctcgtgggacctggatttaaaggcaatgtgaaagaattcatagctgctactcttgaatatgacactaaaattaatggaatgtcatcagtgttgct

SEQ ID NO: 94185 - DNA, 2292 bp, Glycine max
  Peptide Sequence Number=SeqID_210963
atggtagggaatggtcaatacttggagtgtacttcgatttgcgacgccattaccattcatatccagcaccacacctttgtcgtctacctccacgtgcttcccatctctggttccaacattgtcttagggggtcaattggtcacgctgcaaggtgatcccgaggctaacctgagctcgttgacctcatctcaatttcgtcgtctgtgcagaacacagaattccgggctctacttccacatcaccattctctcggaggattccacttcttcaccaaagactttggctccttcgattcacgtcttgctcaccaagtacaccgccctctttcaacctcctcagtcgctaccaccggcacgcaccacagatcatcacattcacttattgcctcagtccacgccgctgaacgtccggccatatcgttacccacattttcaaaagcaggagattgagttacaggttgactctatgcttcagaagggcttgatacaacccagtaccagtcccttttcctcgcctgtgctcttggtcaagaagcacgatggaacttggcgtttttgtgtggactacaaagctctgaattcacttacaattaaggaccacttcccaattccaaccattgatgaattgctcgatgaattggggggagcacaatgctttccgaagcttgatctcttgcagggataccaccaaatacgaatgcattctgaggatatacctaaaacggcctttcgaactcatcacgggcactatgagttcagagtcatgccatttggactctgcaacgccccttcctcatttcatgcgacaatgaatttgattttccgagcatttcttcgtcgttttgtcatcgtcttcttcgatgacatcctcatttacagtggcacctttgaagatcacttacgtcacctggacatgacattccaggtactccttgataatcaatttgttcttaagatgtctaaatgttcctttgcgcagacgcaggttgagtatctcgggcatttggtctcagggagatggatggaacccgtggcgaagaaaatagttgccattgttaactggccccaacctcagtcaacgagagcagtgcgtagtttcttaggcttagctggcttctatcgtcatttcattagaggttatgccatgattgctgatcccttggttcgagttaccaccattgaaccttttcattggacctctcaggcgcaacaagcttttgagaacctcaagactactttatccacagctccggttctggctttaccgaactttcagcttcccttcaccatcgagactgatgcttctggcagcgctgatgtcgccaacttcgtagctaactgcactgaatgccaattcacgaaatatgaaacgaagcgtgtcacgggcttgctgtgccctcttccaatcccgttcaggccatgggaggacctctcccttgacttcatcactggtcttccatccttccagggcaaaatggtactcttagtggtcgttgaccgtttctcgaaggggattcacttgggcattctacctcaggcccatacggctcacatggtagccttgttgttcatcgatattgttgtcaagctctacggcatccctagaagcttagttttagatcgggatcctttattcatcagtggcttctggcaagagctttttaaattgagtggcactcatcttcgaatgagttctgcctaccatcctcagagtgatggtcagacagaggtaatgaacagagtgattgaacaatatctgcgcgcttttgttcatcgtcgaccggcaacatggggcaagttcctaccgtgggttgagttatcccataatacttcgtggaacagtggtacgggttcgacttcctacgagataacattcggacgcaaacccttctcctttccagactacctggcgggctcctcaaagcttgacaccgtggatgatcttctaatggctcgcgatgaagtgtttactagcattcgccggaaattgctcaaagctcaagcttatatgaagaaaaccacagacactaaatgtcgagaagtgacttatgatcctggtagttgggtcctagtgaaattacgcccttactttgcctatcgtctgaaactaccggagactgcccgtattcatccagtgttccactgctctctcctaaaacctttccatggtgacccagattctggcgcagctgccccacttccggaacattttctcaatgatcagccactcattacctcgctagcaatattggattatcgccgccacacagagaagggatcttgggaaatgctc

SEQ ID NO: 94186 - DNA, 732 bp, Glycine max
  Peptide Sequence Number=SeqID_210964
atgggaaagggatcttttcaggactctgttaaagctctggaagctgacattcagtatgctaataccctggcattaggctatccaagggacaaagatggaggatgctttcagatgaggatatcatacagtccagcagcccctctttttctgtttcttgttcaatggaccgattaccgcctcgccggtgctctgggtttgctgagaattctaatttatgtgacttatggaaatgggaagaatactatgtcaatatatgaaaggaaagcaagcattagacaattttactcgattatatttcctgctctgttgcaacttgagaaaggcatcacagatttggaggaaaggaaacagaaagaagtatatgcccttagataccaaaggaaaagtgagttcaatgagagaagacaatctgaaattgacattgaaagagaagaggaatgtggagtgtgcttggaggtgaaagcaaaagttgtgcttcctaattgctgccactacatgtgtttgaagtgctacagagattggtgtcagaggtctcagtcttgccccttttgccgggatagcctgaagagaaccaactctggggacctttggatttacactgacaccagtgacattgttgatgttgggacaattttcaaagagaattgtaagatgctgtttctgtacatagagaagctgcctctaattgttccagatcccagatatgtgttctatgatccacttctgagatga

SEQ ID NO: 94187 - DNA, 384 bp, Glycine max
  Peptide Sequence Number=SeqID_210965
atgaaggccttttcaagtgtctctgcttactgtcaacatctcaagtcactgttgaatcaactcaagaatgccggcttttcggtcgataacagtaggttggttctgcaattggtgttcggtctcactgaatcctacaagagagtggccacactcatccgtcaaaaattcggccttaagaaggcggctcagacctcgtcctccgccatagtggctcgtgactcgaatgaatctcaagagatgtctgatcattcatcagcatgctgcacaaataatggtggaaaacggtattcaaaccatggcaattctagaaagaatcgcaacaacactggtggtcatgataactcaggcgttgacaagggaggctctggttcaaaaacttattaa

SEQ ID NO: 94188 - DNA, 468 bp, Glycine max
  Peptide Sequence Number=SeqID_210966
atgggtgtgggtgcaagttggggcggtggcaaaggaggtggaaatggagacacagtgggagagacacgctggagaagctcatcaatcttcagggtcatggcattgacagactcacctaggtacaactgttgtttggtgaggcgactgaggacatcctcaagtttgtcaaaggagaaaggaggggcttcaggatcaggcatggtgaaaagcaacgagagcaccaaaattgataaggggctagggcctccagtgaagaagaaggaacttaagcagaattggttatggatgcatcctagcaggggacaactagaatctagcaaatcctgcattgccagctcagctcctcatcacttgtattgcaattcaagcgtaatccctgaggaaataaggaatgaatggagcaattttgaagcccatggaaagtcaaagttgacatttttgttcaacgtcaccaacctagctgcttag

SEQ ID NO: 94189 - DNA, 273 bp, Glycine max
  Peptide Sequence Number=SeqID_210967
atggataaggaagaccatgaagagagggtacatagaagagcacaattttttatctacaaagtattagagaaagcagattctcgtagaaagccatcatgcgtgaggattagaatggtgaagctgaagattaagataggaaatggcttgaggagtatcaagaaggggattttctctagggctggttttcatggacaatttatgatgggtcaggtgaaaacattgaagagtttgatgattggcctaagacagaccatgaaattttgtgtctgttaa

SEQ ID NO: 94190 - DNA, 138 bp, Glycine max
  Peptide Sequence Number=SeqID_210968
atggaaactgtgctggttgagtttagtccaacaagagaaatctgcggacgatgcttgatcagaattaggctaaattatcatgaggaatcagggtttagtatctctataaacaccataggaacacatgagcattgttag

SEQ ID NO: 94191 - DNA, 432 bp, Glycine max
  Peptide Sequence Number=SeqID_210969
atgaagacgaatgaagaacgtcgaagaacggttgaaacctttgcgaaattcttcacggaaaacgttatggaaacgttttggaagcgcctcggcttagattttcttcacggaaacaatttttccaagcaaattcgaaagagagagaacaaaataggggaggtggttgccgcccagctcgcccaggcgagccaggttgcttcctccagaagcaacagccttctggaggaatattctggagggcccaagtgggcctgggtgctatttgcacccccatttttactaactccattggagcttgtaggcctaggatcttcttcatcgatggattcctttgctttgtggaagatgaatggcagcagaatggagaaggaagagagagaggagacgccacttcaaggagaagatgagtctagaagaagctcaccaccatag

SEQ ID NO: 94192 - DNA, 446 bp, Glycine max
  Peptide Sequence Number=SeqID_210970
gccaacgaagcggaccatgtctcgctaagtggccaatggcttctaggaaatgtaaaagtattggttcaagacccacaacacagtatgacacaaggagattctcttccttagatgcttggaccagatacacagataatgttctagggagaaacattttacctaagaggaaggtagagctctatcacactgagctagatgactttaaggctgaattggagaggcgtcatttggttaagattgatgctaacagtctcaacacattcctagagacacctgtggtattagttgagggagagactctacccgtatactccagatactgcaggttgcctacagactttagagagatagaggctgccttatgcatacttggccgagggttcatcttgaactctaagggcaatcctaggaagattctcaggaaggatttgactacactagctcaa

SEQ ID NO: 94193 - DNA, 960 bp, Glycine max
  Peptide Sequence Number=SeqID_210971
atgtcctcgcattcagagcactacacgtcctccccttcagtggagtacaatcctcaccttccgaggactacacatcctcgccttcagaggactacacgtgctcaccatcaggggactacccatcctcgccttcagagggctagatgccctcaccttcagaggagtacacgtcctcacctcaagagggctacacgccctcaccttcagaggactacacgtcctctccttcagagggctacacgtccttgccttcagagggctacacgtactcaccttcagtggactacacgtgctcgccttcagagaactacatggccttaccttcagagggtacatgccctcaccttaaaaggactacaggtcctcgccttcagagggctacacaccctcgcctttagaggtgtacacgcccacgcctttagaggactacatgtcctcacctttagagcactacacgtcctgaccttcagaggccaacacgccctcaccttaaaaggcctacacgccctcgccttcagagggctacacaccctcaccttcagaggactactcgtccctgccttcaaaggactacacgtcctcactttcagaggactacacgtcctcaccttaagagtgctacacacccttaccatcagaggactacacgtccccgacttcaaagggctacacgtcctctcctttacaggactacacgtcctcaccttcagaaggctacacgtcctcgccttcacaggggtagatgccctcaccttcagagtactacacgtcctcactttcaaaggactccacgccctcgctttcgtggggctacacgccctccccttcagaggacaacatgccctcaccttcagaggaataacggttctgaccttcagagggcaacacgccttcaccttaaaaggcctacacgccctcgccttcagagggcaacacacactcaccttcagaggattactg

SEQ ID NO: 94194 - DNA, 684 bp, Glycine max
  Peptide Sequence Number=SeqID_210972
gtgccagtggaaggtgttgagcttgtgcgcggccatcgcgtcgagcacgcgcttgatctcgtccaggctctggaagtgacgggcggagtcgagcatgaagccgcgccagctgaagcgcggcgcgtcctggatctgcactgcgggcagcacgccgttgctgccgccggtggcgagctgggcgagggtggtcgcgccgtagaacaggccggtttcgttgccagcctgcaccagcacgccctgtgcggtgctttccagcgtgtagccctcaccgctgtcgcggaaggtgggcacgatctggaagcggatgctgccggccttggcgctgactttgcccttggccagtgccaggcgcgggccaccgctgcgggccagcaggtcggcgaactggttggcgacgcgctgcgcggcttcgccttcggcctgcagcacggtatcggcgcgcacggtgatgccgctgccctggccgcgctgcacggtggccggggcgggaatcagcatcaggctgccggcgcgcagctgcgggccgggtgcttcagcggcaggcgtggggtcggcggcaagtgccggcagcgccggcaacggggcgagcaggctgcccagcagcactgcgctgcgcatccgggcgcgggaaggcttgaccatcggtacgactccttggaacggtgcgatgaacgctatacatga

SEQ ID NO: 94195 - DNA, 363 bp, Glycine max
  Peptide Sequence Number=SeqID_210973
atgaaggaagcctctagaaataatcttcacttaggatctacagcaaccattgttttggtagcagataataacattttggttgccaatattggagactttaaggccatcttggatattggggtggaaacaggtggtggtcaagttcaaaattggggtggtgtgcctcgcataaatggtcagctggctattacacgggctattggtgatatactctttaaaagttatggtgttatatatgcaccagaagtgattgattggcagcctctgactgctaatgatggatatttggtggtagcatcagatggtgtatttgagaagatgaatgtgcaggatgtttgtgatttgttgtgggaagtaacatga

SEQ ID NO: 94196 - DNA, 318 bp, Glycine max
  Peptide Sequence Number=SeqID_210974
atgacagacaggcagagtgggccccaatccgatccgtttgatgtagaaatgggagatcacttggaggatatgattcgtgaccttggacaagagtcttttcagcatgcacatgcccctgtgtatgaaggattgcagagtgactcaaagaagccattgtatctggggtgtaagaattccttgacgctgttgtcagtggttttaagtctggttaatgttaaggccagatatgggtggagtgacaaaagctttacttcactgcttcaagtagtgcatgatctgcttccagaggaaaacacgttgcataaaagctactattag

SEQ ID NO: 94197 - DNA, 381 bp, Glycine max
  Peptide Sequence Number=SeqID_210975
atgaaaccaattgagctgtattattccctatgggttggcctatccattctaaaatgctactctcttgggaataacatcatcgagttgtacaaaatgagatcactgatgttttgtacacctccaaaagcaaaacttaccaagacacaacagacacgagaagaggaacaaagagtgcttcggtgccaatggctgcaaggaaagcaacgtcacagcagacacgaagcaagaaagcgtgacgatggcagtgaagagggtggctttgcgaccagagcacgaccaaggtggctttgcgagactctgcatggtgggtcaaggacaatggcaatgaagagggtggctttgcgagactcagcttgggggggtcaggggcaatggcaatga

SEQ ID NO: 94198 - DNA, 967 bp, Glycine max
  Peptide Sequence Number=SeqID_210976
atggagaatcgctccttcgaccacgtcctcggctggctcaaatcctcccggcccgacatcgacggtctcaccggcagcgaatccaaccctctctccgtctcctccccctcctccgccacaatccccttcactgacgacgccctcttcatcgacgccgaccccggccactccttccaggccattcgcgaacaaatcttcggttccaacgacacctctgcagtccctcccccaatgaacggcttcgcccagcaagccgagtcaatcctcctgggcatgtccaaaaccgtcatgagcggtttcaaaccccacaccctccccgtctacactgctcttgcaaaccaattcggtttatttgacaaatggttcgcctccgttcctgcttccacccagcccaaccggttctacatccactctgccacctctcacggcgccatgagcaacgtctgcaaggacctcatccacgactttccccagaaaaccatcttcgactccctcaacgagaatgacctctcattcgacgtctactaccagaacatccccgccacgctcttcttcaagagcctgcgcaagctcaagaatgcggtaaagttccacgactatgccttgaagttcaagaagcacgccgagaaggggaagcttccgaactacgtggtggtggagcagaggtacttcgatgtggaggtttttccggcgaacgatgaccacccctcgcatgacgtggcggccgggcagatgttcgtgaaggaggtgtacgaggttttgaggaagagtccgcagtgggaggagatggcagtgctgattacttacgatgagcatgatgggttttatgatcatgtggcgacgccggtggaaggggtgcctaaccccgatgggatcgttgggccccacccttattactttcggtttgataggttgggggtgagggtgcccacgtttattatctcgccttggatcgacaagggtaatg

SEQ ID NO: 94199 - DNA, 858 bp, Glycine max
  Peptide Sequence Number=SeqID_210977
atgattgtcaaacaaagtttgcaagcagaaaatgaacaagagcagccacacctcctcacctcaatcaagctaaacaaagatttgttgaagagtgaaccccccattgatcatgatcacagtgaagcaaagaagagtgatcaaccctcgcaattcctttgtggtatatgttttgatgacaaaccactgtctgatatgttcaaagatggcaagtgtaaccaccccttttgcactcactgcatatcaaaacacgtggtgactcaaatacatcaaagtattctcaaggtcatttgtccagaccccaactgttatgtggaatttaagcctgaatatttgcgtaccatcttgccttgtgatgtcattgatagatgggaatgtctgagacgtgagtctttgattcttgggtcggagaagacttactgcccttttaaggattgttcggttttgttggtgaatcagggaggagaagttgccaccagtgctgagtgtccctcttgtcataggcgattttgtgcacattgtaaggctccttggcatggaaggaagaaatgtaaggaattccaaagggtgaaaaagaatgaaaaaaagttggataagaagtttttcaatttggcaaaggaaaaaaattggaagaaatgcccccactgcactatgtttgtccagagatgtggtggatgtgaccacattgcctgcaggtgtggatgcaacttctgctacatttgtgggaagaattggaaccctgaacatcgatgcatgataatgaggagaatagtttacgacctttatcagagaactgtgggttggttcaggcgtgccaatttgcgtttttcggggggccgaaattcgtcaatgaattggtga

SEQ ID NO: 94200 - DNA, 279 bp, Glycine max
  Peptide Sequence Number=SeqID_210978
atgtgcctattcctaatatatgttggataccttggtgctgtgatgtttgcttatggtgttgatatgggatattgcaccattgctcaggctgaattatgggcaatttatttgggaatgaagattgcctggagaagggatgcttgctatgctctgattcagaagattcatgaatttaggaggcttgaagggaattttgattggtctcacacgttcagagaaggaaaaaaagttgctgataaagttagtaaaactatgattattcgcctgaggatcaactga

SEQ ID NO: 94201 - DNA, 843 bp, Glycine max
  Peptide Sequence Number=SeqID_210979
atggtccttttactctcactcgtgacttccaaaactcaccatgccctatctctccgcgaacgcttcgccgccatcgtttccaacttcaccacctctctctccgccgctccttccgacagcccttgccaccatggggcgagaagaagaatggtgatcaactcttcaacagccacgttgaccgacggcgacgagaagaaaaaatcccccctgctttgtcatcatgatcacgataatgaaacaaacaagagtgaccagtcctcgaaattcttttgtggtatatgtcttgatgacaaaccagtgtctgatatgttcaaagtgggtaaatgtgagcactccttttgcactcacggcatatccaaacacgtggccactcaaatgcaccaaaacattctcgtggtaatgtgtccaaacccaaagtgttcgatggaattgaagcctgaatatttgcatgccattctgcctagggaagttcttgttagatggaaatgtgcgatgtttgagtccttgattgttgagtcggagaagacttattattactgcccctttaaggattgttctgttttgttggtgaaaaatggaggagaagttgtgactggtgctgagtgcccctcttgtcataggctgttttgtgcgcagtgtaaggttccttggcatgaaaagatgagttgtaacgaattccaagagttacaaaggaagataaaaaaattggatgaaatgtccccggtgcacgagctggatgtgcggatgcagcttctgctgcatttgtgtgaagaacgggaagcctggacatgtatgcaagaagtgatggcattggcaagaaagatttttgagttctacagttaa

SEQ ID NO: 94202 - DNA, 159 bp, Glycine max
  Peptide Sequence Number=SeqID_210980
atgtttaaagatgaaatagaagatgatgaagcttcgagcatggtggggaggtcattaaaggtaataaaccttcaagactatggtgaaccaactgcaaatcatgggcacgatccatggaagggggctagttggggaggtaatggagggcgaaaaggctga

SEQ ID NO: 94203 - DNA, 1521 bp, Glycine max
  Peptide Sequence Number=SeqID_210981
atggcttggttaagaaacctctcaaagtttgccaccaagagagcatcatcatctcaaagacccaaaaacactgacccattttgtcttttaccctccttcacttttctctcccacttcagcagcaccaacaccattgaggagaaaccttgtgtggagcctgttgagtacaattattcgggcttggagccaacaaggccccatgagaagccacgtgtggtggtgctgggttctggttgggccgggtgcaggctcatgaagggcttggaccctcgtgtgtatgacattgtttgtgtctcacctcgcaaccacatggtcttcacccctctattggcctctacttgtgttggaactcttgagtttagatccgttgctgaacccattgggaggatccaaccagctatttctagagagcctggttcttatttcttcctcgccaattgtacacaaattgatgcacataaccatatggtgcactgtgagactgtaaccgaaggagtagagacaatagctccctggaaattcacaatctcatatgataagctggtaattgcattaggatcacaaccttccacttttggaattcaaggagtcaaagaacatgccatctttcttcgtgaagttcaccatgcacaggaaattcgtaggaagctgctcctgaacttgatgctgtcagatgttccagggatttcagaagaggagaagcaaaggcttttgcactgtgtggttgtcgggggtggtcctactggagtagaattcagtggtgagcttagcgattttattacgagagatgttcgtcaaagatatgtccatgtaaaggattacatccgtgtcactctaatcgaggcaaatgagatattgtcttcctttgatgatcggcttaggcgctatgctaccaagcaattgacaaagtcaggagttcgtcttgttcgtggcattgtgaaagatgttaaacctcagaagattgtccttaatgatggttctgaggttccatatgggttgttggtatggtccactggtgttggtccattgcctataattcaatctttggatctccccaaagctcctggtgggaggattggtgttgatgagtggctccgtgtttcttcggtacaagatgtgttctctataggagactgcagtggatttgttgaaagtactggaagacaaacacttcctgcattagcccaagttgcagagaggcaaggtaaatatttagcagctctattaaacaaaattggtaaagcaggtgcaggccatgcgaacagtgcaaaagaaatagagtttggggatccatttgtttataggcaccttggaagtatggcatctattggtagatacaaggctcttgttgaccttagacagaacaaggaggcaaaagggttggctctggcaggatttctgagtttttttatttggcgctcggcatacatcacacgtgttatcagctggaggaacagattctatgtatttgtcaactggattacaactgtggtatttggccgtgatataagcagattatga

SEQ ID NO: 94204 - DNA, 186 bp, Glycine max
  Peptide Sequence Number=SeqID_210982
atggaggagggtgtcggagggacgggtcttgtagtgaatagcgacggatttgcaaatatcatcgacgcaagagtaggagatgggaactttgaggaagaacttcgaggggagaatgtggtgctccatgtcggggtaagagatgtcgatggcgttcatggattaaagtatcctatgagcgtgatataa

SEQ ID NO: 94205 - DNA, 1012 bp, Glycine max
  Peptide Sequence Number=SeqID_210983
agctttgtatgatctggatggggagcctgtatggggatacaaacatggtggggcaggaggattcaaacatgaaaagataatctttgattttccatatgaagttctcacacatatatctggctactatggatctctgatgtacatggggccagctgttataaggtcacttactttccacaccaccaaaaggtcctatggaccatttggagatgaatatggaacttatttcacaacaaagctgagagaagggaaggttgttggtattcatggtagaagcggcttatttctagattctctcggtgtgcatgcaatagaaggaaaagtaattgtgccagtggcaacatctccttccatggaaatcatctcaagagaaccaagtatttcggaaatagacaatcctcaatggctagttgttgccaaaccagccccagttgaacagcattatgttgaagaggatattctattcacttttgctccctatttcacatcaaaggcttcacgttgtgtgattaaagaaccagctccatgtggaccaggtccatggggtggggatggaggtagaccctgggatgatggagtcttttcagggattaagcagatttatttgacaaaagcacctgaaggcatttgctcgattcaaattgagtacgatagatataagcaatctgtatggtctgtaaagcatggtggtaatggaggaaataccatgcatcggataaaactggagtacccaaatgaggttctcacttgcatatctggctattatggttcagtcactgctgatgaacaacctataatcataaagtcactcacattccatactagtcgaggacagtatggtccatttggtgatgaagtagggaaatacttcacttcaaccacaacagagggcaaggtggtcggtttgcatgggaggagtagcatgtatttggatgccattggggtccatatgcaacattggctaggaggaattcagaaaacttcaaagttatcctttttcaagctattttga

SEQ ID NO: 94206 - DNA, 522 bp, Glycine max
  Peptide Sequence Number=SeqID_210984
atgagaaagagaagttactttgaactgtgcgagcttcatgtccctagcgaggtcggacaccttcttgcggaggtcgtcgtcatcgccggcggcggggagggcggaagcaaggagtgcgagccagccggcgatggcgacggcgcgttcttggagggcggaagagaggattttgcaggtgacaaggacgagtatcttgcttccgttgttgtagacggagacggtctcggcggccttggagagctcggcggagagtcccttgagggcggtgtggacgggcggggagtgcgggagcgggagaaggaggaggtgggagaggcggtgggcgaaggaggcgaagcggcggggcgtgtcgaaggggcggcggtccggcggggaagtggagatgtcggagagggagatgcgaatggagtggagggtgggcggcgggggcggggaatagtggatggacattgtgtcatggttgtgttagaatggaagggagaggtatacattacagaatatgagcaagaagccagactttga

SEQ ID NO: 94207 - DNA, 1881 bp, Glycine max
  Peptide Sequence Number=SeqID_210985
atgcttgaacggggcactactagattggccatacatagtcttattgggaactctgagaaagagagagaacatgctatcaagttattactagagttctgcaatgatgaagattgttgcgtaagaattgcatcagaaaaaggtgcattagttcttctctcaagtatagcaggaaatatggagtatccatccttgtccaatttagctgaggaagtcttaaggcagatggagagggtagaggataatgttcaatgtttggcagcagctggaagatttggaccattgatttcacggttacatgatggctctgttggtgtaaagatagagatggcttctctggtgggaaggatgaccttgacaaatagctgtaaagaacaaattgcaaggcaaggtgccagagtatttgtcgaacttttgtctaatcaagaaggaagcggaccaagccttcaagcattgtataacttgtcagggttggatggcaatgcaaccatccttattgaatcttcagtccttccatctcttatagaagttttatttgatgagaaggatccatcatatgagctgaagtcattagctgcttcaacaattgcgaatattgtatctaagccagggcattgggaattagcatctgctgacaagaaaggaaacccaatgcagtcagaaattgttgttttaagacttttggggcttttaaacagtttgccctctcagtgtcaagtgatagttcttcgcattctttgtggtattacatcatctcctcaggcatcagagttagtagccagtcatatcacgtccaagggtggctttggatcggtcataccatttcttgaacatccagaagttgaacatagagtgtttgctttcaagctaacaagactaatatctgaatggtttagtcaatatattgcaaatgagttgagactgtcaaacaaacttacggtactcaaagaaaagctgttaaataaccaatctacaagtgatgagagatcagatgcagcacagatacttgcaaatttttccctctcagaaggtgaaatacagacacttttaggaggtgattttgtggaatggactgctgttactcttaagaaccagcggcgcatttccaatgcaaggtcttcttatactgcatcaggcatgcaggaaggtcttataggtctcttgcttcacttcacaaggaaccttgatcaacaaactcttaatatagttagagaaaatcgccttatgggtattttctgtgagcagctggattatacttcaaaagcaaaggtgaaacaactcgctgccattggattgaaacacctatcagaatttggaaggtcagttactgctagggactctaaaccaccatcttccagtgggttctgctctttcttcgtgctcatgtgtgggaaagcctctagtcaaccttccatgtgccccattcacaactgcctgtgtgacgaagatagtcagctgtgcctgcttaagagcaactgtatcaaaccccttgttgacatcctccatgacaatgacactgatgttcagcttgctgcagtggatgcactatctactctattactagattacacgtcttgcagtttcaaaagagttgtggatgagcttgagcatctgggtgcaattgattctcttatcactctctttacagaagttagatctgaggagcttcaagagaagacaatttggatgatagaaaagatattgagagtagacaatgtcagcgatcggtatgcactcaatcattctcttgtgcgagctttggttgaatcctttaagcatgggaataccaacacaaggaaacatgctcaagatgctttaaccctcctaaagcagttatcaggagttagtggaaagacatcaagtcaaactcgagctagaagatag

SEQ ID NO: 94208 - DNA, 849 bp, Glycine max
  Peptide Sequence Number=SeqID_210986
atggatgagaacgaagagagggtttggtgcacgctggaaaaggaaggggaagggagagagagcagcaaagcagttcagagtggtattgtcatggatttggctcgtgctttggggtttgagcctggtgatcgtgctgagttttgtaaccaagtgaagctcttcaaaggtgatccttttagatcccattctgtgcctgagagaagggtattgatgtccttggagaggattcttagtaactggtctgtggagcctgtccctgtgagccctaattgggactttgaaattgttgaagatgctgctgctcctgtttttgcgtttaagagtttcctctgccccttgaccaaggaagtcatgagggaccctgtggttgttctggagtcctctcaggcctatgagaggactgcaattgagtactggtttgaacggtgcatccaggacggccgtgaccccacttgtccggtcactggcagggttcttaagtccttggagctgaagcctaatattgggttggctggagcaattgaagagtgggttggaagggttgttgagtatcaaatcaaatctgcagtgcagtatctgagtgaggatcccttgtctgttgatcatgttgagcgtgctctggatcatgtttttaaggtttctgaagagcaccccactagaagatacataatcaggaatgctggtgttgtgcagctgatagtgactgtgctcagtaataactccaaaactattggatcgcatttgagaagcaaagctctaatgactttacttagcttggcagaggatgaagaaagcagggtcagttttgtttatctttctatgcttattttcgagtttttgcatctttaa

SEQ ID NO: 94209 - DNA, 411 bp, Glycine max
  Peptide Sequence Number=SeqID_210987
atgaattcattgcctagcgctgttcatgtgtcctccaccatcgtgtctggagccccgcgaattctttgcctagcgatgttcgccaattcttcattctccactttcattcagagccccatgaatttattgcttagtgctgttcatgcatccgccaccatcgagtatggagccccacgaagttattgcgtagagcgctgttcatgcatcctccaccaacgagtctggagtcccgtgaagttattgcgtagcgctgttcgccaattctccattctccacttatttcggagccctattaatttattacctagcgctgttcatgcatcctccaccaacgagtttggagtcctgcgaagttattgcgtagtgctattcgccaattctccattctccacttttttcggagccccatga

SEQ ID NO: 94210 - DNA, 315 bp, Glycine max
  Peptide Sequence Number=SeqID_210988
atgctcgaacaacgcttgaaaatcaattcgtggggctccggactcgatggtggaggatgcatgaacgacaatcaattcatggggctccggaatagatttgatgatggaggatgcacgaacagcgctaggcaatcaattcgtggggatccggactcgatggaaatcaattcgtggggctccagactcgatggtggaggatgcatgaatgacaatcaattcatgggactccgaataagatttgatggtggaggatgcacgaacaccgctaggcaatcaattcgtggggctccggactcaatagtggaggatgcatga

SEQ ID NO: 94211 - DNA, 159 bp, Glycine max
  Peptide Sequence Number=SeqID_210989
atggttagagcgttgcttacgacccatggccgaccaataggcgaccaagtccaaagccaaagtcatagcaggacacacctagttgctcatgatcctaggaatttaaataaaacaagcacaagctcggaaggtagaaagataccttggatatgcatgtag

SEQ ID NO: 94212 - DNA, 279 bp, Glycine max
  Peptide Sequence Number=SeqID_210990
atggcaatcatcgcacggtggccgacgatggtcatgggggccagattcgagccttgcacaaccatggggaccaattcgaaggcatgcataaggagagggaagacaaagggagaagagagcttgggcgaagaagggaggtcggggacaaaggaggggtgtacaaatagcaaccagccttccaggatattccaacaaaaggcggtgccttctggtggaagcaacccagctcgcctgggcgagctgggcggcaaccaactccctcttttcccctataaatag

SEQ ID NO: 94213 - DNA, 510 bp, Glycine max
  Peptide Sequence Number=SeqID_210991
atggaggttctaaatgcaaaagcagttgttccttcaaattcatacggatcgcctgctgatagtgttgatgagtatgtcagaattagtgaaagcactgtagctgaatgcttagaagcttttgtaaagggtgtgaatgatatatttggagatgagcatctacgaaggcctgacaacaacatcaattgcctactacaaattggagacgcacatgggtttccaggttcgatgacactggaaagtgaggagaagaggtggttgttcatattcgcggtggtgcgacttgacaatgtgggtgttattggcgctcaccatgttagcgaggacgaatgcataacttgtggtcgcaatggtcaacactatagatctagaggcaccgttgaattggtgaatgctgacgccattaaatttgagcttgaggagagtgatggtggtgcagggcagggagaggttgaggatgggtttctaggcaagggtgttgatgcaatcctaccccctaagggcattggatag

SEQ ID NO: 94214 - DNA, 273 bp, Glycine max
  Peptide Sequence Number=SeqID_210992
atgtcgcaacctacccttcggcgggagggcgacgcgagactcacgggtgcatcttccaagggaggaaaacgcacagagtcgccaccaacgtttattcgaggaaaacgtcagaaaaaccggaaaaggcgtgatctacgagctttgagtgtgaaaggttcgggagttgtatttacgcacagggaagaccgaagaacgaatgaagaacggtggaaaagcatcgcgaaatcgcccacggaaacgtctcagaagcgttatggaagcgcctcagcttaa

SEQ ID NO: 94215 - DNA, 660 bp, Glycine max
  Peptide Sequence Number=SeqID_210993
gatgccaaggagcaaccatcattggtgattgtgtactttggtggtaatgattctactcttccaaatccaaatggccttggtcctcacgtacctgtagaggaatacaaggaaaatatgagaaagattgctatccatatgaagaaattcttgagcagcgtgtgcttaaaacttgatcttatgttgatggttgctaagtttgatacaaatcctaatgattggcagtgcctttctgagaagactcgcacaatatttctcactactcctcccatcaatgaggctcaaatccataacaacagtgatccacatggcctgctactaaggacaaatgaagcttgtctaatatatgcagaagcatgtttggaagtgtgccatgagatgaatgtcaaggccattgatctatggtctgctattcagaaaaaggataactggagagatgtttgcttcattgatggaattcatctttcaactgagggaagcaagatagtaacaaaagagatattgaaggtgctcaaagaagcagagtgggagcctagtttatattggaggtcaatgccaagtgactttggggaagattcaccatatgatccagttggacctgatggaaagtcaactattaatctctccaactttgcatttcccaacaatgaccaatgggactag

SEQ ID NO: 94216 - DNA, 108 bp, Glycine max
  Peptide Sequence Number=SeqID_210994
atgttaggaacatcaaggccacaatttgtgctgtttgggtcttccattgttcaatacagttattatgaaggttggggtgctacactttctcacttgtatgctcggaag

SEQ ID NO: 94217 - DNA, 474 bp, Glycine max
  Peptide Sequence Number=SeqID_210995
atggtgggaccagtgagacctcagtttgtgctctttggttcttccattgttcagctcagttactctctccaaggttggggcgctattcttgctcatttgtatgctcgcaaggcggatataattctgcgaggatactctggttggaattcaaggcgtgctgtgcaagttctggatgaaattttccctaagaacgccactgagcaaccagatttggtaattgtgtactttggtggtaatgattctcttcttccacatccaagtggtcttggtcaacatgtacctctccaagaatacattgaaaatatgagaaagattggtacccatctaaagttattactgccaagtttgacacaaatccttatgattgctagagcctttcaaagaagactcgccttatatttctcagtgctcctcctgtcaatgaggcacaaatttatggaaccaggttttgacttcaatctaattgctatttaa

SEQ ID NO: 94218 - DNA, 225 bp, Glycine max
  Peptide Sequence Number=SeqID_210996
atgagcgacaaagatgcaatggcagaagtgaaggagtggcttgcgaagaaatttgaagactctctgtgcagccatctcgcgtttgcacctcgctcgcgattgttgtttcaatcccaaggtgggctgttgaagaggtcattggagatgaacttgttgatgactcttttgttccaagcagcacaaagtgaggagaactatcaagggtcacttcattctgaacggtag

SEQ ID NO: 94219 - DNA, 204 bp, Glycine max
  Peptide Sequence Number=SeqID_210997
atggatttgggaatgaacatgtcttgtgcaacattcagctgtcccagggcatctccattgccttctccgtggtcaggtggcaggctatctcatttacatgaagcaatagaaccaaaagtgctcttcaagttgatgttaagtgtgttgactcctgataggaatgagaaggctgctagagctgctttcaataccagtattgactga

SEQ ID NO: 94220 - DNA, 329 bp, Glycine max
  Peptide Sequence Number=SeqID_210998
ttccaatcaagagatctttcttgatcggtgctgctgtggttgcctcctttggttaccgcaaaaagcgtgatggctcttgggtaaaaaagggtgctcaactaaatgatgatgaaggacacttatcggttgaaaaggactcttctctccttcagagtattttggacaggtttgatggacttcaaacctatgttggtgagaggtttaactccttggaacgtcaagtggacacacgattcgaggagatgaacttagggattgcaaaggttgaagaagatgtcaccatcattcgcgactgctttgatttacctccaccgctaccatcagtttag

SEQ ID NO: 94221 - DNA, 780 bp, Glycine max
  Peptide Sequence Number=SeqID_210999
atggtgcgagaaagcctaaaatctgcaaggcagagctttctgggattcaaaaatatatcagaccagggcatagttgatatctgctttgaagacttttctaatatgagtagaactcacatctcagttccttctaattttatgattcatttgagaaactacattgataaaagaaaagacaatgcactggggctttgctggagattgcctgacaaagaaaccattatataccttaacaggaggaaaagaaggcgactagataaatcagcttcatgtaatgattttcctcagattagtgaagttcaagaaagtgaaaggtgtgcagatatctcaacacataccacacctagtatctcagacattaagatgcttgaacccgaaggaagtatccagaaagaccatcaggcctcaacatacgtttgtgaaactagtatgaatttcactgaggagtttcacaaagtggattcaaaaagaattcaaagctgtgaatcattgtctaacttagtgcatcacttccattctgataagtgtgaggttgatggtagtgaagcaaaagctaaaggtatgttaggatctgactcatctgtttaccaagaaaggctgcacatgtgttgcaatcgtgatacaacacctctcaattcgaaaaggtctgcaaaatatatcttaaaactcaccagacctaggatctcagacattaagatgcttgaacaagaaggaagtatccagaaacaccatcaggcctcaacatctatttgtgaaactagtatgaacttcattgatgag

SEQ ID NO: 94222 - DNA, 443 bp, Glycine max
  Peptide Sequence Number=SeqID_211000
gcctatgctcctgggttaggggctagtagtttgcttttatcagttcctaggccaccccctgatattggagggcggccaactgtggatcgcgcccacaagacaccttgtggacctgaagaagtccaacagggccctagggtttccagctccggttatgggcctctgtcagtcctaccggggatcgcgcccacaagacacccagtggacccggagaagtccaacagggtcctggggtttccagctctgattacggacctttgtcagttctatggagtgcctgtcgcccccatcaagggtgagacaccacagcagcctgaggatggccggcagcgggcaatagatgcaccgccgccacctccagagccccccagctcatctataaaggttggagcgttgcctacaacccgtggccgaccagcaggcgaccaagtacaaagccaaag

SEQ ID NO: 94223 - DNA, 231 bp, Glycine max
  Peptide Sequence Number=SeqID_211001
atgggaaagatgagatcgagagcaagcttcacatatttgaagcttaacttcttcagtggttgtggctcacgggctacctttatactttcccaatctatgacgccagttcagaaaataatcgtcatcatattgaatgccttgattcaagatttcttcaagatcaagccttgcctcacaaagaaaggtttcaagtcattcaaggcacatgtaatcgattaccaatacatgtaa

SEQ ID NO: 94224 - DNA, 300 bp, Glycine max
  Peptide Sequence Number=SeqID_211002
atgccgaggttttcaaaggctttgcggattttgggtagcacaaatctgggaagtcgatggggggaaggtgttgttggaccaaatggggggtttcatggcgaggaagtggtccaaggctttgaggcaaaactcgagcatccagtgaggttcatctttgagtttcgagatgatgaggtggattgtgtctctataaaggcctttggggatcaagaaagagtcgatgttgatggtgaagccaaacttcttgtcgtagtcacggtgattgcgatggaggctttcgccgatgtcatcatcgcttga

SEQ ID NO: 94225 - DNA, 279 bp, Glycine max
  Peptide Sequence Number=SeqID_211003
atggcaaattttgttctacagtttccaaatactttgaggagtttcgctgtgtctgcttcctccaactccaacggagctcctcctggtggttctggaagcagtagtggtgggggtgggggccctgtaatattggaacttcctctagataagatcagaaggcctttgatgaggaccagagcaaatgatcaaaacaaagttctggaattaatggatagtatcaaggaaattggtcttcaagtgcctgtaaccacttgctcccttttgctgatttatttttaa

SEQ ID NO: 94226 - DNA, 445 bp, Glycine max
  Peptide Sequence Number=SeqID_211004
aagtgctaaagttgatgtctcgctaagcgagctcaatgcgcttagcgagtgtcatccgctaagcgaggcatcaacgcacttagcggataagaagaatctggaagggaatctatcacacaggcatgcgctcaatgcatcattagctcactcaacgagttgtttgtcaccttccaagcttagcgcgagtttggcactgaacgaaaattcacttactcgcgctaagcgcgacatcgaggttagtgagctcttttttaagcctgacttgaggagaatgaaaggaggtctaaggagagcgctgaatagccataagagcttgaatagtgaaatacacagaggcaaagaatggagcaaagaagccaagtttttatcttttaggaaaatttgtgagtttttgagtgattgtgagattcctagacatggaggagacatccccactcctttgtaa

SEQ ID NO: 94227 - DNA, 432 bp, Glycine max
  Peptide Sequence Number=SeqID_211005
atgtttggacacaagtactacatattgggcaggttgtcatctgaagttggatggagctactatgataccatcaggtatttgtcataccctaatttcatccggggacaattgtttgtcggcatgcggatttttgccggtcatgttgagctgcttaaagccaatttccgtgtgatccggggtgttcttcagccctgggcccatctaggcccattaggaagcttcaacatgaagcaaccagcttgcctgggtgagcatgttgcttttgaacaaagccaccggctcgcctgggtgagctgggcggcaagcttctcccttattttggctataaaagggcgtgggaggctgaggggaaggggttcagcacccttgatattcatatttcacttaaaattagtgaggagaagaagaaagaaggagaaaatcaaggcctag

SEQ ID NO: 94228 - DNA, 234 bp, Glycine max
  Peptide Sequence Number=SeqID_211006
atgtcgaagcgagatatatatcaatcgaggattaaggcgcatgcaagtgtggtggtgaagatgtcatggatcatgtgggatggccgttcacgttttgcttgtgagagtcacgtttgtgatggggcaacgatgccaatgattggaaaggagatccccgtgaaaggatatgtgatatcgaagcattgtctcgtacttgaaaaagattatggaacttgtgacaccctttaccccaac

SEQ ID NO: 94229 - DNA, 114 bp, Glycine max
  Peptide Sequence Number=SeqID_211007
atgcttactcttggacaactcactggagggcacagtaagcaagcggcaccagacatgacgcatatgcaagcgtcgccatgccactctctttctctctacaacaatgactggtag

SEQ ID NO: 94230 - DNA, 339 bp, Glycine max
  Peptide Sequence Number=SeqID_211008
atgctgaaaagagacaacgataggatatgcgactggaaagttcttcacaacaatgcaaaacatgttgttggagctccaacgacaaacaacgaagatcggcggcgactgccaacaaaggtgggaaatcgccagaaaaggggcaacaagcaaaaaggtcaatcaaaatgtggaaaaggattgccagatgaaggccaactagcggatagctctactaaaatgtggaaaaaaatcgttggaaaagcgataatagtcaaaaaagtcactagagaaggagaaaatgtcgaaataagtcccatgaacaaaaaagtccatgtagttttccttattcacttaacttga

SEQ ID NO: 94231 - DNA, 549 bp, Glycine max
  Peptide Sequence Number=SeqID_211009
atggctttctttttgtatctctgtagtacctctgggctggctatatttgcctgtatgccaactacattatcaagtggtgttgcacttacccagcttgctgggggaaattctgcacttgctcttgcaatgactgtgatatctaacatgttaggaatattgattagccggtgtagcacgaggatgatcaactggctctgttggctctaccacaggtgtccgggccacattggcaggatgaagaggtttactgtgcagcttccagcaacggtcaatggtgtgcccagtacgataacaatggtcgcacttatatcaatttgtccgtgtgagaatggttattctttgaggcaagagcatataagggtctccgccaaggtcataaagaatgcactcctattctcagattctttcttagccttagcaggaatggatgcagcaggaggcaaaatctcaacacctctttgtagatcagttgacgtgctagtggtggggtcacttgccccgaaaggttgccggagcggcaatcgtggcggtggccaaaaaatgcattag

SEQ ID NO: 94232 - DNA, 702 bp, Glycine max
  Peptide Sequence Number=SeqID_211010
atggcttccactagctctgtcactccatcaaaggcaagggctcccattttttcaaacctcctactctccattgagaagttggacggctccaactactctaataggacttctgaagtcaccttatggattagtaggttggggtacaaatctcacctcactagtacaattgattccatactcgcggttgaccgtgcacaatgggcgaagattgatgccaacctatgcagtgttattaagtccaccctccacccctcccttaaatcgattttcctaccccatatcatttgcaaatcggtttggactgaggcgcgtgctctttacacaaacgatactcaacagctatatggagtgtgccaagacttgatgactcttcttgccccccaaaaatttgaaaccctacatgaatataatgagctcttacctcttgctgcctctattccaattgaggccaagaaggaactagagaaatgcagtgctttctttatgactctagctctttatggtatgcctccagagtattctgctacacaagaccaaattcatgggtcacctgtcgccccaatgatggcatccacttgttctacactgcttaggattccaccgaagcctactaccaacatccccacttctatgatgggggacacatctacccttgcttcccagagcaataatttttggatgctctcgaacaaggtcatctaa

SEQ ID NO: 94233 - DNA, 462 bp, Glycine max
  Peptide Sequence Number=SeqID_211011
atggttatcacacatcttggacctcaagtcgatggtattgaacttccgctaaatgaagttacttcacaacctccacagattattgaagatgccttagcaaccatctccacttccaatcctcctcgtgagatagctcccttgaccacctttgctccaactagtgtgtctgaagagaacattcaagaattgttgcgccttcaacagaccaacttggaagataccatggaaaaaaggttcctagttgaacgcatggagaccaatttgctgatcaagaacactttggaatattcactcaaatccttcaatgattatgttctcttcaacatgaatctactaatgcaacaaaggttgcctccatctgcccaaccaactccaccaccaccaaccactgttttacttacatgcctttttaataaaacaagtgttatagtggtcacacatgtgtgttttcatgctttttaa

SEQ ID NO: 94234 - DNA, 322 bp, Glycine max
  Peptide Sequence Number=SeqID_211012
cacaagacatgtgaggagatacatggagaaaaatgaagaaacaacaatggaggagaaggtaaatctgaaaattaatagaggtttaaggagcaccaacttgaagctcttgtgctctgataaccacttgatggaagcttgcttgagaagcttctatgaaggtgagagaaggcaccatccactagggaataagtcagggaaggaggagattcaccaccaagagagttccttggatgagaatcctagggccttctttagccgctctatcccaatcctcttggagtcttctatcaattacccttgggggataggattgcatcaatga

SEQ ID NO: 94235 - DNA, 240 bp, Glycine max
  Peptide Sequence Number=SeqID_211013
atgaaggaacttcagaagaagttcaagatggacgatgcaaagccaataaagacccctatgcatccaaccactgtacttggactgaatgaagactcaaagcaggtggatgaaaagacatatagaggaatgataggatttcttctatatctctttgcgtccaaacctgacattacattcaacgtatgcctctatgctagattccaaaaaggaaccaagggaagttcatttatccgttgttaa

SEQ ID NO: 94236 - DNA, 333 bp, Glycine max
  Peptide Sequence Number=SeqID_211014
atggtttctagaggtatcatccccttcgaaaaacatattgcggcagtagggactaccaacaacaatatgttatcaaagagaaaaactctagatgagggttcattgttatcaagcaagtcggagacccagcatgaccatagattcacttccactccttatgttcccatggacccgggtataaggcccattttcaactcaccctgtgtgcaaaaagcacacaacaaatcaagaatcaagacgcgcaaaagcacaagatcaagcatcaagaatccaatccaagattcaagattcaagagaagaaatcaagaagcaacaagtcaagacttcatatag

SEQ ID NO: 94237 - DNA, 378 bp, Glycine max
  Peptide Sequence Number=SeqID_211015
atgtccatttcctccactgttgaacctaaatcctacattgaggcctttaaacatgattgttcgataaaggctatgcaagaagaaatcaatgctttacaaatgaatcatacatggattttcactgatctcccttctcacaaaaatgctattggttgtcgttgggtttataagattaaacataaagctgatggatcaattgaatgttacaaggcatgtttggtggcaaagggctacactcaaatggaaggaatcaactacatagacaccttttcactagtggctaaaatcacaattgttcgattactgcttgcactagctgttatgaactatttgtatcttaagcaactcgatatcaagaatgttttttctacgtggtga

SEQ ID NO: 94238 - DNA, 677 bp, Glycine max
  Peptide Sequence Number=SeqID_211016
gtcttggaagcttcgagatctgcagctttctgaagaagactattgggatcatcctcgaggaccatgcggatggggaaggagccgaggccgtcggcgatggcgagcatgatcttcctcatctcatcccggaactcgcggcggtcgacggcgccgctccggtcgccgtcgaacttgtcgaagatggagtcgtagagcttcgcgagctgatccggcggcgtggcgacgtcgatgccgaagtgcgtctcgatgaggcgcatggactcgaaggccgtgcggagctccgagcgcgagaggacgccgtcgttgttgaggtccagcaccccgaactgctcgtccacgctcttcgcgaaggccgcctcgtcgttcacgaagtcgcgcacggtgctgccgtcgatcaccaccacacccattctgttttgttgtctgtctcacactcgctctctgaagtgaaggaaaggtttaagattgtgggaattggaattgacggtttggggaaaggtggacttgcgataccgtgtcgtcagcacgtgatatttttcgcgaaatctgtggatcgcggcacgggagcattgtttgccttcccgccttttaagacttctggtgacctccatagccaccgtgaaggactgccattgaagtcgaagccttcattttcgtgttctagtgtgacgtgcaag

SEQ ID NO: 94239 - DNA, 943 bp, Glycine max
  Peptide Sequence Number=SeqID_211017
tggtgaatactacatatgggaaaggtttgagatcgatgtcattaatgtgtggacaatgcacgacttgtgcaaagcttgtgtagactatatgaagtttggtttagtttattatttaatacctaatcaagggcttgaaggtggtttccagaggctggaaaatgattgggatgtgttggatatgtgcaacataggctttgttgatgttgccaacgatgtacatgtacactttaaacatgtagtggatgaaatgctggagatcatacctgctgatgtgcttgaaaatgttattgggggaaaaaatgatgcggctaattgtgagaatgaaggtggtttccagaggttggaaaatgattgggatgtgttggatatgtgcaacataggctttgttgatgttgccaaagatgtacatgtacactttaaacatgtagtgaatgaaatgctggagatcatacttgctgatgtgcttgaaaataatgtacatgaaggtgttggtgctgattttgaaaaagaaataaagatgattgtctattccattcggggtggagttgatcatgttgttgctaaacctattgttgaagaacctgtggatgaagttggaagtgatttattgcctaatataagggttgatgacttgtctgatcttgaagaaattgatcctgagtatgtttatgagtctccagatgaagatgatggaagggaatttgagtctttacccagcaatgacaatgaagaggacaccaataaaaagattgcgtatcctcattacaatgctaaaagccattttggaaaagttcacttggaggttgtgatggagtttaagactatcaaattttttatagaagatgtaagagagtataccatatatcatagcagggatctcatgtggcctaaaaatgataccattggagctagaacacgctgcaaacaaaagggatgtccatga

SEQ ID NO: 94240 - DNA, 300 bp, Glycine max
  Peptide Sequence Number=SeqID_211018
atgggtgttaaacatttgaggtggtcaagcgaaagtcgcatgccaacaaacaatggtccccggacagaattaggaagttgtcgttcaactgcacctggcctctatggtttttcgcctgctgatcagccaaatgctacatgtatgcgtgcatctggagctccatcctctacatgtgagccaaggtggactctagggacggtggctaatgtggaggcggtggtggtgcatcagttgttggctattgctgctgatcttgccccgactgttgtgcctgccttggaatgcagtacttctcaatga

SEQ ID NO: 94241 - DNA, 309 bp, Glycine max
  Peptide Sequence Number=SeqID_211019
atgtttcatgccaaggaaccattgtctggtggcatgcaaccttcgcttgaccgcctcgaggggggtgtaaatagcaaccaggcccacttgagccttccagggggttccaacaaaaggcggtgccttctggtggaagcaacccagctcgcctgggcgagctgggtgacaaccacctccctcttttctcctataaatagtggaaagagggtagagcaaaaatgttcagcccttctggtatttaggattctctcgaaattagtgaggaaaattgtttccatggaaaaaatcctagccgaggtgcttctctaa

SEQ ID NO: 94242 - DNA, 312 bp, Glycine max
  Peptide Sequence Number=SeqID_211020
atggtctcttcttttggataccgcaaagagagggatggttcttgggtgaagaaggacgcaccagcacaggccgcagaagaccgttctccatcaccacctcctcaaagagatgattcttcatctcttatgcacaacattcttgacatattgaatggactccacacctttgttggtgagcgttttgattccttggacagccgcattgatgccattgatgcacgatttgcaggaatggatactcacatcactcagcttgaagaggatatgagttatattcatcaatgcttcgaccttccaccaccatcctcatag

SEQ ID NO: 94243 - DNA, 1429 bp, Glycine max
  Peptide Sequence Number=SeqID_211021
atgctcccttcacttatagagttgcacttgcagaggtgtcaacttgaaaacatctatccatttcttcagtatgctaattttacctcacttcaagctctaaagctgtctggcaatgattttgaatctgagttgcctagttggttattcaatcttagttgtgacatctcttacattgaccttagccaaaataagatacatagccaactacctaaaacattgccaaatcttagaagagttaagttcttgactttatctcaaaattatctcaaaggacccattccaaattggttaggacaacttgaacaactacaaggacttgatctttctcataattttttttctggtccaatccctgcaagtttgggaaatttatcttctttgacaactttggtactcgattcaaatgagttgaatgaaaatcttccagacaatctctggcatctcttcaacttggaaagactttcaattttaaaaaattccttgactggaattgtgtctgaaagaaatttactttctttttcaaaattgagatggtttgccatgagttcccctggcctgatctttgattttgatcctgaatgggtccctccttttcaacttcaacatcttacattgggctatgtgagagacaaacttcctgcatggctattcacacagagttctctaaaatatctaatcattgaagattcaactgcttcatttgaacctcttgacaagttttggaactttgctactcaacttaaatttttcaatctggtaaacaacactatcaacggggacatatcaaatgtgttgctgagttcggaacatgtttggttagcttccaataatttaagaggtgggatgcctcgtatatcaccagatgtggttgctttaactttatataataattcattgtctggatccatttctcctctcttgtgtgacagcatgaaaaataaaagcaatttagtgcatctggacatgggttataaccatttaacgggagaactcacagattgttggaatgattggaaatcgttggttcatattgatttaggttacaacaacctaacaggcaagattcctcactcaatgggctccttgtctaatcttcgttttctgtatctggaaagcaacaagttctttggagaggtacctttttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagtaatgcttcaacccttaaagtcggctttttaattcacttaccag

SEQ ID NO: 94244 - DNA, 634 bp, Glycine max
  Peptide Sequence Number=SeqID_211022
atgtcgtcttctgcacacttggtcaatcgcggccaacgagccagttggcacgcggagatttacgtcgtcttccgcacagtcaatctctgtcaatacaaaccctcaatcgcggccaacgagcctgatgacatgcggaaatttacgtcgtcttccgcgcaacccagagcacgacggcatgcagacactgacgtcgtcttctacaccatttttcaatcgtggccaacgagctcattgaaacccagagatttacatcgtcctccgcacccagagcacgatagcatgcagaaactaacgtggtcttctgcacccttggtcaatcgcggccaacaagctcgttggcatgcagagatttacgtcatcttccgcggagtcaatctctacacagagcacgttagcatacagaaactagcgtcgtcttctgcaccctttgtcaatcgcggccaacaagcccacccagagcatgacagcatgcaaagactaacgtcgtcttctgcaccgtttgtcaatcgcggccaacgagcccatttacatgtggagatttatgccgtcttccgcacagtcaacccagagcacgacaacatccaaagactgacatcgtcttctgcacagtttgtcaatcgcggccaacgagccc

SEQ ID NO: 94245 - DNA, 135 bp, Glycine max
  Peptide Sequence Number=SeqID_211023
atgacgttagtctctgcatgctgtcgtgctctgggtctgatggatagcaaaagagtgtttatgcggaaaaaccacttgggtattttcgcctgcccccaaccttcacggagattgacagctcggatgatgacgtaa

SEQ ID NO: 94246 - DNA, 288 bp, Glycine max
  Peptide Sequence Number=SeqID_211024
atgcagaggatggatctctgcatgcagcatttggctgaccagcaggcggccaaccataggggccaggtgcagttgaatgacagcttctaccaatataccctacaccagcagcgccaggaccctagcccttacccatggcctactctcgagcagttcagggcaaatgttgcatggcttagggacaggcctaattttcaggcgggggcaggtcccatagaggccccaggagatgaagacgaagctgaggaagacggtgacatggaaaatgagatggatttcttcctttga

SEQ ID NO: 94247 - DNA, 375 bp, Glycine max
  Peptide Sequence Number=SeqID_211025
atggcggtaccctcgctcacccctgtcccgctgctgccaatagcggcaccccctgcggttcccgcttctgttagtggcggcacgcctatgccgctaattccgctggcggcaccaccccaagaagagacccccttctttgtaaaggggaccccctacagtaaatttgccggtcttaaacaatctttctcatacctttgtcaaattttagaattgtctagatcattgacaactagagtatctggaaccccttaccttggtgggtcaccactacctcaaactagtcgaagacacatattttatgtcagtcggcagaagaaagccaagacagaagccagagaatgtcaatcaactctaataaggggaccccatcaatag

SEQ ID NO: 94248 - DNA, 639 bp, Glycine max
  Peptide Sequence Number=SeqID_211026
atgacggagagggaggagaaacaaaagaatgtacattcttcgtgggctagggtttatgtggagggggcagtgcatggtggcaccatcatcgtgaccaccatctttggatgtgcaataaggaagaaggaaaaggggaagaaaagaaaaaaaaagaggaaatgggggagggtcgttggaaatcgctttttgaagcggcgtgcaatggttgaagcaaatgagaaaggaagaggaaaggagaaaaatatgaatttcgacggtgctatgaagggttcgctgtcaacgaaggtggagaaaacagagaataaaaaggccgaattgcggtgttcgacaccagttaccacccaaagtagaggatcactcagtgttttgatcaagaatacaaaaggataccaaggaaggggacaaaatggtcctttttgggtttttctagaccctagctcgcccaagctagcatctggctcgcctgggccatcaaataacttcatggttaagaaattagctcgcctgggtgagctagttacttcagggctaaggttcaacttgcctaggcgagctccagctcgcttgggcaagctgcaactgccccaaagtgaccatttgcctataaataggcgtcctaggggtgttttaaggggttag

SEQ ID NO: 94249 - DNA, 381 bp, Glycine max
  Peptide Sequence Number=SeqID_211027
atggctaagaaggcttctgaagactcgctttgtgagattggctcgctaagtgagagaaaaattgaagtccctttggaaattgaaagagggtttgacctaatggatgtgactcatgggttctttatgattaaatttgacctagatatagaccatgacaaggctatcaatggtccaccttggacgatctatgatcactacttgattgttcacccatggacactagaattctctgttgcggatgctactgttgaacacacactagcatgggtttgcttacccagtcttggaaagatattttatgatgaaaatgtgctcttatctatagcctctgccattggaacccctatcaaggtggaccaccaaatgctagacatggcttaa

SEQ ID NO: 94250 - DNA, 231 bp, Glycine max
  Peptide Sequence Number=SeqID_211028
atgaggatgatggcagaccctcatacaagtggcatgatagtgaatagcaggcccgcaacaaatgcaaaaacccacgagatgataagcaatcttgataaccagaatgatatgggtattgacctccaaccccctaatacgtccagtatgtccacagggagtagtcttacttcgacaatgctaaccaagttggtgaatggttttcaaattgttggtatggaagtggaacaataa

SEQ ID NO: 94251 - DNA, 258 bp, Glycine max
  Peptide Sequence Number=SeqID_211029
atgcataacttcaagcaatttataacgattaagtctcttatccatgagtcagccatcaagatgattcaggaagatattttggtttcttatcctatgtatccccttgtcaaaaagatcaagagctttatgcaactcgaatgggtgcctcattttagtcacacccttcagaaaggacaaccaagtggcaaacgatctatggtttgcctttcaattcttagtccaaagtttcttgtggactctcttaggagttcccattaa

SEQ ID NO: 94252 - DNA, 306 bp, Glycine max
  Peptide Sequence Number=SeqID_211030
atgcttacggatcaagtgatccgtaaaacgcacaacaactttctgatagcggtttacgccatcgccggcaacactggtggaaaaaagaaaaggttcacgacgcttacctcgactgtggacggtcacgaaactccctcgacggcgaagaagaagaaaaagaatgaagaagaagtagaaacgcgaagaatgaagaagcaggaaggtccgaggaagaagaagcaagaaggtccgaggaagaagaagcagaatcgcggcacgggagagacaggcgagggttatttttttgaaaaagtactgaggggctaa

SEQ ID NO: 94253 - DNA, 476 bp, Glycine max
  Peptide Sequence Number=SeqID_211031
gttttggagcttctcaggaaaaagcgggacttgatcttcggcgaggacacgtccaacacaaagtgagacccgaaagccgaccttggttgatgatggtaatcatgatgttttatgatatgaggccaatgaatgaccttgtcaaattaaccataatgattgaggacgccagagaagttgagagaagaagattacttggtattgaagacttagatggcccaacaagagaagatctagttgatgctttggatgaagtgcatctatgctcaatgagattaggttcagggaccctctgcctttgtgacaatggaatagttcagcaaggacttgtatccattgggcactttagagttggaaaacagatagctgatatcttcatgaagatcaatgaaggaaaaattccgaaggatagagctgctctccagatgcttgctgaggaattggcttcatggcctaatctagagtttatagagttttga

SEQ ID NO: 94254 - DNA, 168 bp, Glycine max
  Peptide Sequence Number=SeqID_211032
atggagatggcgggatctatggacatcaggatcccttgtatcaaaagtcttcctagtaggttagtccatgcattgaggtcaggcagtgtggctgtggctcagtggagagtgcggtggtgcaaggtgtggcggttcaaggtactagagcatgttggttcacttgtatag

SEQ ID NO: 94255 - DNA, 183 bp, Glycine max
  Peptide Sequence Number=SeqID_211033
atggaagatgctttgcctaagaaaaagcccagcaaatctctctatgccaaagccactgacactggaattgatcctgaactggctgcaaagaaactgaacattgattgggattctgctgctgaaattgaagagcaaaacgcagacgatgagacagaagtgcctccagtggtggtcagttcctaa

SEQ ID NO: 94256 - DNA, 225 bp, Glycine max
  Peptide Sequence Number=SeqID_211034
atgtgggagcatgtcaatgacatgaacacaatggttgatagtttggaaactccaaatgtggctcgcaagctttttcaaaggataattgtcccttgtctcctattatatcacagtagagaagatattgcacacctaaagcttgttaatggaaaaggtcttacattcaatgcatgcaagctttcaactcaatacaatttcatccaactacaggatctcaatatgtaa

SEQ ID NO: 94257 - DNA, 192 bp, Glycine max
  Peptide Sequence Number=SeqID_211035
atggcacggtgcatattgtcacatgttttggcttttgcacttgttgctgcgttgagcttggttaacgttgcacaatctcaatctgcaaacgccaccactgatccttccgaaggtttgaacttctgggaattttctcagtttcagttttgcaggggattcagagaaatagctaactcttcatcattaacatag

SEQ ID NO: 94258 - DNA, 366 bp, Glycine max
  Peptide Sequence Number=SeqID_211036
atggtggcttttggatcaaacaagtttagaggatctcttccatctgaacttggaaaattgacaaatttagaagaaatatgggcttcagacacggaactcacaggaaaaataccggacttcatagggaattggtctaagcttcaatccttgagatttcagggcaattcttttaatggctcaataccatcatcattttctaatttgagttctttaacagaattagaactaaagaataacaatatttctggtttgattccatccaccattggagagttacacaatttgaatcaattgtgtcaactagaaagcaagaaactagtcaatgttgttattccatggtatatctccgatttgagtattggctag

SEQ ID NO: 94259 - DNA, 333 bp, Glycine max
  Peptide Sequence Number=SeqID_211037
atgtgtctcaaaaatacacaaaatattataattttaacttgggtcaaattgccttacaagtattgcaaacgagttagattttcaatgcttggaggtagagaacctgtcaatggtagtgaagaaagcatacaaattggtgagagagaaatagaaaagatacaatgctgtgatgcgacaagtagttctattgtcataggaacaatcacatttgatcaatgggttgaaggttgtatcatcaatgagggaagtgtcgatggctcttccagtacaaagttcaccgctaatattccaatgagttgggtttgccaatatatcccatttcttaaagattga

SEQ ID NO: 94260 - DNA, 426 bp, Glycine max
  Peptide Sequence Number=SeqID_211038
atggagctagggcaaggaaacctagtctctttctctagttcaccaagtgtgtcactacaaccaaagttgccagatccccctacattgatgccccaccatgactttccttcaaggacaaggtatttgggaaacaaacagaaccaaaaaatgtttcgtaacctactaatggaaagggtaatgaaactggagtatgatggtctgaatagattactttttaagtttttcttggagaaagcgttatttgaagagctatgtcaaccatggaagaagtttcttgtgataaagatactaggaaagaacataaatacagaccatgacaaggctatcaatggtcgaccttggatgatctatgatcactacttgattgtttgtccatggacaccaaaattctctattgtggatgctactgttgaacacacactgtga

SEQ ID NO: 94261 - DNA, 324 bp, Glycine max
  Peptide Sequence Number=SeqID_211039
atgacgaatgtgtttgagttttctagccttggcgaggtttccctctgccagggtgagcaatcaaatagaaagtgtcatgcttctattaaaatcattcactatgatgaggtgtgcctctggcaaggcgaatcaactaacagagctaccttgagactgaaacccaagtttgctataccgaggttcccctccactatggcaaatataaaacatcagagatattacagggtagaggtgatttcactacaacaaggtgtcaattgctgcaatgatttcacccctacactcttgtctatgattggtgcagaaatttttaaaaaaacttaa

SEQ ID NO: 94262 - DNA, 849 bp, Glycine max
  Peptide Sequence Number=SeqID_211040
atggaagacctttttaagatgtggaatggacatcttgacaacacacgatcaagggtcagccaaccaccactgataaattgtgatttttgtggaggaaagcattacaatgacaattgttatttctactccatgaataactctgggtggagacaagagttaaatccttatagtaaatatgaagaagaaagaattcctaatcttgaaagtgtgtttgaagaattcatggcataccatgctagctctaaagccaatcaaaattcaatgcaaaatcaggaacttcattttggcaagagctactccatagaaagttatcaagtgggatcggagttacaaccctacaatcaaaatgaagcagaaagaggttccaatctggataatttgttgatacaattcaaggaaacaactgaatcaactcaacgggcaattaaaagtgcaaaaattcaagttggtaagctggcagaagaagtaactcaatttgtggccagaagggaagaagactttgtagaggttgaagctcaagaggaaagccctgcaaaagagcatgattcaagaggaaaacatgaggagaaaggcgaggaaaaagtacaacaatgggagaagtacccaacaatagaaaatcaacaagaaagtattctccaagtcaatacttttcctcatcaactaattatcaaggaagaaaggcaaggagagcatgagaaagccttaagtgtcattctttcattgatcactaacacctcttctgcaatgagttggaaagtgcttccaaaatacatgaagttcatggaatttctagctaaaaggcaaaactacaaggaagatgtgttatatgtgaccttcatgccaccttga

SEQ ID NO: 94263 - DNA, 363 bp, Glycine max
  Peptide Sequence Number=SeqID_211041
atgggtgcaagggatatatcaattattcacagggtcctgagctgggtcctgatccataaatgtggcatcatcatcagagaaattcattactggtgtggccactggagatgcctgcggagtagtggtgtccaatacagttgtggatctccagtatggcctcatcatcatccttctgctccgcctgaggttcctgggctgcggaggcctcacctcctccaaaagaagaaggctggactcctggtcaagcctcctgcggaggaaactcctccaagctcatgtttggttgatgctgagccagattctgtagacgctgaagcaccaggtatagaacctggtgtatgctctatagcatcggcactatga

SEQ ID NO: 94264 - DNA, 849 bp, Glycine max
  Peptide Sequence Number=SeqID_211042
atgcagaactcgctaagcgcgaatcttcgcgctaagcccaatttcctctctggaatttcaaatttttgttctgggctaaatgagtttgcccgcttagcgcatgagtatgagaactcaaacatcaattttgctcgcttagcgaaggtatgtgttgaagggctgcaaaaccccaatctttctagagttttcgacgaactcgctaagcgcgactgtgcactaagcgaggtcatcagttttgcttgtttttttgggtttccagatgaactcgctaagcatggccctgacctgctaagcgagttcatcttctctgatgaaggtttgaatcctgggctaagcgagtttatctcactaagccccaggaacttgtgtttatttttgaatgggtgtctaagcgctaagccagctttgctcgctaagcgcacaatcttctctgtttttgttatttttggaactgggcttagcgagccctgctcgctaagccatttatttttccagaggttgtgtcgcgctaagcgtaccttgtgcgctaagcgcaatttgttttctgttttcgaattgggcttaacgagccttctcgctaagccaattatgcaatggcttttaggaaacgaaaggccacaacttctagaccttaggctaattatgatacaactagatttacatctgaagttgcttgggactgctataccctcaggagctggcagcccgactatgtatccctggcaggggatttgtgctgaatgcagagggcctaccatggaagcttctaagaaaagacctcacgactctgacggagacttggagcgtattgtcctacttcaaccttgcccccacatcacatacttctga

SEQ ID NO: 94265 - DNA, 852 bp, Glycine max
  Peptide Sequence Number=SeqID_211043
atgaatgcagcaagagctttaaattcaatcttcagcaaatgggatatattggcaaacccaactcaatggaatattagtagtgaactttgtagtggaagagctatcgacgctaccaccaccatcgatgacacaactttcaacccattcatcaaatgtgattgctcctatgacagtagaactacttgccgcatcacagcattaaaggtttatgcaatgagcatagttggtacaattccagaagagttatggactttgacttacctcaccaatttaaatcttggccaaaattacttgacgggttctctacctccaaacattggaaatctaactcgtatgcaatacttgagcattggcatcaataatttttctggggaacttccaaaggaattgggaaatcttacagagttaagatcattggcttttgggtcaaacaagttcagaggatctcttccatcagaacttgggaaactgacaaatttagaacaaatttactttgatagttcaggaattagcggtccaattccttccacatttgcaaaccttaagaatttgttgcacgtaggagcttcagacacggaactcacaggaaaaataccagacttcatagggaattggtctaagcttcaaaccttgagatttcagggcaattcttttaatggctcaataccatcatcattttcaaatttgagttctttaacagaattagaactgaggaataacaatatttctggttcgatttcatccaccattggagagttacacaatttgaatcagttggatttaagcttcaataacatcacaggacaaaatttgggatcaattttcaatttgagttcgctcacttacttgtaa

SEQ ID NO: 94266 - DNA, 197 bp, Glycine max
  Peptide Sequence Number=SeqID_211044
gttacacgcaaaacctgcaactgctagaagagttacgctttgccaccgctgtgagcaaactcaagtttgaacatcatttagactccgacatcgttgattttgaggtactaggttcacttgtaattatggtttgtttgattgagatggttgtacttgcgggaacttttggcaccaatgggttaacattgcgatgctga

SEQ ID NO: 94267 - DNA, 210 bp, Glycine max
  Peptide Sequence Number=SeqID_211045
atgtggcccaaagcaagtgccaaagaccctggaaggtcagtgcacttcgccccccacaaacatacacaacatccaacgtatgaacgtggcccaaagcaagtgccaaagaccctggaagggtttttcaaaggaagcgtaagacatgcaatggtggttccaaagtcagaaaagatgcaaaaacaagttgaaactaacaagaaccaagcgtag

SEQ ID NO: 94268 - DNA, 141 bp, Glycine max
  Peptide Sequence Number=SeqID_211046
atggaggattgtgcagtttgtaccatagttggagataatgtgagtctagaattcaatttgagatcaacctgtgcttatttcatcgttgaggtagcaatgagcatccggaagggctcacatattacaggcttccatagctga

SEQ ID NO: 94269 - DNA, 132 bp, Glycine max
  Peptide Sequence Number=SeqID_211047
atgaatgccccagatcgttacgagcgtttcgtcgtccctgaaggcacaaaaaagttttcttatgagatggacacgaagatcatcaatgcgtcatccttcaccatcgactgcacagagaccccaatgtcttga

SEQ ID NO: 94270 - DNA, 543 bp, Glycine max
  Peptide Sequence Number=SeqID_211048
atggcttctcaaagtttgagtttaccaccaacacatattccttacaataggataattgggaagcttgattccaagtttttgttgtggccttcttgtgctcatatcaaacccagaagaatttctacctcaattcgggcaatgggttcctccgcttcttcccactcccagtcacaatatgcagacagcgttgaatctgaagcaggagctgatactattgactataaatctttaaccgatgaagagtggaagaagcggctcacaaatgaacagttctatattactcgtcagaagggaactgaaagagctttcactggatcatctactaagttcaatagtggaactgggtggccatcctattaccagacaattgggaaaaatgtgaaatcaaagttggatttgtcaatgattttcatgccgcgccaggaggttctctgtgctgtttgtgatgctcatcttggacatgtgtttgacgatggtcctccacccacgggaaaacgtttctgtatcaatagtgctgcccttaagctcaaaccaaagcagtag

SEQ ID NO: 94271 - DNA, 276 bp, Glycine max
  Peptide Sequence Number=SeqID_211049
atgtatgtttgttcatacttcataaagagttttaggctgtcacatcatcaaccgcagatgaggatgttgatctcttggttatctttcagcacttttgggaatgttctgtaccctccaatgctctgtggcaagaaggccagaaggatcaaactcaaggtgtggcattcaacatggttgtctatttggatgatgcgaaagggggttaaggatggtgatggggacccctctgttgttatcccagattcaatccttatcccggaggtggttgttgtatag

SEQ ID NO: 94272 - DNA, 513 bp, Glycine max
  Peptide Sequence Number=SeqID_211050
atgagcaatgcaaaccctatgagtactccattggcaaaacactttaagctttatgtagatcaatgtccgaaaacaaatgttgaggtggagtacatgtcaaaggttctcgatgttagtgcagctgtttacttgatgtatgttatggtgtgcactagaccgagtttgacatatgttgtaagccaagtttgcaagtttatgtctaacccaagcaagcgacattgggaagcaatgaagtggagcttaaggtacctaaaggatacagcaagtcatggtattatgttgggtcatcaacagggtgatccttcagttgtgggatacatggattctgactatgctggtgatttagatgacaaaagatttacaacagggttccacaagattaaggagttgatgacatctggtcagattttgctcgaaaaagttcacacttcaaagaatgcaactaatatgttaaccaaggtgatcacaattgacaagttcaagcattgcttggacttgctgaatgttgcttag

SEQ ID NO: 94273 - DNA, 1047 bp, Glycine max
  Peptide Sequence Number=SeqID_211051
atgtcgtcgcagggcacaggttcagtagtggatttcgacctccctgacgagattctatcggttataccgacggacccataccagcagcttgatctcgctcgcaagataacctccatggccatcgcctctcgtgtctcttctctcgagtccgacgcctctcgcctccgccagaagcttctcgaaaaggaccgaatcatcctcgacctcgaagaccgcctctcctccctcacccgcgcctcccaccaaaccgactccaccctcaacaccgccctcaacgaaaacattaagctttccaaggagagggatcaattggccgccaccgtcaagaagttaagtcgagactttgccaagttggagacatttaagaaacaactgatgcagtcgctaactgatgacaatgcatcgcatgctgaaaccatagatattggaacctgtgatcaatcagttccaaaggcatatcctgataaggatgatgatggaagtggctatatggtacatcattcatacaatggccctgcagatgtgggtaaaacaaatgatgaagcttccaggtattcagggcaaaggttttctttgaccccatatatcacaccacgtcttacaccgacaggaactccaaaggtgatttcaacagccgggtctcctagagaatattctgcagctggatcacccaagaaaacttctggtgccacctctcctacaaaacttccatatgatgggcgaacatctctctcatcatggtattcatctagtcagcagtcatcagcagcaaactccccaccatggggacgatcacttccagttcgaactccaaagattgatggaaaggagttttttcgtcaggccaggagtcgcctttcatatgagcagttcagtgcatttcttgccaacataaaggaattaaatgctcagaagcaaacacgggaggattgcttaaccgtaatgcacgctagtactgaaagcagcattgccgagtattgtatgagttggtatgaagttgcaccctatgttatgagaactagaccggtcatcgatgtattgaattaa

SEQ ID NO: 94274 - DNA, 198 bp, Glycine max
  Peptide Sequence Number=SeqID_211052
atgactgaagtagtagtggaaattattgaggctatgccccttaatgcatacaatggtgtgggtgacagaagaattctcaggagatcctctagagttcatcatgtggaagataattcatttggttcttctcttgaacaaaagatggatatattggctaagcagatgaagattattgtaatcgatcgttacatgtggtaa

SEQ ID NO: 94275 - DNA, 1710 bp, Glycine max
  Peptide Sequence Number=SeqID_211053
cccaattcggattacccaccttttcacaccaccccaacacctcacaatacagctgatccacatcttccagcagcctcatcttcccctccttctcaacaaacctccttctcaccatcacccattccagaattcacaaaccccatttctccacctctttccacctcacacccttctccaattcactctccaacacctcaatcttcacctaacaaccgaattcctttcgttcctagacgctcatcccgtcctcaccaacctcccgttcgtcttgccgattacatctgcggtagcgtacaaaatcaaccaagccaatcatcgtcaacgtgcctctattcgatccggtctgccttgtcttattcccatgtctcagagtctgatcgccattatctcatgaacctctcctccgagatcgagccccacaactatcaagaggcgatttctcagcagtgttggcatgatgctatgcgtgatgaaattgcagctttgaaactcaataatacatgggaaatagttgatactcttgctaatgtcaaacccattggatgcaaatggggtattgatttcttcgagactttttctcccgttgtgaagatgaccaccgttcgtgttatcttggcccttgcttccatttaccgttgggatcttcaacaactgaatgtcagtaacgcttttcttcatggggacctttcagaagaagtgtatatgagtattccgtcaggattacaaggtcatggatctcctcagtgttgtaaattgaagaagtccttgtacggcctcaaacaagctagccgcaaatggtacgaaaaactctatactctacttgtgtcctctggttatcaacaagctcactctgatcatagtttgtttgtaaagcattataatggtacaattacagctttattgatatatgtggatgacattgtcttgactggcttggaggtgaatcaatatgatgagggtatttgcgtttctcaaagaaagtattgtcttgaattgcttactaattctggaatgatgggccataaaccaagttcaacacccgtggacaattctatgaggcttcgtcaaaatgactccagtgattttcttgatgatcccttgtcttatagacgtcttctaagccagttcatggctcatcctactaagtctcatcttggtgcagcaaggagagtccttcgatatctcaaaagctgtccaagcaaagatctattcttcaaacgagattctcctacacatctcattggttttaacgatgccgattgggcaacatgtgttgacactagaagatccataacagaagccgaatacagggctcttgcaaccaacacttgtgagttacaatggctgtcctatctccttgatgacctcaagattacttgtaccaaatctgcagttctatactgcaacaatcaaagtgctctttatatagctgctaatcccgtgttccatgagcacacaaaacacctagaaattgattgtcacctcgtccgtgaaaagtctcaagcaggcctgatgcgtttgctccctgttccttcttgtcatcaactcgcaaacatgtttaccaaagccttgccacctcgctcattcacctccaatgtatccaagctggagttggtagacctctacacaccaacaacttgtggggggctaacagaaaatggcccaaaaccgttagaggaggcccatgataatttggcccatataaatcct

SEQ ID NO: 94276 - DNA, 486 bp, Glycine max
  Peptide Sequence Number=SeqID_211054
atgctccaaccatatgggatcaacataggcttaaaggagcactcaaacccggtgacccctaaggcctacactccgaagagtccgtcagggcctctccctcctgattcagtggatcccatcacaatactcgtcgcccttaaagggtcttacaattgtgtgattgcacagttcatagttcacaactcaatacacacatctcatctcaatacacatttttaccaagacagctctgggtttctgcgggaaagaaaaaggctacaatgcgaagggtttttctctcggttcagacatgatatcgaaattcccaacggtgagaattctcggaattgtgttgcgaacatgatactcaaatttcacgacgatccaacggtgaacgggtttgagatcgtcgtttttctgagactattttggtgggctgtgggaaaaagaaagggttttgagaggagaaggggaaaaacgaaaatgaggccaaaaggagacaactga

SEQ ID NO: 94277 - DNA, 1155 bp, Glycine max
  Peptide Sequence Number=SeqID_211055
atgcctttatatgagttatatcggttggccagagagaagcttggtaaagaaactaccagcacacgtgctcctgatcaatgttcctctcctaaggctagggataaagatgtaggatatggtacctacacaaggttggggaaatttggggatttagactctggattaaatgaaattccaatgtcgatgccatccaatgaagtggatttctgtcaagatgaagatgtgttaccttggttggattatccatcaatatatagatgggattctcagaaaacttatgaagaacaatggaatgttttcaagggttcttcagctggacaggttgagactcccagacctaaagctagtagcaccagtcaagcattagatgtaactaaaaataacaatatgagtaatgcaaaccaggatgtgtcttatggcgaaattacttatattctatcttcctcaagtgatttttctaacgcaaaggtgcagaagtgtgatccacctatgaatagcaatggttccagttccaccataatgaatttctcccattttgcaaggcctgctgctatggtaagagctaatcttcaaagcattggcctgaagtctagtttgtcttcatcaagatcagacagtatggaaatgaagaataaaggtgttgttgcaactagcagaattcctcctgaatcaattcatattgattcaagtggtgaatgtttgaaggaaccgaccatgcaatgccagcaggttgtggagcaatccaaggttgattcagagcctgctggtaaagagagttccactaagattgatctatttcccaatcaagttcttggtgacagtggcactaaaggacaaacagctgctgaaaaaagtaaggagccaaccaaggttcaaaagagccaaaatcaaattttgaagcaaaaaagaaaagacactgacgactatgagtaccatagtgaagatgttgaggaagaaccggctggttctaaaaagacaactggcgggcgaggaggtgtaggttccaagagaagtcgtgcagctgaagtgcataatctatctaaaagggccttggatcttcttcatcaatggagtcctttgctccttgaagatgaatgtcagcgaaatggagaaggaagaaagatgattggagacaccacttcaaggagaagatga

SEQ ID NO: 94278 - DNA, 171 bp, Glycine max
  Peptide Sequence Number=SeqID_211056
atggagtcactcaacctaaactgctacacaaaaacttcggtatgcaggtgtggtgaaggtgaaggtactggtgttgagcgttgtggtggtcatcagcggcaaacgaggtacacaaaggtggtggctctgtcgggaacgtacggatcacttacggatcaacttcatccgtaa

SEQ ID NO: 94279 - DNA, 225 bp, Glycine max
  Peptide Sequence Number=SeqID_211057
atgagattcacccggaatcccattgcgctagggatcgtcgctgcgcaggcggtgttttatttccccggcgtgggggaagcggcaacactgggcgcgtataatccgcgcgataacgaccagcagagcggcgcgctgatcgttaacggcggcagcgcaaccttaaccggtaatcaggcgtttgagccgggcattgacggggcggtcaacaccacgctcggccagtga

SEQ ID NO: 94280 - DNA, 288 bp, Glycine max
  Peptide Sequence Number=SeqID_211058
atgatgaagaagaaaggaaagtttcaacattcctacaaaagaaatgatacaatattcaaaaagaaatataaggaacaaagcaatgaaatcatttgctttgaatgcagtaagcctggacacatgaaggatgaacatccccaaccaaagaaaaagagatactttcgagacaagaaaaagaagagtttgatggtcacttgggacaatccagacaatgagaagagtagcagttcaaacaatgagcaagccaatgtttatcttatggctaatacagacaaaaaggttgagtaa

SEQ ID NO: 94281 - DNA, 771 bp, Glycine max
  Peptide Sequence Number=SeqID_211059
atgcctgacacattaccgtgcttggtggcacttgggcagaaacagctggacagaaattacacgaaagtgtgcatgggctgtttggtagggaactttcaggagatggcagatcaggattatgagcttccaatggtagggttaccagagagtggcagcacaggcccgaatctggccagaaaatggagaaacaatgctggaaagatgaaacggcacagagtgactggaaataaagaagagctcttgatcttaggaagcttagcaacagataatgaagagaggtcacaaaggaaggcaccctcaagaatagttgataaactggtcaccattcaaagaaggttcttatggggcggcggatcagagcaaaggaagattgcatgggtcaaatggaaaacagtgaacagtgcgcttaaaaaggaaactgaatggaggatgggacgcggcgacaagtgtcgatttttggaggattgctgggtagacaatgatgtaccactaatgttaaagtatccaaggttatatcagatatcatgccagcaacagcagaccattaaacagatggggagcaacataggtgcagcatgggaatggcagctcaattggaggagacctttattcgacagtgagattgcaatggctgatgactttcttggggagatagcacagaaagaaatccaccctcatagagcagattcttgggtttggaaacccgagccaggtggacaatactcatcaaaaagcacgtatgatgggggcaactcaagatgctgtttttga

SEQ ID NO: 94282 - DNA, 1005 bp, Glycine max
  Peptide Sequence Number=SeqID_211060
atgggggagaaggatatgtggctgaagtttaagaaatggggagatgtgcgagaggatgtgaagctccttgaacaacaactagacagcatggtcatcaatggccttaaacttcacgctaacctcccgaagcatggaagggagaggacaacagataggaaaactaattcagaggtgcaaagtaaggtgggtatgaacaggagcagagcatatgtggatggccaggaacataacagaaatgacgcggtactcaacgtaggggatgagagaaattcaggggtagaaatatcagacattaacaacatcccactcctcattgcagctgaacatacccatggaacagaagatgagttcatgtgggaggcaagacaggaggttaagccaaagtaccttggggacgacatggtcctcttggttggcctcaacaataccagagcggaggaattgtgtaacactgaagaagataacaaaatgtctctattccattcactagagaagtggaacccgggtttgcaaatcgggtataggctggacgaacaatttagaaaggtcgtttgtgattggtggacatcacactcaatacagggttggggtggctatgtgctgaaagaaaaaatgaagggtctcaagcaaagattgaaggtctggaacaaggaacaatttggggacattcagaagaaaattagtaggattgagttggagctgaacatgctagaagttgacggcgttggaagacaactgagtgatagagaaatagagttgagaaagaagctacaggaagaattgtgggtggcaaccacctcctatgagtctttgctaaggcagaaagcaaggacaaaatggatcaaggaaagggactgcatctctaagttcttccatatcacagtcaatgggaatcgcaaacataattcactcagaggactctgggttgatggatgttggacagaagaacctatcaggatcaaagaagaggtctctgggttgatggactctgggggtttcttgtag

SEQ ID NO: 94283 - DNA, 1137 bp, Glycine max
  Peptide Sequence Number=SeqID_211061
atggggagggaggacactaaaattattgttattagtttttgtggctctataaatatttgggaactggagtccatagacagcaagcaagaatgtttgattaaagtggatgaggagtggtcaatgtctaaaatttccaagctttcctcgatatttggagattcatactttacaacagcaaaaacaaaagtcttgtccatcccactaggtgaggttgactacatggatcacatgatgccatttggatccattaaagactggagagtggagattcatactttctttgtaaaagtggaaaatggaaaggctcaagctgctaattttccattttgtacaatagagccaaatgtagggattgttgctgttccagattctcgtcttcacgtgctttctgatctcagcaaatctcaacgagcagttccagcatcaatagagtttgtagatattgctgggcttgtcaagggtgcaagtcaaggagagggtttgggcaataagtttttgtctcatattcgtgaggtggactctatacttcaggttgtacgatgttttgaagacaacgacattgttcatgtgaatgggaaagttgatcccaagtctgatattgatgttatcaatttggagcttgttttctcagatttggaccagattgaaaaaagaattgataagctaaagaaaggcaaggcaaaggattcacaaaaactcaaggaagaggcagaaaagtctgcactggaaaagattcgtgaggcgcttatggatggaaaacctgcgcgatctgttaccttaactgattttgaaagggatgctgtaaagcatctctgcttgctcaccatgaaacctgttatatatgtggcaaatgttgcagaatctgatctagctgatcctgcaaacaataattatgtcaaggacgtaacaaatgttgtgtctgagttgcagtccagaattgtaacaatttcagcacaggttgaggcagagcttactgaactaccagttgaagaacgacaagaatatttgcaatctcttggtgttagtgaaagtggtcttggcaacctaataagggcaacatatgaccttctgggtctcagaacttactttacttctggtgagaaggagacaaaggcatggacaatacttgcaggttag

SEQ ID NO: 94284 - DNA, 678 bp, Glycine max
  Peptide Sequence Number=SeqID_211062
atgagtgaagtagaggaggtgcaagagcagatgaagaccgacatagatgccatgaaagaacagatgaccacaatgatggaggccatgatgagtatgagaaggatgatggaggtcaatacaactactgttgttgtcgaaagtaccgccacaaaagtggacccgactcacccacctggcttcaatcaagtaaatcgtccagcttcggatatggtaggtcagggaggtgaagcgttgggaagtacaggcggcccctatttggtgcaagttcaaaacaagcattccttcccaccatatgtcttgcctcccaactatacaccacccaatgttgcacacactcccgatgagaatgtcaaaaactccgctcccataccaattgagagccaacaaccccaatttggtcatgcacaggtccctctacccatggggggacacatgaagtatcccgagaccacactttatccgactttgagccttacctcggatatgccactaagggatagacattttgtggtgtacccctgccaaacactttggggggcctcagtatcgcccacaaccacaacctttacattttgcagtgggaagagtacctcctgctatggtggaaagggaaaaattcgatcatatagaagaaaggccgagggctatttaaggaggtggagattatgcttttgctga

SEQ ID NO: 94285 - DNA, 450 bp, Glycine max
  Peptide Sequence Number=SeqID_211063
atggaagatgaagttgaagtcgtagctatgttgtgggtgttagagaaggaaatcaaggagaatagggagttgccagtagaaaaagaagaactgcagaatctgctagttgaatttatgcaggtgtttgctaaacccactagactactgcctcatagggaagtaattcacaaaatccagattaaggcgagggaggatcctataaatgtaaggccttatcaatacccctacattcataaaaatgagactaagaagcaggtggatgaaatgctctctataggggttattcagcctagtaatagtgaggattattttgcagaatttagacacttgttgcggcgtggtaaaacatatgttcttgaaaacttttcagctgtaagaagcattggagagtggagagtgaatattatcggtgtggtggtggatatcatagtgcggtgcaggtgtgggtga

SEQ ID NO: 94286 - DNA, 2150 bp, Glycine max
  Peptide Sequence Number=SeqID_211064
atgccaaacatcatcgacgacgatggaaagcaaagcctcgacgacgaaggaacggacgacaccgatacaacccgatgcgtgccgttacccgatagtccgaggccaaatgattgtctgctaggtgaggcccgacaaccctggtcacagttccccagctccaaaaatcgtgcacggcctgattcaaaaaatgcatggaagcagccagctttgccataccccactacagacacaggcacccagctatggaaaatactgaagaataaggccgaaaagagaaaggttggtgggagcagaggtggatcgtcagaagatgaagagggagaatattgcgcagatgaggaaagagtcgagaaagggatgtcatcagaatcaggcccaacagagatgtcaccagctcccacaggccaaatttccaatcctggacgcgacattaccatcggagttcattgggctgcaattaggagattggtcaggagacacaaagcagatatgttatgtatccaagaaacaaagagggagcaaattgataaggctatgtgtcaggccttgtgggacgatctggatgtcggttgggaattcatgccagcaataaatacagctggaggactattgggagggcaagtcaataacatcaatgatttcaatgaatggatagctgacatagagtgcgaagaaataccttctgcgagggcaatggaggaagcaaagagacgccataagccatgtatggtgttcaaagtggactatgaaagagcttacgactttgtctcatggtctttcctatcatatatgatgaagagactaggattctgccctaggtggatatgctggatagagggatgtctcaaatcagcttcggtctctgtcttggttaatggcagccccacaaaagaattcataccacaaagagggctcaggcaagcttccttgtggggcaaaacaatagtcaacatactacagaatgcagatgacaccatattttttggggaggcaacaatgcagaatgtgaagacaattaaggtaccttcaaaagtaatagctaaattggaagccattaagagaagatttttatggggagaaggaccagagcataggaagattgcatgggtcaactggaagacggtatgtcaaccaaaagacaaaggtggccttggaatcaaagacatccggacatttaattcagctctgatggggaaatggcactgggatctctttcgcaagcaggaggagccatgggcaaaagtaatcatctcaaagtatggtggatggagggcactagaagaaggcacaagaggaaatcatgattccacatgtgaaaagtttagattctgggaggatccttggacacacaatggcatgccactaatggagaaatacctaaggttgtatcacatctcatgccaacaaaagacaatcattaagaaaatggggagcagcaataacaatggatgggaatggaagctcacctggaggaggaatctcttggactccgaagtagaaatgacggatacttttattggggaaatatcacagcagcaaatacaacctcgcagggaagataactgggtatggaagcatgatcaaagcggggattactcaacaaaaagcggggatagactaccaaccaagatgaaccttagaaggcgacaagtgatggtaaatgactcgatgtgcccattatgcggacttaatgaagagaaggcttctcacctatttttcagttgcagcaataccttacctctatggtgggagtctttatcttgggttaatctagcaacaactttgccacaaaacgctagggataattacatgcaacatgaaaccgagatacctagtggaaagaagcttacaagatggaaatattcctctgcttctgaatggccactaagggatgacattccctactggtttgatcagcatgcttacaacaatgaagggcaaggctctcaggatgaaaaaagatggtcatcacatctccattcttctctaactcagttgcatgactcaaggcccttgtacagaacatcttcatatcctgagcagcaacgacagttgcaacaccaactccaacattgctccagtgaacctgtttctaacttgtatgatcagcatttttatgatagtgaaactattgaggatggaaaaagatg

SEQ ID NO: 94287 - DNA, 501 bp, Glycine max
  Peptide Sequence Number=SeqID_211065
atggccattttccatcatttgagactcttatttggtggtcttccctctgatctggcagctgcagagactacaagtgaccttgctaaggttgtttgtcagtgtgttcaaggaatggatcttggtgccttaggtgcttgtcttgcagcagtggtttgttcctctgagcagcctcctctacatccccttggaagcactcctggggacgacgcctcccgtattatagtatccgtccttgagaggacaactgaactttttactgatccacatggtgctggcagctatgaagggacgccaaatgtgtctgcaattggatcagatgcttctaaagcaatcagtagggaaatgcctgttaaactcttacgagcaagtcttcctcacaccaatgaccaccagaggaaattactactagattttgctcagcggtctgtgcccgtggttggatttaatagttatactgggagcagtagtggtcttgtgaactcagagactgtgctaagttga

SEQ ID NO: 94288 - DNA, 498 bp, Glycine max
  Peptide Sequence Number=SeqID_211066
atgaaaataattccttatgcttcgaaagtagaaagtctcatgtatgctcaagtcagcactaggcttgatattgccctcgcagtaagaatgctgggaagatatcaaaaggatctaggcatggagcattggaaggcagcaaagagggttatgagataccttcaaggaaccaaggattataagttgacatacaagtattctaatgatttagaaagtagcaaaaagcaaacaattgttacatcatccactatggaagtagaatttattggtttctacaaagctacatcacaggctaaatggctaaagaattttgattacggtcttaaagttgtaaactctattgaaagaccgttgaaaatatttggcaataattcagctacagtattcttctcaaagaaaaataggagtggaagccgaagtaagcatatagacattaagattttagttgttagagaagacatcaagagagaattaatctctatagaggacatagacacataa

SEQ ID NO: 94289 - DNA, 423 bp, Glycine max
  Peptide Sequence Number=SeqID_211067
atgaaccccaaaatatccgatttcggaatagcaaaaatgttcacacaacaggattctgaagcaaataccaccagaatttttggaacatatggctacatgtctccagagtatgctatggaaggaattttctctacaaaatctgatgtatacagctttggagtgttactctttgaaattgttagtggtaaaagaaacaatagcttctacactgaagaacgacaactcaatctagtaggacatgcatgggagctatggaaaaaaggtgaggctcttaagttggtggatccagcactgaataatgattcattttcagaggatgaagtgctaagatgtgttcatgctggtctattatgtgtggaagaaaatgcagatgatcgtccctccatgtccaacattgtatctatgttatcaaacaaaaattga

SEQ ID NO: 94290 - DNA, 201 bp, Glycine max
  Peptide Sequence Number=SeqID_211068
atgaccaacatcctaatggaaaagctttcaagcataaaggaagagagattgaagcatgaggcacctgaaagtgctcatatggtgactcataataaaggaagtgggagaagaggcaatggtgttcttggagtgtgcaagactgtccaaatgaagtggaatggaacaaagatgaattgtttttctgtaatgtgggacatataa

SEQ ID NO: 94291 - DNA, 1222 bp, Glycine max
  Peptide Sequence Number=SeqID_211069
atggtccgcaacacggggggtttgagaagggcttgcaatgctagcttggagcctttctccgttgaagagttcacgaagaagattgaagatctcgcactcaagtttcagctatatgaagaaaataccaatacgaacgatttggattcagaggattttcaggagatttctttgtcgttggtgaatttcacagaggagttcgagctgctggaggagattattccggcaaacatccaatggaaaacgaacaacgtagagcttatgtttttgctaaggataatcaagaagaagctacaatggaaggaagggttcaaagaggcaggggaatccgcgtattgcactgtcaagaaagggttctcttcacaatttcattatgcagatgatggaagttttggttctacgaagatatgcaagggattctcaaaaggttgtagaacttgtatgaccatgaacgcatgcattccacgcagtgtagcagttgtttgtttccttacaagttcactcgtctccctcacgacttgtctccctcacgaaccctttgtcaatctcactctcactctcacggcgctgaaaccactgtcattgttggtgtctcgctcatggtttcactctcactctcacggcactgaaaccacccttcgctcatgtctcactctcgctcacggtgtaggtgtcactgtcactctcgctctcacagtatgtttttctctcgaagcttttttcgatagtgaaatcatggatctgattattttggttgttttcgacagtgttttggttggattcgacagtgttttggacattgttttggttgttcatggttctgatttcaagtatccatggggatcaaccgatcctgattggtcaccggttagtaaggatcctcttactgcaaaagtcgataatctcaaggataaaacttataacaaagacaataatattataaaggccatgtctttatcaaccctaagagatgttcttaaaacaagtccccgttggagagatcatgtccaaacttacactaaggtccttgccaatttcctgtccaatccattagcttcaggaggagataatgatgaagtaggatggccttatgtgagatctgatcttgacccctcacaagtaaaggggcttggtatgttgaaacatatggcaaagataagaatggtcgtacaatgccatcacaaaggttctaggatggcttggactatagcgaggaagctgatag

SEQ ID NO: 94292 - DNA, 1749 bp, Glycine max
  Peptide Sequence Number=SeqID_211070
atgacttgcagcgaacaagagaaacctcaccatgtcttgctttttctcatctatatgtggttgtggtggagtactacttgtatccacgttgaagccaatgatagtttgaagccaggtgatactctgaatgccacggtaccaggggcagagctatgttcaaaaaagggtaaatattgcatgagtttcgacccaataactcatgataatcaggaagcagtttacttgactatatgtgcccaaaagaaagatgattgggaagtgtgggttgcaaatagaaaccaacctgttgactcaaattctgctgttctatcattggatcacaaaggggtactcaaaatagaatcccaagatggtaagaaaaaagtgaagaaatcaccaataatcctttattcaccacctcaacctatcaataacacactggccactttgttggacacaggcaactttgtgcttcaacaacttcatcccaatgggtccaaaataagagtcttgtgggaaagctttgattttcccacagacacattgctccctgggatgaagttaggtttgaatcacaaaactggtggtactaattggtcacttgtttcatggctaagcggccaagtccctactgctggtccattcaagctcgaatgggaaccgaaaacaagagagttgttgatcatcaagcgcggcggcagcagcagcagcggcggcaagcgggttttgtgggctagcgggaacaaattggagcacattccgagcgagattcggcgcgagattgtgccaagcgaaaccggagactacttcacgttgaaaagttctgattcggaggaagagcccacgaagtggacactgttgtcaactgggcaactgataaaccgcaaaggcgtggatgtggcgagggctgatatgtgtcacggatacaacacagatggagggtgccagaaatgggatgcgatattaccctcttgcagacgtcctggtgatgcatttgaactcaaatatgggtaccctaaatgggacacggaagtgaagagagacgaagaaaattcgagttatggcataagtgattgccaggaaatttgctggagaaactgcagctgcgttggatttgctcttaatcatcgtaatgaaactggctgcgtcttctttctgtgggatttggtgaagggtaccaatattgcaaacgagggttacaaattttatgtgcttgtaaggagcaaccatcaaaaccgtataaaacagtggatatgggcaatggttgcaacagtagcaaccatactcataatctgcctttgcattctgcgcagagtcttaaagaaacgaaaacatgtgcttaaagaaaataaaagaaatggaatggagattgagaatcaggatcttgcagcttccggtagatcctctagtaccgacatactagaagtttatttaaaggaggaacatgacttgaaattatttagttatgcatcgataatagaggctacaaatgacttttcgtctgaaaacaagttaggacagggaggctttggagtagtttataagggaattctatctacaaggcaagaagttgctgtgaaaaaactttcaagatcttctgggcaaggacttattgagtttaaaaatgaattaacactcatatctaaactccaacatacaaatttggttcagctactcggttactgcattcatgaagaagagcggattttgatctacgagtatatgtccaacaaaagcttggacttcattttatttggtaagaaaggttaa

SEQ ID NO: 94293 - DNA, 2277 bp, Glycine max
  Peptide Sequence Number=SeqID_211071
atgggcttgtggtttccattggttagctacaaattactgatctgtttgcgcattatttttcccttcataacaggctttgattctagagatcgaagaaaaagcaagtacctgtcttacccatacattggaccaaaccaaaaggatctgccagctgaaactgaagatttgaagacaccatgtccttctcagaaagcaagggcttcaagtgtcactactaatcctctaaatggatcttcttcatatgctaaattgggtagcaagaggttccgaaatagctggtacaaaaaattcatcagctgtaatactatgcccagccattacaatttcatgaatgcatctgcagaagaattactttcaggactttgttctacagctgttgattgtatgtttccagttgggaataagagctttgatttagttgagtggttcttttgcagatatagagtatcaaattatcatgatgaggctgaacttgctacttcccaggttaatgcaaaagaagaaaaattgggaaaacctgagggtaatgatttgccagataccaaaagtaagaagagaaagaccaatagaatggaaaatgcagttaggcgtaagagaaaatcactctctggcctatcagatgtgaatgtaaacacttctaatggtgactctcaaaggcctgggagaaaactgaaacaaaagaggaaggtggaagaagtaactttagtacatcaactgcaaaatgttgagataaattttattggggtaagcagcaaatacagctcagctcctcaagctgcacaaaatttgtgttgccttgcgtctgaaggaaagtctgagcacaatcagagggaaaagatagaggcacaagaacatcaaactgctcaaattaattcagtgtatacagatgcaaaaaagcttaactgcagttcactggtaatagatttgcagtttacacccccagctatacctgttgatattcctgagagaaatagaagtgaaaatacggaagaaatagttttattagcttcaaatccagagtcacgtgtttcccaagaaggacctgttgggagtattactgatcatagcttgttggttagtactaaggctgaggttggtactgtcatggtaaataaaacagggttgatgaatagcatggggaaagcaacaggactgcatctcaatactaaacttgctgttggagtgcctctcaatagcatggggaaagcagcagcagcaggagtgcatcttaatgctaaacttgctgttggaatgcctctcaatggcatggggaaagcagcagcaggagtgcatcttaatactaaacttgctgtagagaaaaaagggttgaagaatagcatggaaaagccagcagaaaagcctctctatacaaacttttctacagggaaaacagggctgaagaatagcatggagaaggcagcagaaaagcctctctatactaaagttgctgtagagatacctgatttgaacggtactggtgctgaatgtaattcgatcagcacagaatttgatactcttaatttcatttcacctgaattaaaatcggagcagtccaaaagcttatctgcatgttcaagatctgccaaaactactacttgcaatagactggatgacagtggagaatcacttggaacctgtgttatcctaaaatttgcccctgtagcctatatcccatcaaaagaagatttaatgacaacattttgccggtttggtcccttgaaggcatctgaaactcagttgttaaaagacactggtagtgctcaagttgtttttgtcagaagtgaagatgctgcagctgcatttcatagtatagagcagaacaacaaatttgcctttggttgttctcttgttgattgcaagctccatcatctttctgccacctgtccacctgttgagcaacttgtgaccactgcccaaccaactgggtttatggcaatacctggtgtgatgacccctactcgaccaaccatgtctatggaaatgcccggtgttacccctacccaaccagctgggtctatagcaacgcctggtgtgacaccaacccagcagccaactgggtcgaaggccgtgcccggtgtcactcctatcctaccaactgggtcgatgacaatgcctggtgagacacctccttcccttcatttcattaagcagaacttgcagatgatgacatcaatcctggagaattcagggagcagtctttcccccaagacgagagccaaactggattctgaaattaaaaaccttatgagaaaggtgaattccaggaccaaggtctga

SEQ ID NO: 94294 - DNA, 306 bp, Glycine max
  Peptide Sequence Number=SeqID_211072
atggataaagaggctttgtgttggaactacacactccttgagcaaattttcaaagtggaggattctgaggccatcttgagaacaccgttgttgaatgttgatcaacaatataccaagatatgtggttatacatcgaagggagtccacttagtaaatagtgagtacaatagaccagagcttgaagcggaagccattctgagagctagagataagtttgtgagtggttgtgagatcctagaggtgaaggagacatcctcaccacttgtattcttgcaatctttcatcttgttcttctctttgttgtaa

SEQ ID NO: 94295 - DNA, 567 bp, Glycine max
  Peptide Sequence Number=SeqID_211073
atggataagagcttgaaggtaggaaaagaagaatggaaggagaaggagagagggagcacgaaattttgtgcctcaaaagaggctcatgagaatcctagggccttctcttgcatctctggcccaatctacttggaatcttctatccaatgcccttgcaggggttatacggtgttgaaatttcaagcctttggtgtggtgactaagaagtttgatagtgatagtgagaatgaagttgttacaaatgttggtaatgaaaacaatgatgataaagcagcgaacatgatgcctatgaatggtattttgcctatccaaatgtcatgggggtttagggacaagaagcatttcataaggaataataggaaaaaggatcacagaccccttacatgcaccaattgtgaagcaaggttgcatgcccgtttggataaggataccgacaaagcggaggttgatgctttgcataggcagggtgtgagaacatatcatattatggggtttatgctagatcaaaaagggggacacatagggattgggttcaacaagagagatttgatcaatcatattaagtga

SEQ ID NO: 94296 - DNA, 291 bp, Glycine max
  Peptide Sequence Number=SeqID_211074
atgatccccctcaaagagtatgccagactcatcgagactaagcttctaagaatgagaaaagcacttgctcaagctttggaagacaaaacttatgctaagaaggaagctaacaagtgtcctattcctctatcatcagattctgatgattctagtgatatgttcttgaggaagcttgatgaagaagctgctaaacaaaaggggaagaagaagccttggatcttcttcatcaatgaagtcctttgcttcttgaagattaatggtagcggaattgagaaggagaaagatgattag

SEQ ID NO: 94297 - DNA, 237 bp, Glycine max
  Peptide Sequence Number=SeqID_211075
atggtcgtgagtggtggtggaggaggagttagggtttctgggctgaggttgagaaggaagagagctcaaaacactgagactagctcaaagcaacttttcatgttgaaagcaattcctctcgggttgggatttgcacgaagtgcatcatttcgcgctaagcgtaattcctcatgggttggaattacgcttagcatgcttctctcgctaagagggatgccaaaaaaatttattttgtaa

SEQ ID NO: 94298 - DNA, 283 bp, Glycine max
  Peptide Sequence Number=SeqID_211076
aagcttcaggcgccaagcgcaccatctcgtgctcacgatcgccttcacttttgcaagcccttcttctcctcttattcccaccaagagcataacttgcaccagctatccattcacctttctatcagaagcttttctacagcaagttgcctggccaggagtccaaccctcttctataaaagggggtgacacctctaacatgggtaacaatggagctgatgatgattacattgcgggcatcactgttgcacatgaagcttgggatccaggccccacacaggattga

SEQ ID NO: 94299 - DNA, 399 bp, Glycine max
  Peptide Sequence Number=SeqID_211077
atggcctcgatgtcgtctctatggccgccaaccccctcggcttcgtcaccgcctcctgctccctcgataacttcgtccacatcttcaatgtcaattccaacgccaccattgcctccctcaaggctcctccccctgaagttgaagtttggaaaatgcacttcgatcccaagaaaaacctatttttggcattgcatagagagtttttggcatccatcgtgtcctctttccctctctttagagagaaataacagtgcaagaagtgagagtggttttgtgggagtggtgtcttccatggcatcaaaccagagactagtagttgattggtgggctgaagatttgactctgcttagaattttaatttttgcttgtcaagtttctcctgaagcaagcaagtgttga

SEQ ID NO: 94300 - DNA, 888 bp, Glycine max
  Peptide Sequence Number=SeqID_211078
atggaaaatgtcaaggcaatcaaggtcattctaaggagctttgaactcgttgcagggtataccaattggggcaaacccaaggcgatgccaactatgggatcctattatcagcaagtggtcccttgcaaagtggtagacaagccggttagattacaaagacgattcttatggggtggcggagctgatcaaaataagattgtttggatcaagtgggaaacggtgtgccgttcaaaggaagaagggggactgggcatcaaagatattagaaacttcaatcttgcactgttgggaaaatggaaatggagcctattctaccacaatggagatttatgggcaaaggtgctagagtcaaaatatggaggttggaggaacctgaatgtagcatcttcggaccctactgattccatttggataaaattttgggaggataattggattaatgatgacatatctctagtagcaaagtatccaagactatattccatttccaatcagcaaaaccacgtcatacagcaagtgggagctcacacaaattctgggtgggaatgggactttaggtggaggagatcattatttgatagtgaggttaccattgctgacagctttttaaatgatattgagggcaagacagttcatccatgtagaagagatgagtgggtttggaaagcggagccaagcggcatttactcgacacaaagtgcgtataatctgctgcagggggaaatcatagaggccagcaattatggagtttttgcggagctatggaatgcagtaaaattattcatatctggtgggagtcattatcttgggttgacaccttcgtggctttaccagaaaatcccaggttgcatttccttcaacatacacttggtagggctgctggaatag

SEQ ID NO: 94301 - DNA, 258 bp, Glycine max
  Peptide Sequence Number=SeqID_211079
atggttgtagaagttatttcacccgcatacttatggttgtttttagctttctatctagagggtgggattgtaaataacacattaaggccaatcatcccaagcaactgtgatcatgaatggagagcactaatggaacaatgttgggcacccaatcctgcagccagaccatccttcacagaaattgccagtcgtttgcgcataatgtctgcagcagcagctagccaaaccaaaacacagggcaataaagcatctaaatga

SEQ ID NO: 94302 - DNA, 120 bp, Glycine max
  Peptide Sequence Number=SeqID_211080
atgccaaatgaagggagagacaaatattacatacctacaattcccaattccatacagatcaaggaaacaagagatgggaaaacagagagcaggattaaatgtaagcagcaagccaactaa

SEQ ID NO: 94303 - DNA, 312 bp, Glycine max
  Peptide Sequence Number=SeqID_211081
atgtatctttctaagattcgggcgagtttacgtagactcgcgagtctgcgacgagtccgcgagttcatgaaattttcaaaacgacatcattttgaagcagagctactcccttactcacgagtcgcgactccatggtcgtgctgtgttgaagctgatactcaccgtttttcactcgcatcgtcatcgctggccctcagtcgcggtcctccgtcgtcatcggtcgtcgctgcctcgctggtcctcacttgcgctccaagctttgcttcatgtcacaacgctaagatgaaagtcatgttacctggactcaggtaa

SEQ ID NO: 94304 - DNA, 264 bp, Glycine max
  Peptide Sequence Number=SeqID_211082
atggagccacacatgaaaatcaacacggtcttacacttagatagggttgttcttgaccatgtggtgcactatatattcaagactctgaccaacgaacttttggtatacttgcctgataaaacctatgagagatggtccatcattcataacaaatgtggcctattccaacttggccaaagatggcatgatttcatcggatactttgaaattgaagagaatgatagtatcaaattcattaagtttaacaagctaatacaatactag

SEQ ID NO: 94305 - DNA, 867 bp, Glycine max
  Peptide Sequence Number=SeqID_211083
atggaagacataaacaggtggctatctttctatgtgaatggaagtgttaaccatgatttcgccatacgaaagtattgccctgcaagaatggagcaagaacaacgaggagaatggcaagatcaagaggcagcagtagttttttatgacactgaattatgttcttcttctgatgctacaggtggcagcactccttgtttggtttcatcagaagttgatgactttgttgatggcttcgtcaacatgaattcagatgatgcatactccatggtgaatggtggagtctttgaatatgttccaaccaccttggaggattcagaattggagatccatgaagctctcacaacaaccatgtgggaggaagaggccaatcttggtgtgaaccaagggttagacttggcctgtgctgaagctgtgggatgtagagacaaccaacaagcagagttgctgcttagaagaatttggcctttggcaagtccttcaggagacgcgctgttttgccaaaggattgaagtggagaataagatggaagcttttcagcttctttaccaaaccacgccttacatttcctttggtttcatgggtgcaaatgaagtcatatatcaagcatcacaaggaaagagctcaatgcacattgtcgacttaggaatggagaatacccttcagtggtcttccctaattagggcccttgcttcaaggcctgagggccatccaacgctccggatcaccggattaaccggcaatgaagacaactcaaatcttcaaacaagcatgaatgtgcttgtggaggaatcaagctcattgggaatgcatcttgaatcacaatttctgagtctccaactccttctcttcttactatggagaagctga

SEQ ID NO: 94306 - DNA, 816 bp, Glycine max
  Peptide Sequence Number=SeqID_211084
atggaatcaccgttcagaccagagattctgaagggaaaggttgctctaatcaccggtggagcctccggaatcggattcgaaatttccacccaattcggcaaacatggagcctcggtcgcgctcatgggccgccgcaagcaagttcttcagtccgctgtctccgttctccaatccctcgccattcccgcggttgggtttgagggggatgtgcggaagcaagaggatgcggtgagggtggtggaatcgactttcaagcattttggaaggattgatatacttgtgaatgctgcagctgggaactttctcgtttctgcagaggatttgtccccaaatggctttcggacagttctggacattgattctgttggcacattcacaatgtgccatgaagcactaaaatatctcaaaaaggggggagaaggaaggagcaactcttctagtgggggatcaataataaacattagtgctaccttgcattacacagcttcttggtatcaaattcacgtgtctgcagcaaaggctgcagttgatgccactacgagaaacttggcactagaatggggaacagactatgatattagagtcaatgggattgcaccaggtccaataagtgacacccctggcatgagtaaactggctcctgatgaaataagtagcaaagccagagattacatgccgctgtataaacttggggagaagtgggatattgccatggctgcacttttcctagtatcagatgcaggtttaacaactttctctcccagatcccaatcaactagttctatgttagggatgcttcaccaaattgcgcaatag

SEQ ID NO: 94307 - DNA, 894 bp, Glycine max
  Peptide Sequence Number=SeqID_211085
atggttaagactagaggattaggccatgtgttaggtaggattgttgctagagagccagaggctgatatagctggggatgagcctatggtagatgctgacgcacaggacaccggtccaaagaatggcgcacaggatattggtgcacatgatgttgcagatgaacctgagggatttcctggtggacccagggacctatcagtgcttacggagtatgttgaccatgttgcggccagcgtatggtctggacaagaacgtcctgagttgaagttatcctcccatgggagaaaggtgcataacttgggcaggcatgttcttgcaattgaggacatggttgttgggacaggattaagtcctttgatcgcgtgttcgatagacatcaacaatcggggacttatatcctcctttgtcgagaggtggcactgggagacttctattttccatcttcctgtgggggaggttttgatcatgctggatgacatcgcgtctcttctccatttgcatatcgttggcgcaatccatgacttccagcctctacgcactgacgaggtggtggggctgttggttgagttattgatggtctcagtagaggccctacgtgatctcactcttgctgggtggtatgcatggggagctgctggcctcatccatatgtatggtcagcttaatgatgtcagtctcagcaccagccgacagcttgctaattacatcaccttgttacagtgttggatatacgagcacttttcgtcagttgcggagtgcaatgctaatccggactacgacgaggtgtcaccacatgtgtgtcgatggattgcaacgaagaagactgtgaagaaggtgtctacagcgacgtacaggcagcgcctggatcgtctgaggatcccagatgtctgctag

SEQ ID NO: 94308 - DNA, 288 bp, Glycine max
  Peptide Sequence Number=SeqID_211086
atgtcttattctagttcttatagggacgagtctctggttgtccaccgggaatccatgcttgaaaatgaggttttaggcataggggaagagtcaaattcatcctttggctcctttgtttcactctctctatttgatgaggaaaattttcagaatttaatgaagggaccagagataacctcagttgttaaagttgttgtcgagacattgtcagcggtgacattaacaccatccttgtcgagtttgatgaagaaaacactaaacataggaaatatgggtgtgattgtgtga

SEQ ID NO: 94309 - DNA, 355 bp, Glycine max
  Peptide Sequence Number=SeqID_211087
ccgaagagaggccaaatgcttcgccctctcacaatcaacacgccttcttctagctccatcaggccaaactactcttcaagttcaagcccaaaaagtgctgaagcagagtccaacaccaagagcaagagaaggagaagctttggatcaaaacctagcaggagaaaaatgtggttcatgcatgtgtttgatgaggaaaagaaggaactgggtaggcaacaagccccgggttcatgcccttattgccaaggcaaggttgaggccatggatgttgagatccagtggagactttgcttcttgcccatgtgcttcaagatcaagaggaagtatttttgtacttcatgtgctagacgtttag

SEQ ID NO: 94310 - DNA, 3180 bp, Glycine max
  Peptide Sequence Number=SeqID_211088
atgcgctcaggagcttgtacattgcaacagaccctcacagcggaggctgcttcagtgttgaagcactctctcgggttggcacgcagaaggggccatgcacaggtcacccctctgcatgttgctgcaactttgctcagcctaagagccagctccttaagaagggcttgtctcaagtctcagccacaaacacattctcattctcattcacaccctcttcagtgcagagcccttgagctttgcttcaatgttgccctcaacaggctcccaaccacacctgctgctgctgctgcaggccctttgctccacacacagcacccctctctctccaatgctctcattgctgctctcaagagagcacaggcacaccagagaagaggctgcattgagcagcagcagcagcagcctcttctcaccatcaaggttgagcttgaacagctcattatatctatccttgatgaccctagtgttagtagggttatgagggaagctggtttttcaagcactgctgtgaagagcaacattgaggacacttctaattcagcaccttctgttttctacaacagttctggtggtggtgttttctcttctccttgctcaccttcccccagtgagaacaacaacactgctagtgttttcaggcaaaaccatttccttgctgcctacacttctaatgaatttagtacttctccttctccaccacttttgttcaagaaggcttcagtgtttcccatcactgagtcaccaccaccttcttcttcttccaaagacgatatcaaggtggtgcttgatgtcctcttgaggaagaagaagaggaacgctgtgatagttggtgactcagtggcactcactgagggtcttgtgggggagcttatggggaagctggagagaggagaggtccctgatgagttgaagtctacacatttcatcaagtttcagcttgcaccggtttctttgaggttcatgaagagggatgaagtggagatgagcctctcagcactgaagaggaaggtggattctgttgcatcaagtggaggtggagccattttctatgttggagacctgaagtggacagtggaaggaacaagtgaaacagaggaaggtggtggtgtttgtggctattataaccctgttgttgatcatcttgttgctgaagtagggaagttgttttgtgactccaacactactaaggtgtggcttttggccacagcaagttatcaaacatacatgaggtgccaaatgaggcaaccccctcttgagactcagtggtctcttcaagctgttcctgttccatcaggtggacttggcttgagcctccatgcttccagtgttcatgattcaaaggtgacaatctcccagaatccatctcatatgatggaaacaaagttcttcagtaacaacaaggaggagcaggataaactcaactgttgtgaagaatgtgcctccaattatgaaaaagaagctcaattgttcaaaccaggacagaagaaactgttaccatcctggcttcagtctcataccaccgaagcccatctaaaggatgagttaactcagctgaaaaggaaatggaacagactgtgccactgtctgcaccagagcaagcagcctcagaaccaatggagcaacactttacatggaaattatcacagttcaaatggcaagatctacccttacaattcatcatacccctgttggccaaaccaaggcagtgtcttcacagattcaagctccatatcttttgctgattcacctgctgcgaaacctgcttatagctccaacaacatagtccctcggttcaggcgccagcaatcatgctccattgagttcaatttcagtgatgtgactcagaaaaagccatcatccacagccttggattctctcaagggcatggaaggtaataatagtgaagtaaagattactcttgctcttggaaattcaacattcggtggttcggggcaaacggtcgaaaatatcataactactactgatagaacactgcgaagagctcatatttgtaaactgttgcaggagaatgtgccatggcaatctgagacagttccttccatagctgaggcattggttgattccaaatctgcaaagccaagtgccactacttggcttttgttgcaaggaactgactctattgggaaaacaaggttggcacgtgccattgcagaatcagtgtttggctcagttgattttctccttcacttggacatgctgaaaaacaacaaggagaattcagcaaccccattttgtgaaatggtagctggagcactgaagagccatgagaagcttgtgattctgatagaaagtttggattttgcagatgcccaattcaggaagttccttgcagatgggtttgaaactgcaaagtttggaaatttaagcatgactgaggagagttcaggccaagcaatattcatactgaccaatggtgacactaggagcaatgaagagaagaaaaccaacgactcggtgatgaagttggtgctgcagataagtgaaaccaagcctactttggagtcttctccacattgtttgggccagaagagaagggctgaaatacttgatttgtttaccaaggttaagaatccaagggttgaggagaaggaagagggtagaaaagtctttttaaggcattcaagcttcaaccatcttgacctgaacatgaaagctgatgaagaagaggatgatgatgaaggggaagagaaaacaggtggaagtagtccaatatcaagtgatttgacaagggaaacagtggttgatccattgagctggaatggtgcacttgagtcaattgagaaccggtttgagttgaatgaaggtccagagagggagagggaggtggcagatatgtttctgtcaaggataaaagagtcttttgaggaggtatatgatgatgatgatggggtggtggtgaattttactgtagaggagagggtgatagaggaaattggtgtggggtgtggtaattttactaacagcatgtttgagaaatggctgaaagacatttttcaaagcagtttattacagacagttaactttggtgataaggggaaggaagggggtataggttttacactttgttggggtggtaaaggagataggaaatcggatagtgatgggttcatgggttcatgtttgcccaagaatgtccaagttaactacttcatggattga

SEQ ID NO: 94311 - DNA, 420 bp, Glycine max
  Peptide Sequence Number=SeqID_211089
atgcatggaagtattagagctcctattcaagggagcctgcaattgggcgaggcttcattagaatgttcgaaagttaacagctgttacggtggggctatgaataggaagaatttaggagggcatctgtgtaaggaggtgttaggaagtctcacattgcctgtctcaattcttgagatctttgtcaaaggcaaggagcaatggggtcatgttgacggaactgattctgctcctgacaaaactacgcatatggaggcacatgccaaatgggaggtcaaagatgcacaggtcataacttggatcataggctttgttgagcctaatatcatcctcaatctcaaaccattcaccactgcaacaaagatgtgggactacttgaagaaaatttataacaaaaataactgctcgcatgtttcagcttga

SEQ ID NO: 94312 - DNA, 1473 bp, Glycine max
  Peptide Sequence Number=SeqID_211090
atggcttgtggcagattcttcatggaaaaacaagttgtggcagagtttgtacgtgttcttaaacttagcagaactgttagtattccacttcagttgctacagacagtgagcattatgatccagaacctaagaagtgaacacgctatatttctttggttaaatgtcttctggtcattgaagagcaataagtggaaaattgaacaagaatacaatttctctgcttgtgaagactcgcaattgaataggtttgaaccagaagcctgttggacaattggtattcctgatgaagtagtttcatttccactgtatgttgaggcaatacgctttgcctttcatgaggagaacatgattcgcactgctgtacgtactgtgacccttaatgtttatcatgttggggatgaatgtgttaatagatatataactagtgcacctcacaccgaatacttctcgaacctggtttcattttttaggaatcaatgtatggatttaaatagactggtctctgagacactgaaaaatccaggcccagattcaacctctgcaattgttgctgctgtagatgaaattgaggataacctgtattacttcagcgatgttatctctgctggaattcctgatgttgggaggctaataacagacagcattttgatgcttctgatttttccaatgcttcttccttccctgagaatagtggacactaatgacatgcaaagtggtgttgtcacttctctctacttactttgttgcatcttaaggatagtcaagatcaaagatttggcaaataccatagtcgccgctcttttttatcccttagagacctttacaagattttctaggggtaaagtcaatggctatatatctgatcgtggtcttacatccgtaagccaagaaccagatgatgataatattgccaagtgcaatgcagaatgcttgacagtgaatgtcccacagtcttctagttcttcaggtttagacacagaaagtattatgtcagaagataattgtagcagttcaaatttggctttaagggaggttttgcttgcatatgttactaaaggggatgatgtacaagttttgggttctttgagtgttcttgccactctactgcaaactaaagaacttgatgaatcaatgctagataggcttggaattcttccacaacgcaaacagcacaagaaacagttattggaaggtattctgacctctttggttgctggaagaaacaatgatatggtggaggatttgacaggtttacctaggaagcaagctttggttggtgaggcgtcaggtgaagagcaacttttttcttctgaaaatagcttgatgagggatggcagtggatgtgagcctggtgtctatcttgaaaagatcaagttatcaccgagtgagaattggggatcgccgatcaagaccttgataatagctgtatgtataccaaaggagcattgcttccttcagttccttgtcccttaa

SEQ ID NO: 94313 - DNA, 975 bp, Glycine max
  Peptide Sequence Number=SeqID_211091
atgtcgacgccgaagccgcgttggcgattaaacagtggggcgagccaaaaagcgctcgaccaatttgacccagtaggtggcgcctaccgacaggttgtcgtcattgaagtcatagccggggttgtgcagggaattgcccggcgttgcggggccgttgccgatcgagatgtagctgcctgggcacttctccagcataaaggcgaaatcttcgctggcggtaaacggccgcagcgtggggataacctggctctctccggcccagtccagcgccaccgcgcgcgccagctcggtttctgccgggtggttcaccagcaccgggtagccgtgccggtagtcgatctccgcgcgggcgccgaagctggcggcctgcgccgtgaccagctcggtgatgcgctgttccagccgcgcgcgcaccaccgccgtcagcgcgcgcacgctgagcgtcagggtggcggtcgccgggattacgttggcggcctggccggcctgcatcgctcccacggtgacgatcgccgtttcctgcggatcgatattgcgcgccacgatggtttgcaggctcatgacgatggccgcgcaggccaccaccggatcgacggtgctctgcggcactgcgccgtggccgccgtggccgtgcagggtgatgtgcaccgtatcggccgagcacatcaaggggccgctggcgaagcccaggtggccggtggggaagccgggcacgttgtgcatggcgaacaccgcgtcgcaggggaagcgctcaaacaggccgtcttcaatcatcactctggcgccgccgccgccttcttccgccggctgaaagatcaggtgcagcgtgccgctgaagttcggctgccgcgccagacagcgcgccgccgccagcagcatggcggtgtgcccgtcgtggccgcaggcgtgcatcaccccggcatgggtgctggcatgcggcaagccggtcgtttcggcgatcggcagggcgtccat

SEQ ID NO: 94314 - DNA, 183 bp, Glycine max
  Peptide Sequence Number=SeqID_211092
atgggatccccgcgggaagccgagggacgggaacgggacaaaaaataccccaacacggagcggggacggggacaggaaagagggttaagggcagacatggtgctaacattatggcgtgtcgttgaaatgcatggtggactagccatcgtttttcaatcttcacctcttgacgatcggccttaa

SEQ ID NO: 94315 - DNA, 471 bp, Glycine max
  Peptide Sequence Number=SeqID_211093
atgtcctttggcggttttcttttatatatagagagtgagagtttggttttatatccgttagcattggaggagggacattggaggagggacttagagaaactgaaggaggctctccaaatcttgaattctccttccccttcttccccaactggattccttaggtttcaggtggcgctccctcccagtcctaagacattcactttgttttgctcccaaccccactcctcctcggtctttcctctcatttatgtttccaagaacgacgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagattctctagaccaggtgcctgacatgcctttttga

SEQ ID NO: 94316 - DNA, 144 bp, Glycine max
  Peptide Sequence Number=SeqID_211094
atggcttatgctctaggaaaagattttctcttggagcagataccattcaaagaatttcagctgatgtatcagtcaacagaccctagtatggaaaaagaatacggtgaagacagaattttgccacaaactaatgtatcagcgtga

SEQ ID NO: 94317 - DNA, 354 bp, Glycine max
  Peptide Sequence Number=SeqID_211095
atgactactattctgcacctggtgatggacaacaagaaaatgaggcccattatctgtaaaaccaaggcagacctcaacaaaactttcaaggaagctaccaaggtctttctaacaactcttatgaaggtttttcaaatagggatccacaacaacagcaagctcagtcaggtgtcgcaacctaccctacgacgggagtgcgaatggtgtaaaacaaaagtgtgtcttctaaaaagaaaacgcgtgggagtcaccaccaacatttattcgaggaaaaagttagaaaaaaccaaaaagaggtatgcaaatttcgataataagggttcaggagttgtttacatatggggaaggtattag

SEQ ID NO: 94318 - DNA, 246 bp, Glycine max
  Peptide Sequence Number=SeqID_211096
atggttggcaagactgtggttgtggtggtcacctttggttttctaccaactcagtgttttgaaggctcttggacttctaagcacacaaaggcttgctcagcaagcatgctcgtcgagcgagacgcgagaagagacaacgtcctcgctgggcgagctggctgcatgctgagcacactgatctctgacttatcctcttctattgtttcgcatcagctaagtgagttggatgccttgctaagcgaatga

SEQ ID NO: 94319 - DNA, 303 bp, Glycine max
  Peptide Sequence Number=SeqID_211097
atgactctgaccttaagggtgcaacggtttgaaatttcctttaagctcatgctaacaacatgggttgaagtatttttgcaaggccggaacaccctaacatgccaccaacagtgtcatctcgatgagagtgatagtgttggattgcccattgtgcgggaattcgtcgattacatggactctcgggctacattcacagtcaaaatggtgagtctctataagattatgataatggtgttacatgagagacttaggtctccactttatattacttttaattttagggtcatagatgcttttaaataa

SEQ ID NO: 94320 - DNA, 606 bp, Glycine max
  Peptide Sequence Number=SeqID_211098
atgggtcgcatcctcgacatgctccccgtgctcctcacgtgcgacccctatttacaattctaccccctcctcgacttcctcctccacgaggtcccgatcctctaccccgacgtccacctctccatcctgcgcagccctaggttactcgtttgcagcgttaacaaccaattgcgaccaacgttgtgctttctgagggaattagggtttagtgggccccactcgctcacgtgccagacgaccctgctgctcgtttccaatgtggaggacacccttttgcccaagattgagtttttgaagggtttggggttcacccacgaagaggttgctaacatggtcgtgaggtcacctgggttgttgacttttagtgtggagaagaatttggggccgaaggtggagtttttcttgagggagatgaatggggatgttgctgagctcaagaggtttccacagtacttctcttttagcttggaacggagaattaagccgcggtttgggatgctaagacgtgttggcgtgtcaatgaatttggaagatatgttgaagccacatttatttgcaagttcctgccgtgttaaggattgcgatgtgactaccatcgcaatgtaa

SEQ ID NO: 94321 - DNA, 396 bp, Glycine max
  Peptide Sequence Number=SeqID_211099
atgatcgctaaatcaaagatcgaggacgaacaccttgtcaacttgcgaaagttattcgagcggctgcacaaatacagattaaggttgaatcccgcgaagtgtactttccgggtcaaatccggaaagttgctcagttttattgtgtgtcagaaaggaatagaggtagacctagacaaggtcaagctgatcgccacttgcgagcctctcttcaagctattgcataagaatcagtctgtccaatgggatgatgattgtcaagtggcatttgaaaggattaaacggtgcctcatgaatcctcctcatgacgagtcaggaaaaaaggaatgggctgtctattacttgagcaagaagttcacaacatgcgaaatgaactactctttgctagaaaggatgtga

SEQ ID NO: 94322 - DNA, 294 bp, Glycine max
  Peptide Sequence Number=SeqID_211100
atgaaatctctgtcagagaaggtagatgcactttcccagaatcttgtgagggaaacgtctgtactaaataataaagaagacactttgaggagtgaagaagccaacaaagcaaatcttgttaaaaatattgaagaattgaagcattctggaaaagagaagtcctctgctgttaaaaaggctgaagagggggcagcagatctgaaaaagaaagttgatgagctcacaaagagtctagaggagcatgataaagaataccaggtaccagagatcaatgtaaaaaaaatgcatcaataa

SEQ ID NO: 94323 - DNA, 213 bp, Glycine max
  Peptide Sequence Number=SeqID_211101
atgtctagtagcttaagtgaggtggttcgcttaagcaagaatgtgcaggaagatgatagatctctagggtcttctcgcttaagcaagaataagtgttgcttaagcgagaatagttgcgggcaaatgagggtcaacccaagggactccccaattgcccagagagtggactatgttaagggacaagacctatgggggatcacttatatggtatag

SEQ ID NO: 94324 - DNA, 456 bp, Glycine max
  Peptide Sequence Number=SeqID_211102
atgacgaagctaatggacagagccattggtggcgccatcgcgattcttggaagtcgtcatcatcgtcttgaactcctcaaagttgacgcaaccgtgtgcgacttgtactgtggagatgccgacgctgataaatgggtcgacactcaaattggccactacattggaattggtactcccttcttcttcttcttcttcttcttctcctcccattcattcaaggtgtgcgacttgtactgtggagatgccgacgctgataaatgggtcgacactcaaattggccactacattggaattgttcttcttcttcttcttcttcttcttcaattctctcttccattggagcacgctattgagctcgttggcggagatcttgccgttgccgttggcttcgaagcggttgaaaactgtctcgagttcgttcatgtcttcaaagtagagaaagaatttagcttttga

SEQ ID NO: 94325 - DNA, 354 bp, Glycine max
  Peptide Sequence Number=SeqID_211103
atggctcaagtttgtttgctcttggtggggcttctcacaatgttctcctctgcctatggctatggatatggtggtggctgggttaatgcacatgccaccttctatggaggaagtgatgcctcaggaacaatgggtggggcatgtggatatggcaacctctacagccaagggtggtgcctccctggctccattatggtcactgccaccaatttctgccctccaaacaatgccttaccaaacaatgcaggaggatggtgcaaccctcctatgcaccattttgacctctctcagcctgtcttccttcgcattgcacaatacagagcaggaattgtgcctgtgtcctacagaaggtaa

SEQ ID NO: 94326 - DNA, 333 bp, Glycine max
  Peptide Sequence Number=SeqID_211104
atgatgatgacagaggtagtaggtgagagtggcgacagtgacgatggtgacaatagaattggtgccggtggcaacgacgacgataacgacaatagagacaatagaatggtggcaatgatggtggtagtaacaatggaatggaagtggtgtgaaagggtggtagtggtaacaacaacgatgacggaggtgatgacaatggtggtagtggaggcaaaaaaggtaaggtgtaatggtaatagcgatgacaatggaggtaatagtggtggtggtgacggttgtggtgatggagacaataatgatgaggtgtggtggcggccgcaacagagttggtga

SEQ ID NO: 94327 - DNA, 267 bp, Glycine max
  Peptide Sequence Number=SeqID_211105
atggcattgatgcacattacctacaaggctggcactgcccagggcacatccctgtcaagtcattctttgagattgtacacttcattaagcgtcaaggcctcctcgttaatcaatttcctcaacaaccactactacttctccaacacagaagatgacgtcaacatcaaggaagccatggaagatctaaattatattccaaaacagctattctggaagtgtataggaatcccaaaaatctatttaggaataacctattctagaatatga

SEQ ID NO: 94328 - DNA, 135 bp, Glycine max
  Peptide Sequence Number=SeqID_211106
atgggtagagtaaagctaaagattaagcgaatggaaaataccaatggtcttctagcaacctatgctaaaagaaagaatagaatcatgaagaaagccgctgagttagctatactttgtgagcatccatgtacatga

SEQ ID NO: 94329 - DNA, 1139 bp, Glycine max
  Peptide Sequence Number=SeqID_211107
aattctccgattctgaaaccgaggcacgtgacgttagcgtgcgtgtgtttttggctatggaggaggacaagtacgcgaaggaattggaggtggctgttagggtggtccacgtggcgtgtgctctctgcgggagggtgcaggagaggctccttgccaccaccaatgatcacgttctagccaaggatgatgattctcccgttactgttgcagaaattttcggggttcaaaatgtgtcaatcattgccgaagaagacatacaaaccatctccaaggatgaatcagcaagcttactggaagctgttgtgaatactgtgaatgagtctttagcttttgcatccaagtacggttttcaaagtccggagacaactctagggacatctgaagttcttgaggccattgcccgttgcaactcaactggaggctccaggggaagatattgggtgcttgaccctgttgatggcacattaggatttgtacgcggggatcagtatgctattgctctagctctgattgaggatggaaaagttgttcttggagttctggggtgtcctaattacccagtaaagacagaatggcttagttatcattaccagcatcatcaaacagcgccagaatcatctctaacaactcctgatactgggggaaaaggatgtgtattgtatgcaagaaaaggaagtggtgaggcatggctgcagtcattaattgatggagataacatgctagaatggtcgaattgtgctagacttattcgtgtttcttcgattgaagatccggcattggcaactctttgtgaaccagtggaaagggcaaactcaaaccattcattcacagctgggcttgctcacagtgtgggacttagcatggtaaaatacgcagcaatagcccggggggacgcggagatattcatgaaattcgcaaagtgtggctacaaggagaagatatgggatcatgctgccggcgttgttattgttgaggaggctggtggtgtggtaactgatgccggggggcgccctctggacttttcaaagggaatgtacttggaaggtcttgacagaggcataattgcatgctctggtgtcacattgcatgaaaaattaattgatgctgtttatgctagctgggactcctcaaatttatga

SEQ ID NO: 94330 - DNA, 888 bp, Glycine max
  Peptide Sequence Number=SeqID_211108
atgggaaaaacaacatcaagtagagattggacacggatctacctcatctacggaatggatcagtggcaaaccttcgtctttcttctctgtcaagcgattctcttttcggttctctcaatactttaccttctctacttcaatgacatctctcacactttccaaagccttctcaaaatcgtcgccgtgcccggcggcgccgcccgcttcgccgccgggttcacgggatccgtgatggcgctctccgccctctgtctcttctacgcggcggcgaattttttttactctgccgtcccactccattccgagatgacccaacgcatcgtcgatgcagtcagtgactggtcgacggtgcggcaggtactcgatctgggctgttgtggccgcggcattttattgaatgccgtggccgcccgccttaaaaaggaaggaagttcgggtcgggtgattgggttaagtggcccgaacaaggccaaattatcggccacgcttcgggctgctaaggtagagggtgtggaggaatacgtaacgtgtcggacaggtgatgcaacaaaactgccatttacggacggtagctttgatgcagtggtgtccggcacattcgtgcacacggtggggcgggggagtactcccgacgtggcgacagcggagagagggagggcggtggcagaggtggtgagggtgttgaaggagggtggggttggggtggtgtgggaccttgtgcatgtgcctgagtatgtgcgacggttacaagacatgaaaatggaagacataagagtgagtgaacgtgtgacggcgttcatggttagcagccacgtcgtgtccttcaagaagccaactcaccacgtgcatggcccacctgaggtcaggttggattggagattctgctga

SEQ ID NO: 94331 - DNA, 2529 bp, Glycine max
  Peptide Sequence Number=SeqID_211109
atggcttcaaccaatccttcagcactagaggattcgctcaatcctcacagtccatattatgtgcatccaagtgagaatccatcaatctcacttgtttctcctcttcttgatcccacaaattataactcatggtgcaagtcaatgtctactgcactcagtgcgaaaaataagctggagtttgtcgatggttctttgccgcaaccagcgcctaatcatgctcttcatactgcatggaaacgttccaacaatatggtggtttcgtggttgatacatttggtatcacctttaatcagacaaagtatattgtggctggataatgtcgttgacatttggagagatctgaaatcaagatattcacaaggtgatttgttgagaatctcagaattacagcaagaagttgcttccgtcaaacaaggaagaggaggtcgaacttttcatggtaatggtagaggctcaaatgctgacaaaagcggcaaagtgtgcaattactgtggtatcattggccacactgagacagagtgcttcaagaaacatggatatccaccaggacatcgtttgcacaaggcgctcgtttgcaccataaacaatgattctgatctcaatacttggcttcttgactcgagggctactgatcacattgcatcttcccttgatttatatagtgagtgtaaacagatttctcccatcattgttagcctccctaatggagaacaattgattgctagatactctgggactgtgcatatttcagaatttcttgttctgactaatgtgttgtatctatctaatttcaatttcaatttcaatttgatcttcatttccaaattgactaattccatgcattatcaggttgtattcttggctaataaatgtctgatacaggaaatctccaccaagaggatgattggtacaattgatgttgaatatggtttgtacaaactcaagtcaacctctagccatcacaacaatacatcccttgctatacttaatccctccaattatgtcaattcttgtaatacaatactattgatatatgacactgcagattccccttctcctacacctttacctcctcaacctaaacctatatctgttgaccagccatatactgaacccacctcctctgaacattccctttgtaagactgacagagttcgaaccaaacccatcaaatacaatgactatcaaaccagtttcgcatcaaccactatcaccaatcatccaggcaccaaacatcctatttcctttgtgatttcctataacaagctctcttcccattatcacagctttattcttaatgtctctgctaattatgagcctaagtcttatactgaagcctgtaaacatgattcatgggttcgagctatgcatgatgaaatttctgctttagaaaggaatcatacatgggtgcttactgatttacctcagcataaaaatgtgattggttgcaaatgggctcgcttggttgctaagggctatacccaaattgaaggtctggactatttagataccttttctccagtagccaaaattactacagttcgacttttgttggcactcgctgcttcgaataagtggtttatcagacagcttgatgtcaataatgcattccttcatcgtgatcttaatgaaaaggtgtatatggttctacctccaagtatgaaatctactaaacctggtcaggccaatcgtcaatggtatgctcgattatctacttttcttgtggctcatggcttcaaacagtctgttgctgactattctctctttactttcaaaagagaaaattcattcactacattattggtctacgttgacgatattgttctgagtgagaatgatctctctgttatttctgatattacaaaattactggatgacacttttaagatcaaagaccttggtaatttgaagtattttattggatttgaagttgcttgtggaacctctggtattaacatttgtcaaagaaagtatgctttggatcttctcatcgatactgatatgttaaatttcaagcctttcaatgcttctcctactactgctcattacacggctctttatcgtattcgtcaatacattaaagctgctcttggtttgggtattttcttttcttctaccagtgagcttcaactcaaagcctttagtgattctgattgtgttggatgtattaatactaggaaatccattactggtttttctgtttatcttggttcatcacttatatcatggaaatctaagaagcaagccacagtcgcaagaagttcttctgaagttgaatatcgtgcccttgctattgtaacttgtgaaattcaatggctcacatatttgcttcatgactttggtattattcataagcttgctttggtgttctgtgacaataaatcagctctccacattgcagctaatcatgtcttccatgaaagaaccaagcatattgagattgattgtcacttggttcatgacaagctgttgatgtttacacaaaagcttcagcacaacaacttgctgatgtttacacaaaagctttag

SEQ ID NO: 94332 - DNA, 1212 bp, Glycine max
  Peptide Sequence Number=SeqID_211110
atggcgttccctctctctccctccttcaacccctccatcgctcgaaaccgaatcgcgtgcttctcgaagaagcagcaccgccacgtcatcacaaaggatacggaagtggtggtggtagacagagacacggcgcgtgccacgtcagcgggcgcgatgctggagaggataatgaagcggttgaggagtgtggcggtggttccgatcgtgattgcgtcggttcagataagcgcgttggtggcgccgttagttgattacgtggcgtctccgggtgccgccgaagcggttctgtattcgccggatacgaaggttccgaggacgggagaagttgctctccggaaagccattcctgccaatgctaacatgaaggctattcaggacactcttgaagatatttcgtacctgttgaggattccgcagagaaaaccgtatggaacaatggaggggaatgtgaagaaagctttgaagatagcagtagatgaaaagaattctatattggctagtataccagcagaactgaaggaaagggcctctttggtacatgcgtctctaatagagggaaaggggggcttgcaaactctacttcaatctataaaggaacaggatgcagataaagtatctgtgaaccttgcatctacactggatacggtagcagagctggagttgttacaggcaccaggattatcatttttgttgccagagcaatatgcacaacaatatccacggctttcagggagaggaactgttgcgttcaccattgagaaaggagatggttcaacattttctccagttgggggagagcagaaaaatactgccaccattcaggttgttattgatggatactcagctccactaactgcagggaattttgcaaaactggtgatggatggagcctataatggcacaaagctcaactgtatcaaccaagctgttatctcagataatggagttgataagaacactggttatagtgttcccttggaaataatgccctctggacaatttgagcccctttacaaaacaacattaagtgtgcaggatggagaactgccggttcttccgctatctgtttatggggcacttgctatggctcacagcgaagcctcggatgagtattcatcgccttatcagtttttcttctatctctatgataaacgaagtgctggtttgggagggatatcatttgatgaaggacaattttcagtttttgggtaa

SEQ ID NO: 94333 - DNA, 117 bp, Glycine max
  Peptide Sequence Number=SeqID_211111
atgactaaattcttcattcatttaatgaagaatcaaaacgggaagattgaagcaaccttcattcgcaatgggaatatggattctaaaacctatataagcaagcaaaacatggcataa

SEQ ID NO: 94334 - DNA, 1101 bp, Glycine max
  Peptide Sequence Number=SeqID_211112
atggtgttggtcaaaggttcgttctcgagagagtcggtcgaaggcaagtctgaggtacaagtgttccgtgacgaacgaccttttcgactttttatgagtcaattgccacccaatgcgaccgagaaggtgggtaagagtgtggccgttgctactgaggtggggacatccgagagggccgcttcttgtcccaagaagcactcgatgctgaaggagaaatgcctgccttctcccatcacgctttcaaagtatatgtgggtcaacatagagatgggtatctacttttcgtgttacaaccacaaatcggacttgaccaacctcattagttggcgctcgattagtgacatgatgaatttgaagacgtgcccgatcactcttcgcacagtccgatctgatgccactccgcttgtagagttcgtgttcatgaaccaagaggggatgaaccgagatttcttctacatctcccgggagaagaggctaaagcaacctatgcttgagtttcaacttgtcgtcacctccactttgggcaacctcgtggctctaatcaatcaaaaaattttcaacaacaatttccaggcgtggatagtcactcaacacctgcaagggtcatccaacattgaaggcctgaaagatcagttgttgaagggcgaggacttcttgaatgtggcatttcaagccaacatgaaattggtcgatgataataagaacctagaggaccaggtgcctgccttgtcaaatgatgccaagggatgggagacacgttccttaagtgtcgaggccttggttaggtcttgggatattgatattagtaagttgaggtcagccttatctaacgccaataaggagatgaatgaggctaatgctgaaaaggaatgtattcagcaaaaggcctttgatgatgtctacaatgctcatgaggttggcttcaaccattgtctcctgcagatgctgcaaatgtgtgatgtcttggactctaatgtcttcgacatcgacaaagatgatgatgctgacctttcaccctcgagaccaacgacccccgtcgaggagacccctaccgaagaggcacatgctaaagacgtagaaaatgtagagcctaaggactaa

SEQ ID NO: 94335 - DNA, 924 bp, Glycine max
  Peptide Sequence Number=SeqID_211113
aacgtccaccttcgagaagcacataggtcttgggaacctgaggctaacccactgggaagaggggaggctgaatcaaccaccataggtttacccagagccactaatttgagcgtgcattcagacgttgttcccccgactaggaacaccttaggaagacagttgtcacagttcaagaatccctttgcccctagcattatggaggcaactcttcactccaattgggagaacttaactattgacaagtatgatggcactacagaccttgaagagcacttggacatctacactacccaagtgagcttgtacaccaaggaggacatgatcctctatcgggtgtgggtcgaggctgtattggccaagaaagataacgactggcctgactacaacaaggccttagttgtcaacattttggctaagcccaagagagccaacaccccacccaaggctgatcactcaaagcgttgtcggggaggaatagacttgagtctagccgggggagacaccaagaacatgcaggatgaccggaaaggcgggggagctgaagccgctctagggagagagaagaaagacccctcaaccagccaaagcggaataggttgggacaaagggttcatctggctctacactaaatttgggcacgaggggccactgcaaaaaaggttgaagatacgatacgtgatagtagatgcccacacatcgtacaacatactccttggccacccttcgctcaatgtcctcggcgcaattgtatcgacccctcaccttgcgatgaagctatgcccccatgcaagggaaggaaccccagaagccgtccactacatggaggctggaggtaaggccaaagaggtagaagaacttaagcttgatcccaaaaccaatgacgacaacctagtgattctaattgaaggtaggaccactttctag

SEQ ID NO: 94336 - DNA, 459 bp, Glycine max
  Peptide Sequence Number=SeqID_211114
atggtggtgtttgagggttggggaacatcgaaggtgttgctcgcccctgaattgttgtgtctgcatcgttcaacttcagatttggcgacaattgtaataccccgacgaatcacaccagaaagagagagatccaaaggttgtttagttaagcgtgcttggtttggagttattatgggatgggtgaccttgtgggaagttttccgacagtcattaatcttgaaagcaaccaaagcagattgtcgagatctcaaaaaggactacttacgaaagattctgactgatgaagggtcaagactttcttttgcttttgtcgtggatcttgtgttgggcttcccgttgttaaagagggagaggaaccttgtgcttagtttcaattcatggaaggtagtcatgggagatgacaatgaagttgtcatcgttggatttgcaagcagtgaagtggagcatcagtttggatga

SEQ ID NO: 94337 - DNA, 1677 bp, Glycine max
  Peptide Sequence Number=SeqID_211115
atggacccgagagacaaggagaatatgatgttcaacatcaaatccacaaattattgttatagagtcatgccattcgaggttgaagaatgccagagcaacatatcagcgcttaatggacaaaattttctaggggaaacttggccgaaacctggaagtctatgtggacgacacggtggtcaagtccgacaatgtgacaactcatttgggagatctagaaaaaatcttcggtcagctcagaaaggaatacatgctaacttggacaaatgtcaaaccatcttggagatgaagagtcctcagaatataaaagaagccaaatgtctagccgacaagatagtctcactgtctgggtttctaccaagaattgctaaaaagattgattgtttacctctcagtttcaatcaaagccacaaatgcggtgttggtactacaagacccgaagaagaggtaccaggttatgaaaaaggtagccctcaaattggtcaacatcgtccatcacctccgacaatactttcaaagccacaagatcacttcgacttcattaaccaattccatccctcaccaccatatttcgaacaagaatggtggacactacatgtggacaactcctccaacaagtatgggagtgaagcaggggtcattctggaaggacccactagggtggccagggcctactccttacgtttcagattcaaagctacatgcaatcaggccaagtacgaagcactcctagcaggtatgaggctcgctaaagagctcctaaggtactatcatgcatttgaaaagcttaagggagaacttgaggaagtgcaacttaaaacctttattctgcattcggtgccaagacccagcgtctcaggaaaagaatgtctacagggtgaaaaaggctcccatgggtggaagaaggagatacttaactacttgatggggaagggtttctcctcacctttgctcaagtgccttgaccaataccaggctgaggatgtcctccgagaactgcacgagggcatttacgatctatatgtcagagaaagaactatggccaccatagttctcaaggatggctactattggctaacctttaggacgaactactcaaactttttctcctcatctctgctcaatgaattctttggtggtctcggcataaggcaccctcaaaccaatgagcaggccaaggctgtgaataaggtcctatgggcctacatatgcacccctcaatgtacaactcaagaaaccccattttggctcacatacggtgcgaacgcgatgttaccagtcaaagtaggacaagtctctctccaaagacactacttcgttgaagccgagaaaaatgaagcattacaagtggatttggacctgatagaccaagtacgtgaagatgtggaagggaacctagtgtggagagcatgcggcaaagctcagaagcccctgtcagatgggaagctcacgcccaactgcgaaggaccattcaggattcgacacaacctgaagaatagagcatacaggttgaaagaacttttcgggaagtaccctccttggccaaggtcaaacttcaaagctcacaaacagttccctctcgagtaccctcctcggtcgaggtcgaaattcaaagatcatgaacaattccctcccaagtaccctgctcgattgaggtcaaacttcaaagctcacaaatag

SEQ ID NO: 94338 - DNA, 141 bp, Glycine max
  Peptide Sequence Number=SeqID_211116
atggaagttaaaatgatgttcttgaaaaagtgcgattccgggaggaatctcggggttgaggccataaagattgtaagggtagaggttgatcaagaaggagaagttggagtcgtgaaggaattggaggagtggaccgaatag

SEQ ID NO: 94339 - DNA, 312 bp, Glycine max
  Peptide Sequence Number=SeqID_211117
atgcaggttgcccttcaaaatcaaaccaaagaaagaccacaacttccaccaaagatgtgcaagagaggggacctctctattggtcacaagcatgattgttcaaccacgttagtccggtccagaccgggctgcacgcgcttgaacaaccgacccggttcaatccattgtggttttgtggtgccaaaaatgcctcaaggaaacaaagaggtattgaaaagagcactaagtccaccaccaacacgaaggattgggcttagatggttgaatttcagaccaaccccaagcaagctctccaacatgtccacggcttga

SEQ ID NO: 94340 - DNA, 129 bp, Glycine max
  Peptide Sequence Number=SeqID_211118
gtgtggcacggcgattttggacagagttggcatgacagtgctagaggacaggatggggtggtgcagcaaggtgatgcgtgggagaagtctgaggggaaggagaggtggcgtaaggatttgctgaattga

SEQ ID NO: 94341 - DNA, 221 bp, Glycine max
  Peptide Sequence Number=SeqID_211119
atgcatatcagaatccataaactccttgtactccaccagttttctaatgaatttttggctgcactgaatccagtgcaacgcaatcaggaagaaccaatgaatcctgtagagatcgagtatgcagatgctttaatggagctttgtgaggagatgagtatcaaggccattagtctgtggtctgcaattcagacaagggatgactggttagatgatagtttcac

SEQ ID NO: 94342 - DNA, 162 bp, Glycine max
  Peptide Sequence Number=SeqID_211120
atgccttccgtggacgaggttggtagcgcattatccgtggggtttggagatggtgagagatccacatgccttccatggagtccacaaaaaggtgtggagcatcttgatataggtcttcttgtattagcacttttgattttctctaactgcggggtagaataa

SEQ ID NO: 94343 - DNA, 780 bp, Glycine max
  Peptide Sequence Number=SeqID_211121
atgacggacaaaagaaaagttttaggaaaaaataatgaggaaacaagaatttattttacatggaatttggaaatggaacgtgtattggctggtgtacttagagatcaaaggaatttgggcaacaagggtgacggaggttggaaaaggtcagcattgaatactgcagccgcagtgttgtctacaagcttcaatgttaatgtcacatcagataatgtcaaaaaccatatcaaattatggagatcgtggtatggtatttcgcataaatcggctaaaccgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaatcaagctctaatacaaaagaaaaaaggcaaggttcgacttcttctggcacacatcctcacaagagaaagatgggagaaaaagaaggaatagcagcttctttggataaaatgacgaactcttttaacggaatggtagaaaaaatggatggtaaagttgatgatgaagatattcaagaagtattacgtgaggcagctttgatcccagatcttaatagacaacaatgggctaaagctattaaatggttagctgacgatccaaagccgttagctattgtgaaagcccttccaattcaccaaaagacagattatgttttaacacatcttggagaatga

SEQ ID NO: 94344 - DNA, 159 bp, Glycine max
  Peptide Sequence Number=SeqID_211122
atgtggagaccaaaaacagttacacaagttatatcctcctacacaaattatatcctcctcgtatattgcgatagtcatgttgatggcaccaacaatggtgcgatcatagtaatggtggcggcgatgatggtggttgttgcagtggcgatcttgacgtaa

SEQ ID NO: 94345 - DNA, 258 bp, Glycine max
  Peptide Sequence Number=SeqID_211123
atggaggctcacccaggcgagccaaatttcgcctgggcaagtgttacaggctacaaatatgtccagcagcataaaagagccatttctttctccttctcttccactaaaccctcccccaacacccccaacctcctcctccaccaccactggtcaccggtgaccgccatgagccgcctttgcttgtcgtcggaccaccacacggagaagaacattttaatcggagtggaatcttcaaaactcaactcaagaattcgttag

SEQ ID NO: 94346 - DNA, 1727 bp, Glycine max
  Peptide Sequence Number=SeqID_211124
atggatcaaaaagataagcatacggtttcacatcaagggcggggcgaatctagcaagaaagagaatatgaaaagatcgctcttgggtccttgcaaagctgaggttgaatcaacaacggctgatgaggcaactgcagcgaaaagcccttcaccaatgctacgtgagtgcaatatttgcggcaaggtcttcagcagcggcaaggctttggggggtcaccgaagatcgcactttcaaaagcaccagaagaaggtaaaagtccgtttcaccaatcactcgtcaaaagctggtgatagcagcaacattaatagggctaataattgtgattacgatgctgatgatgatgggaaacgcatttgttgcatttgcaagaaggaatttcccaccaaaaacgcattgtttggccacatgcgatctcaccctgagaggtcatggaagggtgtgtctcctcccactcgttctcccaataagaactcctcatcttcttctctctcttcttacactttttcttcccaaaattctgattctatggagaaaaacatggaagagtatcgtgatgatgattatgttgattgtgttggtgggggtgggggtaatattgttattattgatctttcaacttttacttcacccagttggcttaagactgatgtgagaggcagaaagtgtattggggcttatgaggctgctgaaaccctcacttacctaagtgcttattctaagtacttttgcagtgagtctaatagggtttctcccaagaaggatgaagtgctgtcgaaaagtgctccacctctaatcaagaatggcaaaaggaaggttggtgaatcgtcatcgagcaagaaacataaggtgaaaaagattaagttttatctgaatggtgaattgaagatcggaaagaaaaatgatggggacggtgaatttgatgatgatgagggtgagaagctgaataggtgcaagggtttatctaaatctggggttggaagaattttgtatatggatgatgaggtggaagaggaggagggtgtggacgaggctttcgacgatgtgatcactgaggtggttgctcctgctaaggtgcaagatcacgttgatgaaaggaaggtgaagagggtggtggaccataaagggaagaacagtaagaaactggtgatgaaatttaaggcaaaagacacagaatatgagaatggaggtcaagagaaagagaaagtgggtgggtataaatgtggagcttgtgggaaaaaattttcaactttccaaggcttgggagggcacagatcagtgcacaaggagaagaacactgagatcatggacgagtcgaaccgctccaaagctgttgttgctgatcaagaagacaattcttccagctctagtaacatgcacaaggtggatgaggccacaatgaatgaagcaccattaccaacagacgagacaacagcgaatgaaaaggcaccattgctggcagatgaggcatgtcaatcttctccatgtaccaagaaattggattttgatctgaatgagctgccttgtgttatcgagaaattctctcctctgcctttctctgactctgatgtgcttaaaactcattcagcgttctctgctctcggaacagtggcgtcaccaccttctccctccgcagctgaatcacttaaacatcacggtttctattgcttgtgggagagaggcagaaactacggatgggcgacagggcgaggtgttggaggaagtgaagg

SEQ ID NO: 94347 - DNA, 339 bp, Glycine max
  Peptide Sequence Number=SeqID_211125
atgtgtagaataaaagtatcccacttcatatcttttaaactctgtctcctgcttctttttttcttcctaatcattccttcctattatgatagaggtatactgcatctatatcagcagcaaactggaaatgaggatgctcaactgactcctcttttatgtcttggagctggagcatgtgttgaaataattgctatgtctgcgacttatccaatggatatggttcgaggcaggattaatgtgcaggttcaccaatgggttattcattcatggagtaattccaaccaaaatttacacagtatcactgcatcattctccaatactccaattaatatgcattga

SEQ ID NO: 94348 - DNA, 180 bp, Glycine max
  Peptide Sequence Number=SeqID_211126
atggcttatggtgggcaacaacgaggtaggagaggagatcgtggagggaggtcgatgaatggaaagaaagaggatcatgatggcggtgtgagcggcgatgccactaatcaatttggaaaggtgaatgagaaagaggcggacctcgatttgaaaacagtggatcttaagactccaccatag

SEQ ID NO: 94349 - DNA, 672 bp, Glycine max
  Peptide Sequence Number=SeqID_211127
gaagaagaggataggaatgatgattttatacaaaatcctccttctgttgattatgaggcttgtgatgaatctacaccttcttttcaaatccctgtttcggctgcacctgtttcacaaattcctcctcagcctacaacaatgaaacctccatcacgctcaaccatccctactatctctaatgaacacatgactcaatactttatgccaccacttgctattccacctatgccgatcgaaacctcaccaattcaagaattagctgaaataaatcctcaaatccaagcaattaccgacaaactcaatgctttagtcgatcaacatgttcccctcttcatacaagcaactaacattgatactaagcttaccttaatgcttcataaaaaagaagctttggaaattgatctaaggttgagtgaggaacaacatattaaggacttaaagtcctggatcaccatcagggatcaactttctcaacttgaagttgagttggcaatcgatccagcgaatacatgggacattttatcgacaaccaatctaagagcttcctcatctattctagattctatggctaccaaggataatccctttgtcgcgccagctcgcctgggtgagctaattcctttagccataagtaactggctcgcctgggcgagttgcccctgccccaaatga

SEQ ID NO: 94350 - DNA, 183 bp, Glycine max
  Peptide Sequence Number=SeqID_211128
atgggagaagtccatgaagggttatgtggagcgcatcaatctgggaacaacatgaaaaggatgattaatcaatatggttattattggccaacggttactgaggaatgtttcagtgccaaagtggctatcgcgctaagcgaactcagtgggcttaacgcgtatccattgctaagcatgacttaa

SEQ ID NO: 94351 - DNA, 168 bp, Glycine max
  Peptide Sequence Number=SeqID_211129
atggataagagcttgaaggtaggagaagatgagtcggagggagagggagagagggggcacaaaatttatggctcaaataaggattgcatcatccctccccttgaaaatgatttgacctcaaattcagaggttcttgaaactctgagcttcttccctcaacacctataa

SEQ ID NO: 94352 - DNA, 1000 bp, Glycine max
  Peptide Sequence Number=SeqID_211130
atgacaccttcgaccgaagatgtgaaaagagcaatgcaaggattgtttgctgtacttcagctctttagaaagacaccttttttgccaagagagaaaggaggggcaaattgggaccaactcttagcaagcaaagaagaagcatctgtcaactggttccctcgatggaaagaagaaagaaccggagttcttattttgtgcggaggattcctgaatgttcccttgatagggacgaggggttgcatcagctataatcccgttctttctataagacaacttggctaccctatgagaggagcaccaatagaggaagaaatcgcgcctgtcatttcacgaggtttcaatgagaccaacgtggagacacttcggaaggacaaagagctcagaggcagtaacaatgggcccatcggtggctactgtaagtggttgagaaccgctaaaggggaggaagttgaggcaccggaggaagacgaagaggagaatgccgaactaagaaatgtaaatatagctaccaccaaggccttggagcaagagacagaaagggctcgtagggaagagcacggccggaacaagttccgaggggctctgtggggcagcaacaacgagcttaagcttcggagggaggaaagggaccaatcccgggtagacagtttgatcttgaaggatgagttgaaggcttgcttgaggtccaagagaaacttgtctcagcggttatgcgagacagagaccaacatgctagccatcatcagcaagtaccaagaagaattaaatctagccacggcccacgagcaccaagtggtggacgagtatgcccaagtgtacatagaaaaggaggctagaggaagggtgatcgacgcgttacatcaagaggcaacaatgtggatggaccgatttgctcttaccttgaaggggagtcaagaacttccccgattgctagccaaggccaaagcattggtggacatctactccgcccccgaggagatccacggacttctcagctatt

SEQ ID NO: 94353 - DNA, 759 bp, Glycine max
  Peptide Sequence Number=SeqID_211131
atggccttacttacaggggacgtgagcctcacacggtggctggaggacccaacagaacctaatacaactctgtcatggaatgtgatccatggaactggtatgatcacacaggacatattctggtcgtcgagctattatgtggcattgggcaatttggatgaggatgtggaggtagcattaaacctcagtataagggcctccttgcataatacaacgaatgctttctacaaatgtgatcttgccaatggtccatgcagtttgaatcttttgttttctgatggaagtgcagctgtcttagttactcctggtccacaacaggcaagattattatcatgtggattgactttgcttgtgtttggggccttcaacttcttgaacaagcttcagtgtgctcatgaagatagagcaggagttagatctgagggaacagaacgtcagagagcccctttgcttcctcacaaagatgatgatctttcaagttggggttcatcgtatgagtccttgccacaagatgagaaggatcttggctttcttccaggaggccccattgatgggaagactttagttgatggtgaaaccagtaataacacacggcatctttgtgctatttgctttgatgctccgagggactgcttcttccttccatgtggacactgtgtggcttgctttgcttgtggaactaggatagccgaggcagctggtacttgccctgtttgtcgtaggaacatgaagaaggttaggaagattttcactgtttga

SEQ ID NO: 94354 - DNA, 911 bp, Glycine max
  Peptide Sequence Number=SeqID_211132
atggcttatttttcttcttggcattacaatatttcagagaattattgccaattaaagaaacatgtggctattgaagaagaaattgccctgaaagaaactgttgttgcagtggagcccatttcaactaaaactgccagagatgcacaagaaactaaatacaaagagcgttctgaattgggaggaaaattggaagagaataatttccattatcatgtggaagacagtgtcctttccaaggagaaacaccatgaacgtatggttaatttctgccttgatgatatagattctggagaggccatctcttcaactaaggcatacacttgcttcatggaagctaaagctactgcttttattcaaaatgcagaacttcatcctccttcgataaggcatttgagagttcccatcctgcctccatgggcagatggaaaggctagaatgtctaagtttattaatagtgaactaaagcttgatcaaaggcatagaaagtccgacatttatgaccataagctctgctttgtaagagttcatcttcatccattcaaagaaggatgctttgaagagggtgcagttatttgtatggacttcaagatcattactacgaccatcatcattgccgacaccaccaccaacatgatcattgtcatgatcaccgtcatcgcaacgaacatgatcgtcgccattactaccaccaccaccgtcagcaatgacagcgggggcggtcattttggttgtcaggacggtggtcatggtgatgatcgcggtgatggtagtggtggtggtcatgacaacaatagtcatgttggtggtgccactggtggtcatggtagcatggtagtggttaaggtaaccatgagagttgtggtagaaaccgtcatcagtggtggtagtggtgatattcatgataatgatag

SEQ ID NO: 94355 - DNA, 678 bp, Glycine max
  Peptide Sequence Number=SeqID_211133
atgggcgtggacttctacaagattcttcaggtagatagaagcgccaaagatgaggatctcaagaaagcatatcgaaggctagccatgaagtggcaccctgataagaaccctaacaacaagagagaggctgaagctaaattcaagcaaatctctgaagcttatgatgttttgagtgatccacagaagcgaggagtgtatgatcagtatggtgaggaggggctgaatggggtgccgatgggcgcaggtggttttcctggtggtggcggcggcggcagcagcggtgacggtggagcgacgtcattccggttcaaccccagaagtgcagatgatatattttcggagtttttcgggttttcgagaccctttggtggtggaatgccggacatgggtggccgagctggtggctctggattttccaggggtggaccgtttggtgaggatatctttgctcaatttagaagtgcagctggggagggctctggacatatgccaaggaaaggtgcagccattgagagaccattgccttgtagcttggaggatttgtataaaggaactaccaagaaaatgaagatttcaagggatgttagtgatgccagtgggagagtgttgcaagttgtgaaatctaggaaaaatagtttctcccacgagttaggaaaaatagtttctcccacgagttag

SEQ ID NO: 94356 - DNA, 375 bp, Glycine max
  Peptide Sequence Number=SeqID_211134
atggaaaccatatccaagcgatttgaagagcttgatgtttgtagcaaagttactttgaagagtaaacttcaggaaatttcttaccctgatctagactctatgtgtgttcttgtagaaaagaatagtaattcttcagtcaaacatagtgcatcatcatctgagcaaccaattcaaagaaagaacatgtcgatgttggatcaatttcatccatgcattcatgatttcattgtaaacattatcgatgtcaaagctgatggtatgagtgaagattcatggtcattggtatgcaactatttgcataaagaacttacaaaatggtctaatgagtatatcaacctgattggtggcataaacacatttgaggaattaaagtag

SEQ ID NO: 94357 - DNA, 417 bp, Glycine max
  Peptide Sequence Number=SeqID_211135
atgtggagctcacctccatcatgtacgatgagttttactgggagctccaaaggagacagtggcaccactggctcacgccatcatggccaagctctgcacaccgaacggtcagttcattctaaatgccgatggggtcgatggaacgtcctgagctacttcaacctcgctccgacctttcacaccttcgacttgaatgtggaccaggctcgactcatctacgggctgcgcgagaaactggcccagtgcccatactcgcttagtgaccagctcacgcttagcgtgaagaaggccaatgagaaagctcaaggtcgcgcttaccatgaacaccgtgctaagcgtgtgattaaaccgccattgttgctaagaccaggattgcatgttcaacgcgaagttagcgtgaaaagtaagctaccttga

SEQ ID NO: 94358 - DNA, 216 bp, Glycine max
  Peptide Sequence Number=SeqID_211136
atgtccatagaggaaaatgaggaagttggagaagcaaagggtgaaaagaaagagagacattggaaagagaatagtagcatgagggagagcgcaaataatagcaattcttcggatgctatagtccttgaagatctcttcaacagtgtagggtttggaaggcatttagccaaaggctacagatcaaagagtgtagagaaactatgcatcagtttttaa

SEQ ID NO: 94359 - DNA, 291 bp, Glycine max
  Peptide Sequence Number=SeqID_211137
atggatgaactgaaggatttgatcaaacaagttgcgcctcgtgggattcccccttatggtgttgatgaaatacaaatggtaacgcgattgttttttcggaaaccaagtcaccatgagtattcagaaaaagttataaaatttgaaataattgaactcaaaaccaacgaggacgtgatgaaggtgctcattgagtctaactactggaaaaagattgggccaatagaaattttagttgttttcagtaaacctttaccgcaaatggaaggcgagttatccttgtcgcaaaattag

SEQ ID NO: 94360 - DNA, 496 bp, Glycine max
  Peptide Sequence Number=SeqID_211138
tttttcccagtgtagtcaatttcatgcgatagcacatttatcacgccaaagcagcccctggttgtttcagagttctttcataaatttctgctatctttggtatagtgggtgtttggcagtctggaaacgattatttagcttgatcaatgatcttccatctgtttttgaagttgtgactgacaggaaaccagttaaggacaagccaactgcggatagtggaagcaagtctaggggaagtgccaagagatctagcgatgggcaagttaaaagcaacccaaagtttgtagatgagggttatgaggaggatgaagatgagcataatgaaacactttgtggaagctgcggcggaaattacaacgctgatgagttttggatttgctgtgacatatgtgagaggtggttccatgggaagtgtgttaagattacccctgcaaaggctgagagcataaagcaatataaatgtccatcatgcagcctgaggcggggcaggccttag

SEQ ID NO: 94361 - DNA, 444 bp, Glycine max
  Peptide Sequence Number=SeqID_211139
atggctaaggagttggggggaatagggttcagaaacacctatgggtttaatcttgttctgctggggaaacaaggttggaacctcttaaccaacccatatactattatttcaaagttgctcaaagataaatactatccaagaggggattttttagaggctaaggtggggtcaacccatcttactcttgatgtagtatctgtgtttatagtcttacaagggaagcaacatgttatgcatgtctcagattttgatagaattctcacttgtatttacaatatgatcattaatgaaatgaggacaaagcttaatgtgttatatagttattgtgcggcacgattcgtatactacgcatcattttcctttttcataaagaaacagaagagtgaaaaagatatatcgattaaacttgtaaaccttatctctgcattaagctatgccaactaa

SEQ ID NO: 94362 - DNA, 138 bp, Glycine max
  Peptide Sequence Number=SeqID_211140
atgggttccaaacaacgctcttgtggctcggccactgccagagaacgcctacgctggacacaagaactccatgatcgttttgtggaggctgtaaatagacttgggggccctgatagtcaagatgaaaaaggcttctag

SEQ ID NO: 94363 - DNA, 546 bp, Glycine max
  Peptide Sequence Number=SeqID_211141
atgcatcctaaatgttcaagtggtgcaatcaagaaaattaaagaggagcaaaacaagaatcaagtggttagattcttgcgagggctgaatgatcaatattcaggtgttagatcacaactaatgctcttagataatcttcccaatgtgaaccgagtttttgcactagttgctcaacaagaacaacagtttgccactgagattgcttccatgccaaaggcttttcttgtggttagcgatgatacatcagactccaagagaaatcaagggagtagtaatggttggaataacagatacacttttaagaaatgttcttggtgcagaaaaatgggtcacacaattgacatttgttataggaaacacgatttccctgctggttttaagttcaagaattctaaaaacattgctccaagatctgcatatatggtgatggctgagagaaatgagaccaactgtccagatgattcatcaggaaaggatacacaaggagatgcacgatttggttttactatgagccaatatcagaatttgatggctctactgccgtag

SEQ ID NO: 94364 - DNA, 705 bp, Glycine max
  Peptide Sequence Number=SeqID_211142
atggatcaagaactagaggcgctgacaaggaacaatacatgggtcctggttgataaaccacctaataaaaacctagttggttgtatgtgggtctacaaagtcaagcacaaacaagatgggacagtagaacgatacaaagcaagactggttgtgaaaggttacactcaaataaaaggaaatgacatttctgaaatcaataaggtcaagcggcaacttcatgcacaatttcgcattaaggatcttggagaagccaagttctttttgggtttagaaattgcacggtcctccaaagacatagtgcttaaccaacgcaaatatgccttggaacttttatcagactctggtcttctctgttatcgtcatcaagaagttgttcacagagtacttcgctatatcaaaggatcacctgggtgtggccttttctacccagcatcaaacgctcacaagctcacaacctacagtgactctgaccgggctggttgcatttattctagaaaatccattactaggtattgtttatacattggttcttctctaatctcatggcgatccaagaagcaaactactgcagcaaggtcctcctatgaagctgagtatcgtgcaattgcagcaacagatctgcaagccgctgaaccttctcttgtgtcactcttctacgacaaccgctcaataattcatattgctcacgatcctagcttccattag

SEQ ID NO: 94365 - DNA, 399 bp, Glycine max
  Peptide Sequence Number=SeqID_211143
gatgccttcaacctcttcaagcggcatcagaaacaggcgctggccgttaaatccgaccacttcgctttccacttcccgcgtttcctggccatcctgacgctcaattacacaggtcgcgcccagcggcagctgcaggccggtggcttcaagcaccagaccggtggcgcgggtcagtcggccataacgacgaacagatggcaactgcgccatcttcgtctcaaagttgtcgagggtattgagccagcgggtcaccctcatcggcagagactttacatccgccgtgatgtagcgtcgggtcaccgcgcaggcgccagccgtgcaggctcagcgtggcgcccagactctcttccacgcgctgcaggtcgtccggatggacgcgcagctgcggcttcccgctga

SEQ ID NO: 94366 - DNA, 426 bp, Glycine max
  Peptide Sequence Number=SeqID_211144
atgcctgggatcgttatgcagacaatgtccttggccgaaagatccttccggaaaggaatgtgaagctatatatcacagaatttgatgaattcaggagagaaattgagaggagaaattggcataaggagctcactaacttctcagagggaagcattgatgttgttattgttaaagaattttatgctaacctctatgaccctgaagacaaattgcctaagcaggggagagcttgcccacctactccagacgggctgcctctaaagatcttaaggaagaatctgactactctggcccagacctggagtgttctatctttttctaacttagccccgaaatctcacacttcagatattactttgtatagggataagttaatatatgggcttgtaatgcagatggatatgaacttgggatccctcatctcag

SEQ ID NO: 94367 - DNA, 246 bp, Glycine max
  Peptide Sequence Number=SeqID_211145
atggttcactgttatcaagcaagtcggagatctagcatgaccacagatttacctccactccttatgttcccacggacccaggtccccagtggagtcgccaactgtcgcaacctacccttcggcaggagggcgacgcgaggctcacaggtgcatcttccaaggaaggaaaacgcgcggagtcgccaccaacgtttattcgaggaaaatgtcggaaaaaccggaaaaggcgtggtctacgaactttaa

SEQ ID NO: 94368 - DNA, 840 bp, Glycine max
  Peptide Sequence Number=SeqID_211146
atgactggtgaggtccctactgagctgtgtgcactgcctcggtttaggtccaagttgcagctggacaagctcttcgatgggtttcgggcctctgtcaaaggtgtcgtctcgcggatctatgtcaaattccctacccaggctggattgatagacggtcagggctcggatttgagacccttcatccactgtcatgacatgagtgccttcagccgctgtaggggcccaacagtcttcggtgttgtgactaataccgcggtggtatctatggctcgtactaggccctttggagagaagctgacacttgtctggcttatgcctcttgtcctacgtgtgcgagtcaggcttggtgtgtgctttgtgcttatcgcacttttgtccgacttggcggacttcattctgaaatttggacattacttccatctggatgtagcccttggctcgttcacgcaatttgtccatgctaccgggtactcatcgtctgcgatgagacctactagtagcatattgcgcactgaatcgtttgacaagggtgtcgaagctatttatggacctagaggttcgcctgtgtcaggaagttatcagatactcgtttggatctgttgtcccatcgtactgcttgaggttgagtggtttccaccccaagggtacatctgcctccataatgtggtcgacaaaaggatgttgacggacagtccattattgcatgtgattccccttgggtgcgttcaagcaagatgtcagatgaggatgcgagtctgcgaggggggtctcgcgtttgatgccagaccgagtgaaaggattgatgagaggccgtggtgtatgttttaccgcagccccatg

SEQ ID NO: 94369 - DNA, 135 bp, Glycine max
  Peptide Sequence Number=SeqID_211147
atggcgtctatgccatatgcccttagacttgtcgagtctagtttgcaaggccctgaggatgactctgttagctatctcttcctgtccgttagtctaaggatgttcgacaaaggtgaccaggtgcttgatgcttag

SEQ ID NO: 94370 - DNA, 456 bp, Glycine max
  Peptide Sequence Number=SeqID_211148
atgtcatccacagcgagtgacatgtatgcaagagcatactactatgactctagtgtgcgccacccacggcaagtgacacagatgcaagagcgtatcaccacggtgactccattacatgtcacccacgatgaatggcattgtatgacaccgatgatgagtgacatacatgcaagagcgtattaccatcatgactctactatgtgtcacccacagcaagtgacatatatgcagaagcatatcaccatgtctccagtgcgtgccacccacagtaagtggcatgtatgcatgagcacagtgctcaaaacccaggttggacaattccatggtcaatcctttacagggctcgcaaaacccaagtacaggccacccacagcgaaggccatgtatgaaagggcacaacacttacgctacacacaagacttgtcaaacccaagcatcgtgcttgctgattgttag

SEQ ID NO: 94371 - DNA, 249 bp, Glycine max
  Peptide Sequence Number=SeqID_211149
atgtctgcttctttcgttcatcgtcttccaagaatccctcgaagtgaagctttcatcatttcgttcaatctctgcgaagcattgccagaaaagttcatgtgtgaagtctccgtcaaatcgaagagcctctgggcaatggggtacgaagttttgagggcgagccctggtgcagcggtaaagttgtgccttggtgacttgttggtcatgggttcgaatccggaaacagtctctttgcatatgcaagggtaa

SEQ ID NO: 94372 - DNA, 357 bp, Glycine max
  Peptide Sequence Number=SeqID_211150
atgaactatattccttcgaatcgttgttggaagtgcaatagatgttatagtggtacaagcggtttgaaagattcctttgtcgaggtggttgaagagttcataaacaaagctagtcagaaagattgttatcacaatgatgggggaatcaaatttccttgtgttaaatgtgattgtacttggattttggaggatagggttgtgaagagatacaacaggaggcatgaaagagaattgaagaattggagtctcacgctcaatgcgagagcctcacttagcgcatcaagaccgctcacccaagaagctcgcttagtgcaagaagccacattggaagctagttgtcacatgcaaacgcactaa

SEQ ID NO: 94373 - DNA, 1002 bp, Glycine max
  Peptide Sequence Number=SeqID_211151
atggctccggaagtgctcaagcggaattatggaccagaaatagatatatggagtgcaggagtaattctctacatcttattgtgtggagttcccccattttgggctgaatccgagcaaggagttgcacaggccattcttcgagggcttatagatttcaaaagggaaccttggcccagtatttctgaaagtgctaaaagccttgttaggcaaatgttagaacctgaccctaagcttcgattaactgccaaacaagtgcttgagcatccctggctccaaaatgctaagaaggctcctaatgttccacttggagatgttgtcaagtcaaggcttaagcaattttcgatgatgaacagattcaaaagaaaagcccttagggtcattgctgatttcttatccaatgaagaagttgaagacatcaaagatatgttcaagaagatggataatgataatgatggcattgtttccattgaagaactaaaagctggattccgaaactttgggtctctactggctgactctgaagttcagttgcttattgaagctgtagatagtaatggtaagggaacactagactacggggaattcgttgctgtttcccttcatttaagaaggatggctaatgacgatcatcttcacaaggccttctcctattttgacaaagatgggaatggatatattgaaccagatgagctacggaatgctttgatggaagatggagcagatgactgtacagatgtagcgaatgacattttcctagaagtagacacggacaagatgggttgctttccacttggtgctgtgcgagtcacgaaggattggtgcagtcagaatatgtttatcaaagtacgaatatcttgtacttcgaattcagcactccgttttggtcattctatcctactgccggttgtttcctccaaggtatactctgggatgctgacaacatctattatttgtttgtctcagcatgagcctggaagatatgctggttctggcagtgcctga

SEQ ID NO: 94374 - DNA, 930 bp, Glycine max
  Peptide Sequence Number=SeqID_211152
atgtcgttcataaacattttaaaacaacaacgaaatttaagtctcatggtgagcataccaacaaaacaaccctcccacttctccttttacgttgcagacgcggaatgtagagtagacagcagaaaacctaactgtaccaacttcaatcttccaaacaacagtagaaatccaactacaaacagcagacaagtcacacctccaaactccaaaccgaatccacgcaatgcactaaaccgaatccaaattcagcgtacctggcttgaagaatatggagaggccaaaatcaattgccttgagcggcgaattctccttcttgttcgcgaacaagaagttctccggcttgaggtcgcggtggatgaccccgtgcttgtggcagagctgcacgacctcgacgatcgtccgcgtgacggcggcggcggcgcgctcggtgtagtgcccgcgggcgacgatccggtcgaagagttcgccgccctcgcagagctccatgacgaggtggacggcattgtcgtcctcacaggcctcgcggagcgacacgatgctcgggctctccggcaggtggcgcatgatggcgacctcgcggcgcacgtcctcgacgtccacggctgtccggagcttcctcttcgagatgctcttacacgcgagcagctcgcgcgtgtcgcggtcgatgcagaggtacgtcacgccgaactcgccgcgcccgagctcgcggtccacgaggtaccggtcctcgatgttctctttcggcacgccggcaagcaccgtgatcggggccttctgcttggcggcggcggaggcggagccacctccgccgcgcttgccgtggtcggcgttggagaagctcgatttgacgtcctcgcgggccacagcggccggggatctgcagcagttgcccatgggagcagagatcgcggcggaggagaggttttatag

SEQ ID NO: 94375 - DNA, 519 bp, Glycine max
  Peptide Sequence Number=SeqID_211153
atgtgtgatagtgtcatggacaagcttcttaacattcaaggcaagacaaaagatggtttgaatactcatcgagatctagctgggatgggtatacgagaccagttacatccaaggtctgatggtaagaaaatatacttgcctctagcttgtcatactttgtctagaaaggagaagataagtttgtgtcattgtttttgccatgtcaaagtgtctcggggattctctggaagcaatgtcttccaaggttattttgatgatgtcaaagaatcaagagttaagcaaagtttcaagcaaagattcaagaatcaagtttcaagattcaagactcaagaatcaagtttcaagaatcaagattcaagaataatcaagatcaagattcaagactcaagattcaagaatcaagaagaagactcaatcaagataagtattaaaaagtttttgaaaacattgagtagcacaagaagttttcacaaaatcattaccaaagagttttactctctggtaatcgattaccagaag

SEQ ID NO: 94376 - DNA, 648 bp, Glycine max
  Peptide Sequence Number=SeqID_211154
atgaagctttttgtcacagagtttgatgagttcaggacagagctagtcagaagaaactggcacaggatgctgaccaacctcatggaggggagcatagatgtggctctcatgaaggaatattatgctaaactttatgtcccggaggataagcctccaaagcaagttagggtcagagggcatttaattaagtttgatgcggattccctcaacacttttctggagacttcagttgttctagagccaagggagactcttcctccagggcttgccatggaagatgctgaggaaggacctcactactctggcataaacttagagtcaagcttcatgatgctgaatcaagttgattcaagtagttttgatgatgacaaagatgatgacaaaaagcccaaaagaatgatttcaagattgagtcaacaaggtacatcctttgtggtacaagtagagggtacatctacttgggttgttgtaactgagaacaagagagggtacatctcttgtggatcagttcaagtggagggtacatccacttggttgttcaaagagaacaaggaagggtacatcccttgtggatctttacttgtaaaggtttttacaaggttgaaaagaaatctcaaagaccgcaggtcgcttagggaatggatgtag

SEQ ID NO: 94377 - DNA, 240 bp, Glycine max
  Peptide Sequence Number=SeqID_211155
atgaatattgaagagaatctgccatgtcatcacgcgctcacgcgtcatcagctcgttcaacgagaagattgtatcttctatgcttgtttcgctctttgggatactacttgtttgtatggatgcaaaatctatcgacaagtgcactggcatttgcaaacaaaaatcatgattgtgaatgaaagtaaaagtatgttctattctaattacaaagtaataaacgtgagcaagctcaagtactaa

SEQ ID NO: 94378 - DNA, 326 bp, Glycine max
  Peptide Sequence Number=SeqID_211156
atgacgacgacgaagaacaagtacgaagggagatgtgcaatgccaccgattataaaactaaatctcaatcggaggtatgtgcatcttactacaaatgtgggcatgggaacaatgtccaaccttggctccaaagaggactccttcccaagtagaaaatacaccactggggcacaacgacgtggaaaccaacatatcggcaatgatgatgtgagagtttttcgtcacaagttggatattatgaaacgtcatgagtttgtgtgggagccgtacccatcaaccgttatatcattgttgcctcccgtttgtttagtcggaagtctcgcatg

SEQ ID NO: 94379 - DNA, 153 bp, Glycine max
  Peptide Sequence Number=SeqID_211157
atggaagcaaaagcacaaaaatggtggcctaggggtgaaaatctgcaaatgccgtgggtgtttgcgtttttgaatgagggaggagagttttgggtggaaagaaactccccctccctcgtttttatgtttccagatgcaggggtgctcgcccag

SEQ ID NO: 94380 - DNA, 276 bp, Glycine max
  Peptide Sequence Number=SeqID_211158
atgcttccatttgtgcattctctccttcttttctctcttcggttccatgaaggtgaaggtaccggtgtttggtgttgcggtggtcgacggtggcatatgaggtacgcaatgttgggtgcattctggtgtacggcagatcacgcggatcaaatggacgaagatcagtggatgtatgaaggtataatgcctgaagaagttgatatggatgaaaatgaagaagaatgtggtgtgaatgaaccacatgttgattgttcgaatctgttcaatacttcttag

SEQ ID NO: 94381 - DNA, 466 bp, Glycine max
  Peptide Sequence Number=SeqID_211159
atggagtcacttcatacccaaaagcctcatgtgtgtgtaccattcccagcacaaggccatgtaaaccccttcatgcagctagccaaactccttcattgtgtgggtttccatgtcacatatgtgaacaccaagttcaaccacaaccgtttggttaggtcccatggaccagactttgttaagggtctccctaattttcaattcgagaccatactcgatggtttgccaccttcagacaaggatgcaactcaggatgttccaacactgtgtgattcgactaggaaaacatgttatggtccgttcaaagagatggcgatgaagctcaatgactcttctcctgaagtgcctccaattagttgcatcattgccgatgggattaatggctttgctggaagagcctcaacatgtggttttgtgggatatttgcaatatgaggagctggctaaaaaaggcattcttccattcaaag

SEQ ID NO: 94382 - DNA, 480 bp, Glycine max
  Peptide Sequence Number=SeqID_211160
atgtatcataatgttgaagcttatgtgcttgagagttttatcatttgtgacttccaaagtttggatgttttgcctcattcagtagagaatgagatcaaagaactaggagtactttcaaatcttcatggtcagttttgtattatcaacttggagaacgtttcccaaagcgatgaagcattggaggcaagtataatggataaaaagcacattaacagcctatggtacaaatggtcaagatgtaacaaaaatagcactgatttccaaattgaaatacatgaaacatttcagattataaattgtgaactacttgtatcttctctcccaatggattttgccattcaaacattggagatatgcaaaagcaataaagtagcactacatgttcttcctctcttggtggaaaatatagtagtagaaggaagctcaatgatggagtccatgattgagaccattactagcatccaatcaacttgtctctag

SEQ ID NO: 94383 - DNA, 351 bp, Glycine max
  Peptide Sequence Number=SeqID_211161
atggcagcaacaatggctgaccctgagtttgtcaacttgatacatggaaagaagcttaagaagaagttgcttcaaatgttggagatcattgcaagagtgatcacagacactaatgtcaaactttggttcaatgctctcaaagatattgtctctgagatcgatgacttaacgatgtttccgccaaagctgctactcaaaagcagaaagattgttaaatttgacattctcaagattgaagattatgttaaatggagtcttcttaaaaaaccatttcaatttgggattagcggaagtaaaattcttctaatatcccgtaatgaaagtacaacatttgtagtccaaactgcttaa

SEQ ID NO: 94384 - DNA, 258 bp, Glycine max
  Peptide Sequence Number=SeqID_211162
atggcacattataggctaaagaaaagaaggtgtgaaatgttgttgaagaactcgcttagcgacacagattggctaagcgagcctcattcgcttagcgaggcagccagctcactaagcgagtgcaaaaccctagaagattatcagtcagagagcagtgcgcttagcagcacacagccagcccgcccagcgaggatgcttgttggaaaatgcttggaatccttagaacttgatagagcagctagaggtctttgtatctag

SEQ ID NO: 94385 - DNA, 210 bp, Glycine max
  Peptide Sequence Number=SeqID_211163
atggcgtgcgattcattcttcacgcaggatgttttcagttcccatcacaacatttctcgatgggttcgatctccaccagctactgatgaggctgaagccgcagctttgcttgaagcaatcaaatggatcaaagaaatgaaccttcacaatgtgataaatgtaggcatttgcttcatcttggtaaaaaaacgtcatggatcagtttattag

SEQ ID NO: 94386 - DNA, 1227 bp, Glycine max
  Peptide Sequence Number=SeqID_211164
atggctaaaccaaatagtgcaaaacctggttgtttctctgacttctttcaactactcttttgtgctgctgagaatggaaatagttctccaatgcacccttctgatcaccacattgcaaaaccatatgcaacagaagtagtgcacagtcacaaagatgcaatggccaaaaatgcaaccaaaccaggagtggtggcaaggttaatggggcttgattcacttccaaataccaacttggcgtcaaacacaaacaccacccttcattcagttccaagaagtaggtcagtgaactttgttgattacttgctcaaatttgacacaagccaacccaaccaagtgaaaacctcggcatcattcagagaggttccttcattgcttcagcacaaaaacaaaaaccatgaccttgttgtgttctactgggatgatgagagtgaagatcaagaagttgtgtcctttttaaggaaacaagaaatggggttgggagaatctaggcagagaaagaagcaggggagcaagaacaaggagattgctaatgtaatgaaggagaggaaccacactaagagaaagaagatttccaagtttgagaatgagcctagagtggttcttcctcttaagcatagttcaaaggttcgaaatcacaatgaagccaaagttttggcacaagtttctgcatgctctaagagttgtagtaatagcaggagaaaatgtggtagtggtcctagtgggttaagaacaagctccaatttgccaactaagcagaagaaagtgttctctgaaccaaaatgcacgaaaaaaacaaaaaagcaacagtcaacaaagaagatagacactgaatttagcacagagaatttcagtccaatttcagtcctagatgactatgactattcatttctttatgatcctgattttccagattacacaagccccttaatgccaaagacaaagtgcgaatcttcagagcaactattcttgagtgataatgttggagacagagcaagcaaaaacaaaggctattcctaccctgacatcaacaggaaagaagaatatttttcagaattaacggtgaaacttcacaacttaacacaaaatgaaatgagagaatcagatttcacgccaaagcgcatgtgtgagagtgaaagttatgggaaaatttgtttggagtatgagcacacaatttttgacattttactacacgaggttgtcaatgaacttgtggagctttcatgttga

SEQ ID NO: 94387 - DNA, 198 bp, Glycine max
  Peptide Sequence Number=SeqID_211165
atggtgattgaactggttgaaaccatagagggagagaaagctactaagtgtaaatgttgtttctgccatttaaagacagagctgccgaagttgctgacttcattcaaagatgagaacatcgtggttcttggcattggcaacagggtcatattcatacaaagatttgcaccgactttgttgactcataatggattttga

SEQ ID NO: 94388 - DNA, 219 bp, Glycine max
  Peptide Sequence Number=SeqID_211166
atggaaattatgtgcattgagagggagagggaagcactcctccaattcaaggctgcccttctggatcgctatggcatgctctcttcttggaccactgctgattgctgccaatgggaagggattcgctgcagcaacctcacctcccataatctaatgctcgaccttcacaatggaactataagtattatatttttctccttttcatcaatcaaaacataa

SEQ ID NO: 94389 - DNA, 459 bp, Glycine max
  Peptide Sequence Number=SeqID_211167
atgactattgatagcagattggtggttccttataacccttggtcgttgttgaagtatgattgtcatataaatgttgaagtatgtagtggcatcaagagcattaaatctttgtataaatatgtctacaaaggccatgatcgagtagcaatggaggttcacagaggatcacatgtagatgaggttcaacaatatattgatgcaagatggatttgtgctctggaagctttatggaagatatttagatttatcctttatagaatatatcagtgtgttgatagattacaaattcatttaccacatcatcatcaagttcgattctatagacatcaaagaatcactgatgtattgaacgatgaccgtaactccaaaaccatgctgacacaattctttgctctaatctacagagacagacaagctaggaactacttgtatagagagattgcaaagcattattgttag

SEQ ID NO: 94390 - DNA, 696 bp, Glycine max
  Peptide Sequence Number=SeqID_211168
atggctctcgaagacttggagctactgacacaaaaactaagggaccaactggaggagtcaatcacagaaaaaggacttgcactgcctcttaagcctgaggttggtccttctgctactcgtgtcagcacaaagaaaagttgttttaatcccttggggcagaacccagacatgggtgactcagagaaatgtgggttgcatatcgatgaaaatcttcctcacctggttgtccttagaagagtttgtgaggggtcgagtgtcgtccacaacatccctttaggtaatgatcaagtcaaggtcagtgttgaggaagttcaagatgttgatgctcgcatacctgtacctattcaagaggataaacttgaagctaagagaccggcaaaacctgcagataggtcggatcttgatgttgatcccctatacctgatgacattgaccatcccacaattgttcctcaagcctttgcaggtgtcgtggaatgctaccgtgtttgggatgtataatgataacttcccattgtacatgaagcatgaatatcttattgaaatagcacacggtagtcgatgtctcaacatctatgtcatacaattgtggattatgcatatgagtaagacaaatatgcgagcagggaatgtctttgtgtttggattcctcgagccaaagtctatacaaaaatctgggcaaccgcaatttgaataa

SEQ ID NO: 94391 - DNA, 558 bp, Glycine max
  Peptide Sequence Number=SeqID_211169
atgccttactgtggagtcattgaagaaatctgggagcttaattatgtcaaattcattgtttgtctttccaagtgtaagtgggttgatagcaatatcagtgtgcaaactgatgatttcatatttactttagtagatctaaagaagctcgcttatcaaaatgagtctttcatcatggtagaacaagctaaacaagtgttttatgttcaagatccttgtcatgaaaggtggcacatggctacaccacccagctcccctcctcctccacttgagaaagcaacatctttgttgtctatgtcgaagaagacaagaaaagcaacacagctcagatcattggctactagaccagttggggcgaagataccagtggttcatgtggatcttgccactgggaaagctgctggtccccacaaaaagaaattaagaacacatttggggatcgccactcgtgataaggtggatgttacatataataattggaaacaagtctgtgtagctcaaaaggatttgatttgggcggatattcagatatatttgatattcctaaagcatccaagttaa

SEQ ID NO: 94392 - DNA, 222 bp, Glycine max
  Peptide Sequence Number=SeqID_211170
atggcaaattacacaaacttctttggaagttggctctgcaagttcatcaaatgtcggttacagagaagtaaggctgaaatgctgtatgaactacttatatcttgcctgttcccgaaagaagaaggttgcaaaagaactccaacaattggttgctcactgggttctggaaagcctgcagcttctatcaaagagaataaaacaacgacaatgagcagtttttaa

SEQ ID NO: 94393 - DNA, 329 bp, Glycine max
  Peptide Sequence Number=SeqID_211171
agaacaagcgcaatgaattctcgcagcatagcagaacaagtggatccaacagcaaatctccagagtgtgagctttctgaagaggaaagaccagcttctgatgaatttaccctagttgataagggttcttcctcctcatcagggctagcatcagcagtattcttcacagtttcttcctgcagcttgtcatttgatgcttcagatgctgagatgctaccctctggggtacaaaaatcagttagaatttccaaggacatgctaactgcaatcaaacggagaatatgctttgtgttcttggtgaaacttgtacttgcctataacatacattga

SEQ ID NO: 94394 - DNA, 162 bp, Glycine max
  Peptide Sequence Number=SeqID_211172
atgtacttaattcatgagaagcatgaagaagaggttgcagctgtcaatgagaaaattcaagaattacatgaaatggtaaaagaggcaaaggctaaactggaaactgaagttggtccagtgacaacaagagttctggagaagaaagaggcaatgctggagtga

SEQ ID NO: 94395 - DNA, 675 bp, Glycine max
  Peptide Sequence Number=SeqID_211173
atggaatctggtatttataggagaggagtgaagctatgcatccttttttataggacagtacataagcccccaagctctgagtcgacttacgggcaaaagatgtggtctagtgttgaagatggtctaacgtctggggtagtagccttgacaagtcgacgtggcttgtcaagcccccaagcctggacaagtgttgtccaagctgcttctatcaagttgtctaggatggacatgccttcgatcttgcagactaagtctgacgtgtgtgtgcgactcacacgtagtagtcttgcatatgtgtcactagttgaatggctacatattggagacgcggttcatgcgggacatttgatttcgagtgatttcctgtctgctgaatcgtcttgctttcatgtttgcttcttgggagtccaccataccaggaaggcgtccaaatactcatttggatttgtggtcccattataccgctctaggttaagtggtttccaccccaagggtatgcaatgtgtgagcggaaagttcgttgtcctgggggcgtctgacatgagcctccagccgatcatggcctttagctttctcagatccttctcatggcgtcacttcatctttgcaatgcgggttgaagccttcaaaaggggtctcgagtctgaggccaaaccgagtgctaacaatggatga

SEQ ID NO: 94396 - DNA, 231 bp, Glycine max
  Peptide Sequence Number=SeqID_211174
atggtgtcaggaatagaagaggaggataatccgattcatgcatccaccgtgtcggggatgcctgtcataggagttactataaaggagaacccaacaaacgtggtgagtccctcacgtcaagagcttgatgatcacttgttgatcatttgccttgcaaagagagatgaacaccttgaagcaaagaaacacgcaggagatggaaaaccttcgaaaggaaaatgccactcttag

SEQ ID NO: 94397 - DNA, 327 bp, Glycine max
  Peptide Sequence Number=SeqID_211175
atggtgctgaagaaaccagaacttgtatgccaaaagatagcttggtcagtcgagatgtcggaattaggaatcaagtacgaatcgagggggcctatgaaggctcagtgcctagcagacctcatggccaagttagcaaccactatagagacaaagtcattcaggtggaagctatatgtagatggattatcaaacacaaaaggcagcgggataagagtgattttagaaagcctagaaggagtaatcctagagcaatcccttcagttcgagtttgaaacaacaaacaaccaagccgagtatgaagccttcttagtcaagcaaaagaagtag

SEQ ID NO: 94398 - DNA, 1431 bp, Glycine max
  Peptide Sequence Number=SeqID_211176
atggagaggttctcatcaatttcagttcaaattcaagacttgagtctagaagtagcacttacctcaatgctcatggctctgaaatttggtcccttctcagatagcctatgcaagaaatctcctacaacattggatgagtttagatcaagagttgtcgggttcatccaaatggaagagataattagatttaaagagaaagtgtgtggagaatcatcaagtaaaccaacagaacaagagattaagaccgagagcaatcgtgtgatcaacatgataacaggagatggaagcttgaacttggcttgcaaacactatgtccacaaccttaagactacccccatcactttcacggatgaggcttttgtggggatagactcgaccattatcctttattggtcttccttcaaacaattggatattccagaaagtcagaatgagtcattctcgaaacaactcatatgcttcccaagggagacaactgatacaatgggacatatcaacttgctaaccacttttggagacaagaagggttccaaaaccattatgatcagtggcaagattatcactgttagagctgaccaagcgacgacaagggaatgctacgctgcaagtctcaagattgccaagggaaagaaaggtggtagagcccaaagtacaattgtagcatgcacctctctcaccaacaatctaggagaagcagagcttgaccctagagaagaagagctgagagtagaacccacagaagaagtgaaaccattccaactcagcaatgaaccatcttattgcactaaactaggatgccaaatgagtagagaagtgaaggaatccatagcccaagtgctaaccgagaatgtcaacctctttccatgtttcataagaaagagaaaactcgacttggaaagaggaaaaattgttgatgaaaaggcaaagaaactcttgaatgcaggattcatcaaagaggtacagtaccccacatggttggccaatgagtacaaccaaatcctaatgttcaagccggatgaggaaaagattgtattcatgacggatacaactaactattgttactcggttatgccacacgagcaccacctgtcaagcaaaagacttagtagagatctttacgaaataagaaaatacaacatgaggctaaaccttgagaaatgtatattcagtgtacaaggcgggaaattccttggattcatgcttactcatagaggaatcgaagccaaccctaagaagtgtgtgaccatcattgagatgagaagcccaaacacttggaaggaattccaaaggcttacatgccaattagcaacattatccatattctcgacgagagcatatgacatggccagacctttcttcaaactgctgacgaaaaaagaatgggtagagtggaatgaagagtgtgaagctaactttttgaagctcaaatag

SEQ ID NO: 94399 - DNA, 510 bp, Glycine max
  Peptide Sequence Number=SeqID_211177
atgagagccaagacataccaaaaaagagatgataaaagatacaacaattggattaaagtgagaaactttcaagcaagtgacttggtatggagaaagtgtgggaaatcccggaaagatgctaaggaaggcaaacttgccgcaaattggaaaggccctttcaaatttcacttatccggtaaggcaattccaagaacttggaatgcctcacatcaagttctattacaattaatgttgctcttcaatggcaccctctacttgagcttcaggaatcaaccccaatttgtggttcacgtcctagtcgatattgaagagaaaaaggtcagcttccttgaagaagtatatggcttatcgagtagccttgaaatagtcgatttcatgagtcttaaggatctcaaccacaacttcgtcaagatcactcttcagtttctccacattcaccttgaagagagcaaactccttgttaaggcgttcaatctcctcttggaggtctttagcataattcttgactaa

SEQ ID NO: 94400 - DNA, 312 bp, Glycine max
  Peptide Sequence Number=SeqID_211178
atgacgcgaaaacgcaggaagcctgcagttcccggcgtgctgtggcgcatgttccgcggccgagcgcgaaccctctccgacacaatcatttccttgctccctccgccaccgccaccgcctccgctagtttgccactgccgcggctgcggttgcctcggctgcaccgtcgacgcggagaagtttcttctccggcccgacgatccctctgactactgtaaactgctctcgaaatgcttcgttgtcgtttcgggaaacgcgccttcgccgctcccgttcttcttcccaccctcctcccgcttgtcccaacatatg

SEQ ID NO: 94401 - DNA, 543 bp, Glycine max
  Peptide Sequence Number=SeqID_211179
atgaagatgccttcgtattttaatttgccagcacttgatgtttctgtggcttttccacaagccactccagcctctaattttcctccttgtgcttcggattattttcatttcaatgacttgttgaaaccggaggagcaggccgtgaggaacaaatactgggagaaggctgaattcccatttcatgttatcccaaagtttgctgccctgcgtattgctggtggcacaattaagggttatggttgtcctggtctttccataactggaagtgctgttgctacagcagaagttgctagagttgatgcaagctgttcaactttctatttggttcattcttccttggcaatgctcactattgcattatgtgggtctgaagctcagaagcaaaagtatttgccttctttggctcaaatgaaaactatagcatgttgggtgggaggtggttggatccttgatggccaaaagagatggataggaaacagtcatggagatccaaacatccatgaattttcattgattgccttatactctagccttgcaccctga

SEQ ID NO: 94402 - DNA, 783 bp, Glycine max
  Peptide Sequence Number=SeqID_211180
atgactgatgcaaatgctgcttcatttgaggcatttctccaagggtggatggtgcgccaaagaggttaccttgacgagcttctctcagctcagcaacactatcaggagatgcaggatgatgatgatgtgaggcaattaatcaacagggtaatctgccactatggacaatactttgaagagaaatcaaagattgcccaccaaaatgttcttcttgttttctcaccaccatggttcagttcattggaaagaacctttctttgggttggggggttcaagccaggagtgtcttttcaggttgtgaacacagctttggaggatttgtcagaagaacaaaaggagaggttgagtctgctgaaccaagagaccaaggtgaaggagagagccctcaatgatgagttggccaagcttcatgagagtgtggcagctccaccgctagtggacatggcaaggagccatgggagggtgtgtttcagcaggtccttcatggcagaggagggctcttctgttccaagcactttcagagagacattggagaatcttgtggccaatgcagatgctttaaggacaaacacatctttgaagatttttcaggtactgagacctgctcagattgtctcattcttggttgctgtggctgagcttcagatcaggatcaggtcttggggtttggacaaggattctcagaatggaggccaagggatggatacatgcataggccttaagccttttagcatcatgatggtggatgatgtgcattgggcagtgagcatgttcagcatttga

SEQ ID NO: 94403 - DNA, 618 bp, Glycine max
  Peptide Sequence Number=SeqID_211181
atggagaataaaattggacttaggatcgtacaaaacggagacatagttatgaggaaagtttttgtccctgatgatgacagaatagaaggagtaaattcttttcaggatacaaacaaggtacttgctgtttcacgtgtaatggttgcttggcaacctattggtttatcaatgggcatctatgatatgtgtcataggtacctaaaggagaggaagcaatttggagcaccattagcagctttccaaatcagtcaacaaaaacttgttcaaatgctaggtaacattcaagcaatgattcttgttggttggcgtctgtgcaagttgtacgagagtggtaaaatgactccaggtcatgctagcttggggaagataattgatgataaattgttaaccatatttcagtcgtggattaccctgagggcaagagaaacagctgccttggggagagaattgcttggtggcaatggaattttggctgattttctagtggcaaaggcattctgtgacatagaacctatctacaccttcgaaggcacgtatgacatcaacaccttggttacaggcagggaagttactggttttgccagctttaagtcggttgctcagaaaagtaggctgtga

SEQ ID NO: 94404 - DNA, 1479 bp, Glycine max
  Peptide Sequence Number=SeqID_211182
atgacggagtcagaagaagctggggcaaagccaatgaacacattgggtggccaagtctgccagatctgtggtgataatattgggaacaatgtgaatggcgatcctttcattgcttgcgatgtttgtgctttccctgtctgcagggcgtgctatgaatatgaaaggaaggatggaaatcagtcttgccctcagtgcaagacccggtacaagaggcacaaaggaagtcctgcaattcttggagaccaggaagaggatgggggtgctgatgagggtgctagtgacttaaattacaattcagaaaatcagaatgaaaaacagaagattgagcgcatgttgggctggcaaatggcacatgggcgagcagaggaggctgttgctccaaattatgataaggaagtttctcacaatcacattcctctgctctctggtggacaagaggtttctggagaattatctgcagcctcacctgagaggctgtcaatggcatctccaggtggccgagggaagcgtgtccataatcttcaatattcctctgaccttaatcaatcaccaaatattagggttggggatcctggattgggtaatgtggcatggaaagaaagagttgatggctggaaaatgaagcaagataagaatgttgctccaatgagcacaggccaagctacttctgaaagaggagctggagatattgatgctagtactgatgtgcttgtggacgattccttgttgaatgatgaagctcggcaacccctctctaggaaggtttctattccatcatctaggatcaatccatatcgtatggtcattgctctgcggctggttatcctatgcatttttctgcattatcgaataacaaatcctgtgcccaatgcatatgcattgtggttgatatcagtcatatgtgagatttggtttgccatatcgtggatatttgatcaattccccaagtggctccctgtgaaccgtgaaacctatcttgacagacttgcactaagatatgatcaggaaggggaaccatcacagctagcagctgttgacatttttgtcagtactgttgatccattaaaagaacccccacttgtgactgcgaacactgtcctatctattctttctgttgactacccagtggataaggtctcatgttatgtctctgatgatggtgctgctatgttgacatttgaagctctggctgagacatcagagtttgctaggaaatgggttcctttcagcaagaaatataacattgaacctcgggcacctgagtggtattttgcacagaagattgactacttgaaggataaggttcaaccatcatttgtcaaagatcgtagagcaatgaagagagaatatgaagaatttaaaattcgcgtcaatggacttgttgcgaaggcacaaaaggttcctgaagaaggatgggtgatgcaagatggtacgccatggcctggaaacaacactagagaccatccaggaatgattcag

SEQ ID NO: 94405 - DNA, 1518 bp, Glycine max
  Peptide Sequence Number=SeqID_211183
atggacacaacagattcacaatcggagacttttaagtcatactgctcaaaaagtcaagttgtatctttcatatgggctgtttctaggagtatacttccttctgaattattaggtactcctcctacttggagaataatgaggagaaatatttccaatgcttctgttctaaagtatatagaagggaaaaataaattctttcatcaagaattcaagaattggaatgatgcagtccatggtgtcaaacgcaagcttctggagaagtggatattctggtatttctcttttctggttgtacctttggtggaagcaaacttctatgttactgaaagtgaacaagggaaacaagatatttactattatcgaaaatcagtttgggaaaagttggctgctagcactgtttcttgcttcaaagactggagatacagttacctggatgatgtggctgtacataatattcttaaaggtagaccatttggattttcaaagcttagacttcaaccaaaagaaaatggagtaaggatggtggcaaatctggaaggttcttcaagaataccactgctacatagtatgggagttcgaaattgcaaaacaaaggggaaggagcccaacaagttaggttcttcagtgtttgactacaatgatgtttacaaaaaattgtgcccatttttggtcggccagaagaagcgatcagcatctatgcctagtctattcattgttaagtgtgatgtgttgaaagcatttgattctattaatcaggacaagcttctcgacataatgaaagattttctactgaaagatgtgtattttcttaagcagtatgatcaagttgtttgcacaaagaagtctctgcaggttcaaaagcaatttacaatgcaggatgaaacaagtaacaatagccatacacagtccacttcatttgcttcctttcattcctggcatggtgtctttgttaaccaggaacgatggaagtccgtgaaaaagaaagctctgtatgcagatcttgtgcagcatgtgaagcgcaatgtgttgcagtttgatggaaaattttacttgcaaggtgttggtattccccagggaggggttttgtcttctttgctctgctccatgtattatggacatttggagagacatgtaatatttccatttcttgaaaagactcttgaaagtggcagttgcatagagaataattttgggcaaaccaattgtgatgataaagtctcatcttcctgttacttgctaatgcgatttattgatgatttcctttttatatcaacatcaaagaagcaggcagctagctttttctccaggctagaaagaggatttcgtggttacaactgctacatgaataacaaaaagtttggtgcaaactttgatgtagaacatacatcagactctccattgaacagggtttatgtgggggaagatggtgctacttcatttcttcaatggagtggtcttcttatcaattgttccactatggaaattcaggctgactacaccaagttaatcttcatttaa

SEQ ID NO: 94406 - DNA, 369 bp, Glycine max
  Peptide Sequence Number=SeqID_211184
atgtcagcgccttcagctgctcgcctgaagttagtatcttctcctgagctgaaagccgtattttccattgatgatgtcaagctacctccttggttggatgggatgtgtttggcagaatatctcccaaatctggaagaatatcttgggaagcaggtcttagaggctgtttcattgattgaagttagaaggcacttcattgaagcattatccagtccgtttggaaggccagttgaagctgatgctgtatcttcccgtgacacttattctcaaattgctagggtcttttgcaggaaggcaacttttcttgctgcatctggtgttttcacgttcctgaagtctcatgtctggccaaaagagaaatttgagtaa

SEQ ID NO: 94407 - DNA, 432 bp, Glycine max
  Peptide Sequence Number=SeqID_211185
atggcactgtgcaaccgcgtcagatcgggaatctctctcttcaccaaatccacgttcctcacttcccagcgatccactctccaacgatccctcgttgcccctttcatttccctcgcctccagaaattacgccaacgtgccggggcaaaaggaaaccaaagttaaggtccctctggctttgtttggaggttcaggaaactatgcctctgctttgtatattgcatctgtgaaagccaatgcagtggaaaaggttgagactgagcttctgcaatttgttgaggcagtaaagaatagtcccatattttcacagtttataagggacttgtctgtggctaaggatgttagagttaaagttatccaggatatttgtggggaagccaagttttcggatgttacaaagaacttccttggtatgataagcttcgtattttag

SEQ ID NO: 94408 - DNA, 288 bp, Glycine max
  Peptide Sequence Number=SeqID_211186
atggattctagtgtggggtttattaggcctttggctctagaactacaacagctagcttttgcggcactatacctgagtacacctggagttcagaaatcagctacaatgaaggcggcagtggctgtgattgaaggcaagcttagggtttttcaagatgcagggataaagactcccagactgcgagctacgataccaagtagccctttccgagaaactatcaaccaagatccgatagctgcaaggcctgttagaggtgaccttttaaggcagctttccaacaataggcag

SEQ ID NO: 94409 - DNA, 747 bp, Glycine max
  Peptide Sequence Number=SeqID_211187
atgcaggttggagattattttatgttttacctactaaggaatacatctatattcttgccagctccccgtggaaaacacaaccaggtggcaggtccaccaatcagcgatttatgctttgaaatgctcatgggctcatcaaagtttcaccatcagaaatatggtgaacaaaagagagaaagagctgatgctgatgacctaccagtaaagaaacaaaagtgctatagttcttacagtaccacttgtcctgggggcttttcaattaaccttgacttcaccagtgagtcttcaatgcaagtgatcaggcatcatgggaccagggattatgatgccagtgtctctgaagttcctaagtcaactagaactggaactgttacaaggaagttggagtcagaaggggaacaaggcttgaattgtattacacctaggcttggaaagcgttctaggccatttaaatggcagcggcgtagttacaaaaagcaaaagcaatcaagccctgaagaaaatagtctaaatacacattgcaatgtacttcctactaatacagattccatgcatgctggttctcagtccaacaccactggcttaagctatcatgcaaagctgcagatgccgtggcagtgttcttgctgtttaatcctgcaatctcttccagctgttcccaggaggactgaaatcaaaaggcaatctattttctataaccaggagtattctcatgaggtttttccaaagaaacgtatccaccactga

SEQ ID NO: 94410 - DNA, 1119 bp, Glycine max
  Peptide Sequence Number=SeqID_211188
atggaacccgcgaaaattgattggaagagactagagtggagcttcgtggaagacgagctctacgagcacatcaacgcgcccaagtgggttgacttcttgtcccttgaccactccctcgatgatcatgctgatgaagcttggttctgcaaacctgattgcaaacatcccaagacagcagaggattttctgagatcagcaactccttccaagaagggttttagcccgggttatgtttcagagaatcttccaagtggtgacaaaattagaaggtacagagatgtgaaaatcaagagaagggtgccagcaatgtcatcagcttcaccccaagctgataagttcagattcaaccaagaaagtgaaaaccaaaacccaaatttgtttactcctcctcctactaaggaggttaaccccgtgaaggaagcaatcaagtctagtgaagagaagaagaaactggttgataatgatgacacattagaggatcataaggtgccttcattgagatcaactctatccgccaagaatttgtttgcggggaggcctattctgaatcaaatcacggaattctgcaatgaattgaagaaattagcaataagagctaaggagagagagaatgctgaaaatttgagcccaaaagagagtgaagaggttgtggagaagaccccttgttctgttcaagctttggctgagtccgatcaaaaagagaaagaaaggaagccactgcttgaagtgagtaagactgagagattggaggggatgagtgttaaagggaagcaacagagaaaaaaaagacctgatgaggcagagaacaacaacatgtcaataactcttgacctggagaatctaaagcacaagagggaggggaccttacaacaaattagaacgaatcctccctctcctcagtgcttctctgcggcacgtggattaaacaaacctatcccttcaaaggcttccaaatcccggctaatggagagaggaatacttggagaaattgaacaaaacaaggaaattgtgaaggagtctcctgcagagaagagcagaagcacttcaatagttgatggaagagaaacaaaagccttggacatgttttggttcttgaagccttgcacactgtcaggctga

SEQ ID NO: 94411 - DNA, 229 bp, Glycine max
  Peptide Sequence Number=SeqID_211189
gtcgactctagaggatccccttgtcgtcctgacccgtgaagtcaggggcaaacaagcccgttggcgcgcagagattaacatagtcctcgacacctttttccgtcttgacccactaacatcgtctgctgcacctttggtcgtcctgacccgtgaagtcaagggcaaacgagcccgttggcgcgcggagactaacatcatcttctacaccatttggcgtcctgacccgtga

SEQ ID NO: 94412 - DNA, 576 bp, Glycine max
  Peptide Sequence Number=SeqID_211190
atgataggcacaggttgcataggcacaagttgcattggggttgatagtagcaagtcggcatatggcatcgggattggagttatcggcggggcgagattgtgcgggagccaagttttgagtgggagacctttgtggttgagcgggcactctttgctagatgggcgctggattggaagggtttccgacgtgggccgaaaagctggtgtgggtatctccttccttcttcttggccccacttgctctgaatctcctattgctcgagctggcaggagcggcataatcgaactttccccttttcaagcctacctcgatcctctcgcccgcaaataccaaatatgcgaagctagagggcatgtccctccacctttgggcatactctttaaaggactcatgctccttcgcacatctaccgctaagcgcaacttcagcatgcttagcacgatagaagaatctggcagagcatcaatatcagggtcacgcgctaagcgtgagatcaaggcgctaagtgcaacagttgtcttcagccaggctcagtgcatgactggcgctaagctcaaatccacttactcgcgctaa

SEQ ID NO: 94413 - DNA, 801 bp, Glycine max
  Peptide Sequence Number=SeqID_211191
atgaaagccgatatcgaggccatgaaggatcaaatgacctccatgatggaggccatgttaagcatgaagcagatgatggagaggaagggaggtgttaggcagcatgagcggttcacacatggggcatacccatatggcctaccccccaactatacaccacccaacactatgcacatgcccaacgagaacgctaaccacaccgttctcgttcccttcaaaggccaacaaccccagttggggcatacgccttttgctcaacctgtgggggacgccggtgaagagcctcaggattatgctcagggtgactttgaaccataccctatgttcaccgccgagggtccggagtgtagtggtatgcctcaacccaatgctgcggaggcctctcaacagcgcccgctgcaacctctacacttctccatagggagactacctctggcagtggaaggaagggagaaattggatttcatcaaggagaggctaagggccatagaaggaattagggattatccgttcctcaacatggcaaagctgtgtttggtgccggatttcgataagtacaaggggactactttccctaagaaccacttgaaaatgtactgtcataagataggggcatactccagagatgagaagctcttaatggatttcttccaagagagcttggccagggcgacggtcacctggtatacaaatttggaagcttctcggatccactcttggaagaacttgatagctgccttcatgaggcagtatcagtataacaccgacatggctcttgacagaacccagttgcaaacctaa

SEQ ID NO: 94414 - DNA, 243 bp, Glycine max
  Peptide Sequence Number=SeqID_211192
atgttcatcagtcctccaccgtcaagtgcggagcttcctatggctgggaaatgtgaaaaaagaagaagtagaaacgagagtcgtcatagactaatcacggaaagggtaaagactgaagaaatcagtgtttttatctttactttcctcttatctccgataaaagagtattgggccttccggaggaagcaacccagctcgcctgggcgagctgggcggcaacctcctcccccttttttcctataa

SEQ ID NO: 94415 - DNA, 267 bp, Glycine max
  Peptide Sequence Number=SeqID_211193
atggctccaaagaagcttctagccaagagggcaagaagagatgccattggagagggttccagtgcggccccacagggctggtcgttcctcaatgagaggcgggtccagttgagggacggagagtatgccgagttccaagaggaaattgccaagaggaaatggactcaacttgcgacacccatggctaagtacgatcatgaaatagtcatgaagttctacaccaatgcctggcccacggaggagggagttagagacaagagctcctag

SEQ ID NO: 94416 - DNA, 501 bp, Glycine max
  Peptide Sequence Number=SeqID_211194
atgtgggctttcttgaccggtcatccaatcgactgggcccatttgattcattaccgcatgcataaggcattacggtctagtgcacctctaccttaccctcagcttgtgactttgcttcttcgacattttgaaattcctttggattctgagccttttgtgcaagttaaatgttcctttgctattggtgccggtgcggtaacctcctttggctaccgtaaggacatggatgggcaatggttgaagaaggatgcacaacctgcgcaagacgaacgtactccctctcctctgcctcaacgagatgactcctcagccctcatgcatgaagttctttcggagttacgaggcctccgcacctatgttggtgaacgctttgattccttggatggtcgtatcgatgccattgatgctcgctttgaaggaatggatacccacatcactcagcttgaggaggacgtgagttatcttcgtcggtgcttcaaccttcctccaccatcttcatag

SEQ ID NO: 94417 - DNA, 201 bp, Glycine max
  Peptide Sequence Number=SeqID_211195
atggcggacacctactccgcccccgaggagatccacagacttctcagctatttgcgaatcaagtcactcccgcattttatctctagcatgcattgtatgttggtctcgtcctttgtcacgggaagccggaaggtccatatcaccttcttaactgtacacatagggcactgcgcccccaaatgcgcaagtaagaagaggtaa

SEQ ID NO: 94418 - DNA, 597 bp, Glycine max
  Peptide Sequence Number=SeqID_211196
atgggtgaagcagaggaggtgcaagagaagatgaaggccgacatggaggccatgaaaaaagctaatggccacaatgatggaggccatgatgagcatgaagaagataatggaagccaatgtgaacctgatgcccccatctatcctcaaccaaatgaatcatccaacctcagttatggtaggcaaagatttaggatgtacgggcggcccctgttatgtgcaaattctaaacaagcaccccttcacgccatatggcttgcctcccaacttacaccacccaatgtggcgtacactcccaatgagaatgtcaataactccacttctatactcattgagagccaacaacctcaatctgatcatgcacatgtttctcaacccatgggggagacacatgaaatgccccaccacaatctagcggacttcgagccttgcctcggatatgccactaaagggcaagcaattggtgatatacccctgcaaaacacattgaagggccctcagtatcacccacaaccacacccattgcattccacagcgggtaaaaaccctcatgctatggcagaaatgggagaagttggatcatctagaggaaaggcttag

SEQ ID NO: 94419 - DNA, 421 bp, Glycine max
  Peptide Sequence Number=SeqID_211197
atggcggaaccatcaaagaagcgaaagggtgtttcgagtcaaagtcaacggcattccaagactcaggagacacagattccctcctccatttcctcttcctcattgttctcatccgaagaacaacggatacgatacacaaaccttttctcttctttttccattattgatccaaaattcattgatatggatttcttttccaatgagagttgtgaatgcattcaggcatttgaaaactccaatctcattcctttcatgtctttaaaatttcctatttacactgaattggttaaagccttctattataacctagaaattcaagaaggcactttgatttctgaagtttatgggattacccaggtcattgaccaatccctattctatgacttgacccaattatctagtgaaggtgtaccatttgaag

SEQ ID NO: 94420 - DNA, 197 bp, Glycine max
  Peptide Sequence Number=SeqID_211198
ggtttggtgcaaagtctttatccaccatgcccacgcttgatgcgcatgatctggtgggtgcacatgtacaaggtcatcatgagcatgtggtttctgagggcatgtttctgaggagtgacggcggtggaactggaggagggagaagagatccgtttaggtgcttagataatgagaataataataattatggcggttga

SEQ ID NO: 94421 - DNA, 105 bp, Glycine max
  Peptide Sequence Number=SeqID_211199
atggagagggtccttggaggaaagtttaaagtcggggcacatatcgagacttctgaaattgtggccatcaagatgaaattaaacaggctgaaaggcaccgagtag

SEQ ID NO: 94422 - DNA, 156 bp, Glycine max
  Peptide Sequence Number=SeqID_211200
atggatgaatttgacatccttgtctctctcatcctctcacaaacacatctttgtctattcaacttccactggaatcgacctgcgctcctgagtgttgacttccaagaccgttcaatcagagattactcgtcttgcacgttggtgggggtgccgtaa

SEQ ID NO: 94423 - DNA, 303 bp, Glycine max
  Peptide Sequence Number=SeqID_211201
atgttgcaaaactttacggattacgcaataatactctttttgactgtcggaatgttgctgaactttacggattacctaacgatgggggttatgtacctcgaggcggtcaagcgaaggttgcatgctaccaagcaatggtccccagatgaaattaggcgctacgcaatcaattcatggggcttcggacttgatggtggaggatgcatgaacaacgctagacaatcaattcgtggggctccggacttgatggtggaggatgcaagaacagcgctaggcaatcaattcatggggctttggacttga

SEQ ID NO: 94424 - DNA, 369 bp, Glycine max
  Peptide Sequence Number=SeqID_211202
atggcggaaatgggaaagttggatcatctaaaggaaagacccagggccattgaaggaggtgaagattatgcctttgctaacctagaagagttattcctagtacccaatatcatcacccctcccaagttcaaggtgccagactttgacgagtacaaggggactagttgccccaagaaccatctaaagatgtattgtcggaagatgggggcatacacaaaagatgaggaattgctaatacattccttccaagaaagtcttactggggtagctgttacctggtatactaacttggaaccttcccgagtccattcttggaaggacctaatggttgccttcgttaggctgtgtcagtataatggcttcggatag

SEQ ID NO: 94425 - DNA, 535 bp, Glycine max
  misc_feature (28)..(28): n is a, c, g, or t
  Peptide Sequence Number=SeqID_211203
caatcagaattttccatgtgatcaccanaaggcttctacatcaacattgacactctccaccctctttggtttatgcttctgggctgcattccgtgcttcctctgtagattacaaaaacaaaggtgaaacgaaagatattgagctggtagagttggaacaggcacagattggtgctgatccttctagtgagacctccaataaatctgagaattataaggaggaagcacagaatgcaacacagaagcataaaccaaagaaggtagagagtgtcaacgctgatgcaaaagcctttggtggagattcaactgtgctgaagataggaaattcggctaaagttgtgataaaacaagacatgaagggaagaaggcataaatatgggtttaacaacaacaaacgtgagaaggtagagaagaaaagggtggtggatgatgaaactggcgacaaaaatcagctggatgaacaccaagagcggctacgcaagaagcttgcacttgaggaggaaaggacatttgcagctaatgaacaactttcttaa

SEQ ID NO: 94426 - DNA, 210 bp, Glycine max
  Peptide Sequence Number=SeqID_211204
atggatgagaggccttctcaaagagtcaacctcttgctttctcataaggactcaaagtcctcgcttttatctttcataggactcaaagtgatgcaatcctactccgtaagggcattgggtagaagactccaagtagattgggctagagatccaagggaaggccctagggttctcatgagccttagggtagattttgagcccatgagctaa

SEQ ID NO: 94427 - DNA, 207 bp, Glycine max
  Peptide Sequence Number=SeqID_211205
atgtcattgcctagcgctgttcatgtgttctccattatcaagtgcgaagcttctggtgactgggaagcacgttattctgttgttttccagatcggttccttcgccaaaagaaaaaaaagaagaagtagagatgagagtcgtcatcgcgaaaagggcaggacggacgaaatcagtgtcctatctttgctttcctcttatctccgatga

SEQ ID NO: 94428 - DNA, 210 bp, Glycine max
  Peptide Sequence Number=SeqID_211206
atggagccatctacgaaatacaggaaagatttgaaaatctacgagtcaaccaccattaacttttttgcctgtgaccatcactgcgtatttgacatacatttcataccaccactggagcgacaaacttgtggcaggcagaggcattcatccagaaagcatatctggactgttcgatttactcaggaaatgctggatgctcctgaacccctg

SEQ ID NO: 94429 - DNA, 186 bp, Glycine max
  Peptide Sequence Number=SeqID_211207
atgggagattgtctgaatgagctgggcatggaagatctcaggctccttgaggaaggaatggacaaggccgccaaggttgttcgtgagcgtaagagatgcatagcagcacttacttgtgtctgcggcaaacacaaaggcgccgcaacagagtctttgaattcgtatgttaggtggggaatgatttaa

SEQ ID NO: 94430 - DNA, 1133 bp, Glycine max
  Peptide Sequence Number=SeqID_211208
ggctgcacgccctcgccttcagagggctacatgtcctcacctttataggactacacgtcctcgccttcagaggactacacgtcctccccttcatagggctacacgtcctcgccttcagagggctacacgcccttgccttcagaggactacatgtcctcaccttcagaggactacatgtcctcgccttcagaggactacacgtcctctccttcagaggactgcacgcccttacctttagaggactacacgtcctcgccttcagaggactgcacatcctagctttaagaggactgcatgtcctcgccttcaaaggactacacgtcctcgcctttagaggactgcatgtcctcgcctttagagggctacacgccttcaccttcagaggtttgcaagcccttaccttcagagggttacacgccctcacctttagagggccacactccctcgcctttagaggactacacgtcctcacctttagaggactacacatcctcaccttcagaggactacacgtcctcaccatcagagggttacacgccctcaccttcaaaggagtacacgtcctcgccttcaaaggactacacgtcctcgcctttagaggactacacacgtcctccccttcagaggattgcacgtcctccacttcagagaactccacgccctctccttcaaaggactacacgactacatgtcctcgccttcagaggacagcatgttattgccttcagaggactgcacgtcctcatcttcagtggactgcacatcctcggcttcagaggaatccacgccctcgccttcagaggactacacgtcctcgtcttcagaggactgcacgtcctctccatcagagggcttcagaggactgcacgtcctcgccttcagagggctacacgccctcgtctttagaaggctacacgtcctcgccttcagcggactacacatcctcgccttcagagggactacacgtcctcgcctacagaggactaaacatcgtcaccttaagtggacttcacgccctcactttcagaggactacacgtcctcctcttcagagggctacacgtccttgccttcagaggagtacacgccctcgccttcagaggactacacgtcctcgccttaagaggactacac

SEQ ID NO: 94431 - DNA, 768 bp, Glycine max
  Peptide Sequence Number=SeqID_211209
atggtgaaagttggaacctcttacgtgccgatcaacgtctcattttcgccaaaagttggcccagggcttcccggtatcaacagggacaccaggatttatttattctgcgaagtgatcttccgtcacagtcatacatacgtgaaatcaggcgagcaagggatgatgcccaagctgtcggtccatgtgatgcaagacggcgagcgagttccgatgctccacgacgagtcgggccttccgctgttctatcccacgttgtacgcgacctcgcagctgcgaaatgctggcgtggccgtcaataccatccgcaacaagcttgccgatctgatcgtgttgttacgatgggaattcgcgaatcgtcgtaacttgatttcggacttccaggctggtcgctttctgaccatcgccgatgtggtttcgctgcgcgatttcaccaagcttgatatgcggaactggaaatccgatgggcagagcacagggaagccatgtgtccgtgtcccgagctttttggaagcgacgattgcttcgagccgagctcttgccgcaattggcccgcaacagcatttcaaccgtttgagtacgattgccgactacttggagttcacggcaagcgtcgtcacgcagtacaggaactctcaccaaatcgcgcaagaaatcgcgcggatggtgactgccattcgtaagcaccgaccgcgtggtctagcgaagcaccttgaggaagagccggagcgccgctctcctccgaccgaagtggtgaatcgattcatggcg

SEQ ID NO: 94432 - DNA, 1284 bp, Glycine max
  Peptide Sequence Number=SeqID_211210
atggggggcctggcgctggtgctgcaggtgctcaccaacaacaagttcgtcggttacgcattgctgatcgtggtgatgatcggtcagggtgtgctgggcatgctcgactacacgcagaacctgtacaacttcggcagctggcccaacgcaccctattcggacatgaacggctacggccacttcctgaccgggcaactggcattccagggctactgggcgctgttcctgctgaccttgatgtgcctggcgtcggccttctgggtacggggtgtcagccagggcctgcgccagcgcctggccctggccggccgccgcctgcgcggtccgaccggcgcctttgccgcggtggccgcgctggcgttcgtcggcgtggggagctggctgtactggagcaccaacatccgcaacgagttcctttctccggaccagcagctggatctgcaggcccgctacgagcgcgagctgtcgaaataccgcaacctgccgcaaccacgcattgtcgccgtggacaaccgcgtggacctgttcccggaatcgcagtcgatggtgatcgatgcgaattggacggtgcgaaacacccacgccacaccgatccaggacgtgcacgtctcgatgggtgatgacaaacagctggttgcgctcgatctgggcggacagaccctgtcgatgcatgacgccgatctcggctaccgcatctaccgcctgcagaaaccgctgcaaccgggtgaaaaccgcagcgtgcatttccgggtggtgcagaagcctaatggcatcaccgccggccaggcgccgagcaacatcgtggacaacggcacgttcttcaacagccgcgtgctgccttccttcggctacaacgaaggcgccgagatcagcgaccgcaacgaacgccgcaagcgcgacctgggtgagccgcggcgcatgcccaagctggaagacgaagccgcgcgtgccaacacgtacatagccaacgatgccgactggctcgacttccgcaccacggtctgcacggcaccggaccaggtggcgctggccccgggttacctccagcatgagaccacggtcaacggccggcgctgcttcagctatgccatggaccggccgatgctgaacttctacgcctatctgtcggcacgctgggaggtgcgcaaggcaaagtacaaggacatcccgatcgaggtctacttcgacccggcgcacggctacaacgtggaccggatgatcgaggcggtgcagaagtcgctggcctactacgaagcgaacttcaccccgtaccagcaccgccag

SEQ ID NO: 94433 - DNA, 351 bp, Glycine max
  Peptide Sequence Number=SeqID_211211
ggagtgatggatggacagaatgatcgtgtgatagttgatgctctccaagccttagctcaggctacagggaatccaaataggggagaagctactggagctgctgaggaaattgagaaaattttccaagtgatggcatgtccggaggggaaaaaagtttcttttggtacatatactctggtggaggaagctgagtattggtgggagaatacttgccaatgcctagaggctgaaggtcaagatgtgacctggattttcatcacctgggatgtcttcaagagggtatttttggagaaatacttttgtgaggatgttaggaacaagaaggagatggagttcttggagctcaagtag

SEQ ID NO: 94434 - DNA, 459 bp, Glycine max
  Peptide Sequence Number=SeqID_211212
atgaggggtggtattaattataatcccgtcctggccataagacagataggataccctatgagagatagtgcgaagatacttcaaagagtccgtaaagcatggaatagagtggaaagaaaagataaagagcttaggggaagtagcaatggcgtcataggcgactatcacaaatggttgaagtctaaaacacaagggataacttggctcccaaagataaaaggtctgagtgggaaagaggttgaaattcctgaggagagtgaagaagtgcaagctttgaaagctgagctcgaaaggacgagagtggtaaaggagaagctgaaggtggcggtcactagggtcaggaaagaatgtgatgagctgaaagatatcaacatagccatggttgaagcgctagagcgggaaacgaaaaaggcccgaaaggaagagtggagtaggaacaagttccgaggggctttgtag

SEQ ID NO: 94435 - DNA, 342 bp, Glycine max
  Peptide Sequence Number=SeqID_211213
atgggtgaagtagaggaggcgcaagagcagatgaaggctgacatgaaggccttgaaagagcaaatggccacaatgatggaggccatgatgagcataaaggagataatggaggtcaatgtggctgcaatagccgctaccagcaccattgctgaggtggacctgacctcccccatatggcttcaaccaaataaatcatccaacctcagatatggtaggtccagaaggcaaagagttgggaggtacaggcggccctcatttagtgcgaaaaaacaagcatgtatttccaccatatggcttgcttcccaactatgcaccacccaatgtggcatacactcccagtga

SEQ ID NO: 94436 - DNA, 411 bp, Glycine max
  Peptide Sequence Number=SeqID_211214
atgaagagagaatcggctctgtccctgcattacaaactgtttgaggggacacatgtcccagacattgtctcgacatcagggaaagctgctgcttcaggtgctgtgtctaaggatgctttgattgctgaactcaaggacacatgcaaggtgctggaagcaaccatcaaagccaccacagagaagaaaatggagctggaacgcctgatcaaaaggctctcagacagtggcattgaagatcgagaagcactgatagaagatgttgcagtaagagcatggagacagggggagcagaaagctgatgtcacaagagatgtcttaacatcctggaaaagactagtagctgatagaagatgccgcagtgaactgcttcacagcagtaggagcatggagacagggggagcagaaagctga

SEQ ID NO: 94437 - DNA, 329 bp, Glycine max
  Peptide Sequence Number=SeqID_211215
atgggtgccattgttgttgcagtagaaggaatgggagctaacactcctctgcatcaagttgggactgggcacagaagtaggtgtagggtctcgaattcagtgacttcggggaagaatgaagaaggtgagggaagaggtgagggaagaggtgatgcagtgcttgactgtgcatacatggtgaatgaaaagggaaggagtcgggctgttaaggtgtggcaaaaattgcaggctcaggtggacaaattatctgatgccagacttgaagaggccttctatcagaacacaaaggccttgcaatcatttcaatgtcttgatgctaacacatacag

SEQ ID NO: 94438 - DNA, 243 bp, Glycine max
  Peptide Sequence Number=SeqID_211216
atggatttgaaagtggagagtgtgttttacgcgtcaaatctggttttcgctgctacggaggagaagcaccaccgtggcagtgcctccctgattaaacaacaccgtggattacggcggtgccgacgggctcatatggagaagagatcggaggacgtgatgaaacctccatcaccggcgtggacaatgatggaagctacaaacctgggaatgagagttgtgggagcagagagaaagagcgcttaa

SEQ ID NO: 94439 - DNA, 654 bp, Glycine max
  Peptide Sequence Number=SeqID_211217
atgtatgcacagtcaagcactgcatcacctcttccctcacctcttccctcaccttcttcattcttccccgaagtcactgaattcgagaccctctcccaactcaacaattctgagaccagttactactacaatagagtgttagctcccattccttctactgcaacaacaatggcacccatcatcccttttctgctctctttgctgagctgctcgactccgatgtcgatgctcccgttaggagagtttgcagtactgaagattaatggaatgcaacataatcatcactcggatagtccgttatcgagcgaaagtagtatgatcatagaaggaatgagcagagcctgtcgatatagcccagaggagaagaaagtcagaattgagagatacagaagcaagaggaaccagaggaacttcaacaagaaaattaagtatgcttgcaggaagacattggcagacagcaggccacgcatcagaggacggtttgcgaggaacgacgaaattgacaagaatactacacttcagtggagccaaattggtgctggagaggaagaggatgaagaagatgagaattgggtcactatgttagattccttagttgctgcaaattttgcacaagagtctcacggcacctccacctttggtctattctattag

SEQ ID NO: 94440 - DNA, 138 bp, Glycine max
  Peptide Sequence Number=SeqID_211218
atgaaaggattcgagtttcgacatgagacaaaggacaatggtgcacaacgatgcatggagatagcacaactttttgtgtgtagagtcggaagggaaacctccaacgggagcttagagcttgtggagcttagagcttag

SEQ ID NO: 94441 - DNA, 225 bp, Glycine max
  Peptide Sequence Number=SeqID_211219
atgaagtggaagataggccgcaccaagaaaactgaccgaatgacgtctgaggcagcaaaggaaattgctgagaagattgaaagattcattggaggagcaggcctcacatggttcctttgtcgcccatggacgttaggatccggtgtcaccatcaagcaatactttggaccgactctaaggacctcctgcacgtcttcctccatggctctcgaagacctggagtag

SEQ ID NO: 94442 - DNA, 210 bp, Glycine max
  Peptide Sequence Number=SeqID_211220
atgaagaagaagaaggttgaagcagctggtgtcttgatcagcgaggcatatgcgcttagcgacgagatggaagaatctggaagagaatttgccattcatgcacgtgcccagtgcgccatcagctcgcttagcgagtcatttgtctcttctcgcacccagctcgctaagcgaaaattcactaactcacgcttagaaagaaaatggcgctaa

SEQ ID NO: 94443 - DNA, 795 bp, Glycine max
  Peptide Sequence Number=SeqID_211221
atggctatctggaacacgagtcatgttttaaccaacaaacccattttcctaattcctctacttgtctttgtaaccatgttgttcatgttaccaaacaaagtgaactcagcacattcagtctctttcaccttcaacaagcttggtggtgaccaaaaggatctaatcttccaaggtgatgccacttctaataacaatgtcttacaactcacaaagttagataataaaggaaacccacaattgacactactccagctgctggaatttccttcttcattgcatgattctacaatccctccacattctggtgggaggctccttggactctttcctgactcaaatgctctcaaaaactcttcttcctctaataatgaaaccgctattgatttcaaagcttcatcagacaaagttgttgctgttgaatttgacacataccataattgggatagttgggatccatattataaacacattggaatcgatgtcaactctattaggtccaaggcaactgctcagcggaattggcaaaatgggaaaattgccactgcacatatcagctataactctgcctctaaaagactaactgttgttgctttttatcctgctactaaagctgtgactctttctcatgacattgaactcaataaagtgcttcctgaatgggttagagttggaatctctgcttcaactggagcacataaacaaaaaaataccattctctcatggtctttcacttcaagcttgaagaacaatggggtccagaagaaagaagacatgtatattgcaagcgttgcgtga

SEQ ID NO: 94444 - DNA, 174 bp, Glycine max
  Peptide Sequence Number=SeqID_211222
atgggtgagaaaatgttgattttggaatatatgcagacaatgagagtgccaagagttttctgtgtcgcaaggtggcttgttattcatatttgcgagggtccaacgcctttggacattgggagggctagcaacaggatatggaatgggagctttttcataagtggttggttgtag

SEQ ID NO: 94445 - DNA, 1548 bp, Glycine max
  Peptide Sequence Number=SeqID_211223
atggattcaggagctgttcaaagtgaagtacatgagaacgatgaacattacccccacattgttgtctcagagcaagtgacacatggtgcagaagaagaccactttgatgaggagaagaagtctgttctgaataaggtaaaggcaaaggctaagaaaattaaggacacgattaagaagcatggccatcaagtgcttgatcgtggtcatgtgtataacaatgaagatcagcatacccttgatgatgatgacttagaggaggatgaagaaatggctgaagacccacaagttcatgaaacaccaattcaagaaagtgaagatgttaaaactgctatacctacatctgagcaactcgaatatttagggaagtcaggaattgattttggaggcacagcagttatgggagaagaacctcgtcatgatgcattacttggaggcatttcttcagctactgaaattgatcaaaacatagcgaaaacattttctgtggaagagaaagcagagatacctaaggaaaatttggagaggtcaataggcttggaggaagcgcctcatgctccaggaagtacaattgaggcatatacccctcccaattatgaaaccaaaatcactgatccaagtgtgataggaaaggatgaaatagaagaaatcacaccagttgaggaatcttttgcgaaaatgaatgtgcatgaaaaacctactccagaaccaatcgttcctcttgctgaaaaacatgatcagtttgtgtcacacctctctgctgcaacacaaactcggtatccttcttctgaaagtcatgatgatcagttcaagcaggaaacaacatccacaaatatcaacagaaacctggaaaatcccacagaaactggaataactttcaacaccatcacaaccacagttgaagaacaaccacactacgaagcaaacattgatgaagttgtctctcctaaagatgtcatagattctgaggcaggttcaggagagaaagttgagataaaggacaaggtggtaacaaatgaagagcaaggggatgcttctaacatgcctgactcaactgcacaacatggaaagaacattgctcactctctgtcagagaaattagctccagtttatgataaggttgcagaggtgggaggtgcagtgaagtccaaagtgactagaactagcactggtggtgttggaactgagacaaaaaatgaggtttctgtgaaggattatttgtctgagaagctaaagcctggtgaagaagacaagtcactttctgaggtaatttcagaagctttacataagaggaaggaagagccagtgaaaaaagaggatgaaaacttgaatggtggggatgacaaaatgtgtgaagagagcagtgtgaagagtccagggaaaggtgtggttggcaagcttaagggtgttgttggctcttggtttggcaaatctgaggaaaaaggtgaagatttatccaagagtacaaattctggtgctgaagtggaacaggttcatcaggttgttggtggaaacaagagtagtccatttgaagaacaagggactcgctaa

SEQ ID NO: 94446 - DNA, 1404 bp, Glycine max
  Peptide Sequence Number=SeqID_211224
atgaatgcaataacccttttaggtccaaagagggtgcaaaatttttcccattctttgattattttgcggagattatgtagccatccgtttgatggtaacggattcgaatttattgaggagcctttgaaaaaactaggtccagattatgataccaatgtggatgaaaggctccatttgaaagaggattggggctataaccgaaaacagttttcacttagaaaagggttcttagaaactgttaagttagatgctaagagggtccttgaggttctccggcaagacggtcccggtctcgatgcgaggttggttttaggtgagttgcatgtaaggctatcagggcttcttgtgagggaggttctctttggaattttgaagcacataaattgtgagaataagaccagtcagcaagagggttaccagcacactgtgaatgcgtatcacctagttatgaacatatatgctgagtgcgaggagtttaaggcattgtggaggttggttgatgagatggttgagaaaggtcttccggctactgctcgtactttcaatattttgattcgtacttgtggtgaggcgggtttggctaaaagtttggtggagaggttcataaaatcaaagacgtttaactttaggccttttaagcactcctacaatgccatcctgcatggtcttcttgttttaaaccagtacaagttgattgagtgggtttatcaacagctgttgcttgatggattttcatcagatattttaacttataatattgtcatgtatgccaagtacagactaggaaagttggatcagtttcacagactgcttgatgagatgggtagaaatggattttctccagattttcatacattcaatattcttcttcatgttctcggcaagggggacaaaccacttgcagctctcaatcttttaaatcacatgagagaaatgggtatagaaccaactgtgcttcatttcactacattgatagatggactcagcagagctgggaatctggatgcttgcaaatatttttttgatgaaatgataaagaatggatgcatcccagatgtggtggcttacactgtaatgataacaggatatgtagtggctggtgagattgagaaagcactgaaaatgtatcaatatatgatttctagagaacaagttccaaatgtttttacatacaattccataattcagggattatgtatggcaggaaaatttgatgaagcgtgctcaatgctcaaggaaatgaagaccaaaggttgtagtccaaattcatttgtctataatacattagcgagttgtttgaggaatgctggaaagactgctgatgctcatgaagtgataagacaaatgacggagaaggggaagtatgctgacatacattcaagattcagagggcacaaggcttag

SEQ ID NO: 94447 - DNA, 114 bp, Glycine max
  Peptide Sequence Number=SeqID_211225
ggctacttggatccagattattatactagtcagcagttgactgaaaagagggatgtctatagctttggagtgctaatggtgaagctgattactgcaagaaagccaatagaataa

SEQ ID NO: 94448 - DNA, 393 bp, Glycine max
  Peptide Sequence Number=SeqID_211226
atggctgttattgatgagtgtaaattaaagttcctggagctaaaggcaaagaggaactaccgtttcattgtgtttaagattgagaactatgaagtggtagtggagaaacttggaagccccgaagaaacctatgacgactttagtgcatctctgcctgccaatgagtgccgctatgctgtctttgattttgatttcaccacaaatgaaaactgccagaaaagcaagattttcttcattgcatgggctcctgatacatcaaaggtgagagagaagatggtgtatgccagctccaaggacaaattcaagagggaacttgatggcattcaggttgagttgcaagcaacggatcctagtgagatgagctttgatatcataaaagcacgggcattataa

SEQ ID NO: 94449 - DNA, 2637 bp, Glycine max
  Peptide Sequence Number=SeqID_211227
atgcagagcgagttctccgatgcgaagaagcacagagaggaggaaaaccctcaaacactcgcttccccggaacatggcactgagaagaagaagaagaagaagagaaagagaaagaagataaccgaggaatcaaatgagcagccccaggttgaggtatgccctaaaccctttgcagactcattagtctcgattgttccacaagaggaaaatgctgaaacatctacgcagaaccctaacccacccccccggaaaaagaagaagaagaatagtgttcaaggtgcagagcaagttcaaacacttgatccttcgatcctcttaggcgtggaacctgatgttacgaaggaagaaggggcacaacaagcttcagacctgccagctgaaacaattacgcaaaaccgtgccccaacccccaagaaaaacaagaaggatgtgcaaggtgcacaacagcaacttccgatatgtgacccttcaaatccgacaggtgtggaacccaattttgcgaaggaagaagcaacacaacaaggtgatgcaaatgaaactgcggtccctggaataaatgaagaacgccctggacctgattcaatgcctctggaagacactccccggaaaaagaagtccgcagggaaaaagaagaatgtgcttattaagccccacggggctaaacttgaactagaatcaaaggagtccaataatacagagcaccctcaacaatgctcctcagactcagaactgaaaatgaagatgaaaaaaggggcagaagccaatgctgagaactctgcactgtgccctaaacctgaattggcgctcccaaatgacaaatcaatccctattgattcagtagtgaacaaaaggacagtaccaactgaagctaaggtggaagatcctcaagcgtgttctaaacccaagttagcatcctcaatagacttgccagctccaacaaacccagaaaagaaaaaagaggcagaacctatccaaaaccctgaagcacgtgttgaaccccctcaacctcaatcttgccctgcatcatgtgcagagtctccgggtaatccagcaattccaattgatcagagcagaagaaaacaaaaaagcaagaggggaaaagaaaaaataataatgtgctcagaagagaaggtggagaaccaagggagctcattgcatatggacataaccctcaaccaggttccagaccaggtccaacaaggccaaacaaccccaataagcctacaaccagcatccctgacagaccatacaatcccggtgcatccagcaaccccaatagacccagaacagacgatgaagaagaaaaagaagaagcaaaggaagaatgcgctggagtgggaagagcttaatgataataaaaattgtacagagctgccagaaatctcaattcagacatctccatgccttatagaagcatccccaatagacccagcaattccaatgggctcttgccttacaatcccaatatgtccagcaatctcagcagaccccgaacaggagatgtcaaagaaaaagaagaaaaggaagagtgtgcttaaaagtgaagcagcagaacccaatgaacataacaagctgcctgaagctgctccgcccgatgcccctgttcagaaatctatataccatatagatgcaccctcaatcgacccaataatcccaatgggcccatctccccctgtagacacagaaaccccaatagaccaaggtcaggagatgaccaagaaaaagaggaagaagaaaaagaggattgtgatcataactgaagggacagaaaccaacgaacacggtgtcaagccatctgaaaccccagttgaaagatttacatatcctacagtagcaacctcaatagacccaaaaattccagtcctagctcccccaatagacacagcaaccccaataaaccaaagtcagaagactggcaagaaaaagaggaagatgagtgcccttataagcaaaggggcagaacccaatgaacatgatgacaagccagctggaactcctgttcagagatctatacattctatagcagaaccctcaatagacccaactattccaacaagccaagctcccccagtagacccagcaaccctggtagacccagaaccgatgaccaagaaaaagaggaagaaaaggaacagtgcactaaaaaatgaagggttagaatctgagaaacacaatgctgatccaactgcagaaaccccagttcaaaaaactgaaggatccacaactgaaaattttaagggcagatgcaatgccgggccagcaggtaaaaccccagttcagagaactgacagtctcagagtgactaaatctccctttaaacatcatggtgaaagttccttgagatgccgggcatgccgacagcctggtcacagattccaacaatgccagaggctgaaatgtctttccagggatgaggaagtttgcttcttttgtggggaaattggacattcacttggaaagtgcaatgtgtctcaagcagggggaggaaggtttgctaagtgcttactctgttatgaacatggacacttcagctataactgccctcaaaatggtcatggaattgatccaaaggtgcttgaggacaatggagctatcaatagaaaatatccgggaaaaaatttaggtggaaatggataa

SEQ ID NO: 94450 - DNA, 1431 bp, Glycine max
  Peptide Sequence Number=SeqID_211228
atggcctctaacttcagcttgagaactttgatgatattttcccttgcattttggctcgccctgaaaggcactcttggagggatagagtgtgagactctaagccatgacacatgctcattcgctgtgtcatctgctggaaaacggtgtgtgcttgagaagcgcgtcaagaggactggtgaggaagcatacacatgcaggacatcagagattgaagctgataaactgaaggaccacattgaaacagagcaatgcatcaaggcttgtggtttggacagaaagtcccttggaatctcatcagattctcttcttgagtctactttcactcagaagctctgctcccctcactgctaccagtgttgcccaaatgttgttgacttgtacttcaatcttgcagctggtgaaggagtgtttcttcccaagttgtgtgaagcacaaggtgtaaatgctcgtagaggaatggctgaactgaaaagctctggtattgtggcacctggacctgtgcacggtgtgcagttcgcagctgctcctccaattaaccctgtggagctcacaattgaacccgccgttgccccgaagtgcccttgcctcctcgttaataagaaaatatcaccattagaggtggatgctgtccttctatctcatccagacattgctcaggcagttgcattcggagtaccagatgacaaatatggcgaagagagatttagcaagaagaaccttgcagccttcaaagtccctaaaaaggtcttcttcactgattctttacccaagactgccactggcaagattctgaggcgtcttgtggaggaatttagcgaccctggtctagataaaattgcttggatcagcaggttcctcgggtgggatagaggtatctgcgatctctccgtcttcgtcagcgataaggaaatgaagggagggtttgcaacggtggccagtgacccatttgtcgttgcagtggtagcaaaggcccttatcgcgggtaaaacggtcgagaacctcgacatcgatccaggagtttatcctcttggagacgtgctaaggcaacgacctgtgggagcgaaattggttggagagcttggacctctcagcgaagttccaacaatgccacgttgctgcaatttgaaaagtgcgtcgcgtcatcgtaaaacgaaggggcaaatcgagattcaattgcttgaagcaatgtcggccagggataggggtaaggtttgcaagacgttccagaagggagtccatcttgaggttcatgtctatttgggcctggacaagggaggtttggttctgagaaagaaatgggtgactctgtgtgagtcgggcgacggcttcttcaagatgttcgatggaggtttgctgggtgttgtgttccagcatagtggcagcaggtcggaccacttgttaggtatgttatctactaactatgaagactaa

SEQ ID NO: 94451 - DNA, 567 bp, Glycine max
  Peptide Sequence Number=SeqID_211229
atgattgcggagacagagccctttggcagcgaagagaatggtgaagaggaggagaaggaagggatggttgagatttgtgttcctgaccgtggcagcacacacaatagaaagggagaaacgaatgtcgaagagaaggatgttgcgactgaatggctttgtgtgggaccggttactggcagctgggaaggggtcggaggaaagtgtgtggtgcttgttaacgggaaggtgaaaagttgtcatgggaaggggaggcaacgtgaggaagaagatgggttggttaccttgggaagcaaaggcggcataggtggtgacttcgcaaaggcagaagatggagagggttgtctgggtactatgatattcagtatccgaagaatgtcatcaagtttggaagcaatggaagtttgggctgcagtagtggaagtttggattgcagcgagtttggtcatggcggcctcaagacgatccacacaggcggtggaaagttcggtgtccgccattgaagagtggcaggttggaccaattgttagcggtggttcccttaaattcgagactaaggacaatctctaa

SEQ ID NO: 94452 - DNA, 207 bp, Glycine max
  Peptide Sequence Number=SeqID_211230
atgtctatcatgtgttcaagctcatatagtattgagatctctcattggctagagaaatttggcaatggggtttcaggagataaactagtgggagaggccagcagaatagtggttgctgaagcttgcgtgcaggcactagatcttgaagtcactgaaaaccaagtatatgaagttaactctgttgagctgaaaagaacggatagttga

SEQ ID NO: 94453 - DNA, 909 bp, Glycine max
  Peptide Sequence Number=SeqID_211231
atggttgagctcacctttgtacgagagacactctgtaaacttttgacggctcgatttgttgaacgttgccctgcccctgagcctgttgtttctacctcatttaaggaaactactactaggaagcggggtgccaagtctgccaagatatttgaagcaccagagacattagaacaacgcgtagtagatgcagcagtgcctggggatgtaatcagattttcactcgctgcagataccagatgtagtgttgatagagaaacaaactcagatgatgctcaaatgattagtgttgaagaagaagttgcaaaagaggggcaaattctttggcgtgcaaatttcgaggagtttatacgtcatcttaggcataaggtattgattgagaatgtaagaactcagcatgatgatggaactgctactgtcttaagtgcagtattggaggcaacaagaagtgtacagaaaaaagtgaaaacggaaaattcagttcccttgtcactggatacaattatcacagaggtgatgaagactgatacaggacgaactatgactgtagatcgtattagagcttcccttgtccagttgggttgttcaccgagcatgattttagaggaatcatatagtattgatttgaagaaaattattgaaccggctcgaaatgaagaggttgagtcaattgtgttgaaaaggtatggaacggatggctacagaattttcaggctactggcaaaggattgctgttttcacgacacagatcagatgtttattgttgttgttcttgttctctttaacactagaggtgcaaactgttggaaaaattgtcttaattgtggacacaccttagcccaccttagttgcagtctctttggaggttgcctaaagtgcaaccttgagggtggtggtttagtcccacattga

SEQ ID NO: 94454 - DNA, 387 bp, Glycine max
  Peptide Sequence Number=SeqID_211232
atggaagaaatcccactatttagtgagaaaatgaaattggctcaaaaagcagctagccaaggaaaatggatgggaagacttcaaggaaacaatgaaggaagacaaggaaaacctgctcaagtcaatgatcgtggagcattgaatttggttctagatgttgcaatttggctagtgatgagaatagataaagaacttgctgtgcaaagggatgagaaagatttaacatgtcttcaactactttccaaaatgccacaagtatttcgaagccacactagcatgggaccagtgaagagtctcatatatctcgtgaagagggtgaggatctacaacctcgacactagatcttatgatcctttcgttgagctctacgaggtcaagagaaagtga

SEQ ID NO: 94455 - DNA, 183 bp, Glycine max
  Peptide Sequence Number=SeqID_211233
atggaagagagagaacagaagatcttcataccagataaattttcggcaagattgccattctcgactggcgatatcccaccccacatgaacaaagaggaaaagaccgaaacacccagcttcctctccaaaaacacttccctcgagaaaatcctattggtccgtgatcgtacgtttgatctttga

SEQ ID NO: 94456 - DNA, 1557 bp, Glycine max
  Peptide Sequence Number=SeqID_211234
atggagttttttctagggctatgtggggttcttgttgccttctcagcagcactttgcctcttgttgctcttgatattaacattttattgggttgttttccctaatcaaacacttaagaagcttaagaaatgtgggttgggaggtccaaccccaagttttccacttggaaacattgaagaaatgaaacgaaagaataacattcaatcttcaattgtatcctcaaatttctcgcacgatatacactcgagcgttttcccctacttttcaagctggcagaaatcacatggtaaggttttcgtgtactggttggggacggagccatttctgtacgttgctgagccagagttcttgaagaaaatgtccacagtggtaatggctaagaaatggggaaaaccaagtgtgtttagaactgacagagaccccatgtttgggagtggtttggttatggttgagggtaacgattgggttcgtcacaggcacattgttgccccagcgttcaatccaattaacttgaaggccatggcaaatatgatggttgaatccacgaatcaaatgatagatagatgggctaaccaaataaacaccggcaaccccgaattcgatgtggagagggagatcacagcaacagctggagagatcatagcaagaacaagttttggcatgaaagacggcaatgcaagagatgccattgctaaattaagagccttgcaaatgactctcttcaagactaatcgttatgtaggtgttccctttggcaagtatttcaatgtgaagaaaaccttggaggccaagaaactcgggaaagaaatcgatgagctcttgttatccatcatagaatcccggaagaattcacccacaaagaattctcaacaagatttgttaggtttgttgcttcagggaaaccatcaggttgatggccggtcaggaaagacactatcatcacgagaagtggttgatgaatgcaagacattcttcttcggaggccatgaaaccacagcacttgctatcacatggaccttgttgcttctagccatgcatgaagattggcaaaatcagttgagagatgagataagacaagtggtgggtggatatgaaaagcttgatatcacctcgctctctggtttaaagaagatgaagtgcgtaatgaatgaagttctaagactatacccaccagcaccaaatgttcaaaggcaagcaagagaagacattaaagttgatgatataacagtgcctaatgggaccaacttgtggatcgatgtggtagcaatgcaccatgaccccgaagtatggggaaacgacgcaaatgagttcagaccagagaggttcatggatgatgtgaatggtgggtgcaaccacaagatggggtacttgccttttgggtttggagggagaatgtgtgtaggaaggaatttgaccttcatggagtacaagattgtcttaaccctacttctctctaggtttacttttaagctttcaccaggttacaatcattcaccttctatcatgctctccctaaggccaagtcatggacttccactcatagttcagcccctttag

SEQ ID NO: 94457 - DNA, 384 bp, Glycine max
  Peptide Sequence Number=SeqID_211235
atgggtctcataaatcctttcagcatcaaggaattaaagatggaaaaaggtacaaaggccagggctgagttcgtcaaggccagagtcgtggcaaagaaggactatgttgatttctccgcaacattgagaaaggctcttaaggctaatgacacacttctgggtgaagctatcaagtttgctagcaaccttgctatagagtttaaaagactaagccaagatttgtctcaatttaccaaggaaagggatggaggggatgttggcatggctcacactaaaatgttattagagtcagctaagaagaccatctactcaaagcatgtggcgggtttgaatatggttgagaaggatgtaaggaatgagttgatggtgttggtggttttataa

SEQ ID NO: 94458 - DNA, 456 bp, Glycine max
  Peptide Sequence Number=SeqID_211236
atgattgtgtatatgagagaccttgagctctatataatgcctaagagtgagcttgaggaaaaaggacactttgagggagtggaagacaaatctttaggagaggaggaagttgagggagagaagaggttgaatgagacagatgagagtttgggaaaggtagaagaagaaatgagggattttgatgatgccaaagaagaatcaaacaaggctgctacatttgcttcaagattaatacaagatttcttcaacaaacaaagtcttgattcaagaattcttcaagatcaagcatttcctcaaaacaaagggaagtgtaatcgattaccagaagggaagtttgagaaactgttgttgaaaagggttttgaatttgaattttgaacatgtaatcgattaccagcaacggaactctgaaaattcaaattcaaaaatcataacccttcaaaatataactgtgtaa

SEQ ID NO: 94459 - DNA, 210 bp, Glycine max
  Peptide Sequence Number=SeqID_211237
atgttgtaccagtatgtggcgatcactcccaactgtcatccatgtggttgtgtaaggccaccaatacttgggaggcttggtggtattgtcgggccatgttatgtgtcaaggcatcgagagtgttgtttccttagaaaaaccatacaccatggttatttagagccttcatctaaagaggatgaggatgatccttccaaggacccgtcttag

SEQ ID NO: 94460 - DNA, 334 bp, Glycine max
  Peptide Sequence Number=SeqID_211238
caagtcgatacaagaaactacaaagggaactctgataacaagaaagttaccatttattccaactcttgtcttcccagtgctccttgattctgaacagaccagaccaacaacaaagttcaacaaatccaaaaccaagtacaaattcgtagaaccaaccgaaacacatcatcgtcatatcacagcacagtgcagttcacaagaatcagcgatgcggaaagagaccttggggcgatcgcaggaggaaggagcgagaagcgcggatctcaggagcgaggaagcggccattggagaaggcgaagaaaaagggagcaaaactcaaaccctagaaaattga

SEQ ID NO: 94461 - DNA, 480 bp, Glycine max
  Peptide Sequence Number=SeqID_211239
atggaggttccatgcaatggcaatgctctgccacaacttccaccagggatgagacatagtggaggtggaggggatgatgaaagggatttgagatttgggatttggagggacacgaaaagcccagagaacacaattgagacagattctagcctagtctcattctctttggtagaggttttgggggatgttttgactttgtttgatgatgatgagcgagaaattgaaagcacaaacaaacaagtgcacgattgtgaggatccatgtgtaaatgactatattggagatgatgttctaaatgaaatagataggataacaaaacacattgttgatcagtataaagatcctgaagctggtgttgaccatccttcgtatgatattccacttgattatggtggtcttaacgtagaaggagatgtagcaacaaaagtgatgattgatttctttggtcatgttggggatgataaccaagatgttgaggag

SEQ ID NO: 94462 - DNA, 266 bp, Glycine max
  Peptide Sequence Number=SeqID_211240
agaaaaatgtatgtgatagtgtcattgggatgctccttaacattcaaggcaagatgaaagatggtttgaatactcgtcaagatctagcagagatgggtatacgagtgcagttacatctaatgtctgatggaaaggagaagatgagtttttgtcagtgtttacgccgtgtcaaagtcccacaaggatactcttcaaatattaagagccttgtgcagttgaaagatcttaatttgaattacacagtaggaggtctggaagagggttga

SEQ ID NO: 94463 - DNA, 171 bp, Glycine max
  Peptide Sequence Number=SeqID_211241
atgtcattggagcttctccttcattgtgctgttcgagcttcttctcctctgttcattgtcggcattaaggacctgcagcttcgttgtgctgttccaccgtcaaggcctacagcatccgcacataggcaacaggaagctgcccctattgctgaggatactcctgtcgtgact

SEQ ID NO: 94464 - DNA, 414 bp, Glycine max
  Peptide Sequence Number=SeqID_211242
atgtccaaagatgaaattgaattccttttgtctctcgagattcatggaactcttttccatgcgcaaatccttgtagaacacaaagctaatgaagaacaagaacattgtagcagtcatgtaaaagagcacatccctaatgaaggtcatgacgtaaaaggtggagaggatggtgtcgaagttgatgtgatattggccgacatggagggcaacgggggattaaaagacgtcgggggcgtcgttgttgagggagaggagggtgacgacatgcatgttgagggagaggttaaggtgagaggtgagctttgtggtgacgagggagaagtggtattgagcagtggtgatgaggatgcaaaagtagagctggaggaaaagcgagaggaaggggatggagagaggggaggtttcaggaaatag

SEQ ID NO: 94465 - DNA, 345 bp, Glycine max
  Peptide Sequence Number=SeqID_211243
atggggtcttgttgtcatcagacaccaaccatagagggtggtgcaacaatttggatatgtttagaccattcctccacagactacaggttcaatgatgacacatatgtggagccacatatccctaaggtcccagtggcaccagcagcagcaccgacacatgacccttctgatgtggagcagcctagacatgcaatggaggcttgccaaacaatcgtagaaaggttggagcgtttgctcaacctaaggatagtcactgcaagcacagaaatgcatgaggtcatggaagactacttaaggatcactaggggtgtcacagcagagagcaatgtttatgtcaggtcatga

SEQ ID NO: 94466 - DNA, 312 bp, Glycine max
  Peptide Sequence Number=SeqID_211244
atggcaaataaagtcttagagctgaatatggagggtccagaagaaattggggctgaagctagagctggtaaagatgaagttggagtagatggagctacagtagaaggagctaaggcagggaaagcagaagatgatagagcctcagacctcttgcccttagccttccagggcccccgaaaagtgactgtggggtcatcgaggctctcaaaagataacgaatcagaagtgactcgtctggccttgcacaaggcagtgatgagggcaggaaaaccaagccgtgaggagtcatactgtgcgatcatagaaatatga

SEQ ID NO: 94467 - DNA, 354 bp, Glycine max
  Peptide Sequence Number=SeqID_211245
atggacaataaatgttctgagctaggagtggcaggccttgggagaactggagctggagctgaaggtgggagagtagatgcagatgcagatggagccgatatggaaggaactaaagaagggggagcagaagaagatggtacctcagaccctttgcccctagatttgtgggttcctcgaaaagtgaccgaagggtcatccagagggtacatcaacttgggtttgactgacaacaagagagggtacatctcttgtggatcagttctagtggagggtacatccactaggttcaaagagaacaagggagggtacatcccttgtggatctttgcttgtaaaaggttttttacaaggttga

SEQ ID NO: 94468 - DNA, 636 bp, Glycine max
  Peptide Sequence Number=SeqID_211246
atgacaaatctagatttacatcccaagaggcctgggaccgctacacagataatgtactcggccggaagatacttccgaagagaaatgtacaactatgggagcatagatgtagcaattatcaaggagttttatgcaaatctctatgaccccgaagacaaatcaccgaagcaggtaagggttagggggcatctaataaaatttgatgttgatgcccttaacactttcttctggacatcagtgatagaggaaggggagagcctatcagcctactccaggtttgctcagttcagaccagatccgcaagagctggcagcctgcttatgtatccctggaaaaggatttgaattgaatgcagacgggctgcctctgaagattttgagaaagaatttgaatatgctggccaaaacctggagcgtacattccttttctaacttagcctctacctctcacacttcaaacatcactttagacagggccagattaatttatggcattattcagaagatggacatgaacctcgggtacctcatctcgagtcagatttctcttatagcccagcatgactcctcgaggctaggttttcctgccctcatcactaccttgtgcaaggcccgggagtcacctctgactctttga

SEQ ID NO: 94469 - DNA, 363 bp, Glycine max
  Peptide Sequence Number=SeqID_211247
atggctgccagtgaccatgttataggttgcacactttgtggtggagctcatgggtcaggcttgtgtattcccactgaagaaacatctcatgaagttaattacatgggaaaccagcctagacaaaattttaatgcaggtggattttctggatttcaacatggccaaccttaccagcagcataatcaatggagaactcaccctggtaatcagctcaataaagaccagggtcagctacctaacaagccacgacaaaaagggcctagcttatctgagagaacaacaaagctggaagaaactcttgctcattttatgcaggtgtcattgaccaatcataagagcatagagtcagccacaaaaatctag

SEQ ID NO: 94470 - DNA, 1560 bp, Glycine max
  Peptide Sequence Number=SeqID_211248
atggagtttctagggctaactggggttcttgttgccttcttggcagcactttgcctcttcttgcttttgatattaacattttcttggtgggttttccctaaccaaacacttaagaagcttaagaaatgtggtttgggagggccaatcccaacttttccccttggaaacattaaagagatgaaaagaaagaataacattcaatcttatgctgtatcctcaaatctaacacatgatatacactcttatgttttcccctacttctctagctggcagaaatcacatggtaaggttttcgtgtactggttggggacggagccatttctgtacgttgctgagccagagttcttgaagaaaatgtccacagtggtaatggctaagaaatggggaaaaccaagtgtgtttagaactgacagagaccccatgtttgggagtggtttggttatggttgagggtaacgattgggttcgtcacaggcacattgttgccccagcgttcaatccaattaacttgaaggacatggcaaacatgatggttgattccacgaatcaaatgatagaaagatggtttagccaaataaactcaattggcaactccgaaatcgacatcgaaagagagattatagcaaccgctggagagatcatagcaagaacaagttttggcatgaaagatgacaatgcaagagatgttttcgacaaattacgtgccttgcaaatgactctctttaagactaatcgttatgtaggtgttccctttggaaaatatttcaatgtcaagaaaaccttagaggccaagaaacttgggaaagaaatcaatgagctcttgttgtccatcatagaaactcggaagaattcaccgaagaaaaattctcaacaagatttgttaggtttattgcttcaagaaaataataatcaggttgatggccggtcagggaagacattatcaacgcaagaagtggttgatgaatgcaaaaccttcttctttgggggccatgaaaccacagcacttgccatcacatggactttgttgcttctagccatgcatgaagattggcaaaaccagttgagagatgagataagacaagtggtggagaacaccgaagaacttgatatttccatacttgctggtttaaaaaagatgaaatgggtcatgaatgaagttctaagactatacccaccagcaccaaatgttcagaggcaagcaagagaagacattaaagttgatgatataacagtgcctaatgggaccaacttgtggatcgatgtggtagctatgcaccatgaccccgaagtatggggaaacgatgcaaatgagttcagaccagagaggttcatggatgatgtgaatggtgggtgcagccacaagatggggtacttgccttttggatttggagggagaatgtgtgtaggaaggaatttgacctttatggagtacaagattgtgttaaccctacttctctctaggtttacttttaagctttcaccaggttacaatcattcaccttctattatgctctccctaaggccaagtcatggacttccactcatagttcagcccctttag

SEQ ID NO: 94471 - DNA, 2733 bp, Glycine max
  Peptide Sequence Number=SeqID_211249
atgattgaggcgctattcccagaaaatggttgcggcgatgattctggggtagacccggctgctgctggattacaggttacctcagatgggaaaccaaaaattattgatattcttgattgcaccgggagtggagatattgatacctcaaaggtggtgaaggctgatgctgatggttgtatttctggggcttcaggggcatctttggttatcaacacttcatggaaaaacccatctggtgactggcatgtgggttataaattggtgtatgagctctttacagaaaacttgacttctcgtttgaagaaagaaagaaagaaaaaatgggatgagaaaaaccaggaggaaattgccaaggccgtaaaacagcttactgattttgatcaggaacacatcaaggtggaggacgctaaacttaaaaaggttcgtgaagacctccagaataggcttgatcttctgaggaagaaatctgagagttatgatgataaagggcctgccatagatgctgttgtctggtatgatggagaggtttggagggttgctcttgacacacacagtcttgaggatgatccagattgtgggaagcttgctaactttatacccttaaccaattatagcctatttttcaggactgagaagaaatatggtatcttcagcaaattagatgcttgtacatatgctgtgaatgtctataatgatggaaatgtcttaagcatggtaacagatagctcccctcatggaacccatgttgctggtatagctgctgcattccacccagaggaacctttgttgaatggagttgctcctggagcacaattaatatcttgtaaaattggggactctcgcttaggttcaatggaaactggaactggtttgactcgggcactgatagctgctgtggaggtgatttcaacaattgatatagatttgtctttaatatttgtgtttgaccataaatgtgatcttatcaatatgagttatggtgagcctacatcactgccagactatggacggttcgttgaccttgcgaatgaagcagtaaacaagcatcgtctgatatttgtgagtagtgccggtaatagtgggccagcattgagcactgttggtgcacctggtggtacatctacaaatattataggtgttggagcttatgtttctcctgctatggcagctggtgctcattgtgttgttgagcctccttctgaggggcttgaatacacttggtctagccgtggaccaacaactgatggagatcttggtgtctctgtaagtgctccaggttgtgctgttgctcctgttcctacatggactcttcaacggcgcatgctcatgaatgggacatcaatggcatctccatcagcctgtggtggaattgcattgctcataagtgcaatgaaggctgagggaatccctgtgagtccatatagtgtgaggaaggcccttgagaatacatctattcccataggtgattcacctgaggataaattgtccactgggcaagggcttatgcaaattgacaagttcgatatttttacaaactttgctttcatggaagttttagtaaatgatccttcttcacggggcatctacttaagggaggctaatgcttgccgacaacccactgagtggatggtgcaagttgatccaaaatttcatgaagatgccaacaagcttgaagaattggctgtgtttgaggagtgcattgagttacactcttcagataagacagttgttaaagcccccgagtatctactgctcactcataatggccgcaccttcaatgtatttgtggatcctaccaatttaaatgatggtctgcattattatgaggtctatggtattgactgcaaagcaccatggcgtggtcctcttttcagaattccaattactataaccaagcccatggctgtaactgacagacctcctcaagtttcattttcaaagatgttattccagccaggccatgtacagaggaaatatatagaagtaccacatggtgcatcttgggttgaagcaaccatgaatgcatcaagttttgatacagctcgaagattttttgtgcacacagttcagatatgtccattgcaaagacccattacacgaaggaatgtgattaatttttcttcccctactgccaaaagcttcacctttagggtagtaggtggtcagacattggaactagtcatagctcagttttggtccagtggcattgggagtcctgagaccaccagcatagatcttgaggttgtgtttcatggtataaaagttaataaagaggaaattgtacttgatgggagtgaagcaccaatcagaattgatgctgaagcgctactggcatctgagaaacttgcacctgtagctattttaaataagataagggtcccatatcgaccaatagatgctaagattagttcactttcaagtgatcgtgacaaactcccctctggaaaacagatactagcattgacgttaacatacaagatcaaattggaagatggagctgaaataaaacctcaaataccatttctaaatgatcggatatatgatacaaaatttgagtctcaattttatatcatttctgattcaaataaggctgttgtccaacttaataaaataccaatttatgtgttttgtcctatgagggcgagccctggtgcagcggtaaagttgtgccttggtgacttgttggtcatgggttcgaatccggaaacagcctctttgcatatgcaagggtaa

SEQ ID NO: 94472 - DNA, 567 bp, Glycine max
  Peptide Sequence Number=SeqID_211250
atgggtaccgaagatagcgatgagagcaccgcgaccgtcgtagtcagggtgagaatggaggaaacgatcggcgccaatctctgtcttgggcatgagagaagccaggaaagtggactcattcaagttgcggaaagaggcatcgttgttgttgttgttgtcgttgccaccaccacagagagaagtgcagtgcattgctttggggacaatccaattgcttcttctgaaggaggaagtgggagtgtgtttccttctcgtgctgttgagctttgtctttgttgtgcggtgaaggatgttaaagacagtgtcgtccagggcagggcagggcagagcaattgcttggtcgtaaattccagaaatgccataagaatgcaacatctttctgatgaggtctaccgcaccaccaaaaacacaagtccacgaagcattgtgcagattaacctttccttccgaagtatcttccacctttccaaaattgtaatgcataattcaataaaaacccaatcaagaaaccatggcggctggtgcagaaagaaaccattgaaattcaacactgaggttgtttcttga

SEQ ID NO: 94473 - DNA, 675 bp, Glycine max
  Peptide Sequence Number=SeqID_211251
atgatgagtagcaaaacaaatatatcgttgaaaggacagagcactggatggggaggttccgtggggtgcaactcaaggtgctccaacgggccctcaagagagggaaacgtaggaggaagggatagtggaggattgaatcgaatagtacacgctgtgtgcacaccatcaaaagcccaatacggagagctggtggatgcattagaatttagaagcatggtgactactgcatttatacgaattagagcacaacaattacgatggatgaaatggagaaaaacatcgggagtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaagataaaattagaaacgaagctattagagagagggttggagtagcgcctattgtagagaagatggtggaaaatagacttaggtggtttgggcatgtagagagaagaccggtagactctgtagtgaggaggatagaccagatggagagaagacaaacaattggaggcagaggaagacccaaaaagactagaggttatcaaaaaggatctcgaaattaa

SEQ ID NO: 94474 - DNA, 285 bp, Glycine max
  Peptide Sequence Number=SeqID_211252
atggccgaccacgcaacaaggaagaccacgacggacagactcgaagacgccattacccgattgacccatagccaggcgtccctctccgataagtactcagaattattaggcaaagtcgattccatcttggatcatcttcgcctacgcgacacaaattctaacaaccccaacgcccatacgtcctccgcccaaagaaaccatgtcaagctagatattccgaggtacaatgtgactacggctgccttgctgtctaaagacgacaggctagctcgatatagctcctag

SEQ ID NO: 94475 - DNA, 231 bp, Glycine max
  Peptide Sequence Number=SeqID_211253
atgttcgagtttggaacttctgtacttgtgccttctgttcaggaacttgcaaagcaagccatcatcaatgttccagagaaatatcttcgtccaaatcaagactctcatgttatagtagactcaaccttaacacttccactcattgaccttagcaaattactatctgaagatgtaaccgagctagagaagctaaacaatgcatgcaaggaatggggtttcttccaggtttga

SEQ ID NO: 94476 - DNA, 4143 bp, Glycine max
  Peptide Sequence Number=SeqID_211254
atggccgaccacgcaacaaggaagaccacgacggacagactcgaagacgccattacccgattgacccatagccaggcgtccctctccgataagtactcagaattatcaggcaaagtcgattccatcttggatcatcttcgcctacgcgacacaaattctaacaaccccaacgcccatacgtcctccgcccaaagaaaccatgtcaagctagatattccgaggtttgacggccgcgaccccctcgggtggatctttaaaatcacccaactattcgattaccagaacacccctgaagaagaaaggatcactgtggcatctttctatcttgatggtgcagctttaagctggtaccaatggatgttccgcaacgggttcatcacgtcgtggacgggttttttacaagctctcgaatccaggtttgctccaacgttctatgacgaccccaaaggcgcccttttcaagctagcccaacgaggcacagtcaatgactacctcacggagtttgaaaggctagccaaccgagtcatcggattaccgccgccgtttatgctcagttgtttcatctccggcttatcaccggagatacgtagagaggttctagccctgcaacccatttctcttccccaagccactgcgttagctaaactacaggaggacaaactaagagatcgtcgtcgggtcttttctcgaccaactgagtcttccttcccctctacccaacctactaaccccagcatcaaagccaaagccccatttgttcaacgaaccccagaagagattgcgttcaaacgcgaaaagggcctttgttataactgcgatgagaggtggaactcgacccaccgttgtaagggacgcgttcttctattcattgccgactccccgtcacccgaaactacggattccgaccctgaaccactccctttaccagatgacgaacaccaggatgcccaagaccaggtaacggacgagacgttccctcacatcagcttgcatgcactctcaggatttccctcatctgaaactttcagactttatggaaccatcaatcacgcgcgtctcaccatcctcattgatagtggaagcacgcataattttctccagccacgcatagctcacttccttcgtcttccggtaaggcctacttctccattacgagtactggtgggaaatggttcagtccttgactgtaaccagctatgctccaatacacccctttcacttcaaggccacttcttcaacgtttctttccaccttttaccgataagcggggccgacgccgtgttgggtatcgaatggctcaagcagtttgggccggttattactgactacaccgccctcattatgaagtttcatcatttgggccaggccattgagcttcacgcagacgtttcaaataggcccgaactggtctcagtacctcaagtaaaacgcttggtccgcaccgggtccacatccgccctattccacttaaatctactacccgtaacccgacccgaaccgccacgtcatcatcttcctcaacatcatcttccccaccccgaccctgcaatcgaaaatcttctccgacgttaccaccaaatcttcgaaacacccaccacacttcctcctccccgaaccgttacccaccacataaacctcctcccttcatcatcacccatcaacgtaagaccatacagataccctcattttcagaagaccgaaattgaaaagcaagtctccgatctgctcgcggcaggcctaatacgaacaagcacaagtccatactcctccccagttcttctagtgaagaagaaggatggaacatggcgtatgtgcgtggactaccgtgcccttaacgcagtcaccgttcgcgataggtttccgatacccactatcgacgaattgttggatgaactagggcaatcatcttggttctctaacggccatgaacagcttgctcacacccttcctgagacgttgtgccacggcaaaggagttgaacctgacccctctaagattcaagctatgctacaatggcccactcccacttctgttagagaactccgcgggttcctagggctaacagggttttatagaaaatttgtaaggaattacgcgtccatagccttaccacttacaacccttttatgtaaggatggcttcgagtggaatgaagattctcaagctgcctttgatgcccttaaatccgcaatgactcgagctcccgtactagctcttcccaatttctctgagccatttaccgtagaaacagacgcgtcacaaaccgccatgggcgctgttttggtacaaagggatcacccagtggctttctttagcaaagtatttggtcctcggttaacccatgcctcaacttacatacgtgaacttcacactatagtcacagcagtacgaaagtggcgtcagtatctcttagggagatctttcactatcctaacggaccataagagcatccaggagcttatgacgcaggtaattcaaacccctgaacaacattactacctctctaagttgttagggttcgattacaccatccgctacaagtccggcgcttctaacattgtagccgatgctttgtctcgtgcaccaccaccttccggccagcttctattactctccgtccctcacttggatttcatctcagaccttcagcaatccctacatagtgaccaggagtttcaaacattgctctcgaaaatccaagcccaaccctcagattaccccaaccaccaacttcataatggcctcattctttcccagggacgaatttggttacccaacacaaacccgtatatacctactatcttacgcgaataccacgcaacgccattagggggccacatgggtgtcgcaaaaacaacacatcgtctcgaatctagcttcacttggcagaatctcaaaacagatgttaaacgttttgttcgagaatgcaaggtctgtcaacagaccaagacaagcactcgccggccgggaggattgctccaaccactttctcttccaacaggggtctgggaagatatttccatggattttataacccatttaccagcctcccacggttacacggtcatcttcgttatagtagatcgattctccaagggcgtgcatctaggagctctacccacacacttctcggcttacaaagttgcaaccctcttcattgatctggtatgtaagcatcacgggttccctcgcagcatcgtttcggatcgcgatccagttttcctgagttcgttctggcgagagctatttcggttgcatggaaccctcctccgcatgagtacggcgtaccacccgcagaccgatggccaaacggaggtaatgaaccgagtactcgaacagtatctacgctcctttgtccactcacagccggcaaattggttccgttacctagccctcgcggaatggtcctataacacatctcttcatactagctccggtttcacaccattcgaggttatttacggcaaacctccgccgtccctccctcattaccttccaggccacacgactaacgaagcagtcgacaccttgctcaccagtcgtcaggagatccataccaaactccggcagcgtttattaaaggcacaagaggttatgaaacaccacgctgactccaaacgagaaaacgtatcattcacagttggacagtgggtctacgttaaactccgtccacatcgacaacgttccgtcaccggagacactcattccaagctctcgaagagattctttggacccttccagatccttgaacgcataggtcccgtagcatattgccttcggttgccggacaatgcacgcatccaccccgtcttccactgctctcttctccgagcccatcacggtcccacgccatcctccttagacacatggcccttgcaggttgttgaccacaggccaattccacatccattatgcttcttagactcaaaaatggaccatactacatctccccctacgcgtttggtcctcactcaatggaaaggtcaaccccccgaagacaccacttgggagccttggtcagagttacgcgactcctaccaccttgaggacaaggtggttttcggggaagggggtattgatatgcccatgcataacccagcacccgaagcaactaacccttcacccggaataactagaacttga

SEQ ID NO: 94477 - DNA, 120 bp, Glycine max
  Peptide Sequence Number=SeqID_211255
atggagatcaatgacggggttggcatatccgggaatattctaactcttaaattagagagaaattttgatagaatgggatggaaggataaaggccttgttattcctcccgtccagaattag

SEQ ID NO: 94478 - DNA, 264 bp, Glycine max
  Peptide Sequence Number=SeqID_211256
atggcagatatgttcttggttcacactcttccaataaacgcaaggaatcctcgcttatttcctaactttccccaaccattgagagataatttagagaactattctttggaactgaaaaagctttgcctcacaatcattgagcgaatgacaatagctcttaagattgaaccaaatgaactgctagactacatagttgaagatttatttcaatcaatgaggtggaactactaccctccatgcccccaaccagaaaatgtcatttga

SEQ ID NO: 94479 - DNA, 1656 bp, Glycine max
  Peptide Sequence Number=SeqID_211257
atgagtgacaaagaaaagtttgaggtggatagaaacgaggatcatgtgagttattctagcggaatgcactcggattggagatttgggggttcaaatcttgcaaattcttcggtaggttttgttggcttggggaataattctatgaatgtcagcagaggggatttgattggttcttcttcatgttcctctgcttcaatggtggactcacttagtccaaattactgggaaaaccccaccagctcccaaaagttgggattttgtgacattaataatgtccacaacaatgggggctcttcaagcacagttgcaatcagaaaagatggatttggatttggaagagttggtcaggatcatcatggaacacttgaaatgggttggaatcatgctaattctatgttaccaaatggaccagtgatgtttccccacagtttatctcagtttccaactgattctggattcattgagagagctgcaaggttctcgtgcttcagtggagggaattttggtgacatggtgaactcatatgggattgctcaatccatggggctgtatggagcaagagatgctattgcaggccatgggttgaaatcagtaatagctggaggacaatctcaaggaggtgatatgaatgtagttgaggatgtgcctccatctgttgagcatcttgttgctgctaaaggaagccctctcaagagtgatagaagaagtgaaggtcatgttatattccaagatgaagggaagcaatctcttgttaggaatgctaatgagtctgatagagctgaatctagtgatgatggtggtggccaggatgattccccaatgttggaaggtactagtggggaaccttctagcaaaggactaaactcaaagaaaaggaaaagaagtggacgggatggtgataatgataaagccaatggagctcaagaactacctagtgaaggtgcaaaggggaactctgagaatcaacagaagggagaccaacaaccaatttcaacagccaacaaggcttgtgggaagaatgccaaattggggtctcaagcttctgatccacctaaggaggaatacatacacgttagggctcgccggggtcaagcaacaaatagccatagccttgcagagagagtgaggagggaaaagataagtgagaggatgaagtttcttcaagaccttgtacctggatgcagcaaggtcactggcaaggcagtaatgctagatgaaatcatcaactatgtacagtcacttcaacgacaggttgagtttttgtctatgaaacttgctacagtaaatccacggctggattttaatattgaaggacttcttgctaaagatattcttcaacaacggcctgatccttcaaccgcactagggtttcctctagatatgtccatggcttttcctccattacatccacctcaaccagggctgattcatccagtaattcccaacatgacaaactcatctgatattcttcaaagaaccatccatccacagttagctcccttgaatggtggattcaaggaaccaaatcagctgcctgatgtatgggaggatgagcttcacaatgttgtacagatgagctttgcaacaacggctcccccaactagccaagatgttgatggtactgggccagcaagtcagatgaaagttgaactttga

SEQ ID NO: 94480 - DNA, 1929 bp, Glycine max
  Peptide Sequence Number=SeqID_211258
atggataaaaagggaaaagacagagacagagttttacccatcatcatcatctattctacgctgtcctcctcaaacttctcttcaaaaagttctaatctttaccacaaagcctttagcatttgtgagaagaaaatgtcagaacctgaggaagaaaataaccaagactatgttcccaggtcaaagccagcagaggaaggtggtggtggctgcaccaccatggacttcgatctggacttagaaacttcatggcctttggatcacatggcctttggctcaaaccccatgtcacctttcttgttctccacttcctctgaccaaccttactctcctctttgggctttctctgatggagaagaccccaagcttcctgcttctgccttctctgattgccacaagatcttctcttgcgattcaaattcaatagctgaaaagccagtggagaatgatgacaacaaaaaaaatttgccaccacttgtgcctatgccaccagtggaaaatttggatggttattgtgtaatcaaggaaaggatgacacaagcgcttcgttacttcaaagagttgactgaactgaatgttctagctcaggtttgggcaccagtacggaatggtaatcggtatgtgcttacaacttcaggtcaaccctttgttcttgatccgcatagtaatgggctccatcagtatagaacagtctctctgatgtacatgttttctgtggatggggagaatgatggatctttgggactccctggtcgggtttttcagcagaaattaccagaatggactccaaatgttcagtattattctagtaaagagtatccacgccgagatcatgctcaacattacaatgttcgtggaaccttggctttgcctgtgtttgaaccttcaatccagtcatgtgttggtgtactggagttgataatgacttcaccgaagattaattatgctcctgaggttgataaaatctgcaaagcccttgagatttgtaatgaaggtcgtcagaatgcattatcagagatcttggagatattgacagtggtatgtgaaactcttaatttacctctggcccagacatggattccctgcaagcatcgaagtgttttggcccaaggtggtggtgtaaaaaaaagttgctctagttttgatggtagctgcatggggaaagtttgcatgtctacaactgacatagcattctatattatagatgctcatttatggggttttcgggaggcctgtgttgagcatcacttacaacaaggccaaggggttgctgggagggcttttttgtcccacagcatgtgcttctgttcaaacattacccaattctgcaaaactgattaccccttagttcattatgctctcatgtttgggttaacaagctgttttacaatatgcttacgaagctctcatacaggaaatgatgattatgtattagagttttttctgcctcctagaatcacagactttcatgaacaaaagactttgttgggatccatattggcaataatgaaacagcatttccagagtctcaagattgcttctggtgttgaacttgaggatggttcaattgaaattattgaagcaacaattgaaagagttcatacgaggcatgaatctattccaattacaccatctattaaatcaccacctagacttgatacctcaccaaacatgggggaggaagtgccacaggatccatcagaacaacaaatattgatgtactgtaacgacatgaatgatggaaggagtcttggtaaaaatgcagacggaattgatcatatgccctccatagagactaaaaacataaagaaacccttagagaggaaacgtggaaaaactgagaaatcaatcagtcttgaagtcttgcaacgttattttgctgggagtctaaaagatgctgcaaagagccttggtggtatgttcatactctaa

SEQ ID NO: 94481 - DNA, 1314 bp, Glycine max
  Peptide Sequence Number=SeqID_211259
atggaacaactttctcaaccatcacttcaaccccatcatgtctctgaccatcttcttcattccgatacagtcccttacattgaagtggttttgagagaaaatcaacaagatgacgagtatttcaaagaaagagttgagaggttggagagtgagagggaagagagaaatggggtaatgtttaaggcttcggagtctctcacctcaaccaaggaaagcttgtctagtgtcatagaggggttagagggagaaaaagatgcaacttttgtggaaaatggtaatggggagtggtcagatgtggaatcaaggatgttgttggaagatgcaaggttgatctcaaggcttgcaattgaggtggagacaagggtggataggtacaaggagatgaggaggaaggagaagagagaattggagagtagtttaatcagtttaactgaggagaatagagatgttaataacttgcttaggattgctttgttggagaaagaagcattggagaagagaataaagggtcatgaccacaaaaggatgccccttttgcagtttggattgcagaaagttgggtttggattcatgatggggggtgggaataatgaacaatctacagagaattctttcgctaaatcagatagcagtgagtgtgaagaggaggttgttagtctggcctcaacagtggaaaggataatgaagaatctacgccttgaaaccactcaattgaggagatctttggaagaatctaggtcagacacggagcgcctccagtgtctcacagagaaacaggccaaagaaattgaagaaaacaaactctacattaaggagttagaagacagagagagaattttggctcaaaatgtagaggagtttttgatggaaatcaaagcagcggaagaagaaattgctagatggaaggaagcttgtgagttggaagttgaagctggaaagaaagagattgaagagcgtaacaaagtggtggctgctttgaaacaagaactacacaaaacaaaggctgctttgaacatatccaatggaaaattaaggctcaaagaggaacttgcagtcactgcaatagctgcacaggaagcagcagagaggtctttgcggctggctgatactagagcagttgaacttcgtcgacaggttgaagaactaaccagacaactagaagaagcagagaaacacgaacacaacagccataaagtgagacgtatatgttggccatggcaagttttcaaattgagctctggcaatatagcaagcaagagttggaaatgccaaaaggatgctaccagaaatgcaagccttaatttaatgaactga

SEQ ID NO: 94482 - DNA, 2691 bp, Glycine max
  Peptide Sequence Number=SeqID_211260
atggcgtcgatcactgcccccaactctctccaaattcgattagctttcagtccctccaattccaccaaattcccaatccttcttcactcgcgcttccctcacttcgatcgtcgtcggattcgccttttctgcgtcgcaaacaacgaaaatgggtcggacaacgttctcattcgggttgggtcggatggatcgcccaattcggaggttaagaagaacaaatcaaataatgggggagttgtgggagtgggagtggctggaattcttcttctttcagggcttgcttttgctgccttgtttgtcagcagacgaaacagtgccagacaaatgaagcctctgactacacatcaggaacaggaagtgcttttgtcttctgatgattgtaatgacaaaatagagcaagtaaattctggaacaatggaggagcaaggaaatggtaatgtggaaggtcggatagatgtatccagggattgttcatctactgagtatgataagattcccaattcccataggatcattgatgattccaatgcaggatctcagttggtatacgatattcataacaaggacaatgattctgatgccatgaagcacatatctgttcaagaagaattacagattgaatcagctgctgatgaggagtcagttctccctgagggtgcaatggtgcttaatggttcagaatctgaaaatcctgttgattcttttgatagcagcactgctgtagattcacaaaactctattactgaacttaaggagaacccatcctttgttgaaccaaaaaaagtgtccaactttgatgctgaacccctacctgttataagtgaggagcaggatgaaattactgattcaagtggcaatagaagttctggtattgtagccgataatgaaactgtacttgtcaatattgctgttagtactcagtcaaataaaacaacttcatttcctgcggttattcctgaagattgggaagagagtgctcaatcagtttcaaccaaagaaaatcttgacctgaacaacatgccacaggtcttacaccagtcatccttggcagagcagagcttttcagaaaatgacctgtttacaaaatcatttgtttcatcaatcgatgcatttttagacgagcaggttaaaaatgataataatgaggttgatatatgtagatctgaaacttcaaactttggtgctttttactctgctcctggtattcctgccccatcagcagtttcttcagttgtacaggtgcttcctggaaaggttttggttcctgctgctgtcgatcaagttcagggacaagcattagctgctttgcaaactctaaaggtcattgaacctgatgttcagcccagtgatttatgcacacgccgtgagtatgctcgatggttagtgtctgctagtagtgctctatcaaggaaaactatctcaaaggtatatcctgccatgttcgtagacagtgttactgagcttgcatttgatgatatcacccctgaggaccctgatttttctttcattcaaggcctggcagaagctggacttatcgaaagcaggctttcaagatgttatgatagaccgttgtccacaaatgaagactatggcccattttacttctcccctgaaagccctttatcacgtcaggatcttgttacttggaagattgacctagagaaaagacagcttccagaagcagatagaaagccacataaaccagttacaaaggcccaagcagccatagcccttgctgctggagatgcttttgacatagttaatgaagagcttgcatgctttgagtcagaatctatggatgaaaatgctgttgcttctcatagtgccttagtagctcaagttgagaaggatatcaatgcaagtttggaacagaagctttccatagagagagaaaagatcaatgctgttgaaagaatggctgaagaggcaagatgcgagttagaaaggttgagggctgagagagaagaggagagaatttccttgatagaggaacgagctgctattgaatcagaaaggaatgttttttctaggttaaagcatgaggtggaagatcaactacaaaaccttattagtgacaaggtagaaatagcttatgaaaaagacaggattagtaagcttcgggagctagcagaagttcaaaacaaggaaattacacaattacagtatgagctagaggttgaacgaaaagccttgtcaatggccagggcatgggcagaggatgaggccaaacgagtaagcgaacatacattggccttggagagggctagagatagttgggagaggaatgaaagcaaagcggcagttgatgacttccatgaggaccttgctggagttacattgctcaatactgaggagcagttatcggttcaagacacggttgacagggctgaaaacctactggacaagctaaaaaaaatggcagtagaggtgggaggaagagccagagatatgattgacaagattatccacataatttcccaatttgtatcaagattgagagaatgggcatgcaaaactggaaaacaagctgaagaattgaaacaatctgccatctcaaaggcaggcaagtcagctcatgaggtgcagcaaagtgctcttgaatttggatttactatcaaagaagaggcaaagcgagttgcaggtgattgtagagaaggagttgagaagctcactcaaaagttcaagccctga

SEQ ID NO: 94483 - DNA, 234 bp, Glycine max
  Peptide Sequence Number=SeqID_211261
atggtggttctgagcctacttgattacgtgcagcttacagtggtaggcacttccaccaaaggagtcgtaaaggggttagagggagaaaaagatgaaacttttgcagaaaatgataagggagagtggttaggtgtggaatcaaggatgttattggaagaagcaaggttaaggcttgcaattgaggtggtgacaacggtggataggtacaaggagatgaggggaaggagacgatag

SEQ ID NO: 94484 - DNA, 1530 bp, Glycine max
  Peptide Sequence Number=SeqID_211262
atgtcaattctgtgtggtgtgcctcttcttgaatgtgtgtactgtctggcttgtgctcgttgggcttggaaaagatgtatttacactgcaggccatgacagtgaaacttggggacttgccactgtagaagaatttgagcctgttccccgcctttgtcggtatattttagccgtgtatgaagatgatattcgacaccctctttgggaacctcctggtggctatggaattatccctgattggttaatactcaagaaggcatatgaagatacacaaggaagggccccgccctatatgctgtatcttgatcatgatcatgctgatatagttcttgccattaggggactaaatttggcaaaggagagtgactatgcagtgttgttggataatagattggggaagaggaagtttgatggggggtatgttcacaacgggctgttgaaggctgctggatgggttatggatgctgaatgtgaaattctaaaggagttggtagagaagtatccaaactattctctgacttttactggacattcccttggatcaggagtagcagcaatgttgagcatggtagtggtgcaaaatcacgataaacttggacatattgagaggaagagggtcaggtgctatgctattgcacctgctaggtgtatgtcactgaatttggcggtcagatatgcagatgtcatcaactctgttgtgcttcaggcaactgttaagcataagttgcatctaactactaatatcctcatactccgttacttccttgtcttgattcatgccaattgccaaatcttgtactttgaaataactgctcttttccttgatcaggatgacttcttaccaaggacagccactccattggaggatatattcaaatctcttttctgtttgccatgcttattgtgcttgaggtgcatgaaggatacatgcataccagaggagaagatgctgaaagatccaaggagactctatgctcccggtcgcctttatcacattgttgagagaaagcctttcagaatgggaaggtttcccccagttgtgaggacagcagtgccagtagatggaaggtttgaacacatagtgctttcttgcaatgccacatctgatcatgccattatttggatagagaaagaagcccaaagggctttagatggccctggctacaattgttttctctttatctcgccagcaccaatggtcttaaggtttgaaatgttgatgagggagaaagatagtatcatggaaatacctgcaaatcaaatcatggagatgcaagaaacattagctagacacagtgaagaatacaaagcagcattacaaagggctaaaacatttgatgttccacatgcttatacaccagaatcacaatatggaacttttgatgaggagggagaggagagttcaagaaggtcacaaggtgaatcttcttttggttcaactaataggagtacagtggatgaaacttgggatgaaatgatcgagcgtctttttgataaggatgagcatggtcacattttgctcatgaaataa

SEQ ID NO: 94485 - DNA, 615 bp, Glycine max
  Peptide Sequence Number=SeqID_211263
atgaccacagaaactaaaagagcacgtgggcgcccaagagtcttcgatcccgatgatgcacttgataaagcgctgcagattttctggaatagaggctatgaaggcacctcactggctgagctgacggaaactttaggggtgaacaagcctagcttgtatgccgcctttggtaacaaagaagagctgttcatgaaggcgctatcgaaatatgcaacaggcccggtggcctttgtcaaagatgtgatcaatgaacccacggcgcgtgcagtggcacaacgttttttatacgaagcagctgattttttaacccagtcttcacaccctaaaggctgcatgattgtgcaaggcgctttgtcagggggcgaaagtgccgagatgattaaacaagtgctgattcaatatagagcaggttatgaaaactttttaaccaaacgctttgagcaggctaaacaggatggcgatttacccaccgatgccaatccacaagcattggccaagtatcttgccactttgcatcagggtatgtcggtgcaagcaaccagtggcgcttcaaaagaggatttattggcgattgctgatctggcactaagtgcctggcccaaggcttctacctga

SEQ ID NO: 94486 - DNA, 222 bp, Glycine max
  Peptide Sequence Number=SeqID_211264
atgttgctaagtagcaacgtcatccatatctttgtaagagtggtcatgttggtgcgcatgatccgcgctcatctctttgcagcagcacaggtgaaatcttgccccggtatgcatagtggttgcacaatagcctcctcctctggttgtgctcgcacagttggccctcctccaggatcaaggggtggcctaggaactcataaaaggaaactactagccccttaa

SEQ ID NO: 94487 - DNA, 694 bp, Glycine max
  Peptide Sequence Number=SeqID_211265
agggctgcacaccctcgccatcagaggactacacgtcctcgccttcagagggctgcacgccctcgcctttagaggactacatatcctcgtcttcagaggactatacgtcctcgcggggagaggactacacgtccacaccctcagaggactacacgtcctcgccttcaaagggctgcacgccctcgcctttagagggatgcacgccctcgcctttaaaggactacatgtcctcaccttcagagggctacacgtcctcgccatcagaggattgcacgtcctcacctttagaagactacacgacgccttcgtagggctacacgccttcaccttcagaggactacacatcctcgccttcagagggctacacgccctcgccttcagaggactacacgccctcaccttcagagggctacacgccctcgccttaagaggactacacatccttaccttcagagggctgcatgtcctcaccttcagaggactacacgtcctcccctttagagggctacacaccctcacctttgtagggttacacgccctcaccttcagaggactacacgtcttcgcctttagagggctacacgccctcgccttcagaggactacacgtcctcgcctttagagggctgcacgcgctcgccatcataggaccctatatctacgtcttcagagaactcatggtcctccacccttaa

SEQ ID NO: 94488 - DNA, 2289 bp, Glycine max
  Peptide Sequence Number=SeqID_211266
atggatgaactagctaataaaattcaagatgaattttatggtatagatgcagcttttggagaaccctactcactgcgggggttctcaactaaagaaaatgatgtgcaagaaatatccctgcaagctttaacagatatagaccatcgcttagcctatttttcggagaagctggtgaacttgcatgtgctttatatttatctattggccgaggaaagtgatcttgaagcaatggattcaacgaataactgcatcttggccaacttatttgagaaggcaatgacatttgatctattgtctggcattttagattctgaggtaagagagctggacagtttcatggacactctccaagaagaaattgttgatgctcgtcataaaatattttcatgcaaacatttgactgaggttttctttatgatggacaaaaaattgcatgactctgaagagtctgtgaagcagtttcaacagcagttattggagttgaaaatgcagtcatcccagttacagaaaaccattgaggcttttcgacatgagaattgcgaagcggggaaggccttgaatttatcaggaaatggtcaactgacaaatgtgaaagcaaaatccaatgaacagatggttgaacaacgaagatatattctgcgaatgcttgagaaatctctagcaagggaactcgagcttgaaaggaagttagcagagtcaagaaacaatgaagacctaaagttgaaactccattacacagaacaagtggcattttatatggaagaagctgcagaagtagtttggggaagatttctagaggcagacaataccacagaggtgttaatggggatttctaaaggtataatgggacgccttcaagtaactgagttcaacctcaatggttctatgcaacgagaaaatgagctgagatcaaaagttcaaattttgatagatcaactcaaggctaaagatgctgctttagagaagcttgagaaatgtaatgttgagagtgttaaggaaaaatctgaggtgttggctttaagggaaaaggtgaaatttcttgaggaagagcaaaaagaatttgagcttcagataaataatgtgactgcagagaatgaagcatgtcacgaacacctaattgaaatggaaaattttgttgactctttgaaagaaagcattgacatagcagaaaatcgggctgagagtgcagaagcaaaggttacacagttaactgagaccaacttggaacttactgaagaggtgagttttcttaaagggagtgccagtactgcagagaaaaaggttggttcacttgagaagcaactaagggaattagatatccaactacaaaatgcaaaggcatcttctgaagcaagtcaagaacagcagaacatgttatacacagctatatgggatatggaaatattgattgaagagctaaaatcaaaggttgcaaaagctgaaactaataaagaaagtgctgcagagcaatgctttgtgctgtctgaaactaacttggaacttaataaagaattggatctccttaggtccagaacagtaagcttgaaaacatctttggatcaagctagcaatacaagatcatcaagggcaaaagaaattgattgtaaagctaagcttatcatggatatggtaatgcaactagcctctgaaagagagcgcatcaataaccaggaaaataaacatttggtagaaaagttaaagaatactaaaattgatgcctctttagatgcatccaacaatggactaaataacagaaatgaagatcaagcttccaacaatgactcgagcaatgataactctgctaaatcatcagatgaagaaggaatagatcactttaataagacatttcaggcaggtgatagctgggtgttaaatttaattgttcttttaatgacgctgcatgtagaattgatgaatgcatataagctgtctctaggtttctatggttttcagttatgtttgtttaagaacttggatgaatatgtggatgaagaaggtgcaagctccgtaactcgagtaacatcatctatttcagcagataagcctgcaaattggagaaacttgacatttctttcagtagcaatgtttgtcccactgatttctgtgctagccttctggtggacaacctttgtttcaacccagcttcctaattctttatggcacaagagctatcttgagcactttatcttgggatacgcgttaatagcacaagaaatacgtacaatgcagcaaagttccctcagcaaagcatggtttccgtttcgtgatggttatagtctatgcccttag

SEQ ID NO: 94489 - DNA, 543 bp, Glycine max
  Peptide Sequence Number=SeqID_211267
atgatcattagtctgaatgatccgtcttgtctgctgcacttgcctacgaccgccaagcccattgatcatgtcccttccacctttgacaaagatgcggtgaagatgctactaatgcatcaccgtgccattctaacaattttaaaggccacaatggcgaaaagggcagggttgtgtgtttgggttgacacaacttatttgttgcacttgattgacaatacgatatttgccaacaagtcttcgactcacatccatgtcacctacctcatgtacatcgacaacctggatgcttgccacgagtatgcatggggagtagttgcactgacatacctctacgatcatctctcctatggaagccaatacaccagcaaacaatgtggaggttacatgacgttactcatggttttccacccttataccattccgtcgaaggatggaccaccaccacgtggttctatggcatcagaagctatgcagagcttgttggacctcagagttgtgccaaagggcacgagtcatcatcaactcatacatcaagctttgtaa

SEQ ID NO: 94490 - DNA, 489 bp, Glycine max
  Peptide Sequence Number=SeqID_211268
atgccagttgcaaaactcccagcctctggcactatcgatttcaggaaaacagacgatggaagtgattctttagacacaataatcagacaagcaattggaaaagaacctttgctttcctttcctagggccggtgacagcccagtacagtggattcaattacttaatgctttagatcagcaagcttttaagcttgtttctggttctgctgattctaaatccaacattctgatgaaatctttcatttgtttgacagaacttccagggtggcctttgctatctcctgtgaaggttcagttacagaagtgcaacaagtgttctcgagaattttgctctcccattaactatagaagacatatacgcgtacagcatcgattgaaaaagcttgataaggattctgaaaaaaatagggatcttttaggggcatattgggataagctctccatagaagagtcaaaggaagttgtgtcattcaagaatgtgatgctggag

SEQ ID NO: 94491 - DNA, 862 bp, Glycine max
  Peptide Sequence Number=SeqID_211269
atgtcaggtggtgttggtccaacgggcagtgacattagcctaccacaagaacaagaagttggccacaaagaaccgcaagaacaacattcactcaagaatctccacaaaaccatcaccaccacaccacacaaaccaactttcctctctttccgccatctcaactgcttagctgtggttgttgtcttatccgccagtggcatggttgcccctgaagacttcgcctttgtgctcttctccataatctacatgtacttcttatcaaagatggctttcccatctcttctcccatcaaaggaggaacctttagttttcaacccaaaaaacaaggtccttgccctctatgtgtttgtaggggccatcattggactttatgccccaatagcttatattttagagggaatatttgagggtgacaaagaagggatcaaagcagctgcaccccatgtttttctcttgtccagccaagtcttcatggaaggtgtggcattctctggcaggttctcaactccaatgagagcttttgtgcctgtcttttacaactcaaggaggattttcaccattgtggattggcttaggagtgagatcaacaaggttaatgaagtgcacagtgggtctgataggaggatctttgttgggagggtacttgctgtggctaacatggccttctgggaaggcagttcgctccaagctggactgtatgcacgaaccccccgttcagtccgaccgctgcgccttatccgtcatgcgccggttaaggctaaactgaaaggacaagttttggtgactgcgctcctccaagccaggtacctcggttcaaagagtggtagctcagagaaccttcgaaaaaccgccctgcaaggcg

SEQ ID NO: 94492 - DNA, 1929 bp, Glycine max
  Peptide Sequence Number=SeqID_211270
gaagttccagggtcttcaattttagaagctttgacaactcttagaaaacaaggattttcttctcttccacaatattatctgagggctggtactgcccttttgaatattgttcaatccaggccttctagttttcctatatcttcccaagagttgttcagtatcctagatgattctagtgaaaaaacatttttggttggatcagcagtgtcgatgcaaagatatgtttttgatggagaggctggaaagattggtcttgaaccaaaaaacctagttgcttgcacaagtttcttgctagagcagaaactggtgaaggcctggcttgctgacaaggatgctgaagcattgagatgccagaagctgctggtggaggaggaggaagctgctcagaaaagaaaagctgagattttagagaggaaacgccaaaaaaagcttagacagaaagaacacaaggccagggaacgactcgaagatgacacagaaattaaagagaacataagcagcacaggagaggatgttttgccagctgaagcttcttctggtacatgtgactttgaagcacagaatccagatatatttgcggatcattctcctccaccacatgtaacttctcgctgcctagacactaatgaagttgtagaaggggatacagtgtcaggttatgattttgacactgatcagtatatagagcgacaggcatcacggggacataatcgccgtcgcataatggctgccagatggcaagggctgccaaaatcacaatgggccaaagccaatggttcgcatgcaggccagaattctcaaatgtcaaagcttggagttattcaaaaacatggaaccaaccgtgatcaaagggcagctcctatagttaatggtagtaaggtttggagccgaaaacctaaaccagaaactaatggggtggttttaaaagccaaactgcagaaagaaccagacaaaggtaagagtcatgaagttttgataggatctgtatcagttagtctggattattgcagcagccattcacaagggaatttggtggcagcccagcgggactgcgtggtagagaatctagccaagcagaatactgctcaggaaaagccagtgaaacatgattcctttcagggaagtaatggtcggttaacagttaagctttggaggccggttagccagcttggaactaaagatccattgccacttcaaaatggtgagacagaagctgatgtaattaatggaaaatatgaccaaaatttgtcaggtcaaagtagtttacggttgtgtagtatagatggtagtgatattggttttgaggacaatttttcccacactggggctaaagtagattcagaaagcttacgtctaaccagccatgctgcaaaagcctttcttgcacaaagatggaaagaagctatctcatctaaccatgtgaagttggttgttacacctgattgtcaatcttctaatgcggacagatttaacattcttgcaaatacagagaaccgattgcctgcaacttctggagttgctaaatccaaacccaaaacaaagcctgagaagggaatgaagataaagtacattcccaaacaaaaagaagcaacctacaacaacgacgatagatatattagtagtgattgtggtgacagtaatcttgaaggtgacattagtggtggtaatgatgcagatggtggtgatcatgataatgtggtgacgtcaatgatggtgacaactataatgatagtgatggtaaaaggtggtggtggtggtgatgataatgatggtaacagtgacattaatgctggtgacaatagtggtgatgataatgatgatgatgatggtaacaatgatggtaacgtgacaatgatgatgatgagtgatggtggtgggaatgatggaagtgatattggtagcagtggtggtagtaatgcatatttttaa

SEQ ID NO: 94493 - DNA, 180 bp, Glycine max
  Peptide Sequence Number=SeqID_211271
atgataaagatagaagataaaaatgataataatgtgtttgaatgcttaaagctaagtggacctcctgagcttaacgagtatgacagtgatcatgcgcttagcacgagattcgcgttaagcgcgtctttgaactttctcgtggatcttcttcacgctaagcgtgagctaaccgctaagtga

SEQ ID NO: 94494 - DNA, 714 bp, Glycine max
  Peptide Sequence Number=SeqID_211272
atgtggccattcagcagaaaaggggcttctggtttttcatcatcatccacggcagagcaagtcactgaaggaattgatggaactggtctcactgccattgtcacaggagcatccagtggtattggcactgagactacacgtgtcctttcattgcgtggtgtccatgtgattatgggtgtgagaaatatgcttgctgctaaagatgtcaaagaaacattacttaaggagattccctccgctaaagttgatgccatggagttagatctcagttcattggagtctgtcaagaaatttgcatcagagtttaagtcctctggtcttccattgaatatgttgataaacaatgcaggaattatggcatgtcctttcaagctctctaaagacaaaattgaactacagtttgccacaaatcacttaggtcattttctcttgaccaatcttttgttggacactatgaagaaaacttcacgtgaaactaagaaagaaggaagaattgttaatgtctcctctgaggctcaccgatttacatattctgaaggaatccgttttgacaaaattaacgatgaatcaagttacagcaactggcgtgcatatgggcagtcaaagcttgccaacattttacatgcaaatgaacttacaagacgtctcaaggtgtcttggcttctactctgcagtggtgtcatttacaaattatctggtggaatagttaattaa

SEQ ID NO: 94495 - DNA, 534 bp, Glycine max
  Peptide Sequence Number=SeqID_211273
atggaacgtaagaggaagaatcgatctagcagtgccacagctggtagcatcccggaagccgcaacaagtgaggcaattgaaccttcaagcaatgctatcaggggctctgaaaatagggtacccgtgccattggatacttccagcagtcaagaagtgattttagctgctggaaagataatgatggaagaggagaaagcaacaaatggggctgtcactcgccatatgcttggcccacaatttgtaaataagctaatatgcgacttaaatcaatctaatgaagatagctacaagccttggtgtattgaggatgtatctctattcatcttgccgagtaaactgggttatgatattaatcagtgcaaattgatttttgcaccaactttgtttgaggagcattggtcttgttatgcattcgagccaaaaagaaatcttgaagattcgacaaagcctatatgtggatgggttcgacatcctaaaaacgagattagagaagagattttgaaggcagcaggagtatgggggaaattatgctga

SEQ ID NO: 94496 - DNA, 3012 bp, Glycine max
  Peptide Sequence Number=SeqID_211274
atgcttacatggtgggggaaatcatcatcaaaaaaaaccaagaagaaagcaaataaggaaagtttttttgacacactgcaccgaaaactcagaatttcatctgaaggtaaagtaaacattagatctggaggatctcgtaggcattgcaatgacacaatttcagagaagggggatcattctccatctggatcaagatcgccttcaccttccaaagtggcaaggtgtcaaagttttattgataggcctcatgctcagccacttccacttcctggtctgcacccttcaagtgtaggccgagtagattccgaaattagcatatcatcaaaatcaagattggaaaaagtctccaagccatcattgtttcttccacttccaacacctggatgcatacgttgtaggccgaaccctgcagatttggatggagatatggtcactccttcagtctttagtgattgctctgctgacagtgatgagccggcagactcacacaatcgtagtcctctagcaactgactgtgagactgggactagaactgctgctggcagtccttccagctcgatgctcaaggatcaaccacctactgtttccctactgaattcaacaggagtaaagaaaccaggaaatattctaagtaatcatatgtcttctacttcaccaaaacataggcctttacgcaaccatgttccaaatcttcaggttcctcctcatggtgccttctatagtactcctgatagttccttgtcaagtccatcaagaagtccattgagagcatttggcacagatcaggtgttgaattctgcttttttggctggaaagccatatccagaggtcaattttgttgggtctgggcattgctctagtccaggttcaggtcacaattctgggtataattcaatgggaggggacatgtcaggaccgttactttggcaaccaagcaggggtagccctgagtattctccagtacctagtcccagaatgactagccctggtccaagctctagaattcagagtggagcagtcacacctattcatcccaaagccgggggaacacccacagaatcacagactcatcgtttgcctcttcctcctttgtcagtttctaattcctcaccgttctctcattcaaattctgcagcaacatctccatctatgccaagaagtccagctagagcagataatccaagctctggctcacgttggaagaaagggaagctgcttggcagcggctcatttggacatgtctatcttggtttcaatagtgaaagtggcgaaatgtgtgcagtgaaggaggttaccctgttttcagatgatcccaagtctatggaaagtgctaagcaatttatgcaggaaattcatttattaagccgtttacagcatccaaatatcgtccagtattatggttctgaaacagattctagttacagaatatttgtttctggtggtttatctgataacatagaagtgggaatttctcgacagtatttgtttttgtggttccttatagaggcttctgaatcgccccttgaacaggttgatgacaagctttacatataccttgaatatgtatctggaggctccatacataaacttcttcaagaatatgggcaatttggtgaactagttattcgtagttatactcaacagattttgtcagggcttgcttatttgcatgctaaaaatactctccatagggatatcaaaggagcaaatatactggtagatccaactggtcgggtcaagttggcagactttggcatggcaaaacatataacagggcaatcgtgtctattgtcattcaagggaaccccttactggatggctcctgaggttataaagaactctaatggatgcaaccttgcagtggatatatggagtcttggatgcacggttttggaaatggctactaccaaacctccttggtttcagtatgaagcggttgctgccatgttcaagattggtaatagcaaggaactcccaacaatccctgatcatctctcaaatgaaggaaaagattttgttaggaaatgtcttcagcgtaacccgtatgatcgcccttcagcctgtgaattgttggaccacccttttgtaaaaaatgctgcacctttggaaagacctattctggctcctgaagtgttggaccctgtttctgggatcatacagggagcaaaagctctggctattcatgcttttggcaatacacgtacaattttttattcggagtcgagcatattggggtatttgcaggatctatatcctcactcccctttccatgctaaaattgtgatagagtccaagggaatgaaggatatccacatcagcaattggttcactcaacacagaatggagtcagaccttttctggtttatactaggaggaagggtagaaaggtctttggcggctaaggccgctggacaaggaaagaatctttctagcttggattcagatagactttctattcattcttctagatttttgaaaactaatcctcgtgaaagtgaaatccatattccaaggaatatatcttgccctgtttctcccattggaagcccacttttgaggtcaagatcaccacagcacaggaatgggaaaatgtctcctcctatatctagccctcggactgcttctggggcgtccacccctcttgctggtggcagtggtgccattccatttggtaatcactctaaacagccaatttactttcaagagggttttggaagcattcccaagtcctcaaatggtgtctacattaatggccattctcatcacgactcgagtgttgacatttttcgaggaatgcaaataggatctcacattcaaccagaattggtttccagtgaaaatgatgttttggttaatcagtttgcaaggcatcctcatgcagagccatatgattttcagtcagtcttggcagatcgtgttggccggcagctgctgagggaacatgttaagattaacccatccattgatctcagtcccaactcgtctttgcttagccggccaaacggtttatga

SEQ ID NO: 94497 - DNA, 1570 bp, Glycine max
  Peptide Sequence Number=SeqID_211275
atggcactggcttctgttccaaaagtggtgtttggtttaattgcatttgcaatcttttgggtgctagcagttttcccagctattccatttctacctattgggagaactgcagggtcccttcttggtgccatgcttatggtcatattccaagttattactccagatgaagcttatgacacaattgatcttccaattcttggtcttctttttgggacaatggttgtgagtacttatcttgaaagagcagacatgtttaagtatatagggaagttgctggcttggaaaagtagaggtgcaaaggacttgctttgtaggatttgtgttatctctgctatctcaagtgctcttttcacaaatgacacatcttgtgttgttttaactgaattcatattgaagattgcaaggcagcataacctccctccaacacccttcctacttgcccttgcttcaagtgctaatattggatcctcagcaactccaattggcaaccctcaaaacctggttatagctgttcagagtaagatatcatttgggaattttctgattggtattcttcctgctatggtggcaggagttgtagcaaatgctataattctcctaataatgttttggaagttgttatctgttcataaggatgaagaagatgcaggtgcagaagatgtggtagaggagtatgattcccatcggttttctccggccacaatgtctcattattcatccttgaattctcaagaatggagttcccatcttgatgctattactgttcagaactctcctcaggttcagattctaagaaaccggtcaattgcaaatgcaagtgaaagtaatgggatttctagcaacacttttgatactgcaagaatctcaagtgtatcaagggatggaacaaatggtgtggcatctatggcaaaggaggaaactagcccttcaaattcgtcagcaggagtagatacacttattcccccttcagaaagaaaaaccaattttatcataaaatggaaaagggtactgtggaaatcttgtgtttacatcatcacagttggaatgctggttgctttacttctaggtttaaatatgtcatggactgcaattactgctgcacttgctctcatagttcttgatttcaaagatgctacaccatgtttagagaaggtttcgtattcacttttgatattcttttgtggaatgtttattacagtggatggcctcaataaaactggaattccaagtgctctgtgggacataatggagccctattctcatgttgatcgtgctagtggaattgcaatacttgcaattgtcatacttgtcctatcaaatttggcttcaaatgtaccaacaggaagggtagcagcctcagctgctgcaatttccaaagcagatgagaagaaggcatggctgatattggcttgggccagcaccatatcagggaatctctcattgttgggatcagctgctaacttgatagtgtgtgaacaggcgatccgtgcgccaaacctaccatacacattaaccttctggagtcacctgaaatttggccttccttccacaatcatagtcactgctattg

SEQ ID NO: 94498 - DNA, 1515 bp, Glycine max
  Peptide Sequence Number=SeqID_211276
atgggaaccgttaacaacaccgtcgacaccgtgaatgctgcggcctccgccatcgtctacgctgaatccagaatccaacccaccaccaccgtcccgaaaaaacgctggggaagctgctggagcttatgttggtgttttggacctcataaaaacagcaagagagtgggcaatgctgtccttgttcctgaacctgttgaacctataggcccagttggatttcatcctgctactgctgcaccaaatccttcaactgctattgtaatgccattcattgtccctccctcttcacctgcatcttttctccaatctgatcctccatctgctactcaatcaccggttggattattctccctcagttctctcactgttaatgcttctggtggacctgcatccatttttgccataggcccttacacctatgagactcagttagtctcgccacctgtattttctaccttcacaactgaaccatctactgctccgttcactccaccacctgaatctgtgcagctgacaacaccatcatcccctgaggtgccatttgctcaattgctggcatcttctttagatcggaattgtaaaagtaatggtacaaatcagaggtttgcattatccaattatgagtttcagccttatcaacaatatccagggagtcctggcacccaactcgtatcacccagatcaatcatttctacttctggcagttctactcctttccctgatagacacccagttcttgaattccacaaaggggaagcaccaaagctcttgggctttgaaaacttcttgacacataaatggaattcaaggcttggatctgggtctttgacgccagatagtgcagggcaaggttcaagactaggttcaggatctttcacacctgatgctgttaagctagcttcacaattaggctctgggtgtttgacacctgatggtttgtgtcaggactcaaggttcggttctggatctttgacacctgatgctgtagcaccaactgctagaaatgacattgatataggaaaacagatttctgaggtaacatccattgtgaattcagagaatgagtgtcaacccaaggcagcattagttgatcacagagtttcatttgaattaactggggtagatgttccacgatgtctagcaaataaatcagggtcttcattgcttggaaacatgtcagggtcttctcagggtacactggttgaagaccccgttgacatagaaaagatacaaaaaaactccaatagtagttgtgctttctgttcaaggaaaacttcaaatgcttcaaatgataagtcttgcaattctcctggagaaggagcggaacagtgctgtcgaaagcatcactcttttaattcttccaaagaatttaactttgacaacagaaaaggtgttgtttctgatactcctgccaatagctccaattggtggactaataaaaagatagttggaaaggaaggtagatcaagcaacagttggacattcttcccaatgctacagtcagaaatcatttaa

SEQ ID NO: 94499 - DNA, 126 bp, Glycine max
  Peptide Sequence Number=SeqID_211277
atggtcgagtggggtcctgaactgcacacgtcggcttggagaagtgtctttgacaagaagggggacctgcaaaacaaatgtaaagccggagttgttgtaaccttacagataattcccggcttgtag

SEQ ID NO: 94500 - DNA, 3204 bp, Glycine max
  Peptide Sequence Number=SeqID_211278
atggattcgagcgacagtggtcgcggttactccaagcgcgagagggacgacgaggattgggagtttagtgataagcggaaggataggtctaggaagttcggtgccaatggcggggacgacggcgagggttccgacggaggcgcgagaaggaagcgttctagcagaaccaccacggatggcgacgattacgattcgcgctccaagcaaggggccaagaagaggcaggaggagagcaccctggagaagttgagcagttggtatgaggatggggaattggacgataaggccgcgaggaagcgcgggggtggtgacggtgagtttcatgagagtgtggtgagtaaagaggatggtaagggtgagggtggtggtggtggtagggagaagggtgggcatgatggtaagagttcgaggagaaagtgggatgaggttgatgttggtagtgtgaggaaggtgcaagatgagaagggggatttgaggagtgggaagcgagatagttctagagatagggagaggagtgaatcttctaggagtgagcatggggagagtaaagcctctggtggtggtggtgatagggttgcgaagtctagtagtaaggaggatagaagaggggattctgagagagggaagaataaggggaagtcggatttgggggatgttggttgggaggagagggttgagaagcccaggcaccatagggctgctgctggttatgatgtggctgaaacctgggataggtcattgaatgcagtggaggaggatggacatgtgcgggttagggataagagtattagggaaagtgggaactcgaacagatcaaggacaccggataagagtggaaaacgccatcaagatttggagacctcggaggcagattatgaaagaagtggtagctttaaaaggaaggagcacgaaggtgatggctataaggatgatagatccaaagggaaagatgatacttggaatgacaggaggaaggatagggaaagttctaaagaaagttggaagaggaggcagccgagtaacactgacaaagattcaaaaaatgaggagggtgcttttgacgacaacagggattgggagttgcctagacatggttatgagaggatggataatgaaaggcctcatggacggtttggtggtagaaaagatgcgagcaggggggaagctgttaaaacatccacaaagtttgggatttcgaatgacaattatgatgtgatagagatccagaccaagttttatgactatgggaaatcagagtctgtgtccaaccataccaagagaactgaaactcatcagcagtacaatgctaaatcaggtgctaatgatgaagaatgggcatatcatcaagatgaaagaggaaggaagagtgatttatctggttctgggacacctggagaagatctgaaggagagatatgctgatgatgactatgatttttatgggggaagaggaagaggccagaaaggtggtgtatctgcccgtgttactggtggccaaagttctagtactggtggctcacagccccaatatggaaattcggagtctggatcctttaacagagctggtccacaaggaataaaagggaacagggttggtagaggaggaaggattaggcctactgggagagacaatcagcaagttggaataccgttgccaatgatgggatcaccctatggacctcttgggatgcctccgcctgggccaatgcagcctctttcacatggtatgtcacctgctcccggtccaccaatttcccctggagtcttcatgtcaccatttactcctggtgtttggcctggagctcgaggtgtagacatgaatattataggtgtaccacctgcagtgtctcctgtacccccaggtccttcaggtccgcgatttaatgctgctaatatagggaacccaccaaatcctgtaatgtattataaccaatcaggccctggaaggggaatacccccaagcatttctactcctggttttaatcctacaggatcaatgggtcgaggagccccacctgataaaactccagggggatgggctcctcctaaaagtagtggaactcttggtaaagctccttccagaggtgaacagaatgattattctcaaaactttgttgacactggtatgcggccacagaatttcattagggagcttgagctcacaaatgttgtggaggactatcctaagcttagagagcttatactgaaaaaggatgagattgtggaaaaatctgcatcggctcctatgtattataagagtgatttgaaagagtttgaattatctccagagttctttggaacaaagtttgatgtcattcttgtagatcccccatgggaggagtatgtgcaccgtgcccctggtgttgctgatcacatggagtactggacatttgaagaaataatgaatctcaagattgaggccatagcagatacgccatctttcatcttcctttgggtgggtgatggtgtaggccttgaacaaggtcgccaatgtctaaaaaaggaacactgcttgatgggcataaaaggaacagttcgtcgaagtactgatggccatataattcatgccaatattgacacagatgtcattatcgctgaagaacctccttatggttccacacaaaagcctgaagatatgtacaggattattgagcactttgcccttggaaggaggagactagaactatttggtgaagaccacaatatccgagccggttggctgactgttggtaaagaattatcatcttcaaattttaataaagaggcatatgtgaaaagttttgccgacaaagatgggaaagtttggcaaggaggtgggggaagaaatccaccgccagaggcacctcatctggtggtgactactcctgatatagaggctcttaggccaaagtcaccaatgaagaaccaacaacaattgcagcagcagaattctgtatccatttcattgacgtcagctagtgcatcaaacagaaggcctgctgggaattcgccgcagaacccaactgcactcggcgtcaatcaagaagcttctagctcaaacccttctactccagctccttggggttcacctctggagggcttcaagggacgtgaaggctctgtattgccttcagatgataaagtaatggatatgtacggatttcatggaccagcatctgcaaactatctagattttgaatcatacagacaaatgaatctgttgtag

SEQ ID NO: 94501 - DNA, 1350 bp, Glycine max
  Peptide Sequence Number=SeqID_211279
atgaatcatcatcttcagtcgattacacactggttctggagcagcaagtcccaaaagatcaagcaagacaaagatggctacatttggctaccaacagcacctgatggctataaaaccttaggccatgttgtcaccaccacacctgagaaaccctcacttgacaaaatcaggtgtgttaggtcagatctcacagaccagtgtgagagaaactcatggatttggggaccagccaagagcagtgatgagaaaggtttcaatgttcatgaagtgaggccaagcaatagagggactcaagcacctggtgttcttgtaggaacattttttgctcataattgtgaagctccttcccctctccctattgcttgtttgaagaacaccagcatgaacttctcctcctcaatgcctaatttgccccaagttagggcactagtccaagcttattctccattcatgtacttgcatcctgatgaagatttccaacctgcttccaccaagtggtatttcacaaatggggcattgcttgttaagaaaggagaagagtccaaacctgtggcaatagaccctacaggctctaaccttcctcaaggtggcaacaatgatggtgagttttggttggaccttccttctgacaaagccaacaaggagagggtgaaaaagggtgatttcaagagttgccaagcctatgttcatgccaaaccaatgtttggtggaacattcactgaccttgtcatgtgggttttctacccattcaatgggcctggaacagccaaagtaggactcatagatatcccactagggaaaataggagagcatattggagactgggagcatgtgacactaagagtaagcaacttcaatggagaactaaaaagggtgtatctctcacaacacagcaagggccaatgggttgaggctcctcaacttgagttccaaagtgggaacaaagcagtgtgctattcctccttgaatggccatgccatttatccaaaagtaggacttgtcatgcaaggccttgatgggattggaataaagaatgaaactaagaggagtgagaaggtgattgacatgggggtgggttttgaggttgtttctggtgagtatttggggtcagcaattgtagaaccgccttggctaaactttttcaggcaatggggtcccaaaatcacctatgacattgcaaaggtgttggacaagttggagaaggttttccctgctttgcaaggccttgaagatagtttgccaaaagagttgttgggagaggagggacccacaggacctaagctcaaaagaaattggagtggtgatgagccagccttttcgggtgttcccacaacattaaaaagcatgtga

SEQ ID NO: 94502 - DNA, 828 bp, Glycine max
  Peptide Sequence Number=SeqID_211280
atgggtcgatttgtggttgggcaattcgagcatggggtgcttgcagcaaagttccgtaacagtggacaaacatgtgtttgtgcaaatagaattattgtgcaagaaggtatatatgagaagtttgcaaatgctttacgtgatgctgttcagaatatgaaagttggggatggttttagtgaaggtgtgtcacagtttctgttgaaccaactgcctgtggatattgcctatcttgcatctctgtttttccaaggtaatattcattcatatggacttcagaaaatgagtcatggtgtaactcatttcatatccatctctaaacagggtcctctaataaatgaagctgctgtaaaaaaggttgagtccttaattcatgatgctacatcgaagggagcaaaagtaattcttgggggtaaaagacatagccttggacttactttttatgaacccacagtcatcagtgatgtcaacagtgatatgcacatatcaagagaggaagcatttggacctgttgcaccccttttgagattcaaaactgaagaggaagctatcagaattgctaatgacactaacgcaggtttgggttcatatgtatttacaaacagtatccaacgatcatggcgtgttgctgaggctcttgaatatggactagtgggtgttaatgaaggagtaatttcaactgaggtggctccatttggtggttttaaacagtctggccttggaagagaaggctccaaatatgggatggatgaatatttagagatgttttgggtcaatgggtatgggctgatacctggcatacaaaataatgttattcttcactgggtctaa

SEQ ID NO: 94503 - DNA, 102 bp, Glycine max
  Peptide Sequence Number=SeqID_211281
atggctgggacattgtgcccctccagtggccaacacacgtccctttgtgcgagccacaaacatttccagtatttccttaccaatgtaaaccctgaaacataa

SEQ ID NO: 94504 - DNA, 330 bp, Glycine max
  Peptide Sequence Number=SeqID_211282
atgggtgaaaaacatgtacagtttcaccaaacacccaaaaagctcaaatgggtcgtggggaatcggctaaaagatcgaaactttgcactcaatttcaaacatttagacgcagtggggaaatgggagaagagggttgcatctgcatctgcaactgaacggagagaagattataagggcgatagagaagtttcgaggatcgaagtgccatgcggcaaaggtgatatggtttcattcgcccttggatatggtaggaatgaggcatcaagacgagatgaagggggtggtcggaagcaatgccgcacgatggttcgtgttgacatgcaagggaag

SEQ ID NO: 94505 - DNA, 874 bp, Glycine max
  Peptide Sequence Number=SeqID_211283
atggcaatgttgacagaggaggtaggtgaggtggccagaattatcgcgaggcgatatggtgagcaaagtgaaaaagaaagtgacaaaagcaaagatttgggtgaagaattggcggatgttctttttgtaaccttatgccttgccaatcaaacaggggacacagaaatgcttacgaaagccttatcagaaaattctgaagtggtggacattcatcatgccggaaccgccatgcgctttcttacttcatatttttctatcctcgagggcagggatactatccttaccggatccggaagaatgaaagaaaggcctatcaaaaacctggtcaatgctttgcgtgatctgggagcagatattgaatatatggagaacgaaggttttcctcctttaagaattaaggggaagctggaaaatggtttggagatcaatcttgtcggcgatatcacatcgaggtcttatattgaaatgacgcttgatattattaccagatttggcattaaagctacttttacaggcaatgtgattaaagtagaaccttttgcaaacccatcttctgttatccattatgaagtagaaagtgactggagctctgcttcatacttctactctatctgtgcattgggaagaaagactattcatctgaaaagcttctataaacaatccactcagggagattctgcaatagcaaacatctatgagaagttctttggaattacaacgactttttcggaagaagaacataaaattactttaaaggctgatcctgacttttcttttccggaaaaaattgaactggatatgaacgactgccccgacattgcgcaaactctttgtgtaacggcagctgcattaaaaattcctttcgccatttcag

SEQ ID NO: 94506 - DNA, 537 bp, Glycine max
  Peptide Sequence Number=SeqID_211284
atggaagaagacaatattgatggtgcctttgtggaaaaaccatattttgagaaagatgaaggcaacaagaagggaggatctttgaagaagtttccaccttgtcctcattgcaacagtaatcatcttgaatatttttgttggtatagaccaagcaccagatgtaggcctgccatcaatatggtcatgcagagaaagttcgtaaaaataaagcaaaccaacaagcacaacaagcccaagttgttgagcatgaaaagcatgaagaacaaaaagaagagcatttatttgatgttatttgcggtccaacaagctaaaggcccaagtggagaaggacaaagcccccgagtggagaaggatgaaggcccagaggcagagacactatcaagattattaaatgttgctgaaggcccagatatgatgagaatccagaaactggtcaaatacaggctaaaggcccaagtggagaaggccgaaggcccaagtggagaaagacaaagcctccgagtggagaaggatgaagacccaagtggagaaggatga

SEQ ID NO: 94507 - DNA, 1218 bp, Glycine max
  Peptide Sequence Number=SeqID_211285
atggacgctcccctgctgctggccaaaggcgagggggcggcgctggtgacggagaacggcgactacgtggcggtgagggagctgaaggaggtgaagaaggtgttctggattgagacgaagagagtgtggcagattgcgatgcccattgttttcaacatatggtgtcagttcggtgtgaattccgtgaccagcatgttcgttggacacctcggcgacattcagctctctgctatctccctcattaactccgtcattggcacttttgcctttggtttcatgcttgggatgggaagtgcaactgagacgctttgtggacaagctttcggagctgggcagtttcttggtcaacaggaagatatagctgatcttgcagggagtttctctattttagtaattccacaatttctttcacttcccttcaattttccaacgcaaaagttccttcaagctcagagcaaggttaacattattgcatggattgggttggtggctttaattctgcacattgggatgctctggctcttaatttatgtgctagattttggcttagctggtgcagctttggcgtttgatatcacaagctgggggatcacagtggctcaacttgtttatgttgtgatctggtgtaaggatggatggactggattgtcatggctggcttttaaggatatttgggcctttgttaggctctctcttgcatcagctgtaatgctttgccttgaagtttggtatatgatgagcgttatagttcttgctggcaaccttgataatgcattggttgctgttgattccctctctatatgcatgaatatcaatgggtgggaagccatgctcttcattggagtaaatgcagctgtcagtgtcagagtttccaatgaacttgggcttggacatccaagagctgccaagtactctgtctatgtgacagtctttcagtcgcttttcttgggaatctttttcatggctattattttggcgactagagattattatgccatcatttttacaaacagtgaggttttgcataaggctgttgcgaaactaggatacctccttgctgtgacaatggttctaaacagtgttcaaccagtggtttcaggtgttgctattggaggtgggtggcaagccctggtggcctacatcaacataggttgttattacttatttgggcttccactggggttccttcttggctatgaagcaaatttgggggttgag

SEQ ID NO: 94508 - DNA, 372 bp, Glycine max
  Peptide Sequence Number=SeqID_211286
atgtcgaaaaacctttcgcattgcgcgacaactagtgtcaagcagctcaattcggtaagtaaagataaggatactaatttcatcctagcgatcttgccatccgactggctactagcgaaaaacccaagcagtgaaacctgtcaaaagaaagaatgtaagaggtatcagactttgatagtctcgacaaaagactctgatagtcctggaaaagtaaagaagactttgatagtcttgacaaaagactctgattctgatagtcttggaaaagtaaagaagactttgatagtcttgacaaaagactctgatagtcctggaaaagtaaagaagactttgatagtcttgacaaaagacattggagtctttgaaatgtaa

SEQ ID NO: 94509 - DNA, 963 bp, Glycine max
  Peptide Sequence Number=SeqID_211287
atgctcagtcgcatcacccagcgccagctggaatacttcgtcgcgtccggcgaagccggcagcattattggcgcatccgaacgtattcacgtgtcgtcaccgtcgatctcggccgccattacccacatcgaatccgagctgggggtgcagctgtttgtgcgccaccacgcgcagggcgtgtcgctcaccgccattggccatcaggtattaaaagaggcgaagctgattctggaacagatgtcgaatctgtataccatcgcctcagagtcgctgaataacgtgcgcggcccgttgcgcgtcggctgtctcgacacgctggccccgatgctgacgccggagctggtgtttggctttggccgtgccttccctggcgtgcgcatcacgctggtggagggcaatcatgaacagctgctgaaacagctgcgcgccgccgatatcgatatcgcgctgacctacgatctggtgccggccagcgacatcgcgtttcagtcgctggcgcagctgccaccgtatgtgatggtcggcgaacatcatccgtttgccagtcagtctgcggtgaccattcaggatctcgctacggtgccgatggtgctgctggatatgccgtggagccgcgaatattttctcagcctgtttagcgaagcgggcgtgacgcccaacattgtgatgcgctccggcaatatggaagtggtacgcgcgatggtagccaacggcgtgggatttggcatcgccaatgtgcggcccaaagccaatctgtcgcaggatggcaaacgggtgatccgcgtgcgccttgccggcgtaaaccggccgatgttgctgggatacgccacggtggcccacgtgcagcagtcaatggtggtcaacgccttcgccgaacgctgccgcatgttcatctccgatcaatacattcccggcatggccgcgccaagctacttcgacccgcaggtggtgcgcgtcgcctga

SEQ ID NO: 94510 - DNA, 954 bp, Glycine max
  Peptide Sequence Number=SeqID_211288
atgctgaccagccgtaacctgctcgaacatctggtggcttttgacaccactagccgcgaatccaatctcgcgctgatcgatttctgctggcgctacctcagcgggctgggcgtgacctgtgaactgatgcacaacgcagaacgcagcaaggccaatctctatgcgcggctcgggccagccggcagcggcggggtgatgctatcgggtcacagcgatgtggtgccggttgatggccagacgtggacggtgccgccgtttgcgctcaccgaacgtgacggcaagctgtacggacgcggcacggcagacatgaaaggctttctcgcctgcatgctggctgcggtgccgcattttctcgcccagccgctgcgtcagccgctgcatctggctatctcctatgacgaagaggtgggttgcctcggcgtgcgctcgctggtgaaggcgctggcgcagcgcagcgatcgaccggcgatctgcctgattggcgagccgacagaactgcgtcgggtgctgggccacaaaggcaagctggcaatgcgctgcgaagtgcagggcgcggcctgccactcggcttacgcgccgcagggcgtcaatgcgattgaatacgccgcgaagctgatccagcgcttaaccgtcatcggtgaacgtctggcggcgccggaacgacaggatgcgcgctttgatccgccatttagcaccgtgcaaaccggggtgatccacggcggacgcgcgctgaatatcgtgcctgacgcctgcagttttgatttcgaagtgcgcacgctgccgcaggaggatgcgcagcaggtggcaaacgagctggtgacgtatgcacagcagacgctggagccgcagatgcgcgcggtgcagcccgccagcgccatccgcttctcgccgctcagcgcctatccagggactggataccgccgcgcacagtgccgcggcacagctgattgcccg

SEQ ID NO: 94511 - DNA, 240 bp, Glycine max
  Peptide Sequence Number=SeqID_211289
atggcggtccaatgcacgagactcctatcattgtggggtctagtagatccagggtattttaccttcaaattagctccttctaggacggctccctctagattggcattggtaaagatctgcattctgttaagttatgagacaataattaatcaatcacacagacatttacacaagacaacattaaagctgcttgtatcaagatacaaacccgtctctaaaaatcaaaattatccattataa

SEQ ID NO: 94512 - DNA, 240 bp, Glycine max
  Peptide Sequence Number=SeqID_211290
atgcttctttggcgaaggaggcagcccagccgcgatggagaggcagtgccgacaagggagaataaacaagaggaaggaaaggaagaaggtgtagacgaagataagggaggctttgagggctttaagaagcagaagaaactcgacgaagaggctacttcaatgtggaaaagattcacgaaggggtgctgcgtgcgcgcgacgttcaacaagaagcaagaggtcatgagtgcgcgagactag

SEQ ID NO: 94513 - DNA, 945 bp, Glycine max
  Peptide Sequence Number=SeqID_211291
agccggctggcggcgcgctcgccaatgtctgcctggggatagccatagcgaacggcgtgtttatactggctgccttcagcggtatcacgcttttccatcctgagagcatcagttttatcgttattcagctcgcgggctgtgcttatttactctatgtcggtctgctttttatccgctttgctggcatgaactcattgtctgcctgcagcgtcaaaacagcggaatcagtaactcagcctgctggtgcctcgaaccattaccgtgaactgggcatgggttttctctccggaatactcaatcccaagaatgcgctgttttacgtgagtctggccacgcttattggtggtggcgatgcgatggtgaatgtgaaagtcgtctatggcatatggatgtttagtgtcgtgctgctatgggatttactggtcgccgctttcattggcaatcgtctggtactccagcacttttcccgtttattaccctggctggaacgtatctcaggaatgatgttgattggcctggcattgagtgtcatcgtggcattatttatgagtgattctgcatctacatccatcggtctgctgctgttccctgcgcttacgcagcttgacctgaccggtccgtttgaagtcttttcgcgggcaccagacacggaagtgcatctcatctggaaaaatctggaccttgtggtgttagaccgggggatggcgattcagccaaccaccacgtttaaaacgtgtcctgcgctggatattatctgtgttcccggcgggccggggcagataaacctgatggaggatgaagaagtcctgtcgtttatccgggctcagagtaagcaggcgaagctggtaaccgacgacgcactgggcttcgctggatcagctggcactattagcgcagagccagtaacgagcgtgttgtacgcgaccgcaccgtatacgggcgctg

SEQ ID NO: 94514 - DNA, 171 bp, Glycine max
  Peptide Sequence Number=SeqID_211292
atgaagctcgtttggtgtccagaatcagcattaaaagcctacctcgacactgttaaatcatgtgagaaattaaaggaattgggggtaccagagttgctatcagccatggctgcaggatggaacacgaaattcatagtagaatcatggtcctacgagggtagatttcgctag

SEQ ID NO: 94515 - DNA, 378 bp, Glycine max
  Peptide Sequence Number=SeqID_211293
atgacttcatttacttgtcattcttctgcttttgaggaattattggtgttaatcatgtatatcttccgtctttgtcttgctcaatgcagtggaggtgcagaaagccccggagaattgctggcagatttaatttaccaattattggcatacatcacatggaagctcatgctttgccagatggacgcggcggaggcatgctatcaacaattgaaatgtggtataggacggtcccttgcactattttctgagtggagacgagggaggagaggggaagagaggtacatttctcagatgaagattgcaagattgtttccaggattaggcaaagatcgtcgtggacatggatggattcaagcatctcgatctccagcagtgtga

SEQ ID NO: 94516 - DNA, 192 bp, Glycine max
  Peptide Sequence Number=SeqID_211294
atggcaacatcgccatcacgtttagatgcggcaagcgacgatttgagtggaagttggtttctgcagaaagtggtgagtgcggagaaaagagaaggtagtggtggctttgggaagaagattaggcatgaaagtgctgaaaaaaaccaaacatgtgactttcaagactttaacgctgagattgaatcagggtga

SEQ ID NO: 94517 - DNA, 816 bp, Glycine max
  Peptide Sequence Number=SeqID_211295
atggttatctcagcagccacttcaaataacaacaacatccatcagttgcaatctttcaactctcagaacaacaattaccacctttgcgacgcgtccttctcttcgtacttgaacaacaaagaagagatcctagcagaatcaggccatggctatgttagcagtagaaaggatcctcttggagtaaagaaggaagatgatggagaattggagtatttgaagctgaaaagtgaaatcagttttagcaaaaattctagtcacggaaaaacaacttcaagaaatatgttcaatgttgatccagaggctaatcattcagttaaagttactaggcctcacgcaaccaaaatctcgattaaaaaagatgtttacttccaaagcccagagaagttaggtgtgggattgagcaaagaaaacagtttagcactctcagagaagtcaaggaattcattggaagtgtttggctccccaatattgagtagcaggagcaagtctttgagctttgataaaaagtttgcaaagacctcttcctcttcttgggatgttgctcctaaaattgaagaaactgacttctcagcaatttctggtggaaactacaatgatgttgatagtgatgcaagttcaaactttaatgtaaatattgattcggagaagaaaaagaataatttgggcataaaaattgctgctgggatagcaactgctgcttctgctttagcaatatctgcaataatcattttcctgatttctagaagaaatatgaaataccagaagaagattttcaggaaacgaatgtcaatagagatggatggctacagaacatga

SEQ ID NO: 94518 - DNA, 435 bp, Glycine max
  Peptide Sequence Number=SeqID_211296
atgattgataatacccaaatgccttttggagaggtatctactgtttctacgaagtttgagtcattcagggcacaacattttcgcatgttaatggagaacctatgtgttttagaagaaacttttgttgattctgaagcactgaggttggaaaaggctattatattgcaactaggaaaggtgctagctgagttagagaaaattaggacagctatagaagaggataccaagccagtagcaagcttgagtacctgggtagaaacatctggagttgatgagaaggtgctacaacagctattgcattgtggctattattgttgggatgagctcatacaaagtagtcgttccttagttgtataccttgcccgaaaatacaggggtatgggaatagcattggatgatttacttcaggtttgttccaaatgtcattgctcatga

SEQ ID NO: 94519 - DNA, 237 bp, Glycine max
  Peptide Sequence Number=SeqID_211297
atgcgtgctcaaagctcaaagctttctccgcaagtattgctgattgaggtacgaggaaagcttcaagtttcgtgccattttgttagatctcactgccattgttactgtttgggttcgagtaagcaggttcataacaagttactaacacttcttgcaattattttggagtttggggcacttgtttgtgtggtgtatgcacgcattaagttaccataccataaatatgatgtggcgtaa

SEQ ID NO: 94520 - DNA, 1239 bp, Glycine max
  Peptide Sequence Number=SeqID_211298
atgcagagtgaagaacatgtgcaaaagcagcaagaagaaaaggttgttgtaccagaagattcagctgaaggcactagggatgatgtaaaaggtccttgtgctaatgatggtggaattgaatctcagtcaccagttgatcctccatcaaatgagggagcagagtctgttgcacttccaaatggctcagataatgaggacaccagccaagtggttacatctgatgcattgaattcttcaagtgatctgtctgagagtgacaaaatggctgtggaatccgaagctaaatcagaagcgaaagacaatccgattgcggaagacattcccattgaggttgataaattggacaagactgtttgggaagaattgcctgtgggagttattgatgaagatatcaatgatgttagtattgagaaggaagaacatgatgatgttagatctggaagtctcccagccatggtgaatgattcagcacaagaaggatcagattcaaagaactatgcaatgatggaactgccattgagattacatgaggagcatgaaagggacaatgaaatgaatatttctaatggagaaacacggtctgagaatgagatatttattgaggagcttcctgtgggactgcacgatgaggatacaacaatatctaaagataagagggatgatcaagctaagcctaaaacatataaagagaagctgaaagagcaagaggaggtgcattcttctagggtaaaaattgagtacccggaagaaggtgaactcaatggtgatgcaccaatggatataagagttgagtgcaagtcaggtgaggaagctggaactgatactaagttgcttcctttgacaacacaagtcagtgataatgaaccagaaaatgaagatgaggagacaccagagatggttgctgaagaggcaattagtgctgatgataaatactttagttttgactgttttgatcaaaactctctaccttaccttccaaactcttcttgtggtcaagaagttcctcaaacttacaataatgactaccccttcagtgaaatctatggctccttacttgatgaatcatcaccacagattatggattcattctatagcacccttggtactccactcaatacccctccatttcttggtcaagaggattatccaatattgtctatgatggaagaagaggagcagggtttgcttggggaagagcttaagaatttggagttgcaaaccacatgtaaggagccatag

SEQ ID NO: 94521 - DNA, 774 bp, Glycine max
  Peptide Sequence Number=SeqID_211299
atgtatacaggatcatggcttctccacttgcctcgcctccttctcctcttcctcgtcctcctcatcctccttcagacgcatcagcttcaccctggtgctgagagaccagtggtccacattgatcctgctaccggtaaggccgacggtccccataggaagaaattaagaacttatttggggattgtggcacgtgataaggtggacatcacgtacgagaactggaagaaggtctctactgctcagaaggacttgatttgggacgatattcagagacttttgacagtaggacaaaaaggaagttacttcagactatgggcgagagatggagccgatcacgacggtgtggatgacactgtctgtgaaaaatacggcataagcaaggaaaactgggcccagtttcgccagactcgcagagacccttcttgggagaagctcctggctgagaatacgaagaagaagctggaggaagctgcacagtcaggaagcattgatggtgtcatcgacccttcatccccggtcagacgccacgtgaagtggaagatggcccgcacgaagaaaacaggggagatgacgaaagaggccgcaaaggaaatcgctgagaagatcgattcctttaaggagcaggcaacacaggaatctttcgtcccctatggacgtcaggatgttcttaccgctgctattagacgttcagagcaccttggacgtgtccgtgctgctggagccggtgtcaccatcaagcactactttggttcgactccacgggtttttcaataa

SEQ ID NO: 94522 - DNA, 231 bp, Glycine max
  Peptide Sequence Number=SeqID_211300
atggtttccatgtgtggagaagattggttgattggccaagtaagcacaaatgatgcactaaatccagctccagttgacatcttgttgggtcaagaatttgttgcagctatgagtaaaaacaatgtaggtgtttcatctgcacaaccaagttttcagttgcagaacaatgctttgaagaggacaaccaagtttgagagtgagccaactctatttttctacatagactcctaa

SEQ ID NO: 94523 - DNA, 366 bp, Glycine max
  Peptide Sequence Number=SeqID_211301
atgttgtcattgcagtggactgataagtggcctagtgaatccagcacatatgctgacatagaggcaatatatgaatgccttgaaactaagtatggagttagccaagaagatgtaatcttgtatgggcaatcagttggaagtggaccaacactgcacttggctgctaaattgccaaggttgagagatgtggttcttcacagtggcattctttctggtcttcgagtgctctgccatgtgaagttcacattttgcttggacatttataagaacatcaacaaaataaagaaggtcaagtgtcctgtacttctaatacatcaagtatatggacaaagcacattacccatcatactagagttctttccctag

SEQ ID NO: 94524 - DNA, 378 bp, Glycine max
  Peptide Sequence Number=SeqID_211302
atgcctctcacacagatggacaacaaagaaggccttctaaggcggactctggctctttcatttgtatgtaagagtcctcctcaggcacgagattttccgatgaaggataaacttgctggttgccgaggaccagagggaagaacacctaggatagtgctgaatgaaatggccactctgctcgtgcgatggtcgataccagcgccacgagatgaggctacttccatccaagggaaaagtgaagtcctagaacgagacggttcaatgtcttacaatgttcaagcagcattcttgccggaaggattttttaggaagcccggacacctaccgaacatccctgaaggatggaacaacatgatgaagaaggcggcgaaagtttag

SEQ ID NO: 94525 - DNA, 168 bp, Glycine max
  Peptide Sequence Number=SeqID_211303
atgaagaatgatcacgaaatgaggggaggaggttgcacagcagctcgcccaagcgagctgcttgcttcctccagaagtaaccttgctcacccaagcgagctggttacttcatccctaagctttctggtggcccaggcgagccaggggcctgaaaaagtcaccaaatga

SEQ ID NO: 94526 - DNA, 309 bp, Glycine max
  Peptide Sequence Number=SeqID_211304
atgaacctgactaggagcagatcgtttgatacaagctatggagttttggatgacgtcacttccagaattgggttcaacatcatgcaactagcaagacaaagcagcaacgaacaccaagcagcaaccagcaaccagcaaccaacacccagcagcaacgaagaagatgaagcaacaacagcgtgcgacagaggaagcaacaatgtgcataagaagaagaaaaaaaatcaaagaagaaagaagaaacagaggaacaatggtaagaagaggaaaaagacgaagcagaagagaaagaggacgaaacataagtaa

SEQ ID NO: 94527 - DNA, 894 bp, Glycine max
  Peptide Sequence Number=SeqID_211305
atgacgcggtcaacgcttccaccctcatctccgatctccctcttcgtgtcgctcatgtgcgttgctttcgcgtgcgccacatcgttgaacaaaattgagcactgcgagttggattgtgcaagttccacggtggaggggctgaacgtggttggtgactgcgaacccaagtgttctcaggggttgaagattccgacccaaattgaaaaagaaggacaagacgcgatcaaagagtatttggataccgttttcagcaacgcgctctttggcggtggttcaattgaaacagggcagaataaggaaacacaaattgaggacaagggtgagaagaatgtggatgcagataaatcagcttatacagcgcccaaagagcctggggtagaacataagctggcaattccaagccatatagaagaacaaggggaagacgcgatcaaagagtatttggataacctattcagcaacgcactttttggcactgattcaactcaaacagggcataatcaggaagcacgtccagaccgctattctgtcgaacctgacagcaaaacacaaattaagcacgagggtgagagtatgaatgcacaaaaatcatcttataaacttcccaaagagccaggggaagaacaattgttagatggtgatcttgcagtcaacgttgaccttgagattgtgggcgatggagagtatgttcttaagatcaagagggtaaatccaagtttaaccaatcatgatgaagtagaaagggctaagcatatggctcaaaacggagccatgttgttacattacggagagattcttcaagacatgggagagaaactgatttctcagtcccaagcatcactttactcagtatttaaaatccctacacctcccaaattgaagtctgatcaatga

SEQ ID NO: 94528 - DNA, 297 bp, Glycine max
  Peptide Sequence Number=SeqID_211306
atgacgacgtataccaccacacctgaccacaacattcagttaacgacacaaggcatgacccaggccctccgtgtcggcgaacacctccgtcacgtgataggcaacgacgactgcttccctaactggcgggtgcagttctacgtgtccccctacacctgcacccaatcgatgctccacgagcttaaacggtgtttcttaaagaagaggattatcgacgtgagagaagagtcgcgaatccgagaaaaggatttcagaaactttcatgtgaaagaaaggatgaattattttaaggaataa

SEQ ID NO: 94529 - DNA, 372 bp, Glycine max
  misc_feature (40)..(40): n is a, c, g, or t
  Peptide Sequence Number=SeqID_211307
atgacttacaccaagaaaactgatcaaatgatgtttgagncggcaaaggaaattgctaacaagattgattccatggaggaggaggcttcacaggattccattgtcgcccatgaacaccctggtcgtgtgcgtgctgctggagccgatgtcacgatcgaacaatactttggaccggctccaaggacctcccacacgtcttcgtccatgtctccgaaagacatggagcagttgaggcaaaaaatcagggaccagctggaggagtggatcacagaaaaagtgactcgacaagtactcgcactacctcctgagcctgaggatggtcgttcaactactcatgtcagcacaaaggaaaatgttgtcatctggttttga

SEQ ID NO: 94530 - DNA, 375 bp, Glycine max
  Peptide Sequence Number=SeqID_211308
atgggtcaggataacagaaagtgtggggcggtcgaaaaaagcgaggctcttgctcctacgtatcctcaatttgtgatgaggaactcagacctacgtagttctagcttttgcgatgctgacatctccggaaagggtgcagatgaccacgttggtctctacttgtcaatcgaacttggggttccgaatgatgcggtgcggataaccggaaggtgtctccacatgctaccagactcttgggtcatgatagcaaaaggtggggcggtcgacaaaagtgaggctttcgctcctacgtatcctcaattcgtgatgaggaagtcagacctacgtagttcatacaaaagtgagaccaaaatagtctcggtgttctttaactaa

SEQ ID NO: 94531 - DNA, 1550 bp, Glycine max
  Peptide Sequence Number=SeqID_211309
atgttttccgttgatcagcttctcaatacttactggccaggccagcagccggcgcactggcagaaaagcctgctgaagtgggcggtgcgtgaacaggagtttcaggactttgcccagcgctatccgcatctgaaaggggtggatatggtggagcaggtgctggagcacctggatgtgcgctgtgagctcagcgaacgcgaccttgaacagatcccgacgcacgggccggtagtgatcgtcgccaaccatccgcttggcgcgctggacggcctggcgctgctggcggcggtatcgcaggtgcggcgcgacgtgaaaatcgttgccaaccgcatgctgatgatgctggaacccatcaacaacctgatgctgccggtggataacatgggcaaccgcaccagccgcgagcagctgacgcgcatgcagcagcatctcgacaaccagggcgcgctgattatcttcccggccggtgaagtctcgcgcctgtcgagccgcggcgtgcgtgaccgtcactggcaccacagttttctgcgcctcgccgcccgcgcccgcgcgccgctggttccggtgcacgtggcaggacgtaacagcctggcgttttacgccgcggcgaaggtggcggcaccgctggcgctgctgatgctggtgcgcgaaatgttccgccagcgcggcacgcgcatcaaactgcatatcggcgagcagattcccttcgccaactggcacgatggccatacgccgggcaaagaactggcgaagcggctgcgcaagcatttgtaccgcatcggtcagggacggcgcggtctgtttcttaccgaagccgccatcgcccgcccggaagatcgcgctgagctgaaaaaagcgttgctggagagtgaacggctcgggacgctgccggacggcaaacagatttacctgtggcggcgcaacggggccagctgggtgccgctgctgcgtgaactgggccggctgcgcgaaatcgctttccgcgcggtgggcgagggcagcggccggcggcgcgatctcgacaagtatgacgatgattactatcacctgattttgtgggatgacgaggcgctggagattgtcggggcctaccgctttattcccggcgccgagcagctggcgcggcgcgggctgcagggcatctacagcgacagcctgttccactatgacgagcgcatgctgccgattattcagcaggggctggagctgggacgcagcttcattcagccggcctactggggcaagcgcgggctggattatttatggatgggcatcggcgcttacattgcgcgctatccgcagacgcgctacctgtttggcccggtatcaatctccggcaccatgccgctggcggcacgcgatctgctggtggcgttttaccgtctctactttccgaccgatctgccgctggctaaatcgcgccgcccttatccggcgtcgctgccggaggtgctggcgcagttcaccggcgataactacgccgacgatttgcgtcgtctcaagcatttgctggctaatctcggtaccgcgattccgacgctgtacaaaca

SEQ ID NO: 94532 - DNA, 264 bp, Glycine max
  Peptide Sequence Number=SeqID_211310
atggcttttggtgcacgtaagttgtcttcaccctcatcttcatcatcaggggacaaaaacttgaagcataccaatgacaaaattggaaactctaaattgtctgcatcttcaacgaagggccgtggatctgtgggtaggatcaaaaggaagtccaacaaaagaggacatgatcatgaaggtgaaaacgtgaagatggggtacataatgaggccaaaagtgagcaccaaagttgatgcactagataaatctgttcttgcagcttga

SEQ ID NO: 94533 - DNA, 414 bp, Glycine max
  Peptide Sequence Number=SeqID_211311
atggctctagtgataggtcccctccttgggatccttgggaggattgcattagagaagctccccaatcttgtgggacaaacatttatagactacaatgatattgcaaacttgctttacattagtttctttgctctagaaaagcaagaggctgttggtgcactttggaatttttcatttaacgatagaaatggagaggccattgttgtagctggaggagttcaggccttgattgagaatgagtatggaccagaaagcaggcaagtgggagttgttggtcatgcatacacaaattgggctgcaaagatggctgttggattggccataggtgtcccctgggtgatgtgcaagcaagatgatgcccttgatccagtggtgacccatgtcaagtttttagctcccttactcactcattag

SEQ ID NO: 94534 - DNA, 793 bp, Glycine max
  Peptide Sequence Number=SeqID_211312
ttattcccctgccatctcttttgtccccaagtggatattcaaattgaagaaacttgtttctcttcaattacatggtaatgaaatccaaggtccgattccttgtggtattcgaaacctcacacttattcaaaatcttgacttgtctggaaattcattctcatcttctatacctgattgcttatacggtcttcatcgtctcaagtctttggacctaagatccagcaacttgcatgggactatttctgatgccctgggaaatttgacttctcttgttgaacttgatttgtcatacaatcaacttgaaggaaccattccaacttctttgggaaatttgacttctcttgttgcactttatttgtcatataatcaacttgaaggaacaattccgacttttttgggaaatctccgcaactcaagggagatagatttaacatttctcgatctctctattaataaattcagtggaaatccatttgaaagtcttggatcactctctaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaacaaacttaaatatgttggactatctaacacggggattttcgattctattcccacttggttctgggaagcacattctcag

SEQ ID NO: 94535 - DNA, 312 bp, Glycine max
  Peptide Sequence Number=SeqID_211313
atgagacttttttgcagtctcggccagaacacgctgacatctcttggaaaggtgctggtgacaacgttagtcactgcatgctatcgggcttggggtcttacggatagcaatgagaatttttcgcagtctcggctggaaaacactgacttcttcgggaaaggtgcagcaaatgagactttttcgcagtctcagccggaagacgcaagcatctctgggaaaggtgcaggaattaatgaaacattgggcttaatccggattttggttatggacttgaagagggcaaacttagcagcgcttaccttagttaattag

SEQ ID NO: 94536 - DNA, 852 bp, Glycine max
  Peptide Sequence Number=SeqID_211314
atgctttctcataagggtggacccttgggtactagtaccctctcctttagaggactgcacgtcctcaccttcagaggactgcacgtcctcgccttcagaggactgcacgtcctcaccttcagagggttgcacgccctcgccttcagagggctacacgccctcaccttcagaggactacacgtcctcgccttcaaagggtcatgtaccttcatcttcagaggactacacgtccttgcctctagaggactacatgtcctcgccttcaaaggactacacatcctcgccttcagagggccatacgtcctcaccttcagaggactcatgtcctcgccttcagaggactacacttcctcgccttcagagggctacgcgcccttgcctttagaggactacacgtcctcggcatcagaggactacacggccttgccttcagagggtcatgtaccttcatcttcagaggactacacgtcatcgcctccagaggactacataggactacacttcctcgccttcagagggctacacgccctcgcctttagaggactacacgtcctcgccattagaggactacatgtcctctccttcaaagaacttcacgtccttaccttcagagggctacacaccctcatcttcagaggattatacgtcctccccttgagaggactacacgtcctcaccttcggagggctacacaccctcgccttcaaaggactacatgtcccccttttcagagggctacaggccctcgcctttagagggcgacacgtcctcgcctttgaagggctgcacactccctcacctttagagggctacgcatcctcgctttcagagggctccacatctgcaccttaa

SEQ ID NO: 94537 - DNA, 318 bp, Glycine max
  Peptide Sequence Number=SeqID_211315
atgggtgaagtagaagaggtgcaagagcagataaagaccgacatggaggccatgaaagagcaaatggccacaatgatggaggccatgatgagcatgaagaagataatggagatcaatgcggctgcaatagccgctaccagcaccattgttgagttgggagggcaagcagttggtggtatacccctggaaaacactttggagggccctcagtatcactcacaaccacaccccttgcattccacagtgggtaaaaaccctcatgctatggcagaaatgggagaagttggatcatttagaggaaaggctcagggtcgttga

SEQ ID NO: 94538 - DNA, 309 bp, Glycine max
  Peptide Sequence Number=SeqID_211316
atgatttttctcaagacatgtttaccaaagagtttttactctctggagcatgatggctcttgggtgaagaagggtgctagaaatgttggtgaagaaggacatgaaggagaagattcatctctactttcgaagattatggacaggtttgatggtcttcaaacctttgttggtgagaggtttgacacttttgaattgcaagtggatatgtgcttcaatgaaatggagtcaagaatgacaaaggttgaagaacatgtatcttacattcgttcaagcttcgatcttccaccaccgccgctaccatcatcttag

SEQ ID NO: 94539 - DNA, 813 bp, Glycine max
  Peptide Sequence Number=SeqID_211317
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagaacagaggtgattgtaatcagagacccatttacgggaattgatgaaacaaaggatgttgtggaacaagccacggagtatcttgaagatgtatctgatgtgattatcaatttaaccggtggaacttcgcttttaggatatatgatagagcgtgtgagagatagaattagaaatggtaaaagaataacgacagttcttgctgcggatgaacgaccgtatcaagaacaagtgcaaaatccgtacgtaataggaaaggttattgagattgagcaaacagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 94540 - DNA, 159 bp, Glycine max
  Peptide Sequence Number=SeqID_211318
atggaggatgatggcaaggtacttcccaaacactccaataagcaaagcaaaaaggagcttcaaaccaagctttgtgtggtcgagtatttcggaagcaaaatgggtcatggaagaggattgtgtatggaaggtgggaatgaaaagagcattagattctaa

SEQ ID NO: 94541 - DNA, 234 bp, Glycine max
  Peptide Sequence Number=SeqID_211319
atggctaccattgtagtatcaagcttttgctgcaaaattccttccttggttggtgttttgctgggttttgaggttgatttagggatggttgtcgctacctaccctacggcgggagggcgacacgagactcacgagtgcatcttccaaggaaggaaaaacgcgcggagtcgccaccaacgtttattcaaggaaaacgtcagaaaaaccggaaaaggcgtgatctacgaactttaa

SEQ ID NO: 94542 - DNA, 225 bp, Glycine max
  Peptide Sequence Number=SeqID_211320
atgggatcgagtcaggcgccttcgcttaaaaagaggttctatcaagtcaaggcagcgatcaacgcttttcttgcctttcatgaccgcaaggaaagcccagttgtcgctatcttagccgatctatatgacaccttcgaccgaagatgtgaaaagagcagtgcaaggattgtttgctgtactccggccctctatatatggttggtttcgcaccttttctgccaagag

SEQ ID NO: 94543 - DNA, 135 bp, Glycine max
  Peptide Sequence Number=SeqID_211321
atgggtcctggttcctattatcagcctctgactcttgatgctgaactttctagggacatctttctcaactcttatgctaacttgacatctctagagatgatttgtctattcgtccatgctcaagatataaaataa

SEQ ID NO: 94544 - DNA, 336 bp, Glycine max
  Peptide Sequence Number=SeqID_211322
atgtttgcacattcgattaaaggctgccgtcccttgggacggacgtgtggggtgctaataccttccccgtgcgtaaatacaactcccgaaccttttcacttaaaagtttgtagatcgcgtcttttccggtttttccgacgttttcctcaaataaacattggtggcgactctgcgcgtattcctttcgtggaacacgcatcccgcgagtcacgcgtcgccctcccgccgaaggggaattggaaaggaggattggtgtcatcccttgaagaatttgagtcaagaagtaaggggaaaaccaccttaagagctattggactaagaagcactccaaattga

SEQ ID NO: 94545 - DNA, 477 bp, Glycine max
  Peptide Sequence Number=SeqID_211323
atggaacgtgtattgactgatgtacttagagatcaaaggaatttggacaacaagggtgacgaaggttggaaaaggtcagcattgaatgctgcagtcgcagtgttgtctacaagcttcatgttaatgtcacatcaaataatgtcaaaaaccgtatcaaattatggacatcgtggtatggtattagtcactggtcatggagctgaaactgttgtggatgctgaaaaagcgaagagtagagaaacaaatgaagtggaattaatgggattaggtgctactgccatagatttagaagaaccaagctctaatacaaaaggaaaaagacaaggttcgacttcttctggcacacatcctcacaagagaaagatgggagaaaaagaaggaatagcagcttctttggataaaatggccaactcttttaaccgaatggtagaaaaaagggatggtaaagttgatgatgaagatattcaagaagtatga

SEQ ID NO: 94546 - DNA, 969 bp, Glycine max
  Peptide Sequence Number=SeqID_211324
ggtgcacgccagcaccttgggcgcggtaccgcggcgacgcgtggcgagatcgacgaagatccggtggccgtcgcagatccggcccgtcgccggcgcataggccgcgacgatgctgcgcaattcgggcgcatgatgttcgagcgcggcgaacaggttgccgggatcgcgcggcccggcgagcggcaggagatgctgcatcgcgtgcgggttcatcatcgcgatcgcgccgctgctgtcgcactcgatcaggccgacggggcaggcgtacagaaactcgagaagctcttcctcgctcgacctatcgctcatcgacgcggcttagcgttcgatgaggatatagcggcgcgcaatgccgggtgccgcgagcagacgcagccggaccctggtcgggcgcatccgcagcgtgaggacataggggacgatgtcgtcgatctcgggctcgtcctcgaaccgctgcgcgacgagaaaattgttcatgcactgcgccaccgcatcgaagaacggcacgcccatgacagtcgcgggatcaaggcccgacatccgcgcctcggtcgcgttatagacctggacgagcgtgtcggcttcgaacccgaccacgccgaacggcagggtgtcgcggtcctcgacgcgcatcgtgtcgagctcgggcagcccgacattatcaaaactgtattgttccagtaccatagccacggtctccctgcgactgcgctatggggcggcggggctggttgcgcccgtcttgcgcatgagatgctcgcggtaggtttccaccgtgcgcgggctgatatccagccgcgtcgcgatctgtttcgcggtcagcccctcgacgatctggcgcaggacctggcgttcgcggtgcgagagcgaggcgaggcgctgctcgagcagggtcgactgcaggatccggtcgcggaccgccgccaccgcgccgagcagccgttgtgcctcgaacggcttttcgagcag

SEQ ID NO: 94547 - DNA, 339 bp, Glycine max
  Peptide Sequence Number=SeqID_211325
atgtcatttcctgctttcaggattagctcgcttggacgagctgagctcgcctgggcgagcaccccctgcacaaaatggtttaaaaaagagagggggagtgcagttttcacccaaggaacttctccccctcacttaaggacgccagcactcacgggattctggtttttgctgaccctaggccaccattgtgtgctttttgcttcaattttagtgtccttgccaccccatacaagggatggccttaggcctaggttgtgttctgaaataatggggcaagccacattgcccctatcccctttcagtttgtacccaaaagtgtgcccaccaagtgctcggtga

SEQ ID NO: 94548 - DNA, 555 bp, Glycine max
  Peptide Sequence Number=SeqID_211326
atgcaggctgtgaagaagggtgatactatttttatcggaaaatacctatttactagaagtgaaacagcttccgtatggctagaggtcagtgaggagaaaggtgaggatgtcacctgtctgatttgcatcgatcttcctactcttgctgataaagataaggaggtaataagcacatggggtgttcgaaacaatattgacttcctttcattatatacccgacacgttgaagatattcgtcatgcgcgtgaatttctttctaaattgggtgaccgtaagcagacacatatttatgcaaagattgaaaatacagagggactgcagcattttgatgaaatattgagagaagcagatagcatcatcctcgctcgtggaaatttagggatagaactcccatctgagaaggctgctatttacaagtgtaacatggttggaaagccagttgttgttacacgtgttgtagactctatgactgataatctaagacctactcgtgctgaagcaacagatgttgccaagcagtgttggatggaagtgatgcaattctccttggagtag

SEQ ID NO: 94549 - DNA, 384 bp, Glycine max
  Peptide Sequence Number=SeqID_211327
atgaccgaagggatcaccaatgctaaggatttccttgataaactagagaaatgctttgaaaaaagcgataaggcaaaaacaagtacattgctacaccacttgatttccataaagtataacgggaaaaaaattagagagtacatcatggaaatgtctcatatagtttctaagcttaaaggactcaagcttgaactatctaaagacctcttagtgcattctcttcctgtgcaatatagtcaattcaaggaaaagggcaaaaagagaaagagatttgaggctgcaagtggttcagatcaaaagaaacctatcattgacaaggataagtgtttcttttgtaggaaatctaaacatcaaaagaaggattgccccatgtatcatacctag

SEQ ID NO: 94550 - DNA, 321 bp, Glycine max
  Peptide Sequence Number=SeqID_211328
atggtcaatttagatgttgttcaagtaaaggagaatttggcacatgaaacattgcccttgaggatcaaggatatgcgaacaaagcacttaagagggaaagagattttgttggttaagaattcgcctcggcaagacaaatttcgcctaggcaaatttgagttggatcagcttgcccaagcgagtcaaatttcacctgggcgagtcttacggtctacaaatacgtctagcaacataaaacaaccatttttacctacatctcttcccttgaaccctcccccaacaaccccatcctctacctccaccaccacttaccaccagtga

SEQ ID NO: 94551 - DNA, 282 bp, Glycine max
  Peptide Sequence Number=SeqID_211329
atggattcactcggttggggtggtccctttgacgctccaccaaaaattgaagttcgtggtggaaaggcgtttggtcattgtctcgagggaagaggacattaccctctttttgatcaaggggttcccacgaaccctaagagaataaaggtcattcctaaatggcccactacaccaagtgttgagggaagaaggccagagtttcaagagtctctggatttgaggtcaaatccttttcaaaaggaagggaatgatgcaatcctaccccacaagggcattggatag

SEQ ID NO: 94552 - DNA, 459 bp, Glycine max
  Peptide Sequence Number=SeqID_211330
atggctagaattagtcctaaactcaatgcaaggtattatgggtcgtttaaaatactagaaacgattgggaaaatgacttacaaactgcaacttcctcccacttcaagcattcatcccatgtttcatgtgtccttactcatgaaggcagtggggacttatgaggcagaagttgacttacctactgagctggaagatgatagagctgacatcatcgaacctgaagttgttttagcttctaggagagtgatcaagcatggagaaagattgaaaaagtggttgattcaatggaaagggaagccagtggatgaagcaacatgggaggatgaaatctcaatctggagccaatttcctactctttgtcttgaggacaagacaattgctcaagggggaggtattgatacaaccatttgtgaagaattacgtgagcctttagtacacgaaggcaaccaaggaaggtag

SEQ ID NO: 94553 - DNA, 1335 bp, Glycine max
  Peptide Sequence Number=SeqID_211331
atgggactgaccaaacctaaagtgccgttccatgtatcaaccattaagaagccacagcatgagtacaacatctttgttgacaatactaacttaccattcaatcacgtttggctaaagtggagtcatggagagaaacggtttattcacccactggaaagcctctctgttatgagttttgttgatacagatgttggggatgttgtgccagtgaaggcccccccaatagaaagcacccctttcaagcttgtggagaccgtccaagatttgaaagagttggctgctaagctgcattctgctgatgaatttgcagttgatttggagcataatcaatatcgcactttccaaggcttgacttgcctgatgcaaatctcaacaaggactgaagattttattgttgacactttgaaacttcacagttctattgggccctatttgagggaagtcttcaaggacccttccaagagaaaagttatgcatggagcggacaatgatgttgtgtggcttcaacgagactttggaatctacatttgtaatttgtttgacactcaccaggcttcaaaggtgttaaaattggagaggaagagtttggagtatcttctttgtcatttttgtgacattactgcaaacaaggaataccagagtgcagattggagactacgcccccttccttatgaaatgctaagatatgccagagaagatacacattatctgctatacatatatgatttcatgaggattgagttattttccatgcttaaggagcctgaaagtgttgacgctccactggtagaggtctacaagtgcagttataaggtctgcatgcgcctatatgaaaaagaacttctgacagagaaatccttccttcgtatatacgggttgcaaggcgctggtttcaatgctcaacaacttgccgttgtttcgggtttgtttaaatggcgtgactttgttgcccgtgtaaaggatgatagcacgggatatgtattgccaaataaatctattcttgaaattgctaaacagatgcctgtcactgcaaacaaccttcgtctattggtgaactcgaggcacccatatgttgaacacaatttggatagtcttgtcaacataattaggcattctattcagaatactgcggcatttgaagaaattgctcaattattgaaaacaggacatgatgttgctaccattgctcaacaattgactcgacatcctgcccaggaacataacaggcaccccattaggatcggcagccaagtgatggaggtcctgccgctactattgaagaagccacgacaagccattagaattggcagagtgattggaggagggtttaggtag

SEQ ID NO: 94554 - DNA, 225 bp, Glycine max
  Peptide Sequence Number=SeqID_211332
atgaataatggagaaatagatgatgacatggtgactgacttaattgtggggtcaaaaagaggaaaaaaaattattgcggttaaaacaaccaccatgattaacatggataatgaagcatctaccaatactattcttgaagggaaccaacaacttgaaagcgaagagcattttttaatggtggacctggagcaatggcttaactttgttttggaggaagtcttttga

SEQ ID NO: 94555 - DNA, 606 bp, Glycine max
  Peptide Sequence Number=SeqID_211333
atggatgcatggggtagtcttaaagatttccctagtcaatctaagtataagggatgtctcaagatgtttggaattgtatgttcactatgggagtactttgttgagtatgtgaagaatacatggttgatccctcacaaggaatgttttgtaaaagcatggacggataaagttatgcacttagggaacacaacaagcaatagattaagctttgtagatatgggttcaaacgagccatttgcagatatgttcgtgcaacaaaagtttgatgttatattaaaatgctttgcaggggttaacataattgggaaagttactataaaaagtaaacttcgtgaaatagcataccctgacataacttcaatgtgtccaccgtttgataagaagtcatccaaggcatcgggtcaaaaattgaagttggaaaagattcacaaaagaaatattttcatgctagatgaatttcatgttaaccttaacccatatattttggacattgttgatgtaaaggttgatggccattgtggttatcgtgcagttgcttccttactaggtatgggtgaagacacttggcctctagtgcgtaacaatttgcttaaagaacttcgttag

SEQ ID NO: 94556 - DNA, 165 bp, Glycine max
  Peptide Sequence Number=SeqID_211334
atggccttaggggacatggcagctcgcccaggcgagttgttgcttcatcctgaaggaagtaaagataaggacactaatttcgttcaagcgatcttgctatttgaccgagtaactagcaaaaaccaagtgaaaccgagaaaacatgaggacattgaagttctatag

SEQ ID NO: 94557 - DNA, 944 bp, Glycine max
  misc_feature (942)..(942): n is a, c, g, or t
  Peptide Sequence Number=SeqID_211335
atgccgggcgtagtggatctggtgctgacccggcagtggtcgatgaacaacatggtcggattggatcacgatatgtcgctcaatacggtgatcgtggtggcggcgagctactggcaggccaaaaaggcggcggatttgctggaggtcgactggctgccgggcgctggacaagcgctgtccggtagcgcgattgcggcggagaatctggcgatgctggacggcgataccttggtgccggcggtcgatcgcggcgaggcgccggcgttgattcgtggcgctgaacaagattcacgcctgcatgaggcgcgttacggcgcgccttatgtggcgcatgccaccctggagccatgcaacgccaccagccattatgaagagggccgtatcgaaacctggggccccttccaggggcaggacatggtacgcaacgttctggcgaaaatgttcgggctgaagccgacggatgtggtggtgaatacgacctacctgggtggcagctttgggcgcaaatatctgccggatgccgtaatgcatgctaccgccgcctcccgggcggtggggaaaccggtcaaggtgatctatccgcgcgagatcgacattcggcatgaatattatcgtccgggctgcatcagccattatcgggcgttgctggatgaaaacggctacccgcaggcgctgtgggcgcgctatgccgggcagtcgctattctggcaaatgcggcgcgaaacggtacacgaggccgggggatgggatgaaagtatggtggagtgcgtttacagcacgccgtatcgcatccctcatctgaaggtggaggccggcatcgtcgaacagccgatttccctgagctatctgcgcggcgtcggcagcgtcgccagcctgttctttttggaaagcttattcagcgaactcagccataaggccaagcgggacgagtatcagtatcgncg

SEQ ID NO: 94558 - DNA, 396 bp, Glycine max
  Peptide Sequence Number=SeqID_211336
atggagaggagtatgattgatgctgccagtggtggagctcttggtgatatgactcatgctgaggctaggaatttgactgagaagatggcttccaactcccaacaattcaatgcaagaaatgatgctattttccttagaggagtccatgaggtggccatgaattcatcttcatctactaaaaataaaaatcttgggggaaaacttgatgccttggtcaacctagtaactcagcttgccatgaataaaaaatctacatttgcacctgttgcaagagactatggtctatgttcttcaacagatcaccatacagatctctatccttctttgcaacaatatggagtcaatgagcaacctgaagcttatgctgcaaacatttataatagaccccctcagtag

SEQ ID NO: 94559 - DNA, 396 bp, Glycine max
  Peptide Sequence Number=SeqID_211337
atggctgtggatcaccaagaaccgcagcaacaacaacagcaccaaccctcgatgtttccgtggaagctccggcggagggtcccacttctccggcgtcggaaggggcagacggtgcggctgggcgggaagaagcgatggcggcgaatttcggggctacttaggatgtttcggaggatgcgtttaaggtggctaaagttgcaatatgttcgcatgttgaagaggcttaaggaacactaccgaaacatcgttaaggatctggtcgaagctgggtccaccattgaaacctttcagcaacgtcttttcatggaaagcacttttgcaatccccgttggtgttaacttgtctacttatccttctcgctttggatcagatcgccccagaaccatcttcatgtaa

SEQ ID NO: 94560 - DNA, 1959 bp, Glycine max
  Peptide Sequence Number=SeqID_211338
atgaaagcgccaaatgctttgtttggtgcaaaacgcagaaaatttcaagggattttcaatgctctgtgttccatggttgtgcttttcttcttttacaaccgggaagacatcatcagcaacccgattctcagacaatcctcgtacttcacgaatcatgggttgcctcaaaatgcgattttgagagatgggtcttccttggttcaccgtcgaatggtggaaatcagcgccaacacttcaggtgtagctggtgaaaatgatttaggcgtaagtagttctggattatgtagtgggttggttcaacatgatggttattctagtccctgtgaattcttaaaggttaatccacagtgttcttctgatgggtatctcgattacttgaagtttttctattgtacatgtctgggttttagtttgtttggttatctagtgttgggtgtgtggctggctgctttgttttatctcttggggaacactgctgcagattatttttgcccttctcttgagcatctgtcaaggctcttgaaattgcctccaactgtggctggggttgtgctgcttccacttgggaatggagcacctgatgtgtttgctagcatagctgcttttgtgggtgctgaaagtggtgatgtagggcttaacagtgtgttgggtggtgctctttttgttaccactattgttgctggaactgtttcgctgtgtgttgcggataaggagattggaattgatcgaagatgctttataagggacgtgagtttctttctcatcactcttgtttcgctgcttttgattttgtttgttgggaaggtgggtgtcggggcggccattgcctttgtgtcgatttatattgtgtatgcattcattgttgctgccaacgagatattgcggaaacatgcacggaggttgaaattggatgctgtcacaccaatgcttcctgtccagggaagtgtgttctctctaggttcggaagaggatacttcgatctatagctctttactggaagacactgagagcgacccccctcgcctccctccgtcgttgccacagtggatgtggtcctcaaatgtggcaatatattcaaaccaggcaaataagatcaattttttggatgatgaaaggcctccctggggatggagtgatggctccacggaaaacaccaggacatcgttcactgtatcaaaactttttctgatgatggagattccactggcaattcctaggcggctaacaattccaatggttcatgaggaagtatggtcaaagccttatgctgtggctagtgcttcattagctcctattcttctagctattttgtgtagcacccaagataatgtgagtaatcagggtgttatactttcttattgtgttggtgttactcttggatgcacctttggtattcttgcatataaatacacagtgtctgatcatccgcctccccaattcttgcttccttgggttctgggaggattcctcatgagtatagtgtggttctacataatagcaaatgagcttgtggctcttttggtagcgtttggtgttattttcggaatcaacccatccatcttggggttaaccgtattagcatggggaaattcaatgggagatttgatgtcaaatatttcattggcattggatggagaagatggagttcagattgccttatctggatgctatgcaggtcctatgttcaacacacttattggcttggggatctcgttactgcttggggcttggtcaaagaaaccctctttgtatgtggtgcctgaagacagtagcttattttacaccatgggatttctgatcacaggactgttatgggcacttgttgttttacctcggaacaacatgcatcctaacagaatattaggaatgggtctcattgccctttatttgatatttctttctttcaggatgtgcactgctatgggatttataacaattgctggtttaagtttaagttga

SEQ ID NO: 94561 - DNA, 861 bp, Glycine max
  Peptide Sequence Number=SeqID_211339
atgggagcagtatatagtaacgaccaagagctcaccgatcatatcattagagatggaagaagcttctctgatccaaagctttcgagagtagttagaggctcttcaaaagaagaatgtggaataaatggtcgcactgagatagaaacaagaagtagacctccaagccctacgggaagaaaacaatgtcattcaagctcagttgcaggcatgaaaggccaacacggttggaagccgttgaacatcgaccagtatgatgaaactataaaccctaatgaccacatcgaagtggatgacgagtcattgtgggacctcatggctcgtttctcttggattgcagtcaaaatccgagacctcaaacctatagtggcttttcatgccataatagcagctctcaaactgaaggcgcttgcagacagcctatgcaagaataggccaacaggcatggacgaattaagatgtcgtgttattggtttcatacaaatagaagatttgtcaaatttttgcgacaagctcggggtcaaacatctggtgtcttcaatcgagcacccacaaacaaatggacaagaagaggcagccaacaatggagaaatccaagggattttgggtagagaagttgcctactattctatgggcatatttctgcactccttaattgacaacaaaggagactcctttcaaactgacctatggcatttacatcctgattccgatggagggactacgctcaagtacaagaggaggcttgcaaaagaagggcaactcaaaagtatgcatcaaggacccttcagagtctttacgacaccgcagaatgaagcataccaacttgaggagctcgatggaaaggccataccccgaacttga

SEQ ID NO: 94562 - DNA, 147 bp, Glycine max
  Peptide Sequence Number=SeqID_211340
atgacgggagacgaatcaaaattcacacatatctctcccaagaaaagcggacatgtaacttatggtgacaacaacaaaggtagaattcttggagttggaaaaataggtcttaaacatagtctgcttagtgtgagtcaattatggtga

SEQ ID NO: 94563 - DNA, 633 bp, Glycine max
  Peptide Sequence Number=SeqID_211341
atggatttgtcttttcttcaaagcccacatgcacagtcttttcttcgtagctcaaaggcacaatatcagatgataaataacacaatgggtgaaggtaatactagtactagagatatgagcaccataaataacacaatgggggaaggtagtactagtactagagatatgagcaccgataaaataaatgttgatttaaatgaatatccaattgaagatatttctttagagaatggttattcaggaacagttagtgaacattttgatcatgatattgtggcaaatgatgtattagaagttgaggaaattgaaacttatgagaaagaaaatattgtgtcttctagtcagaatattgagataaatgaatttgcagaagaagttgatagagatgaaacttataatgagacaaatattgttccttttgttggtcaaatttttcttagcgaggaagaagcatttgcattttataagaggtatgcatatcagcatgggttctctgttcgaaaaggtagattcatcacacgaaatggaattatgaggaggcgtgattttttttgccatcgtgaaggtagaagctcgttgaaaatcatagaaccattaaaagaacagagaaacagagaatcaacaagggtgtga

SEQ ID NO: 94564 - DNA, 204 bp, Glycine max
  Peptide Sequence Number=SeqID_211342
atgaagtgggaaacaaatgaacacaagaatacgtttggaggggaaggaggtggagatctgatttactgcaacacaggaggcgacgcaatcccgcccctccacctcatcaccatgcgcgacactaacctgcccggtgcgcgcctgggcgcgccgtgtgtgtgggcgcctgtcagtgtgtgtcagtgcgtctgtgtgtgtgtgtga

SEQ ID NO: 94565 - DNA, 402 bp, Glycine max
  Peptide Sequence Number=SeqID_211343
atgagtccttggccaagcattcgtgtgggacaacaagatcttagtgaacttgatgaagttcaagtgttgtgtggagtgaaccatgaagatttgaaagagctttttcatgtgtcaaaaacaattagagaagcgactatgatgactaaggaattgcattttgatattaaaacaccaaagaagaaaaaaatagcttttcttaatacatttgatttggagggtgcaaaaggatttaaggaaaagcaagctctaaacgggccgctgaagaaaacaaaatcaaggttgcatcggaagaagttggataacaacatctcgcaggccttgtttgctttcatggatgaagaagaaccacgaaaggacaactgccacaggaggagaaggacaactgaggataatgattattga

SEQ ID NO: 94566 - DNA, 781 bp, Glycine max
  Peptide Sequence Number=SeqID_211344
atgaagttcctcagctggatgcaaaataaacttggtggaaaacaagacaacagaaaaccaaatgcacatactacaacaactactactactactacatatcatccaaaacaagagcctagggaagaattcagcgattggcctcatggtttactagcgattggaacatttggaaacaagactgcaatcaaagaagacttggatgaccaaaatacacaagaggatccatcttcttcagaggaaatagcagacttcactcctgaagaaattgggaatctacagaaggagttaactaaacttctgagacgaaaacccaatgtggaaaaggagatttctgagcttcctctggacagatttcttaactgtccttcaagcttggaggttgataggagaatcagtaatgcactatgcagtgaatcagaagataaggaagaagatattgagaaaacactaagtgtaataattgataaatgcaaagacatttgtgcagataaaagaaagaaagcaatggggaagaaatctatttctttccttctgaagaagatctttctttgtagaagtggatttgctccaacaccaagccttagagatacccttcaagagtcaagaatggagaaggttttgaggacaatgctccacaagaaaatttgcacccaaaattcttctcggtcaccgttggtgaagaagtgcatagaggacaaaaagatgacaaggaagaaaaatgaggatgaatcagatgagagaaatggtgatggctgtaaatgggtcaagactgattctgaat

SEQ ID NO: 94567 - DNA, 384 bp, Glycine max
  Peptide Sequence Number=SeqID_211345
atggaaaactccttattcttccccttggttcttcaaatgagatccccttctgttggattcaccggaatacttgtgcttcttgttttcctctctgcttgctgttcttctacacatgggagtttggaaacggagaaaacttttgccattataaaaccagacggattgcttggtaactacacagatgatatcaagagaacaattgtagaatatggtttcagaattttaaaggaaaagattgttcaactcgatgagggcactgtgaaaagtttttatgctgagcactcttcaaaaagcttcttttcaagccttataaaatacatgacaaggtatgaggtatgccattcccatgcaatgattgtcttgatgaatgatgatggtatataa

SEQ ID NO: 94568 - DNA, 1047 bp, Glycine max
  Peptide Sequence Number=SeqID_211346
atgactgggaagaggattgattgtgtggatggatcagacttaaaagggtgtttttacaaactagaagtgcttttgaagcatgtcccaccttttctaggttcacttctaggtctagaggttgatggttctggaaaatcttatcatactgaattgatctctctgaaagacgaaaaggataaggataaagtggccaaagctaaagacggatactttgtgaaaagccatatatacaccgttaagattccacagtttaggggtggctctgtcttctcaattaagatcagatggtcacagaaaatattatttcatgatggccagttatctctctgtgtccctttcagctttccctcatacgtcaaccctgctggaagaaaaatttctaagaaagagaagatatttttgaaagtgaattctggtgctacaacggaagtgttatgcaaaaccaccagtcatccctttaaggaactactgcgccaagctggcaaattaaatttatcatatgaagcagaagtgcctgcatggtcaagtacagacttaagtttttcgtactctgtttcttccaatgacatatttggagcagttctcttgcaatctccattcctgcgtgattttgacgaaagagagatattttgcttgtatctttacccgggaaacagcccggatagaaaggtttttaaaaaggatgtggtgtttgtagtagatataagcgcaagtatgaagggaactcctcttgataacactaagaatgcgctactgacatcactctctcaactaagtgcacaagatacatttaacattatagctttcaatgggacggtttacttattttcatcatcaatggaaagagctacagaggaagcaattttaaatgctaccacgtgggttgacaccaattttattgctaatggtgacactaatatcatgcttcccttaacacaggacttggtatctgtgcttgatttgcttgtaatgctaaacataaagataaaaggtagatttgttgctggtatggtatacttagaccagcacattctatgccgtgtttaa

SEQ ID NO: 94569 - DNA, 354 bp, Glycine max
  Peptide Sequence Number=SeqID_211347
atgccatatccagaggatgcgaattgtccagcttatctagacaatagccttatattagttgaactgaactacaacaatgaagaacttagatcagagtttgaacatctattttctcacatgacagctgttaataaagatgaaggtggtatgttttttctctatggatatggaggtaaaggaaaaacatacatttggaaaacacttgcaagttcactgagagctgacaataaaattgtaataatggtagcctctagcggcatagcttctctgctattgcctggaggtagaactgcgcattcaaattttaaaattccagttccagtttttgaagactcaacttgcaatatccattaa

SEQ ID NO: 94570 - DNA, 722 bp, Glycine max
  Peptide Sequence Number=SeqID_211348
atggggttatttgaggtaagagcggacgatgcgcatgacctggtcgatttccgcttcgggttcgagcgtggcgccggatcgtccgccctgggcggattgcaggaaggtttcgcgcagatggctttcgagcacttcggccatcagccccgtggccgcgccgcgcagggcggccagctgttgcagcagcgcgccgcattccgtgccttcgttgacggcgcgctccagcgccagcgcctggccctggatgcggcgcaggcgcgtggtgacgcgttttttctctgcgggggaatggggcacggcgggctccggattacacgtggcctctcacccgccccgcttgccgccccaggccagcgccctgccggcgccactctatgcgcagctcaagcagatgatcgcgcagcagatccgtaccggcgcgtggccggcgcattaccgcgtgccgtcggaaagcgagctggtgcaggaactgggttattcccgcatgacggtgaaccgcgcgttgcgcgagctgacggccgagggtctgctggtgcggatgcagggcgtgggcacgttcgtggcccagcccaaggcccggtcggcgctgttcgccgtcaacaacatcgccgacgagatcacggcgcgcggccatcggcaccacagccgcgtggtgcgcctggccgaggagccggcgggcagcgagcaggcggcgggcgctcgacatccgcgaaggccagccg

SEQ ID NO: 94571 - DNA, 198 bp, Glycine max
  Peptide Sequence Number=SeqID_211349
atggccctgaaatctaccctaaggctcatgaaaaccctaaggccttctcttgcatctctggcccaatcttcttggagtcttctatccaatgcccttaggagagttagtggtatcataacgacgaggcgagtcattacagataagggaagcccatatttgccatattcgtccgaggtgatccatattgggataccataa

SEQ ID NO: 94572 - DNA, 545 bp, Glycine max
  Peptide Sequence Number=SeqID_211350
aaatgatgttccgcaacatgcgcagcgtgccgatctacgcgctgacggtggtggtgctgtacgcgctgacgtcggcccgcaccgggttggcgcagcagcgcctggcggcgcggcgttagccgccaacggccgccggcgcgggcggcttgtccgcatgaaaagcaaggcttacgcaacagataaatcgtcacatttcgccgtctttggttgcggacgcggaaggacatcaggaaagagggcctatgaagaattcaagcttgcgcagggagttgctgtggttcgtgctggcgatcggggtcgcggtgctggccctgggtggctgggatgcctgggaacgacgcgccgagatgctggccgagcgcaagaccgaattgcgccacgtgctcgacctggcggccagtatcgtgcgcaatggcaagcaacgcgccgtcgaggaggggctgtccgtcgaacaggccaagcgcaatgtggcgcagcgcctcgcgcagctgcgctatggtgcggacggctacgtcggcgtgttcgacgacggctatgcgttgctg

SEQ ID NO: 94573 - DNA, 228 bp, Glycine max
  Peptide Sequence Number=SeqID_211351
atgaatcacttcttccggaaagttcccggaagaggttttccgggagtcttccggaagacgtttggttacttccggaagaacacttcttctggaaactttccggaaaatgttcttccggaacttccggaagaacccctaacgggtcttctgaaagacttcggcgtcagccttttccgccattttttccgacgtactctcgtcttctcccctctcgtcttctaccctaag

SEQ ID NO: 94574 - DNA, 183 bp, Glycine max
  Peptide Sequence Number=SeqID_211352
atggtgtttagagggccaactatagggggtgagtccaaagaatgtgtgttaagcgcatttagcgatttattcgaacacgggacaccagccttgaagaagggccgagctagcctgacacctatctttaagagcatgtcccgggaacagagcaaaaagaagcctcttgttggggagttctgttga

SEQ ID NO: 94575 - DNA, 294 bp, Glycine max
  Peptide Sequence Number=SeqID_211353
atggctcacataggcattgtgaccatacttataccagagctgacattggaagttcacaaagcggctgcctccacgacctcgaccactgcttccactagcaccggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 94576 - DNA, 567 bp, Glycine max
  Peptide Sequence Number=SeqID_211354
atgacgagtcgtgatcgcgccgccaatcgttcatgtgcgtcctggggaactctcggtcgtcggcaatcgctgacgcaggtcatagccggggaggcttggacctgttcgcgttccatcaacttcaacggagatgcgtcatgtcgaagatcgacaagtctgtgctgcccgtgcattcagcccgtatctggccacccttggcgatccagtgagaagcagggatctgcttctgcgtgggatgccgatcgagtctgtctaggcacagggtcaactccatggaggcgctttcggcaacgcctacggacgcacattgccgtcgctctcatgctcggtgcgggagtgggaaccgccatggtgatgctgtccattgtgctgcaggcatcctccgatccggtcccgggacgcagcgggtcgctcttccgtccacacctggacgtgcgcccgggagcacagcacgcggcggcacctgatcctgggcaggggttgacctggcctgatgccaaagccctgctggaccaaaggtatgcctggaatcaggcggccatggccggtggcccaaaagcctgctga

SEQ ID NO: 94577 - DNA, 396 bp, Glycine max
  Peptide Sequence Number=SeqID_211355
atggccaaaatacaaggcccaaaagaagaaaacaaaacctattctaatatttacaaagaagagtggacccaaccttggcccatgggctcaaaaatctaccctaaggttcatgagaaccctaaggacttctttatcaggtctagcccaatcctcttggaaactcttgctcatggctctggtaactggtcctttcctagtgaggattacatcacagctgctagggttttaagagtggtccggttactattcacagaggcagagattgtagggtttcattttcagttttttcgcgttactgttcacgcgcatggtacgattcattctcatttctgtgttgcaattagtttccagttgatgtatttcatttttgttgttaatggaaggctgaatctctag

SEQ ID NO: 94578 - DNA, 615 bp, Glycine max
  Peptide Sequence Number=SeqID_211356
atgacatcggcagaaatgcagttgagaagggaaaggggcctaagctttacttgtgatgacaagttttcccctagccatcgttgtcctaataagcaacattttgttctacagtgggaagaagaggatgatcctgcattacaaccagatccaccagacgaggttgagacagttggtgaccccagttttcaaattcatcatttgtcttataatgctttaaaaggctcatcaggtcttggaataatgaagtgcagattgggagtgcagattctactagatagtgggagttcagataacttcctccagcctagactagctcaatgcctgaagttacctgtagaaccaattcctaatttgcaggttttggttggaaatggaaatgccttgactgctgaaggattaattcaagacttggaggtgaaaatccaaggtcatacactgaagctaccagtttacctacttccagtttctggtgctgatctagtgcttggggctgcatggttggcaacaattgggcctgatctttctgattatagtactctgacattgaagttttacttgggtaatcaatttatcaccttacatggtgagagaccctccctaccacaacaggcttaa

SEQ ID NO: 94579 - DNA, 664 bp, Glycine max
  Peptide Sequence Number=SeqID_211357
atggccatgcttactattctccttctaagcaaactactttctctcttctctaaatttgcagtcgcaacagataccatcacccagtctgagttccttgaagataacacgaccttggtttcaaacaatggaacctttgagttgggtttcttcaccccgggtagtagtagttccccgaaccgctatgtaggaatctggtacaaaaatattccaatcagaaccctggtttgggttgcgaaccgcgacaatccaatcaaagacaactccagcaaattgagcataaacacacagggcaacctggtacttgtcaaccaaaacaacaccgttatttggtcaacaaacaccacagcaaaagcatcccttgtcgtagcacagttgttagactcaggcaacttggttctaagagacgagaaagacacgaatcctgaaaactacttgtggcagagctttgactatccctcagacacgtttctacctggaatgaaattgggatgggacttgaagaaaggcctcaattggttcctaactgcttggaaaaactgggatgacccttcaccaggggacttcacacggtctactttacataccaataatcctgaagaggttatgtggaagggcacaacacaatactacagaagtggcccatgggatggaattggattcagcg

SEQ ID NO: 94580 - DNA, 963 bp, Glycine max
  Peptide Sequence Number=SeqID_211358
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgccggtgcggccgcgcaggatccgctcgaggccgtcgcgcagcggcgtgcccggtgcgatgagggccagcgtctcgcgcagacgcagcgactcctccgggcggtcggtggccaagacgggtcctctctcgggtgcggtcggcgcagtctatcgaccagtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 94581 - DNA, 129 bp, Glycine max
  Peptide Sequence Number=SeqID_211359
atgtctttagaggttacttcctcgttgacatcttttgttttgaatggaattgccatgacaggtatgctagaagtagtgtctaatccttggaggtttacagtagggaactggttatgtgactcagatctg

SEQ ID NO: 94582 - DNA, 583 bp, Glycine max
  Peptide Sequence Number=SeqID_211360
atggcggataagtttcacattttgcttctgaacggccccaatctcaatctgctggggacgcgtgagccggagaagtacggcagcacgacgctgacagagattgttaacggattggaaaaccaggcatccgcattggatattaccctgagccatctgcagtccaacgccgagcatcagctgatcgatcgcatccatcaggcgcgcggcaacaccgatttcattctgataaatccggcggcgttcacgcacaccagcgtggcgttgcgcgatgcgttgctggcggtgcagatcccgttcatcgagatccacctgtccaacgtgcacgcccgcgaacctttccgccatcactcttatctctcggacgtagcggtaggggtgatttgcggcctcggcgcggatggctacgctttcgctttacaggcagcggcatttctgaactggaaatctctgaaggcgaagaatcggttcgcatcagccgtgccgcaccggcgcaggcttatcccgtcatgcagcaggcctacgcgatgccggcacagcactcagccagccctggctaacgccgttgccaccgcgcctgcggcag

SEQ ID NO: 94583 - DNA, 504 bp, Glycine max
  Peptide Sequence Number=SeqID_211361
atggcggaaaggttcgcgggcgtgcacgttggacaggtggatctcgatgaacgggatctgcaccgccagcaacgcatcgcgcaacgccacgctggtgtgcgtgaacgccgccggatttatcagaatgaaatcggtgttgccgcgcgcctgatggatgcgatcgatcagctgatgctcggcgttggactgcagatggctcagggtaatatccaatgcggatgcctggttttccaatccgttaacaatctctgtcagcgtcgtgctgccgtacttctccggctcacgcgtccccagcagattgagattggggccgttcagaagcaaaatgtgaaacttatccgccattgtgctgcgaagatattcaaccccaaatcgacgaactcggggatccgtgacaggaatatgagcgctggaacacagaaaaagttcccgccggcggcgcgcgttttccgtaccaatacgcgcgccgcgcgtagttcagcgccaccaggcgcggaatttctt

SEQ ID NO: 94584 - DNA, 627 bp, Glycine max
  Peptide Sequence Number=SeqID_211362
atgtcttgcctagtgatcataactctgaccttcctctgccgaagtgtcagctggtgtatgccacctaccaggcacactctagacccggatatgtctaacagggccctgggatttccggcattgatcacgggcctctgtcagtccttcggggttcccgtcacacctagtaaggtgatccaaccgccgatcacccgggccttcattgagaagtattgcatgcctaggcaggcgcagggtgatgcaccacaggccgcagacgcaccgccaccacctcatcaagctgatcctgctgggtcattaggcatggagcggtatctacagcacttggttcgccagcaggcggccaaccaccgggggcaggtgcagatacatgagtgtctctaccagctcagcctcagcagcaggcccagggcttcgttccctttgtgtgtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggcgttggaccttaa

SEQ ID NO: 94585 - DNA, 192 bp, Glycine max
  Peptide Sequence Number=SeqID_211363
atgaacatgctcttgactcgacatcgtttgttctgttccactagaacttattgttttggggacgggaaagcagttgatgatcccccccaaaaatggtatgttgctgccatttttgaaaagattgcaagattaaccgaagtaatgcctaaacccaatgattcaaagaaaagtaaaagatcatggaacaagtaa

SEQ ID NO: 94586 - DNA, 285 bp, Glycine max
  Peptide Sequence Number=SeqID_211364
atggcggttttggcctctgtggtggcagtctcttctccttctgcacttgaaaacaagtttgacggtggaacaacatgcgatgtggcaacttgcgtccatgcattgtggaaacctatgaccatgcatcataatgggcatgatctagtttggcttcttccacaatggtgcatggcaaagtgtgagagaaggtatacgatgacagatgcacatcgatcaacgttggtgctagcaaagcatgagaagaaagggaaggaattgacggtaaggaaagagaaagaaagatag

SEQ ID NO: 94587 - DNA, 186 bp, Glycine max
  Peptide Sequence Number=SeqID_211365
atggatacctcagagccctacacttgggcaatgaagggcatcttgcatgaacctcaaccatacactggggcaatgaggggcaccgtgcatgagcctcaagtgaacatagaggccgatcaaaagttctcccccatcgatgttttcaacaaaaaaaggtggacaagccctaggatttcaatggattga

SEQ ID NO: 94588 - DNA, 1755 bp, Glycine max
  Peptide Sequence Number=SeqID_211366
atgccagtgagacagatgagggagggctcagaacagcacattgtgatcaaaccccatttgcagaaccccatgaatggagctaagaaggttcctagagctgttcaaaatggcaaaggttcaccaccgccaccactgtcacaacaggaactaccccacaaccaaacttcacctcatgcaaggaacaaggggagaagaaggagccgaggtggaggaagaaaatgtgatcaaggagatgttttgatgagacctattgtgactagtggtgttgaaaatggaagcaccatgtgtggtgaaaaagagatgagttaccctacttcaagcaagtcgttgagctttgctcctagacctggctatggacaagttggaacaaagtgcattgtgaaggctaaccacttctttgcagagttaccagacaaggacttgaaccagtatgatgtcagtattacccctgaagtgtcttccaaagcagtgaacaggtccattatagcagaacttgtgaggctgtataaagagtctgaccttgggatgaggcttccagcatatgatggcagaaaaagtatgtacactgcggggccacttcccttttcatggagagagtttaagataaaggttgtggatgatgaggatggagttaatggctccaaaagggaaagagaatatagagtggtgatcaagtttgttgccagggcaaatttgcatcacttgggccagtttctggctggtaaatgtgctgatgctccacaagagacactccaaattcttgacattgtattaagagagctatcatctaagaggttttgcccaattgggaggtccttcttttcacctgatattagaacaccacaacggcttggagagggtttggaatcatggtgtggattttaccaaagcataaggcctactcagatgggtctttccctcaatattgatatggcttctgctgcgttcattgaacctcttccagttgtggaatatgttgaccagctattaggaaaagatatcctgtcgaggcaattgtccgacgctgatcgcattaaaattaagaaagtccttagaggtgttaaagttgaagtaacccacagagggagtgttagaagaaagtatcgagtttctggtttgacttctcaaccaaccagagaacttgtgtttcccgttgatgagaattcaactatgaagtccgtagttgaatacttccaagagatgtatggtttcacaattaaatattctcaccttccttgccttcaagtaggaaatcaaaagaaagcaaattatttacctatggaggcctgcaaaattgttgagggacaacgatatacaaaaaggttgaatgagaagcaaatcactgctctcttgaaagttacttgtcaaagacctcgcgatcgagaaaatgacattttgcagcttaaatataacgaaagtgggaaagaaaagaattgtttaccccaagttggccagtggaatatgatgaacaaggaatttaatccagagcctgttatccccatctacaatgccaaatcagaacatgtggagaaagctttgaagtatgtttaccatgtgtcaacaaacaaaacaaaaggaaaggaattggagcttttgttagcaatattgcccgacaacaatggttctctctatggtgatctcaagcgtatttgtgaaacggaccttggtttaatttctcaatgttgtttgactaagcatgtctttaagatcactaagcagtatttggctaatgtgtctttgaaaatcaatgtcaag

SEQ ID NO: 94589 - DNA, 576 bp, Glycine max
  Peptide Sequence Number=SeqID_211367
cgggctaacctgacagccggggtgaagcagccagtgattgaggagaaagaccccggttttgcggctttgtttggcatgctggaaaccgctacaggcgagtccgcccaatggccggagttcttgcggttgcgtgccggcagtgtgcatcgggcggatggcggtatgttgttgctgcatttgcgcgatttaatgcaggacgagggcaatggcagcgctttgctggaaaaactctaccgtttcatgcgtaatcacgaagtgcagattgaggattgggcaaaccatgcccagcaaggtgctggtggcaatcgtcatggcacattgccagtgcacgtgaaaatcgtcatgattgccagccgtgaggattattacgattgcctggaagcacagccagacttttttgattttttcccgatcaaggtcgagtttgaagatagggtttcaagccacactggacaattatgcttggattgccggatacattgcacgcaaatgccagcagcaatttatgcacaggatagaagaggaccaggggcgtatcagtacgcgttttgcgcatctggatcaactgatgcatga

SEQ ID NO: 94590 - DNA, 861 bp, Glycine max
  Peptide Sequence Number=SeqID_211368
atgggaggtagaaacaccgttctggttgatgctgtaagctgtagaataccattggttagtgacataccaactataatatttggagcggatgttacccatcctgaaaatggagaagactccagcccttcaatagcagctgtagtagcatctcaagactggcctgaactgacaaaatatgctggtttagtgtgtgctcaagctcatagacaggaactcatacaagatttgtacaaaatgtggcacgaccctgttcgtggcttagtcagtggtggtatgatccgagatttgttgatttcctttagaaaggcaaccggtcagaagcctctaaggattatattttataggtatgcatgcgcttctttagaaccaaactatcaacctccagtaactttcatagttgtacaaaaaagacaccatactcggttgtttgcaaataaccacagggacaggaacagtacagataagagtggaaatatattgcctgggactgtagttgattccaaaatctgtcatccaacagaatttgatttttatctctgtagtcatgctggcatccagggtacgagtcgtccagctcattatcatgttctgtgggatgaaaacaacttcacagcagatggaattcagtctttgacaaacaatctctgttatacatatgccaggtgtacacgctctgtatctgttgttcctccagcgtattacgcacatttagcagcttttcgagcacgtttctatatggagccagacctgcagcaggagaatggctcctcaggtggtggctccagggcaacaagagcaggtggagtcaagccattgccagccttgaaagaaaatgtgaagagagttatgttttattgttag

SEQ ID NO: 94591 - DNA, 324 bp, Glycine max
  Peptide Sequence Number=SeqID_211369
atgagggttcactgtaatcaagcaagtcggagacctagcatgatcacagattcacctccactccttatgttcccacgaacccgggaaaagaaaagggaacaaaggagaagtcatggtaaggaatgcacactgattgattggcctaactctctaaaaacagtcctcagtggagtcgccaactgtcgcaacctacccttcggcaggaaggcgacgcgagactcatggcagagttttccaagaaaggaatacgcgcagagtcgccacaaacgtttatttgaggaaaacatcggaaaaactggaaaatatgtggtctacgtactttaa

SEQ ID NO: 94592 - DNA, 315 bp, Glycine max
  Peptide Sequence Number=SeqID_211370
atggctacattgcatcttgttgacataggaaacaacctcgtaggttctatcagattgaatgactttcaaatgtcattgaaatggagcaacattggcaatctgcgggtgtacctcattcagccagttgtgtggacgcttattgaaactgtcttcttgccatatgcaaatgcacgtctgagtaaagggttacctttgcccatcattcatggtttcaccttacaaaatgcagagataatcttgtcaacttcaagaattgcagtttgcagcgatgtagcttttgcagattcaaacaagcgttttcttcaatttcattga

SEQ ID NO: 94593 - DNA, 969 bp, Glycine max
  Peptide Sequence Number=SeqID_211371
atgcaaatttctcttagcaatttagccttcaagacccctcaactcttcccaatacaccaccccattttccctccaaagccaccactgaaccaccaagtttcaacgcagagccatgtcaacaatgtcctgaaaggttcgtcggggtatttgtccgaaatcagcaaagtgattgatcacgaagaacagtaccgggtagcccggtcgcaggttagccgtaaagttttggacttggaaggttattccatagagggtctttcagttggaggccaagagacatgcatcataatccctgagttcaagtgttcttttgatattgggagtggtaagttgatggcgtacataggcatgttgaatgccaattcgattttggagaagggagggctgccaatgtatgtagctagccgtggtttgttcaatttgaaacctccaactgtgtttgtgcctccttgcatcaaagaggatgtcgagaagctgcttgatattcacagaacaatgggccaagttgaattgaatgctgaagtggttgctttggatgtgggtatgtttcatttgtctttcgttaatgatcaggaaatatcttcaaggaatgacgtgcaaaatttcattttaggggagacgtatgagatacggaataaccttgttgtccgaccattcaaaacacaacatgttatacccagccagggttatgtagtctactcaatcaggaagaagttgaggaaacagtatgcacaccttaatgggaaacaaattgagaaattgaagaaatcaggtgttgagattaccgacatgatattatcgcctgaggtggccttcaccggtgatacaacatcggattttatgcttgacccgtgtaatgctgatgcattgagagcaaaaattcttataaccgagataggcatttacatttttgatcctcaggatattcgtcaagctgcatcaaaattgcagtccaggttgtccgctaaagtg

SEQ ID NO: 94594 - DNA, 294 bp, Glycine max
  Peptide Sequence Number=SeqID_211372
atggggatcgcacccacaagacacccagtggacccggaaaagtccaacagggccctggggtttccagctctggttacgggcctctatcagtcctacaggatgcccgtacccccccggcaaggttatgtcatcatagggatcgcacctgcaagacacccagtggacccgaagaaagtacctgtaacctccagcaagggcatcaggccccctgctgatcgagctttcatcaagaagtactgcgtccctaggcaggcgcagggcgaaacaccacagcagcattgggatggccggtag

SEQ ID NO: 94595 - DNA, 207 bp, Glycine max
  Peptide Sequence Number=SeqID_211373
atgtcggagaagctatgttacgcctgcttcgcaaccgcgtctgatggttatggcagcaaaatgctcaacgacttcaagaatcgcctcgtctcagagctcaacaacagcaaaccagtcatattcaaaggacgttgcggcaccttgaaaaaattaatggctgaagaacatgatcaagttgaaaatattacggaagtcaactcaagctga

SEQ ID NO: 94596 - DNA, 1092 bp, Glycine max
  Peptide Sequence Number=SeqID_211374
atgggtttcacaggggagttggtaagaagtgtcttctccaaaaatcgttctgatgggtctcatgaaaacaaaagaatgattcagcttcagttaagagctctgaagtcacggtttcacagtccgtacatgagggcttgtttaaacgatgaaggagacactgaaagtgaagaaactgtggagaatgtagcacagaacaggccaagttcaaactccaaaaagtcattgaatgaggaagaagcagctgttcttattcaatcagcatttagaggcttcctgttgaggcgtcaaaatggagaaatcaaatcacaaactggaaaagatgagttcaatttagtaacagaaagtccagacaaaaagtccataggcacatcaattgatgtccaaacctcaaactctacggaagttttctctgtcgaaggagaaataaagggcatttgccaccgtattcagcgcaggaccagaactcaagcaataaagcaaaaggaagattgggatgacagcacagtaagtagctatgtttcaaaaatgaggatgcagaatagaatggaggcttcaaccaggagggaaagagcactggcttatgctttctcacaacagctaagaatctgttcaaagaggaaatctccaaaatttaacagcatggagtcaaatatgagttggagttggcttgagcggtggatggcaacgcgccttccggagacatcatcagttgaaagccatgccatgaagcagtatgacccttctaatggtagtcacaaattcacaatcatgacaagattttttgatgctgctggggaagaaaaggagagctgcgggtcaaatgaagtgccccttcattttgataactattccatcaattcacgagaagaaaaagttagcttcaaaccacatacaccaaagaccaacttcaaagctaggagaactgtttcaaggcggaaaacagtgcctagttatcaattccatgaagagcagccaaaggtaagcaaaagagatggttcaggcgatgctagcaaggatattaagcaaaaacaaaagcaagtgggaagcaggacagaaattgcattaagcacctcgaaagcttctaatgtgtaa

SEQ ID NO: 94597 - DNA, 1311 bp, Glycine max
  Peptide Sequence Number=SeqID_211375
atggcacctttctttgttctgtttctattagcctcttcattgactcaagggtatgctcaatttcaaccaaaaaacgaagcttttatatccttgttgattacccaaaatggccttgactttgtgaaggagttgctggtgaacaaggcaatttcctcactggtctcacttcgattgccgaatattgaaaagactgcgaaaatcccagttgtgggtaatgtctacatggtgctctccaacatcacaatttatcatattgatgttccttcctcgcatgtcaagccaggggagacaggaatttccattatagcttctggggttacttgtaatttgagtatgaattggtattactcttatagtacatggcttgtgcctgttaagatctctgacagagaaaggaatttgattagtgctactgctggaaaggttgaaggcatggaagtaggacttacattgggtttggagaaccaggaagggtctttgaagctgaaactcaaggactgcgggtctaatgttaaagatatttcaataaaattggatggaggtgcatcttggctttatcaagggatagttgatgcttttgaagataaaattggttcaacagtggaaaatgctatcgccaagaaacttacgaaagggatttcaagccttgactcgtatttgaaaagtcttccaagggaggtcccagttgatgatcatgcttctatgaatgtcacttttgtcaatgatgttttattcagtgattcatctgttggatttgaaaccaatgggttatttatagaaagaaagatttccttacctattcttgacctcgaccacaagaactcgaaacttccaattttatgcacaaattcatcaaaaatgctagggatcactttagatgaggctgtttttaactccgcaacagccttatattatgatgcaaaatttatgcactggattgttgaccaaataccagatcaatctctactgaacactgcaggatggagatttattgttccccagctgtacaagaaatacccaaatcatgacatgaacttgaatgtatctttatcgtctcctccagttgtggagatttcaaatcagaaagctggtgccaccatatttgcagacatggcaatcgatgttttggaagaagatgaagtaataccagtggcatgcatatcattggctggtgtggatgtaaaatggagttcagcaagcttaattgtacaacattgggctgctctctttaatactctcttttttctattaacagaagctaatccatatcagtctttgttagtactgtcatttatcttaaaacttggctaa

SEQ ID NO: 94598 - DNA, 714 bp, Glycine max
  Peptide Sequence Number=SeqID_211376
atggcggacaccgaactttccaccgcttgtgtggatcgtctcgaggccgccatggccaaactcgctgcaattcaaacttccactgctgcagaccaaacttccattacttccaaacttgatgtcattattcggatattgaataccatggtacctaaacaaccttctccatcttctgcctctgcgaagtcaccacccatgccgcctctgcttcctaagacaatcaacccaacttcttcctctgctaagccaccaccaacagcagaaaccacgtcgcctccaccaactgcagaaaccacgttgcctccctttcccatggcaactttccaccttcccgttaacaagcaccacgcactcttcttcgaatccctcccggtcgccagtcatcggtcccacacaaagtcctctagtcgtggcatccttccctctgacatccacttctccctttctgttgtgtgtgctgccacgatcagggacacaaatctcaaccaccccttcctcctcctcatcttcgtcattctcgtcactgccaaagggctctgtctccacaatcatcttcaggcactaattcttacacccattttcatttgggatccagatgctctgtcatggaaacctgtcattggggtagttatcattctagtagcggttattgtagtggttattatagcggttattgtaatggttattgtagcggttattgtagtgggaatgtag

SEQ ID NO: 94599 - DNA, 408 bp, Glycine max
  Peptide Sequence Number=SeqID_211377
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgactttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctgga

SEQ ID NO: 94600 - DNA, 882 bp, Glycine max
  Peptide Sequence Number=SeqID_211378
atgtatgcgcagggcgaaattgaatatatgcctgctgagtttcatgcggaacaactgaccagtgcctgtctggtgattgcggcgaccgatgatgaagcagtaaacgaagcagtgtctgtcgctgccaagcgcctgaatatcccggtgaatgtggtggatgcaccagcattatgcacgtttaccatgggttctatcatagaccggagtccagtggtgatcgcagtctccagtgaaggcaatgcgccggtattggcgcggcatatccgcagcaaaatcgaaaccatgttacctgctgcctatggccgcattgcggcgattgcaggtgagtttcgtgaacaggtgaaagtcaggtttaccaatgtgcccgcgcgtcgccgcttttgggaagaggtgttgaacgggcctttggtggagcgcgtattgtctgggcaggagcaggcagcacgagagttactgggtgagttattaagtcagcgtgaggatacgcccgtgcgcggtgaagtgtatttggttgggggcggtcctggcgacccagacttactgacattccgagcgctgcggctgatgcagcaatgtgatgtctgtgtctacgataagttggtcagtaaagaagtcatggagttggtcaggcgcgatgccgagctgatttacgtgggtaaatcacgagaccagcatactttgccgcaagaggagattaatcagttactggccaagctggcgttggagggtaagcgggtgttgcggctcaaaggcggcgatccgtttattttcggacgtggtggtgaagagattgaaactctgatgcagcatggtgtgccgtttcaggtggtgcctggaatcactgcggccaatggtgtctcagctatgccgggattccgctga

SEQ ID NO: 94601 - DNA, 1617 bp, Glycine max
  Peptide Sequence Number=SeqID_211379
atgcaattcctgaaacttcctcgccttcttatgccatacgtgaggaggatacatcttcattcgcagccattgccgtcacaaagcacctgcaaatttgacagtattgatgatgctgtggctttgtttcaccgcatggtcgatatgcatcccctgccatcgattgtagaattcaccaaaatcttgggaacgattgcgaagatgagatactatgccacagctattgatctttataccctaatggaatataagggtgttgtgccgtttacagttacttttaacatcttgatcaactgtttctgccacatgggtcagatggattttgctttctctgtaatgggtaagattcttaagtggggttgtcgaccaaatgttgtgacttttactacgctgatgaaggggttctgtgttaatgataaaatgctggatgcactatacatatatgatgaaatggttgcacgaaggattcggtttgacgatgttctgtatggaaccttaatcaatgggctgtgtaagagtaagataggaaaaccaagagctgccgttcaactgcttcaaaaaatggaggagagacagttggttaagcccaatcttataatgtacaatacagttgtccatggccaacggaaagaagttacatcattgctgaatgggttttgtttaaacaataaagtggatgaggcaagagaattatttaatgtgatgattgaaagaggtgaacagcatgacatcattaattacaatattttgatgaatggatattgtttaaacaataaagtgggtgaggcaagaaaattatttcatatgatggttgaaagaggtgaacaacctgacactattacttacactattttgatgcatggatattgtttaattgataaagtggacgaggcaagaaatttatttcatgggatgattgaaaggggtttggtgcctgatgtttggagctataacatcttgattaaaggttattgcaagtttgaaagagtgggtgaagctatgaatttacttgaagatatgtttcttaagaatttagttccaaacattataacttacaattctgtagttgacggtttatgcaaatctggaggaatcttggatgcatggaagcttgttgatgaaatgcattactgttgtcaaccacctccagatgtaaccacttacaatatcttgttagagtctctatgtagaattgagtgtgttgaaaaggcaattgcattttttaaacacctcatctttgaaagaagttttgcacctaatgtttggagttacaacatcttgattagtggttgttgcaagaatagaagattggatgaagccattaatctttttaatcatatgtgtttcaagaatttggttccagatattgtaacctacaatatcttgttagatgctttattcaatgggcagcaacttgacaaggcaattgcattattagtccaaattgttgatcaaggtattagtccaaatttgcgaacatacaatatacttattaatgggttgcacaaaggggggaggccaaagactgcacagaagatttccctgtatctttccattagaggttaccatccagatgtcaaaacatatataatcaatgagctttgtaaaggtggattgtga

SEQ ID NO: 94602 - DNA, 1413 bp, Glycine max
  Peptide Sequence Number=SeqID_211380
atgggttcggcgctgtcaacgccggacacggcggagcatctcgtcggaagcttcgtcggcgacgtgtccatccctctctcctctgacttctggcagaagcttctcgagcttcctttcgatgccgaattgccctcccagcgccttcaccaagcttgccagttattggtgcaaaacaaccgtaatacgaggcatcttgccaagattttgttccatctagcatgctacttgcaggagtccatttctacttctggtgtgctgcagctggtttatgaaaaggctgttaatgcagtttacttgacttcagtgttcctaaaacacttgattgaaagtgctcaagatggtgatgtcgagttatacctgtctctccatgatagtgaatcaataccaaaaaatattttgagagatcagaccattgaaaatcttgtcatgcggaatgtgctcaactttattgcatctgtagatgtgagccccaacacatatttcctacatctggagctgcttaattttatgattattgcaatctcaactcagcttctttgtgggccatctcctggaccgaatgatgtgaacccatttcttgatgcagcgatggctcaggatagccatctggttacttcagttgtgtgcaacctgcttctaaattacattacccgtcctcgtgttccatttaatagagcatcttattccatcttttatgatcgaagtcagaatagtgtgctaaagagagttggttctgcagctgcaaatattgtgttattgccattcagttatttgatcagttcaagcagtgaaggttcaagaaatccaatagcagatagcagtcttcaagtgcttcttgttctcattcattatcataaatgtcttgtgagtgagggctactctgtcctaaagaatcaagtatctgcctcttcagattcttcaccaaaagataatacatatttttctgacaacccttactgcagggccttagagcgtgcaattgattgtgaatataaagagggtaatgcacacagtgaccagcatgtaaaattgccttttgcaccgttgtttgatacccttggcatgtgcttagctgatgagacagctgtcctacttctttactcatttttgcaagggaattccacctttctggagtatgtcttagtccggactgatttggatacattgttaatgccaattctagaagcattatatgatgctcgaaggatgacagcttatcaaatttacatgttgttaattatacttctcatacttagtcaagatacttctttcaatgcaggaattcataagctgatattgccaactgttccatggtacaaagaacgtctcctctatcagtcttctcttggttccctcatggtcatcattcttatcagaactatacagtataatttgtctaaacttcgggtatga

SEQ ID NO: 94603 - DNA, 762 bp, Glycine max
  Peptide Sequence Number=SeqID_211381
atggccaacaagaatgatagaatattgcatttacaagggtttagaaaggtagatccggataagtgggagtttgctaatgaagggtttcttagaggacagaagcatctattgaagaacataaggagaaagaagacattaactaatcaacaacaagctcttccaatagaccattgtgttgaagtggggaggtttggatcattagatggtgaagttgatgcattgagacgtgacaagcaagttctcatggtggagctagtgaagctcagacaacaacagcagaacacaagaaacaaccttcaatcaatggaaaataggcttaaaaggactcagaagcagcagcaacaaatgatgaagttcttgacaagggcaatgcagaaccccaacttcttgcaacaattggttcaacaaagggaatggagaaaggatcttgaggaggcagctactttttccaacaagagaataagaagtgatgttgaagaatgctcaagttttgttaaacttgaacatgaggaggagcacaataatgacataacatcatcagagcttgaggtttctgacatggaccttgttattatgaacactgaggaggaggaagagaaattattaggagctgaaattgaaagcattaatgaggaagtactctgggaagagcttttgaatgagggtactgaagaagatgtactaataggattggaagaagatgatgaagatatagttgtgttggctgaggaacttggttatttggcctcaactcccaaataa

SEQ ID NO: 94604 - DNA, 144 bp, Glycine max
  Peptide Sequence Number=SeqID_211382
atgaatcctaacaatgatggtcctatgattcttgtgaaggaagagtttcccgaaggtgtggctattgctccacaaccattggaggggcttcatgagattggtcctccaccattcctcacaaagacttatgacatcgtcgatgat

SEQ ID NO: 94605 - DNA, 264 bp, Glycine max
  Peptide Sequence Number=SeqID_211383
atgccggaaatcaaaaggaagtattgttacgcaatccgcccacttgggtcttccaggatgttcctccagaaggcggttgcttctggaggaagcaacctggctcgcctgggcgagttgggtggcaagctcctcccctattttcctataaatagagggaggagtggaggagaaaggggtttagcccttctggtactttgtattcacttaaaattagggaggaaaattgtttccatgaagaaaatccaagccgaggcgcttcagtaa

SEQ ID NO: 94606 - DNA, 1194 bp, Glycine max
  Peptide Sequence Number=SeqID_211384
aacagcgacagcgataccacgctgggtcagcaggccggaatctgggcgtttaaccattttcgtgatgaggttgccacccgggtggcggatgaagggcagtcgctgctgtcgccttatggccaggcacagatcgatctcaacgtcgatatggagggcaacttcagcggcagcggggcttcgctgctgacgccatgggccgatcgctacaattacctcacgttcagccagctgggcgtgcaccagaccgatgacgggctggtgggcaatgccgggctgggacagcgctgggtggccggcagctggctgctgggctataacggcttcgttgatcggctttttgacagcggcttgcagcgcgcttcgctgggcaccgaggcctggagcgattacctgcgcttatccgccaactactacacaccgctgtccggctggcgcaatcgcaacccgttccagcagcagcggctggcgcgcgggtatgatgtcactacccagggctatctgccgttttaccgccagctgggcgtgtcggtcagctggcagcagtatctcggcaacaatgtcgatctgtttaattccggcaacagctaccacaatccttcagcgctgacgctgggcgtctcctacacgccagtgccgctggtcaccgtatcggccagccacaaaaccagtaatgaaggcgagagccaggatcagctcggcttacgtctcaactaccgctttggcgtggcgctcagtcagcagctcaatccggataacgtcgccgccgcgcgttcgctgcgcggtagtcgctatgatttggtcacgcgcagcaatacgccggtgctggagttccgccagcgtaaaaccctgtcggtattcctcgccacgccgccgtggcagctcaatgcgggcgagagtttgccgctgaaactgcagatccgcagtgcacatccaatcagtaaagtcagctggcagggcgatacgcaggcgctgagcctgacgccgggtgccgatcccaacgatccacagggctggagtatcattatgccggcgtgggatgcgtcgcctgaggcgaacaacagttatcgcctgtcggtgacgctggaggacagcaagcaaaatcgcgtgacttccaactggattacgctgcaggtgcagccgccggtgatgctggagcaggggggcgaaaaccgcttcgacctgctggcgccataa

SEQ ID NO: 94607 - DNA, 357 bp, Glycine max
  Peptide Sequence Number=SeqID_211385
atggagaatgacaaatgcagaagcaaggcactgaaaattgctgcagcctctcaaggtgtgcattcagtggcattagaaggtgaaagcagagatcaagtggtggtgactggagatacaatcgattctgtttgcttgacgaataagtttcgaaaaaagttcagcaatgctacccttataagtgttgcagatgcaaacgcttccgatgagcaacagggtggtggtggaggagaacagaaagttgaaacaactttagagaaaaaattgccaatagcttattgttatgctaactttcctccaccttgtccattatatgtggtagatcatgatccataccccaatacttgctctattctctaa

SEQ ID NO: 94608 - DNA, 216 bp, Glycine max
  Peptide Sequence Number=SeqID_211386
atgagtctttggcgatggggtggtgagcacggcgattcggcacagaccgggacgtccgtagcccctctgcaatcacccgcaactggcttgcccggccgtaaaaaacggccagcgcctcaattgtttaagagcgggctcatccgggagcagagatgtcgtccatctatggtcaaattattaacaggttctaatgcattggcaaacactgacagttaa

SEQ ID NO: 94609 - DNA, 546 bp, Glycine max
  Peptide Sequence Number=SeqID_211387
atttatgtgtccagtattttcgggcaagatgtcctggacatcgtatccgacatcgtggatcctgcagcttcaattcttcatttgacttttatcttgccttgtgcattgtgcagcaactccagtattttcgggcaggatgtcctggacattgtatccgacatcgtggatcctgcagcttcaattcttcatttgacattttatcttgccttatgcattgtgcagcccgatcttattcctttacataacgttggacatcatgtacgagcagttatgcaagtgagatcagcaactttcattatcagagtaatcaagcacagcggtatctgtagtggtaacagcaaaattctgcaagttgcaagtcgtttccaggatgtcaagacatctcaccatcttctatcagctactagtcttttccaagatgtcaagacatctcatgtgacatcagctttctgctccccctgtctccatgcacttactgcagcatcttctattccagtagcttacatcagtcatcagcagcagcagtctccgagttctccattctaa

SEQ ID NO: 94610 - DNA, 276 bp, Glycine max
  Peptide Sequence Number=SeqID_211388
atgttttggacaaagtggttagaagtgatgaatgtgacattgaggaggcagcaaagtatgtacctcaacacagattttgaattcttgaagaaggaggatcataatggtggttcttactgtgggagggttgatatggaatgcaaagagggtatggctgaagtcctaacatctgatcacaagccttctagggaagatgaaagggacaaaattgagactcgggttagcaatcaggaagcaatagatattacttgtcctttctgtgtagggaacaattga

SEQ ID NO: 94611 - DNA, 378 bp, Glycine max
  Peptide Sequence Number=SeqID_211389
atgaagcaaggcgactggctttgcccgaacttctttgaggaaagaatcaaccaattgaaggaggataataatcaccttcctttgaagaagggagactggatatgcaataaaatacaagatgtttgcaatgcaaagaaaggacttccaatcgtcaaattaatcccggggagtggtaatgtgactcaggttcttttcaactatactggtattttgtttcagtttctgtgcatctacatcaatttcagaagaaacatggttttcctgaaatgtgatcatagacgccttatagtgtcaaaggcttcaagctcttcccttcaacctcagccagaagatatagaccacgataagaatagcaaatttgcctttgtggcacattag

SEQ ID NO: 94612 - DNA, 236 bp, Glycine max
  Peptide Sequence Number=SeqID_211390
atggctaatgaaaaagtggaagagaaagtggtgagtgaagaagagaagcataaatcaaagaaacaagccactaacaaaggtaaagttgtagtaaaccatccaccgatggagcaccttccttatctacatgctctgtcaaagaaagataaggaaagacagtacaagcttttcttagacatttttaaacgactgcaaattaacattcctttttctgaggcgttggagcagatgccaac

SEQ ID NO: 94613 - DNA, 568 bp, Glycine max
  Peptide Sequence Number=SeqID_211391
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggttttgcccgtgttggcttggctagggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 94614 - DNA, 2073 bp, Glycine max
  Peptide Sequence Number=SeqID_211392
atggcggaggcagttcttgaagttgcactcgaaaagttgagctctctcattgaaaaagagctgggattattccttgatttcgatcgagacatgaaaaagcttcgcagcatgttcactacaatcaaggctacccttcaagatgctgtggagaaacaattctcagacgaagctataaaggattggctgccaaagctaaaagaagcagcttacgagctggatgatatcttggacgagtgtgcctatgaagcattggggttggagtaccaaggagtcaagtctggtcaatcacacaaggtacaatgctcttgcttatcctcttttcatcccaagcatgttgttttccgatacaaaattgccaagagaatgaaaaggataactgagagattagatgaaattgcagaagaaaggcagaagtttcatttgactaagacggctctagagagaactagaatcattgagtggcgccaaactagctcaatcatcagtgaacgacaagtctatggaagggaagaagatacaaaaaagattgtagacgttttgatggctaatgctgatgcttatcattctgagagtttattagtttatccaatagtaggtctaggcggacttggaaaaacaacacttgcccaactcatctttaatcataagatggtaatcaacaagtttgagataagaatgtgggtatgtgtttctgaagatttcagtttgaatagaatgacaaaagctataatagaagcagcatctgggcaggcttgcgagaatttggatctagacctgctacaaaggaaacttcaagatttgcttcgaggaaagagatatttgcttgttttggatgatgtgtgggatgataagccaaataattggcagaagtttgaacgtgtattggcttgtggggcaaatggtgcttctattttggtcactactcgtcttccaaaggttgcaacaatcatgggaacaatgcctcctcatgaattatcaatgttatccgaggatgaaggttgggaattgttcaaacaccaagtctttggaccaaatgaggaagaacaagtagagcttgttgtcgcagggaaggagatagtaaagaagtgtgggggagtgcctcttgcaataaaagcactaggaggaattttacgcttcaaaagaaaagaaaatgagtggcttcatgatatcaagacagatgaatttggcaaagttagaagtttcaagatgcatgatcttgttcatgatcttgcacaatctgttgcaaaagatatattgaaactagaccattgttatcatctgcaaaaattgcctaataatttgatacaattaaaggcccttcaacaactatctttgaataactgctggaaactatcaagcttgcctccttggataggaaagttgacttccctaaggaatttatccacttactatattggcaaggaaaaagggttccttttggaagaattaagaccactgaagctgaaaggaggtcttcacattaagcatatgggaaaagttaaaagtgtattggacgccaaagaggccaatatgtcaagcaagcaattgaaccgattgtctttgtcatgggatagaaatgaagagtctgaattacaagaaaacatggaggagattcttgaagcgcttcaacctgatacccaacaacttcagagtttgaccgtgttaggatataaaggtgcttatttcccacagtggatgtcttctagtccttctctcaagaaattagtaattgtaaggtgttgcaagttaaatgtgttggcaagttttcaatgccaaacttgtcttgaccatttgacaattcatgactgtagagaggtggaaggtttgcatgaggctttccaacatttgactgccttgaaggagttagaattatctgatcttccaaacctagaatccttgcccaactgctttgaaaatcttcccttgcttcgcaaattgactattgtaaactgtcccaagttgacgtgtcttccatctagcctaaaccttagcagtctagaacgattgacgattgatgcttgccctgagttgaagaagcttacattccccatattagaccatgacgatgaataa

SEQ ID NO: 94615 - DNA, 349 bp, Glycine max
  Peptide Sequence Number=SeqID_211393
atggcatcatgttcacatagagggctgtctgagaagaggttacctggtttactcattgcagtttcagacttcacaggaggtagcagcctttgcaggtcatggtggttacggctcataggttcatccttagatcatgatcctcataggttcacctcagcctggaggctcttcaaaggagttgttgtggcattggctaaagttctcaagtttcatggaaacataaaaatgcttaagcttggttggtgccagctatttatggttctacccggtggtgtagatagtgctgttagcccttgctttgtggcgtcgagccctgactcgatggggcgtgttgcgagtcccacatcgg

SEQ ID NO: 94616 - DNA, 246 bp, Glycine max
  Peptide Sequence Number=SeqID_211394
atggcgagcaaagatttaacaagaaatgagtctggttcagatcatcaatacagtatggatgaatactgcatggcaatcaagaaggtattgagaaaaagtccatccttgcaccaatgtgcaaaggaacaattaggattggtgattttgtctgatgatgaagcactacatgattcggctgaaataattgctgttgaaatggatggagataataaggaagaagattttccctactatccccaaggctga

SEQ ID NO: 94617 - DNA, 600 bp, Glycine max
  Peptide Sequence Number=SeqID_211395
atggaagcgggaactgctctcagtctccgactccacactcgcattcccattcccatcaacactgccaattcaaataccttattattccaacctcgcttcactctttcatctcattctccttcttccttttccgcttacagttacagaggccccacaccaaaacgccccttcctcgccgactgggtctcccaaaacgacgacgtcgttcgcaccctcccaatctacgtcggctctgcctccctcttcgccatcctcctaaaccgctccctgtccggcatcgcccccgtcgtcgacgccggcaggcacgtccccagtctctctctctctctctctctcgctctttgcttagctcaattgattcagaaaatgcacgaaatagaattcctaaattgtggcttattattaggccttgtttggttgtgttcgcagtcccgagctgacctcttgactttgggattggccgttaccaatattttggcaggcctcgtttggctttcagtaaaacctaaatctattactgtggtaaatcctcgaggagttgaatgcaagagtttgtgcgctacactccctgaagttgcacgtaatgagttgctttggtag

SEQ ID NO: 94618 - DNA, 258 bp, Glycine max
  Peptide Sequence Number=SeqID_211396
atgctggttacccacgtctgggccatccaacaagctagtgccaaagaccctggaaggccagtgcacagtgccccccacgaacatacacaacatccaacgtatgaacgtggccaaaagctagtgccaaagaccctggaaggtcagtgcacagtgctccccacgaacatgcacaacatgcacatgccaatgcatttccaacatcaatcaacattccatttccatgtcattcacaacaaaaatatcatctcatctcaatga

SEQ ID NO: 94619 - DNA, 489 bp, Glycine max
  Peptide Sequence Number=SeqID_211397
atgatctcgtgcttagcgtgtggcctcaattcttgtgctctaacagattcccttgtcacgctaagcgtgctgaagctgcacttagcgaaatttccaagactgaaaggaagaatgggaagaaaaagaaacaagcaaccactaagccatcaggtatatcttcttctattgattctccttcaccagaaattgatactatggcgggaataggaggagaaggaaatagaccaccaaggaggactcttggtgactacgcttatcaacaaagaccaaagcattacaacaacatgtttgttcctcctttcagcaacaaggttgtggagttgaagccagcactgcttagtttgattgctgtctaccttagagttttcccattctccttggcaggtactatgatgtctaagagcccagaggaagcaattgcaatcattgactccgttgcagctagtgattatcagagtcaccatgataggggttcaattcaaagaaaag

SEQ ID NO: 94620 - DNA, 339 bp, Glycine max
  Peptide Sequence Number=SeqID_211398
atgcaagttgatgagtctgcgtatgaggaaggcgttgaacagttcttggaatttgcctccgaaagaagtcgactggatgaggatgaaaaatatgagtttgaagaaatgcataaatgtcccaggtgtggggtatcatggcacaaagtaaaggatgataatgagtgcaacagtgttaaaagcacaaagaaaggccccccagcaaaggtgttatggtatcttctaatcattccaaggtttaagcatttatttgctaatggagatgacacaaaagaccttacatggcatgcagatgagagaaattgtgatggaatggtctgccatccgactaattcctcctag

SEQ ID NO: 94621 - DNA, 780 bp, Glycine max
  Peptide Sequence Number=SeqID_211399
atgacccttttccatcactacgctctcttggatagcaacagtttaaatactcctgacgaagacatcgtcgaacaggttgtgaaaagttgcaagggtttaccacttgccattaaagtgattggtaggtcactcagtcatcgaccttatgagttgtggcaaaggatggtggaggaattatcacatggtcattctatacttgattctaacattgaattgctaacttacctccaaaaaatcttggatgtcttggaagataatacagtcatcaaagagtgtttcatggaccttggcttatttcctgaagaccaaagaattcctgttactgttctaattgatatattcgcagagtcgtatggactagacgatgatggcatagaagcaatgaccatcatcaacaaattagagtccatgaatctggttaatgtcttaatagcaaggaaaaatacaagtgacacagacagttattactacaataaccacttcatcgttgttcatgatcttctaagagagcttgcaatttatcaaagcgcccaagaacaacttgaagggagcaaaagactgattattgacacaaaagaaaataaaaatgaatgggggcttggcgagaagcaacaaggcatgataagccgaatattgtcaaattgttttagatattgttctaaacagaaacccccacagatccatgctcgcacattgtccatatccattgatgaaacttgcaattcgcattggtcacacatgcaaccagctaaagttaaggttctgattttaaatttttga

SEQ ID NO: 94622 - DNA, 198 bp, Glycine max
  Peptide Sequence Number=SeqID_211400
atggatcaagttcaacgtcaagcttttagcaagggactttcagttagcaccaaccatagaggagttcgaagggatcttagaatgcctgataggaggaaggaagccatacctcttttctgggtactatccttctatggggagaataacatcaatggtcaagatcttggaatgagaattagattgagtgaagcaaagtag

SEQ ID NO: 94623 - DNA, 777 bp, Glycine max
  Peptide Sequence Number=SeqID_211401
atgttgataatcattgatcaatataaagagaaggtgaacctagctgctagtcatgggcaaatgctggaagatgaacaggcaaaggtgtcgaccttgcgggttgaaagggaagcgagagaaggggtgatagagttattgcataaagaagccatgaaatggatggatagatttgctctctctctaaatgagagtcaagagcttccaaggttgttagccaaagccaaggcggtgcctgacacatactctgctcccgatgaagaagttcaagaacagatgaaggccatgaaagaccaaatgaccaccatgatgagtatgagaaaaatgatggaggtcaacaaggctacagtccttgccacaagtaccgccattgaggtggactcgattcacccatctggtatcaatcaagtaaatcatgcagtcctggatatgataggtcagggaggcgaagcattgggaagtacgggcaacccccattttgtgcaggtccagagcaagcatcccttctcaccatatggcttgcctcccaactatgcaccacccaatgttgcacatgcgcccgatgagaatgtcgacaactctgctcccatacccattaagagccaacaacctcagtctggtcatgcaaatgtctctcaacctatgggggagacacatgaagtaccccgagaccacactctggtcgacttcgagcctcacctcggatatgccactgaggggcaagcatttggtggcatacccttgccaaacactttggggggccctcagtatcgcccataa

SEQ ID NO: 94624 - DNA, 336 bp, Glycine max
  Peptide Sequence Number=SeqID_211402
atgcgtgttgggactcacatgctgactgctaagatcatgaatatttttggtatgagcggcatgaatcatagtggacgtgtttttgctcctcccaaactactgacaaggtcgaaagataaggggaaggcaaaggttgatcaacaggtagcaaaccataggggtcgaatgcagttaaatgactgcttctatcagtatacactgcaccagcatcgccaggaccctaacccttacccatggcctactcttgagaagttcagagccactgttgcatggcctggggataggtccaattttcaggatgaggcaggtcctacagatgctcaaggagctgcctaa

SEQ ID NO: 94625 - DNA, 258 bp, Glycine max
  Peptide Sequence Number=SeqID_211403
atgttgctcaaagaaagcatttccgatgtgcagaagtgttttagacttgtggtgaatcatttgttggctctaggaaaaacatttgaaagagagaagctcaatgtaaaatttctaaatgttacgctttttggcaagctaagagagtgcgagttagagcttgggagacttaatggtgaagaagaagttgacaagaagaataagggattggttctaaagacaagcacttcacatcacgaagctagtgatgaagattgttaa

SEQ ID NO: 94626 - DNA, 1371 bp, Glycine max
  Peptide Sequence Number=SeqID_211404
atgccgattagtgttaatttcggcgatgtgcgcaccgataaaatagatgggaaagcgtatcagcaacctgtgtcatttacgctttcctgcactaatcttccctctaatgcgcttaaactccagctacaggggaatgcagccagctttgatagcggtgcgttacgcgcatcagtcagcggtttaggtattgcgttttttaagtctaacgctgaaagcggcaacactggtagtggaactgcaataaatgaaacgtacgtggttaatggcactattgctgcccgctatgctgaagctaacttcagtggaaaacttatcgagccgccgttatgtcagattaacggcgaaaagccaattatggtggagtttggttcagtggttatttcccaaatcaatggcgacagctacagaaaacctgtctcctggacgttaacctgtagcaataatcccgataagagtatgcgtgtacaaatcagtggcaccggaagcgcatttaattctgctttgctggcgaccagccagcgtgatttggcgattcagatattaagcggtaaaaatggcgaaaacgccctggcactgaataactggctgccgtttacctttcctgcgctgcccgtcattcaggtggtaccggcgatggaagccccgcgcgtggatggcattcgctgggtcaacgcaagccaggttgaaattacctggtcagtggtggatgtcggtatgatatccggctatgcccgctgtaactcttcagagagaacctgcgcagcaggcatcggtgtcagcgcctggtttatcgggcatggcaccgtattcagcgctgcgggcgggccgcaaatttacgtcgatcagggcgagagcctggcctcggtggctgaacgttttatccgttttaatggtcggggtggcaagtttctgcgtaactcagatacccgttattacagttcatactgcggcagctttgtgacagcctccgcgaccgtaactgactattccggaatggttgcgccctgggcaccttgcgtcaacattccggtggtgccggtatcctgttcggtaagcggagccgcgctgaatattaatcatggtacgctggccccggccgccgttaatggcgccaaagccagcgttaacttctcgcttttctgcaaccgtgatgtgaatatcagttttgcgcttgccggtgggatcaatatcctcaaactcagcaacaacatcagtacgctgttatcactggctgacgggagcctgaataaaccgcaattagtgcgggctaacgtgacgacgccgttcacgctgatttcgacgctctcctcaacaacccccagtcccggtaactttaccggcagcacggtggttttcattaattacctctga

SEQ ID NO: 94627 - DNA, 243 bp, Glycine max
  Peptide Sequence Number=SeqID_211405
aagcattacgggtgtcccggaagccccggaatcccattttcaacaaaacggggggtgtggtggccacctagcttgcccaggccagctcagctcgcccaggccagctcagctcgcccaggcgagctaggttacttcaaccttaagcaagaaattgcccagaaacctctagaacagcccagattcaaaaatcactatttgcacccccattttactaactacaccccctttggcttttttttgtga

SEQ ID NO: 94628 - DNA, 379 bp, Glycine max
  Peptide Sequence Number=SeqID_211406
actcgatggtggaggacgcatgaatagcgctaggcaatcaattcatgggtctctgaataagattgagaatggagaattggggaaccgcgctaggcaatcaattcgcggggctccagactcgatggtggaggacgcatcaacagcgccaggcaatcaatgcatgggtctccgaataagattggagattggagacttggcgaacagcgctaggcaatcaattcgcgggtctccagactcgatactcgatggtggaggacgcatgaacagcgctaggcaatcaattcatgggtctccgaataagattgagaatggagatttggcgaacagcgctaggcaatcaatttgcggggctccagactcgatggtggaggacgcatga

SEQ ID NO: 94629 - DNA, 173 bp, Glycine max
  Peptide Sequence Number=SeqID_211407
catgcgacccccgtttgaccacttcaaaatgtttaatacccatttccatggaatccgtaaagttctagaacgtttcggaaagaaaacagccaaaaacacaaaagtggggggtgaacttatcaaaaaagggggtgcactcaggaaacttcatccagaacatcctagaagtaggg

SEQ ID NO: 94630 - DNA, 380 bp, Glycine max
  Peptide Sequence Number=SeqID_211408
ccttcactcttatcaccaagaagccaaactctgcaatacttgccaaagagcttgaacatcgaaatcatgcgaataaggtatgtcatcacacctttcagagtgcattatctgacgagttgttcaatgactattgttcctacaaggaagcaaaggagatttgggactcctttgttctgaagtaccctactaaggatgtggtcagacaatggttcatcatcagcaactattatcatttgacaatgatcgaggataaggacatcaaggtgcaaatcaacaaataccacaacttgttggaaaacacaaccctgcctgatgaatttgttttcaagcttctggtcgagaaacttcctgaatcccagactagttacaacaatagctga

SEQ ID NO: 94631 - DNA, 450 bp, Glycine max
  Peptide Sequence Number=SeqID_211409
atggtacaagacaaacccactcagaataggaaccgtgtaatgaaaaatgtcaatcctcctaagcccagggctaacttggctgaaggagatgacatgattgttgcggtcatttctcaggtcaatgttgtgactagtgtgacgaaatgggtggtagactcaaaggctatcaatcacatatgtgctgatagaagtgcgcttacctcctacactgttgtggggaatggaatagaacaagtttatcttagtgattcccggactactctagttctaggaaaaataaaggtttttctcaagcccacatctgggaagacactggatttgagtgatgcgctacatgttcccaccatcagagtcaacttggtctctatattatcattgcggaaggttggggtgaaagtgtcatttaagtcaaacaaaattgttatgactaagaatacaaaattgttatga

SEQ ID NO: 94632 - DNA, 348 bp, Glycine max
  Peptide Sequence Number=SeqID_211410
atggcagcggaatggagaaggaagagagagaggagacgccacttcaaggagaagatgagtctagaagaagctcaccaccataggaggctatggaaaagagcttggaggaagaaggagatgaatgaagggagagggagagaagagcacaaaattttgtgctctaaaagagctctgaaatctgaaagaattggatccaaacttggcccatgggctcagaaatctaccctgagattcatgagaaccctagggcctttttcagcagctttagcccaatcctcttggagcctcttgctcatggctctagggactggtcccttcctagggagaattgcatcaacaagtgtatga

SEQ ID NO: 94633 - DNA, 264 bp, Glycine max
  Peptide Sequence Number=SeqID_211411
atggagcttaatgataatgatgtggtggagaaaaatgatgcaggtatcattgtggatgaagatgatgatatcattaaaagtgtaatatcttccattgataaagagattgtttctagtgatgagaaggataaggaagtagcgggtaacgctaccgaagggacttgtgcatgtgagaacttgggtgaattcaatagatttgcgtatttgaatgagattggttgtgtgacattctttgatgagattcaagaatatgctcatatctag

SEQ ID NO: 94634 - DNA, 456 bp, Glycine max
  Peptide Sequence Number=SeqID_211412
atgatgcttgatcagctagaactgacaaagattttccacaacgaaggtgcagttttccattacgagtccacaaagttgaagaccttagaactatacaaggagaacctttcgaaggtgggagatgagaaggttgagtacaacttcctttgcaaggaagcaaaactcaagaagaatatttgtaacaagagcttgctacacaacaaagtggacaagattatgcaagagaaagctaataagaagaaaactagaagccaggctcaacaacaagaggaagagttgatcaaaaaagagaagaagactaagaagaaacatgaacaagttggtgtgtccaatcctcctgagattcaaagtgatgtagctctatgtggagcttgcaggtcttggatcttcttcatcaatggagtcatttacttcttgaagatgaatggcagcagaatggagaaggaagaaagatga

SEQ ID NO: 94635 - DNA, 285 bp, Glycine max
  Peptide Sequence Number=SeqID_211413
atgttggtggcgactccgcacgtattcctttcttggaagacgcacccacccttgatgttgttacaccttgatctatttggtccaaccagcactacatccactagtggaaagaagtatggacttttcatagtggtcggctactctagattgatggaagcttgcttgtggggcttctatggaggctggatctttgagcttcaatggggtcctttaatggtgattttccaccatggagatgcagcggaagacaaaggaaaagaggtgagaggaggcgccatccattaa

SEQ ID NO: 94636 - DNA, 261 bp, Glycine max
  Peptide Sequence Number=SeqID_211414
atgtggggcatcccttttatccttgaaccaaaccaagccctgacatgtatcatgtctagccattctacgagctttgagccaaaatcccgactcatcataaaccttgacccagggggagatgcttgccgcccagctcgcccaggcgagctcagctcgcccaggcgagcagggttgcttcctccagaagcaaccgccttctggaggaatcttctggagggcccaaatgggcctgggtgctatttgcacccccatttttactaa

SEQ ID NO: 94637 - DNA, 420 bp, Glycine max
  Peptide Sequence Number=SeqID_211415
atggaaaaggagaatttatgtctgtatggattccccactgaacaatgggaagtaaatttgcctgctgaagaagttcccccagaacttcccgagccagcactgggcataaattttgctagggatgggatgcaagaaaaggactggctatctttagttgctgtacacagtgatgcatggctacaatcagtggctttctactttggggcaagatttggttttgataaagctgacagaaagcgcctgttcactatgattaatgatttgcctacaatatttgaggttgtaactggatctgcaaagaaacagacaaaggagaagtcatcagagaacaatggcaacaaatcaaagtccagttcaaaaggggtccatatatttggtctgagtagaagtgggaaatgtcttattatcataatatgctaa

SEQ ID NO: 94638 - DNA, 186 bp, Glycine max
  Peptide Sequence Number=SeqID_211416
atggctagtagaatgatgaagaaacacatgacagagaatgcaatgcatgatacgacattcaaaagttggacatcagtggaaaacagagtgagagagtgcggtgaggaaagagatggattgggtggtggcggagggtcaccggaaggaccgtggcggtggtggcccggcagtgttggtggaggatga

SEQ ID NO: 94639 - DNA, 811 bp, Glycine max
  Peptide Sequence Number=SeqID_211417
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggacggaggagctaggttagccgaaagatggttatcggttcaaggacgcaaggtgccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatca

SEQ ID NO: 94640 - DNA, 744 bp, Glycine max
  Peptide Sequence Number=SeqID_211418
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaacgggacgtggcggctgacggcaccctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 94641 - DNA, 426 bp, Glycine max
  Peptide Sequence Number=SeqID_211419
atggctccgaaaaagatttccatgaagaggtctaggagagacgccgcgacgaaagggtccagtgccgcccccgagtttgatagccaccgtttccggagcgccaagcaccagcagcgcttcgaggccatcaaaggatggtcgttccacagagagaggcgcgtccagctcagggaggatgagtataaaaattttcaggaggagatagctcgcaggcattggacgtcactggtgactcccatggctaagtttgaccctgaggtagtcctggagttttatgctaatgcttggctcacagaagagggagtgcgagacatgcgttcatgggtgaggggtcagtggattccctttgacgcagatgccctcagccagcatgaccaccttgacccagacgtggatgacactgctgctcagcaatgtcctgcctag

SEQ ID NO: 94642 - DNA, 219 bp, Glycine max
  Peptide Sequence Number=SeqID_211420
atggtaacaaaaggtggggtggtcgacaaaaatggtgcttttgctcctacgtatcctcaatttgacatgaggaactcagacatgaccacattggtctctgcttgtcaatcggacttggggtctccgaatgacgaggtgcggataaccgcaaggtgtctccgcatgccaatggactcacaggtcacaatagcgaaaggtagggcggtcgacaaaagctag

SEQ ID NO: 94643 - DNA, 336 bp, Glycine max
  Peptide Sequence Number=SeqID_211421
atggaggcatttatggcccaggtggcctggcttggagtccagccttctcctttggggggaggtgaggctcttatagcccaggagccacagccagaggcacagccacagtcggaggtgacacctgaggccactccacagacttcacctgctgccacaccattagtggaggtttcagaggataaggacggcattgcagacattgattatgcagctgatatggaagcagcgcagagcacttgggattcctggcctattacagctcaagatactccacagccagcccaggatgcttcttcctcaccccatgatgagcctacaccggcgcaggatgattga

SEQ ID NO: 94644 - DNA, 315 bp, Glycine max
  Peptide Sequence Number=SeqID_211422
atgcagcaacagcagcagcaatcaatgcattgcagttcacacaccttcctccctcaagcagttgaccagaggaacaaaagcagcaaagtagctagccttaggggagttgctatcctagcaattacatcaaaacattcaaacaatgcagcagcaatagcaatcaatgcattgcagttcactaacctttctcgtaggaaagattcaaaaattgaagaaatgggatacctgaaaattggccaggaaaccagaaaaaccaaggcagacaatatatggaccagctttctgcgcagaccctgcccaatcaattttcactaa

SEQ ID NO: 94645 - DNA, 945 bp, Glycine max
  Peptide Sequence Number=SeqID_211423
atgcctaatatattcaatgtacatcgaatgtctgttcaggctcaaatccatgaggggggaaacagctcaagatataggaagtttgtagaagaaaaaggtatagtggatgaaacatacaatgaaaacctggttgctttgtttcgggtacaaggtgcaagtctagataatatgcaggccatccaagttgatgaagcacttaagtccaacctattgtgctctattggtgctggtctattggctgatatatatgttggctggaaccaaaataaaattataatcagaataattatttttccatctgttgtgctcgaaacgccaacatggctacctgtttccatgagggaagggaacgagcctgatattttctgggatgctctcggtggaaaagcaaagtatccaaagggaaaagaaattcaaggattcatagatgacccacatttgtttgcattaaaaataatgagagggaaagcatgtctaattgatggttttatttctcacactcatttgttggaatttcaactcaagagacttcaaggtggaagcaaacaaaactggagaaggttaaagactactatgcaaaggtgcaattggactaatttaactggacttgtatgcatcaccccagtagcagggcttgtgcaatcgtgggctgctatagtgataggaatattatctgggagcattccatgggtgactatgatgattttgcataaaaagtcaaccttgctacaaaagaatggaacagagagaggaacaagtctctcaaaaagagggagagagaaaggaaccgagagagttatggaaatggaaggtggtggtgacatcttcctcgactcggatttagtggttgttgaagatactcattcttctcctctcttaattcgcgtctctttctttctctaccttagggtgcacacatttacttggcagtgggcaggttggtga

SEQ ID NO: 94646 - DNA, 262 bp, Glycine max
  Peptide Sequence Number=SeqID_211424
atgaatggcctagatatcaccgattggagcaatgcacgttcaatggtcaagatcccaccgtcaaaatcaacagccaagatcccatcgaatgaacttagtatttcagatgttgcaaaggtcgagcaagttaaaatcggaaacactttagtgacttctttggttgaaaggtggagacctgagtcacacacgcttcatcttcttgttggtgaatgcacaatgaccttggaagatgttgctcatcaactgagtttacgcgttgatg

SEQ ID NO: 94647 - DNA, 618 bp, Glycine max
  Peptide Sequence Number=SeqID_211425
gcgacacagggatccttcgtcccccatggatgtcaggatgttctcaccgctgctattggacatccagagcaccctggacgtgtacgtgctgctggagccggtgtcaccatcaagcaatactttggatcggctccacagacaaaaagtgacgcggcagctcatggtatcattcagccagatgcagtcccagatttagtcccagatgcaatctcagggacttgcactgcctcccgagcctctggttggtccctcagatcctgcccgctggttgccatggggagagtttatgagggatccattgttgttcataacactccgttgttgcctggccaagtaaaggtgggtgtggaggaggttacagatgcagatgctccagttcctatacccacttatgaggtttccttagtggggcaggtcgatgatccactttatctgatgacattgaacatcccagagcttttcttgaggctttaccaggttacatgggatgccaccatgttcgggccacagtccattcagaggtctggtcagtcgcagtttgagtctggaagttacataaagagttggatgcagagttcaaaacgcgatgtctaccttggagcctacctgaatggataa

SEQ ID NO: 94648 - DNA, 645 bp, Glycine max
  Peptide Sequence Number=SeqID_211426
atgtccctcgccttcagagggctacacgccctcgccttcagaggactacacatccaacctttcaaagggctacatgtcctcaccttcatagggctacacaccctcaccttcagagggctacacgtcctccccttcagaggactacacgttgttgccatcagagggctacacgtccccacctttagagggctacacgtcctcaccttcagaggactacacgccctccactttagaggctacatagggatacacgtcctcaccttcagaggactacacgtcctccccttcagagggctacgtgccctcgccttcgtagggctacacgccctcaccttcaaaggactacacgtccttgccttcagaaggctacacaccctcgccttaagaggactacacatcctcccctttagagggctatatgccctcgccttcagaggactacacgtcctcgccttcagagggctacacgccctcgcctttagaggactacacgtcctcgccttcagaggactacacatcctccccttcagagggctacatgtcctcaccttcatagggctacatgccctcacagggctgcacgccctcgccttcataggactctatatctgcgccttcagagaactcaaggtcctccgcccttaa

SEQ ID NO: 94649 - DNA, 267 bp, Glycine max
  Peptide Sequence Number=SeqID_211427
atgagaaaagatttgaataccgtttctgctgttcttcgaaagaaaacaatgcggaagaggataaggagggtggaattgatttcaatcggtgaaatcaaaagaaaattgaaaaagaagaagattgcaagttacgagagtcgatttgatgaagaaatgagtaagataggaaggtttgaaggtttgagaatggaggagcgtcgcaaggaggaagaggctgtgcaggggtttctgaaaaacgtggtatttatagaccaggacgcattgtaa

SEQ ID NO: 94650 - DNA, 228 bp, Glycine max
  Peptide Sequence Number=SeqID_211428
atgaggtggaaggcgtcaatgaccttccagggtctgacaaaaccccatcagggtagggttgtgaaagggagacttagagatttgcaatggagcatggcggttgttcgagaaatgaaaggatggaaacttgcggcggtgactgaaattgggctatttgggatctttaactcaatgtctatgaaactttttcagggttggagatctttgcatcaccgttttatctactaa

SEQ ID NO: 94651 - DNA, 1611 bp, Glycine max
  Peptide Sequence Number=SeqID_211429
atgaatacttgtgcgtcaagggtccttctaaaaccacaaaaaggagagacaactttgtttatcattgatatgacgaaggccaatgtttctctcccaagaaccataaaatgggacgaggtaactcttcctgaaaaatgggtcatggacaaggtcacaccgtcagtccccagacccgctccgatcatagaacaaatcaagcaagataactccgataaggtagaaataaccttcaataggagaaattctttctcatctacgatagaagcctcaagatccgaatacgaatcggcaataagagaaaacctagattacccttggatacaagacatcataggtgatccaacaaccaatgtcattaccaattggcagatcaaagatgatatcaatgaagaagtcacctccaaagacatcaaaagcctaatggaacaggctaattacagaaacaaatatcttcaggtattaggggagtccattaaagcaaaggcatcttctaaacagagaactcatgaagaatctccatcaaatatcctgatagaaaaacccttattcaaaccatttaaggttagtgaaaaagaaaaacaaaagattaggaaactaagaaaacacaaatcccttacagaaggggtaggtgacaacaatagtgaattattaaataaaattgatagtttacttaagttcacccctaaaacacctcaaccttcggaggaatcatccaaaatgagaacaagaaatacctccaaattaattaatgttattaatgaagatagtgaccaaaactcagaacaaacatctgaagaaggctcaatatctggaaaagacattaatccaataaattccaaacattggaaaacaccctctaaacttaattatcaacgaccaatcgccactgacctcctattagaaggaagaggcgaaagtaattttaaaagctttagtgcaaataatttctatgaatggaatatagatgcccaaacaaaatgcaatattatgaatacactccaacacatgaccatggtagccacggcataccagacatcccatgagtgttcggaggaaacaatcatagatatcctagttgcaggattttctggccaattaaagggatggtgggataattatctcactaatgataagaaggagattcatgacgctgttaatacccttatttttacaatagcccagcattttattgatgacccatcactctggaaagataggtcagtagaactattatcaaatcttaagtgtagaactttagcagactttagatggtatagagataccttcctaactagagtttacaccagagaagatagtcaacaacctttcaggaaagaaaaatttctagctggtcttccaagatcattaggagacaaagttagagataaaatccgaagccaatccgtcaatggagacattccatatgagagtttgagttatagccaattaatttcgtatgtccagaaagtagccttaaaaatttgccaagatggcaaaatccaaagacaattagccaaagagaaggctcaaactaagagagatttaggatctttctgtgaaaatttttggattacctgcttgtccaaagcaaaagaagaaacagaatcctag

SEQ ID NO: 94652 - DNA, 701 bp, Glycine max
  Peptide Sequence Number=SeqID_211430
atggtgatacttgttggagaaatgttttgccatgccctacttttcacacattgggacccactgatggacagtttgcgagtggctatatcaagtgtgccttatcttcgggttttgaagggttgtttgagtcttgctcgtgattacaagagaacgcattttgttgtttggctaatgaaggagtttggagttgaaaaatcttggacccagttgctaaatcgaaatgggagcagcctaaatcgtgaaaacgagattgtgggagagttatacaagtgtcgtgctactaggcgaagcagcagagaatgttgcatcctagatggaaagagtccaatagtcgaaagcatcactagcttacgctctgactcgagtagcatgggtgaaaggaacccccatcgttgtaacccccattttgagtcaatgtctgcccaggtttttcttggaagtttggtaaagcctatatctttgaatgactcaggtttgattgagattatttgggtcgatgactcttctatcttgggtttttgggtggatgacccagcctgggttggtgacccagatgttgaggaagaactctttttgacagttggcttaagtagagccagcttaaaaccttttccagtgctccgtcctcttctttgggaggtgtctgatgccttaggtggcatgggaatttttctgaaagaattcacgagtgagatgatcag

SEQ ID NO: 94653 - DNA, 408 bp, Glycine max
  Peptide Sequence Number=SeqID_211431
atgccacctaaggcatcagacacctcccaaagaagaggacggagcactggaaaaggttttaagctggctctacttaagccaactgtcaaaaagagttcttcctcaacatctgggtcaccaacccaggctgggtcatccacccaaaaacccaagatagaagagtcatcgacccaaataatctcaatcaaacctgagtcattcactcaggaaccaccaaaaccttcaacttcaaaacaaacaaaggctgattatgccttccccatagaaacactccaagccttacaagatataggctttaccaaacttccaagaaaaacctgggcagacattgactcaaaatgggggttacaacgatgggggttcctttcacccttccctcacggtactacttcactatcggttacctag

SEQ ID NO: 94654 - DNA, 321 bp, Glycine max
  Peptide Sequence Number=SeqID_211432
atgagatctctcaagggaacaacactaagtgaggcagagcaagaacagagcaatcatgctttaacagtggccattgcctcagcagtagttgctgaagctgttgttactgctgctcatgctgctgctgaggttgttcacctcactgggcaacgcaaggaaaactcagaagaatctcaacctgttcaaactgcatttcgaggttacctggatatgggacgtggttatgccttttctctatggaaggatatggtagaaatgtatgatagaaatgatgggagtaggaagaggatgggttttcagataattgacaccttaacttga

SEQ ID NO: 94655 - DNA, 357 bp, Glycine max
  Peptide Sequence Number=SeqID_211433
atgtctcctccacctttaggacctcacaatcactcacaaactcatctcaagctctcaggacagcttcctcttccagctctagtctctgcagatcttcacacaacaaattctctcaaactctctagaacttggacctttctctctctagaactctccaattatgcttcaataggtggctttgttcgtgctcgtgcgcttagcgcaattctgaaccgcttaacgcacattagtgaatttcgacttagcgcggcttttctcgctcaacggattgaccaaagtggtgcacttagcgatatggaccttcgctcagtgaacaagcacagctcatccttcttccagattcttccttgcgcttaa

SEQ ID NO: 94656 - DNA, 1288 bp, Glycine max
  Peptide Sequence Number=SeqID_211434
atgcgcgacgtccagctgatgtttggccagcaggccttccatctgtaccactggacgctgccgtttcgcgatcggctgggggaagttgccggggtgatcggcggctgggtcgatgttaccgagcgtaacgcgctgctgcaggagctgcagctggccaaggacaccgcagacaaagccaaccgctccaaaagtgagtttctcgccagcatgagtcatgagatccgcacgccgctgcacgccatcattggtctgctggagctggaaacccgctcgcagccgtgtgagacgctgtccgaaaatattcgcgtcgcctacagctcggcgcgcgcgctgctgtcgctgatcggcgatatcctcgatctatcgaagatcgaatctggccagtatcaacccacgccggaaaccgtttacctgccggatgtgatcgatcaggcggtgacgctgtttcgcaacaaggccgaaagcaaagggatcgatctgcgcgtagagatggacatcgcggcctactgggtacagaccgatccgctgatgatcaaccagatcctgtctaacctgttgagtaacgccattaaatttaccgatcgcggcagcgtaaccgtggtgctgatgcaggggattggccaggaagaggaaggttgtgagttcgtcattgaagtgagcgatgacggctgcggcatgaccgaggagcagcagcaggcgatctttgagccgtttgtccaggtcggtgaacgtcagcagcagcagattggcaccggtcttggcctgagcatctgccgcaatctggcagagctgctggatggcgaactgattgtggagagtacgccaggtgaaggatcggtgttctccttctacttccgcgcgccggccggcgaaccgcgcgatcaaacccaaccgcatctgtcacagccgctggtcaccgacaaactgtcagtgctggtgattgatgatcatgcgcctaatcgcctgctgctgggtaaacagctggagctggcgggccatcaggtggtggtgagcgaaagcgccgtcgaagcgctgaagctgtggcagcaggatccgctgcgctttgacctgatcattaccgactgcaatatgcccggcatgaacgggtttgaatttgcccaggcgctgcgccagcatgaacgccagcatcatctgccgccgatcatgctatacggcctgaccgcctccgccgagcagcacatcatgcagcgctgcctgcaggctggcatgaacgactgtctgtttaagccgctgaatctggatacgctgctggcacaaatcacccact

SEQ ID NO: 94657 - DNA, 327 bp, Glycine max
  Peptide Sequence Number=SeqID_211435
atgaggagtatggatagggagttgggacatgctaggtgcacccagcaacattgctggtgcacccagcaattagaagaaggttctttcgaaaatcttccggaagaaccttattccggaagctttccagaagaaccttattccgaaagaacaatttgtgttctaccagaagaaccttcttccggaaagcttcagaaggaaggttcttccggtagaacaatttgttctaccgaaagaaccttctttcggagaagctactggaagaacttcttccgagagctttttcagaagaaggttcttccggtagaacaaattatttcggtagaataa

SEQ ID NO: 94658 - DNA, 564 bp, Glycine max
  Peptide Sequence Number=SeqID_211436
atggatgacagtgacatgctaacacttgttattcaagaaatgagtaaggagtttccaactttaatggagactcttgtgcatgaacgagatcaaatgcttcagttaacacttgtcatcccagtatgttacaatttagcagaggggtctggtgtcttggatatggttatggtattgacatcttctgcatatcctagccaccctaatgatctgaaatccaaataccatggagacgtaaacttcttaccttggccccttcccctatatctggttaaaattagaccctgtgaggagactgttgatgatttgcgatactacttcaaaggatacatgtcctccacattattaaaagtggcgagtgagaatagctcagttgttgctgttgttggaaagggccatctacagggaataaagaagcattggaagcaacctgtggtgatgaaggatctaatgacagttccatctcctaaaccagttgtctctgcaacaagaatcgttacatctgttggtgctgccgtggccggggtgtccattatatcgggcatctatctttcatgcaagaaataa

SEQ ID NO: 94659 - DNA, 273 bp, Glycine max
  Peptide Sequence Number=SeqID_211437
atgatgaaagagaagaaagaattccctaagggagggttctcaggctttaggtccttcaaagctttggttcaaatgttgcttgtgggaagatcaactttgaatctggatgcggtgactgccgctcttagagaaaataagagaatgatgagaactaaaaatgttgatgatgaacaccatgcaatagttgtggtggagtctgagcgagggaggaatcattcaaggaaacatgatgggtcaaaaggaatattaaaatcgcaattgcatccgcaatga

SEQ ID NO: 94660 - DNA, 2625 bp, Glycine max
  Peptide Sequence Number=SeqID_211438
atggctagaaagcagaacaatgaaaacgccttgactatcacttgctgccatctgctggtgcagcagttggaattcgtattggccgagcagcaaatgataagtgctgttgcttcttcctctagctcttcttctatgttgtctcctaaaaaatatgacgtttttctaagctttcgaggtgaagacacacgcaggaacttcactagccatctctatgaagctttgaagcaaaagaaagttgaaacctatatagatgaacatcttgaaaagggagatgaaatctcaccagcactcattaaagccattgaagattctcatgtatctattgtggtcttctcaaagaactacgcttcctcaaagtggtgcttggttgaactcatcaagattctggattgcaagaaagaccgaggacagattgtaatacctgtgttttacgagatagatccatcagatgtgagaaagcaaactgggagctacgaacaagcctttgcaaaacatgagggggaacccagctgcaacaaatggaaaactgctctcactgaagcagccaacttggctgggtgggactctcgaacttataggactgatcctgaattacttaaggacattgttgcagatgttttgcaaaaattgcctcctagataccaaaatcaacgtaaaggactagttggaattgaggaacattgtaaacatattgaatcattacttaaaattgggccgacagaagttagaacccttggtatatggggtatgggtgggataggcagttccttcctctcaaacgtaaatgaaaaatcagacaagcttgaaaatcactgttttggtaattctgatatgagtacgcttcgaggtaaaaaagctctcattgtcttggacgatgtggctacctcggaacatctagaaaaattaaaagtagattatgatttcttggaaccaggaagtagagtcattgttacaactagaaatagggaaatacttggccccaatgacgaaatttatcaagtcaaggaattgagttctcatcactctgttcagcttttttgtttgactgtttttggagaaaaacaacctaaagaggggtatgaagacctatcagaaagagtactttcctattgcaaaggtattcctttggctttaaaagttatgggtgcaagtcttcgtcgaaaaagtaaagaggcatgggagagtgaattgagaaaactccaaaagatttcgagtatggaaattcatacagtattaaaattaagttatgatggcttagatcattctcagaaggacatatttttggacattgcatgcttctttaaaggacgagaaagagattgggtaacaagagtattggatgcttttgatttctttgcagcatctgggatagaagtccttttagataaagctcttataactatttcagaaggcaatcacatagaaatgcatgacttgatacaggaaatgggttgggaaattgttcgtcaagaatgtatcaaagaccctggaagacaaagccgattgtggagacaagaggaagtgcaaaatatattgaaatataacagggcaagtggaaaatgcaatttcttttatttgataaagggaactgatgttgttgaaggcataattttatctttgcggaaattaactgaagctctacgtttgagctttgatttccttgcaaagatgactaacctgagatttcttcaattctatgatggttgggatgattatggttctaaagtgcccgttcctactggttttgagtcattgcctgataaattgaggtaccttcattgggaaggattctgccttgagtctttgccacttaacttttgtgctgaacagcttgtggagctttacatgccttttagcaagcttaaaaagctttgggatggggttcagaatcttgtgaatttaaagataattggccttcagggctccaaagacttgattgaggtcccagacttatccaaggcagaaaaactggaaattgttaatctttctttttgtgtaagcttgcttcagctccatgtttattcaaaatctctccaaggacttaatgccaaaaactgttcatctctcaaggaattctcagtgacatcagaggaaataacagaattgaacttagctgacacagctatatgtgaattgccgccatcaatttggcaaaagaagaaactcgcttttcttgtcctaaacggctgtaaaaatcttaagttttttgggaacgaaattgttcacttactgtcttcaaaaaggttagacctatctcaaactaatattgagaggttgtctgcacttccaccatccctaaaatatttgatggccgagggctgcacttctctggaaacaaacttcactcaacatttagtgttacaccacatgatacaaagccgcataccctacttacacaaacatcctagtaaccccgggtattataataaccatgaatgcttcttcttcccgggggaccgcatcaccaaagcgtgtgggttttgcacaggagatagttcaataactattccttatcttccaaaatctgacttgcacggtttcatttattgcatcattttttctgagggaatttacggaaagagaagcagcgtactttcatgttctatcaatcaagacggtatacag

SEQ ID NO: 94661 - DNA, 297 bp, Glycine max
  Peptide Sequence Number=SeqID_211439
atgaagctcacaagcaacaaagttgtctatagtcttgaccgtggttacatcatttgcaaggttatttctctgatatcgtcgtgtgtcatcattgagatcgtggctgtgccgccctaccgaagtcagtcgcacaatgtcaaaggtggttcccgtgccaccccagctttgtgcccaaactcagatcgtaccgtgaccatgtcaccccgtcgtcgaagctggtactggcctaaggtcttgtatggtccacattgtttgtctctgaaaggaaattgggaagtgagtttgttaacagattga

SEQ ID NO: 94662 - DNA, 675 bp, Glycine max
  Peptide Sequence Number=SeqID_211440
atggatctgtttaagtccttcggatatgaggacttagcaatttccgcaaaaagtctattggactatggatgtttggaatcaatcctgattcctccatttgatagattcaagggattcaatccctcaatcaatgaggccataaacctaaaccaggcagaaatgatggactacatcgccatcaaaataacaacttgtccgagcaatttcactgctcagaattacccatgccatgttatgaaactcttaccagaggatcatagagactatccctgtctattcaatgatgaatacgaaagttgggatgtacaaggtactacacaatatcaatatagccttatgagggcacaaattcagggttatcaatggttcttctcagaatcagacaaacgtgagtttgatttaatacaagaaactcatgacacaaggcttttcctgcccttatacaatgggaagtttttcattcctttcccggtagatcacaacaacaaactggttcaattcttcctgaaagagaaaaaagacaaggagatttacgaagccagcggatgccatggacaacaaactcctcctttcccttctactgacctatcaatggaagactcatccgaaatcttctgttctgggaatatccaagacgaagaagatgttacaatcacaaagtcaaccaagaattaa

SEQ ID NO: 94663 - DNA, 822 bp, Glycine max
  Peptide Sequence Number=SeqID_211441
atgaaccgccatccgccattaacaacattgttgttggtttggcctcaagctctttcacttatagggacagtattttgtattgtgttgcgttctgtaatttccttggctctggtgatccttgaacagataaccaattccccatggaacaaatttttgttcatgatgtactatggcttggttatagaaggctcaaagtatttgtatgtcaatgtggtgtgttgctctggaatgtgggaaattgatattggtgttcctgatgaagttgaaagacttgaagtccttcgcgtacataccaaaaacatgaagcttttagatgatgttgatctagagagaattgcaaaagatactcatggatatgttggtgctgaccttgctgccctttgcactgaagctgctcttcaatgcatcagggagaagatggatgtcattgatttggaagatgaaagtattgatgctaaagttgttgaggtgcctaatgttagctgggaggatattggaggccttgagaatgtcaagcgtgagctgcaagagactgttcaatatcctatggagcacccagaaaaatttgagaagtttggtatgtcaccgtcaaaaggggttctcttctatggtcctccaggatgtggaaaaactttgttggccaaagcaattgctaatgaatgtcaagctaacttcatccatgtgaagggcccagaattgctcactatgtggtttggtgaaagtgaagccaatgttcgagaaattttttacaagaccagacaatcaactccatgtgtcctcttctttgatgagcttgattccattgctactcaattgggttga

SEQ ID NO: 94664 - DNA, 354 bp, Glycine max
  Peptide Sequence Number=SeqID_211442
atgcttccagtttcttcactctccctcagccatcacaaaaccacaacaacaattgccgaagccacgtgccactgcgcgttcttcaaattcagtttcaacaaacctcatcatcatcgcactcctctcctcttccctaaccaccttcccaacgcatcgccgccacttctacgaacgacaacctctctccgtcgcaatgccgcggcagatccgcctcctggtttctccggcgtcgctgacgtgatcgtcgttggcgccggcgtcgccggttccgctctcgcctacaccctcgccaaggtgcgtccctctgattttggatcctcccgccacctcacgtgttgtgccttttgggtttaa

SEQ ID NO: 94665 - DNA, 384 bp, Glycine max
  Peptide Sequence Number=SeqID_211443
atgaaaaagcaatatcagtcaggatttgtgaagaaaaactggtcagaaacttctcacatggagagaacgatgattctattatgttatgtgtacgatggacgatgtgtccatgttattgagagagacttgagagagccagacagaatcgttggtgaacttctccagccaggaggatatctaaagctaattgaattagggttacaagactgtctggagcaaattgatgcacaaagggtgttaggatatgttcttttcaaggacgggaaaaaaactaagctgccttatcctttggagaactttcatgctgatgtggctggtaggagcttccataacggacggtttatacagaggatgagagaaaaagctgctactctgcaccagtag

SEQ ID NO: 94666 - DNA, 208 bp, Glycine max
  Peptide Sequence Number=SeqID_211444
atggtcaatgaaacaccaaccctagatgatctgcagctagatgatgatgatattggagtcgaaataccagatggtgtaacaacaaacgaaggttttgatccagcactatgtttggtgggacaattcttgacagacagacagactgattgcctgtattggagacaaagagcaaaggtgaacaatattgcctctcttactcgtgaagatg

SEQ ID NO: 94667 - DNA, 240 bp, Glycine max
  Peptide Sequence Number=SeqID_211445
atgactgatgatgagtttgaggatgaaagagagaaaaagggtatggtcgagtcacgccagaagcatgagcgagtgggggaaggaagaggaggagccgcggcactcggaggagaagaaaacgaaatgcagataatcttaggatcagttaggaaagaaggtttctacccttatttatactactccacctccacaataaatagtgaagattactttatcctatggtggagattaagtctctag

SEQ ID NO: 94668 - DNA, 1446 bp, Glycine max
  Peptide Sequence Number=SeqID_211446
atgcagctttttcacaaacccagcaagggtcagtctctgattaattccatattggtctcttcatcgttctgtgccctttatctcattgtgtcagtgcttcttttggggccttcaaagctagttcatgtgaataggtcatcatcacaagatgtgtccacaacaccaaccacccttgatcaccttgtgtttggaattgcttcaagcaagatttcttggttcaagaggaaggactatgtgaagctgtggtggaacaacaacaacaacaacaacaacaccaacaaaacaatgaaagggtgtgtgtttttggatagtctctcggatgaagacaatggtaggaatgagaatgacacttctcttcctcctctctgtgtctctcaggacacttcaaggtttcgtttcactcacaagggtggtctgcgatcggcgattcgcgtggcgcgtgttgttggggagacagtggcattgtacaatgattcggaggtgaggtggtatgtttttggagatgatgacacggttttcttcccggagaatgtggtgaagatgctttccaagtatgatcatgagctttggtactacattggtgcgcactctgaggtttatgagcagaatagggtgtttggttttggaatggcttttggaggtgcaggttttgctatcagctcctctctggctaaggtcttggccaaggtttttgattcttgtattgaaaggtaccctcatctctatggaagtgatggcagggtgtactcttgcttggcagaacttggggtaggattaacacatgaacccggttttcaccaggtagatttaaagggaaacacctttggcatattggcggcacatcctttaactcctctgttgtccctgcatcatcctgattacactgatccaatctttccaaacatgacaactaaacaagctctgaagcatttgtttgaagctgcaaatgtggattcccagaggatgctgcaacaagcaatatgctatgacagatggttttcatggacagtttcagtgtcatggggctatgctgttcaggttttcccaaaccatatgcttttgccggatgttctgaaggtgcaagagacattcaagcagtggaggaagggaaacatgttggcaaaatcatacactttcaacacaagagaacttcaccctgacccttgtaaaagatccactgttttctttctagacaatgtgtcttctggcaaggatggcatcataagcagttacaagaaatcctttcagaattgctcgatcgatgatgacgtatcgccgaagaaactggaagtgatcaaagtggtcacaaataagctagaccttgacatcaaacagttgcgtgctccaagaaggcactgttgtgatgtgttgccctctactgcacgggaccaaatggaaattgcaatcagagaatgcaaagatgaagaattggtttacatgcactga

SEQ ID NO: 94669 - DNA, 177 bp, Glycine max
  Peptide Sequence Number=SeqID_211447
atgggggatagcagagtgaaggagtgtgccacatcatctgccagggtggatttcaaatacccagaaagaaggatgatgtggtgtgtggcaaatggtgccgttactgtgcccagtaacagctggccaaagctgttcactcgagaactccacactgggcacagtactgtgtcagaataa

SEQ ID NO: 94670 - DNA, 525 bp, Glycine max
  Peptide Sequence Number=SeqID_211448
atgattaatgatcgaaatgcagatacatgggtcaaactagaactcgttgaccatgtgaaacgcttgggcattagctaccactttgacaaggagataggaaaggcccttcacagacagagaagcatgcacgaaactgctctatgctttaggctcatgagggaatatggctatgatgcaacatcagatatatttgagaggttgaaggacaacaacagcaatttgaagggaagccttagcagagatgtgaagggaatgttgagtctatacgaggtatcatttctcagttatgaaggagaacagattctggatgaggccaaggcattcactagcttccatctaaggggtgccctcaaagaaggtagaagcaatactatgctcttagaacaagtgaatcatgcattggagcttccactttaccacagaatccaaaggcttgaagccaggtggtatattgaatcttatgctaaaagaaaagatgcaaatcgggtgctgcttcaatattgtgcagtcaacgcttcaaaatga

SEQ ID NO: 94671 - DNA, 183 bp, Glycine max
  Peptide Sequence Number=SeqID_211449
atggaggccatgttctccgagaagcgagaacggttccgctacaagaacatgagagagagagagaagtttggttgcgattggagaagaagaaggttgggagatgaaggaggactggctgtaatgtaccatactatcctttttttgaaaccgattgaaaaggcctatacgatcatggaggaataa

SEQ ID NO: 94672 - DNA, 167 bp, Glycine max
  Peptide Sequence Number=SeqID_211450
ggaccaataaagcctattgataggtcggaacctgatgacgatctcatataccagatgacattgatgatcccacaacttttcctcaagcctatgcaggacaatgtcgtcacccggttctatttcttgcacaataagtccgacaactacttgaaaggaatggttaaccg

SEQ ID NO: 94673 - DNA, 1005 bp, Glycine max
  Peptide Sequence Number=SeqID_211451
atggcaccatttcccacttcccattacttcagggccttcactttctccattttgttcctcaaaaccctagcttttgacccaattcctctgttttcctatgctggctttggaaaagatctgaaatttaagcccaacgtggccctttttggtaatgcaaaggttctcaatgaagggtctgggattcatttctctggctttgggagttcaagaggcactgggagaatcatgtacaagaaacccatcaagctttctcaagtgtccttggaagatgggggtggcttggcttttgttatggctccaaagggttctcaaggtaatgtgttttatcaaagttcttcttctgggttgaatgatggaaaatttgaagttgttggtgttgagtttagtgcctcaaagagtggtagaaaaggggtttcttctagttgtgatgtgaacatgaatattggtggttctgttgttgctaaaaaaagtaacacctctattggagaaaagttgcatgtttggattgactatgaagctagttcgaggcgcttagaagtgagattgagtcagcatggtaaagcaaggccatcatatccattgatgtggcattcaattgacttgtcaaacgtgttgaaggagaatgaaatgtttgtggggtttagttctgtaaaggggaataatgattctcaagcatgcgatctctattcatggagctttgttctgagaaattttccacattcaatgcattcagagcctctggatccaaaggtctttgttaaaaacactgaaagtccagtggctaaacaaaggagtgattgctttttgagtgttcttgctgcaatgatatttggtactggatgtggagctttaacagcatttattgtgctttacttgtggaccatctttggcaacaataaacgtgcagtggtgccagaggagtctcttgtggaacctgtagatgttgattataggaaaaaagtcaaaattgttgtagataaaaccatcgaagatggtaagaagtag

SEQ ID NO: 94674 - DNA, 483 bp, Glycine max
  Peptide Sequence Number=SeqID_211452
atgcgtgagatccttcacatccagggtggccaatgcggcaaccagatcggcgccaagttctgggaggtggtttgcgcggagcacgggatcgaccccactggaaggtacggtggggactcagagcttcagctcgagaggatcaatgtctactacaacgaagccagctgcggccggttcgtgccgcgcgcggttctcatggacctcgaaccgggcaccatggacagcgtccggtccgggccgtacgggcagatcttcaggcccgacaactttgtgttcgggcagtccggggcaggaaacaactgggccaaggggcactacactgagggtgctgaactcattgattctgttctcgatgtggtgcgcaaggaggctgagaactgcgattgcttgcaagggtgtggggttggtggttttggattgggtctgtgtggatttgttgggaaagtgaaagatggagggtttttgtgggtggtgcctgattga

SEQ ID NO: 94675 - DNA, 273 bp, Glycine max
  Peptide Sequence Number=SeqID_211453
atgttttgcgagaatgctccaatcatatggggtcaaatttggggaaaaatcgagttcatcggggtcgaatttggcttcgggttttccttgattgagaaagttggattcgaagatcggatcgggagaggacttggggagtggggggaggagggggataggatgaggagactaaacccaccgccaccccaccccattgtcatgcctgacaatgaggatataaatattcatataattttaaatgagtttaccatttcaatattatataaatactaa

SEQ ID NO: 94676 - DNA, 336 bp, Glycine max
  Peptide Sequence Number=SeqID_211454
atgaccaagaataagggatacgatatcaacaagtattcattctacaccaaatcacaagatgacgagagtacaatgcaaaataatggggttagtcttaaggatgaattccaatactttgttattgtaaatgatgacaatcctcgtctggcgtccattccttactttggagtcattaaagaaatctgggagcttaattatgttaaattcattgtgtttatttttaagtgtaagtgggttgataacaatatcggtgtacgaaccaatgattttggatttactttggtagatctgaaaaagctagcttatcaaaatgagtctttcatcatggtagaataa

SEQ ID NO: 94677 - DNA, 483 bp, Glycine max
  Peptide Sequence Number=SeqID_211455
atgacatctgaggcgacatgccaaattgatgataggattgattccctgaaagagcagtccacacatggtagctttgtatcccatggacatcaggatccagatgtagtcctagatgcaatctcaaggaatcgtacccctgttgagcctaaggacccagacaccgttacatcagacaagcttgggttgtatgttgatgacaatcctccctgcctggtttcccttggaagaatttatgaggggtcaacaatcgtgcaccatatccctttgggcaatgatctggtgaaggtaggtgttgaggaagttcaagatgttgatgctcgcagtcctatacccactgaagaggttaagttagagggacagatccttaacaccttccttgcttggtcgacacatctaaccttttttagaaaaggatttgttactaataaaatgttgactgttgttggatcaagtggtctcagaataattaagaatgggggttga

SEQ ID NO: 94678 - DNA, 438 bp, Glycine max
  Peptide Sequence Number=SeqID_211456
atgttgtctatgatgatatcggggccaagacatctaggaaatgacattgatgtttatctaagttccatgattgaagacttgagaaagttgtgggacaaggggaaaaatgtccgtgatagtgtcatcgacacgcttcttaacattcaacgcaagacaatggatggtttaaatactcatcaagatctagttgagatgggtaagtgtgaccaattacatccaagatctgatggtaagaaaatatacttgtctccaccatgtcataccttgtcaagaaatgagaagacaagtttttgtcagtgtctacggcgtgtgaaatttccacagggatactcttcaaatattaagagtcttgtgcaagtcaaagatctgaaattagtgtccttaaagtctcacgattgccacatcttgatgcaacaattcttggtcgtggcgatatga

SEQ ID NO: 94679 - DNA, 225 bp, Glycine max
  Peptide Sequence Number=SeqID_211457
atgaccatgattacgccaagctcgaaattaaccctcactaaagggaacaaaagctggtaccgggccccccctcgagttgtcaattgcaaacctgaaaattccagcattgaaaggctttctggacttcctagtggcagtgcattgtttgtagaagctatgacatctcagcaacttatgctttccattcaagaggaggatttcatagaattgaatgatattgcatga

SEQ ID NO: 94680 - DNA, 234 bp, Glycine max
  Peptide Sequence Number=SeqID_211458
atggtggttttggacatttggatttgtgtagttgttgttaataacaatgatgcttatgcctttgggcatgggtttggactagttgtatcaaactatgtttgtgtattggccgagtgtgatgagttagttcagcatgctgaggctttgaaggaagaaaatgcttctctccagtcagaagtaaatcgaatcaagagtgattatgagcagctagtctccgagaattcagctctcaag

SEQ ID NO: 94681 - DNA, 459 bp, Glycine max
  Peptide Sequence Number=SeqID_211459
ttgatgtagcagttgatgtagaaatgggagatcgattagagaatatgattcatgatcttggacaagagtgttttaaactagcacatgcccttaagtatgatacatgggaaagtgatctgaagaagcttttgtatccggggtgcatgaagtcatggacactattttcaatggtgtttagtctggttgatatgaaggccagatatggatggagtgacaaaagcttcacttcattgcttaaggtaatgcaagtgaaagatgatgacaaatatagcagtgatgaaagcataaagaaagacccctcaatgaaggtgttatggtatcttcctatcattccaaggtttaagcatctatttgctaatggagatgacgcaaaagaccttacatggcttgcaaatgggagaaaattcaatggaatgctccgccatctgactgattattcccaatggaagaagattaatc

SEQ ID NO: 94682 - DNA, 273 bp, Glycine max
  Peptide Sequence Number=SeqID_211460
atggtggctctgataccacttgttgagaatttcaataaaccttataaaataccaaatgagcatcaaaacacattacgtcagattatcaagagctttgagtttgttctcggagaggaggtggaagaaggaccaaagagagtggacgaaaagaagaggagcgaaaaacaaagtgagagatctaggttgagagggtggtgggatggttcaccgatggatttggagtcgttggcagcgcgtggtggtcgtagctgtggtgctatagtgactgtataa

SEQ ID NO: 94683 - DNA, 201 bp, Glycine max
  Peptide Sequence Number=SeqID_211461
atgggcacttggggcaatggcagctcgcccaagcgagctggttcctttaccttaaatcgactagcaaggatcaaaagatcaatgaacaatagttcccagatgaaattagggtatgacatgtacaatgattgcaatgcaaacgttcctgacgagatgagaataggacaatggcatgtgagcttacagaatggaggtcagtga

SEQ ID NO: 94684 - DNA, 374 bp, Glycine max
  Peptide Sequence Number=SeqID_211462
atttcagagctcttttagagcacaaaatttcgtgctcttctctccctctcccttcattcatttccttcttcctccaagctcttatccatggcctcctatggtgtggcatctcctctctctcttccttctccattccgctgccatttatcttctacaaagcaaaggaatccattgatgaagaagatcctaggcctacaagctccaatggagcttacatcatggctacattacatgcggtggtcgaggttgtcggcgagaagaacacgcaacgaagagtggtgttcagggttgtggggctgtcagtcaaagttgtaggtggtgggtggtggagtgccaaggaaggaggaagggtggtgaaagggaaggatgaatag

SEQ ID NO: 94685 - DNA, 1344 bp, Glycine max
  Peptide Sequence Number=SeqID_211463
atgcctaggaaaaataacctaaggaaaaataatgcaaggtttgttgatgaagaacatcatgatgaagtggaacattgtgatgaagaacatcgtgatgaagatgtgcatcattatatacagcaattaataaattcactgaataaatctcaatctgaatcacatggtactgagtctaatcatttgaacaattcagctagcactaatgctgaacaaggttcgttgaaaaccagaaatgttcgtgggcctaccttattaagagatatatggaccatgcctccagggaagacaattgatgtgcaattcaatagacgtaaccaagctataggaaaggaaggtagaaagcttgctagctttctaggcattatagctagaaatccagagttagcacctttaaacatagacgattggagatgttttgacaaagaagaaaaaaataaattggtggatcttgtgaggaagaagttctcgatcccagaacgtggtgtggaatttgtcaaaaaatcacttggaaagaaatggaaagactacaaatgtgatttaaggagtatgtatttcacaaagtataagactaaacataccttattgaaacacagaccgaatcatataccaagggatcaatggattggtcttgtctcctattgggtttctgataaaggaaagaggcgtagtcaagcaaataaaagcaatagagcaaagcaaaagatgcctcatacaggaggatctaaaagtatcggtacattaatgaatgaaaaggcaaaagatgggatagagcctacacgagctgaagttttcatcttaactcataaggaacgcaaagatggtagaccattagatgcagagtcaataaaaacactggatttgatacaagaaaagttgtgcaatggagagacttctaatgagcaagatcttgacagtgttgcttgggaaggagatgtgtattctcaagtattgggatctgaaagaagtggctatattcgtgggttaggacttggtcctactccttctctgttatggggtgataaattttctttgggaaatatttctatgaataataataatatgtctaatgagatggtcccaaaattagagcaagagatgaaggagttaaaggagaggcatgaggaagaaatgaaccaaatgaaagagttgaatcaaaagcaagttgcagaattgaccatcatgagacaaaatcaagaaaaaatgatgttagaattatctttcatgagggaagttatgtgtagatttatgcatacggagttaccaacgcctaactttaatagaagctatggacaagtctctgattctaatggtggtcgtgaacgagcaccgcgagtaccacattag

SEQ ID NO: 94686 - DNA, 267 bp, Glycine max
  Peptide Sequence Number=SeqID_211464
atgaagcacagggaaggggatgggacaggccaccaccagccgattgcaaaccttccgtgcaatactggagattgtggaccggaagttcggctgtgtgtgcaatgtgctggcgtatggcggcggcgcaagccaacatcagcagcagcaccacgcgttccaaaggtgttcaaggcgtacatgaggctctggaagcaccagcaggagaaccgcgcgaagttggtggagtgcgggttgaagcagtgggaacttgacgagatcacgagctga

SEQ ID NO: 94687 - DNA, 696 bp, Glycine max
  Peptide Sequence Number=SeqID_211465
atggatcgatgttggatgaaagcatcacacataactgacaaaatcttcacacggttattggtggtgttagcattggtcaacttgaaggcaagatttgggtggagtgacaaaagcttcactgaattgcttgtgttatcgaagaaaatgcttccacgagataacatgttacccaaaaatcactatgagatgaagaagatattatgtcctgtgggtatggactaccaaaaaatacatgcatgccccaatgatgacattttgtacataaatcagtttgccgaaatgcgcaaatgccctacatatggggtatcacagtacaaactgaaggatgatgaatgtagtaatgatggaaccacaagcaatagtcgtctagcaaattgcatgaagcaaaaatacattatgatgtgtatgatgatagcgggtccaagacagttaggaaatgatattaataagtatcttagtctattgattgaagacttgaggaaattgtgggtagacaaggttgatgtgtatgatgggaatctccagcagacgttcaggatgcatgcaataatattttgcaccattaatgactttctagcatatggaaatttgagtggatatagtgtgaaaggacaccacgcatgtcctatctgtgagaaagagataacttacatccaactgaaacatggaaagaagaccgtatatactaggcattaa

SEQ ID NO: 94688 - DNA, 1059 bp, Glycine max
  Peptide Sequence Number=SeqID_211466
atggaagaaagattctccaccatcaaaccaccatcgttcaaaggcaaaaaatgtgattactggaaggagcgtatgatagctcactttgagcccattcataaagatctatggaatgtggtggaaaatggagattatattccatatgatgatcaattgaatgaaattcctagaggccaatggacggaggagaaaaaacttagattactgctcaactccaaggctcggaatgtgatgttgtatgctttatcagaaaagaagtacaccaagggatcacaggaaatagtgctaagagccttaaagaatctcgattctatgtcccttgaggaacttgttggtaccatcaaggttcatgaacaagaacttcaacaggacaaaggacccaaaagagaaaagtctttggctcttagcaaactagagaagggtcaggacaagaagaaacactacaagatcaaagaaaagaagggtcttatgagtaccttgcaagatttggacggcacttcgtctaatgaagatgatgaagaagccaacaaatgcctgatgacaatacaacttctgaggaatctgaatcagatcaagaagatgagggcattggatagaagactccaagaagattgggccagaaatgcaagagaaggctctagggttcttatgagccttaggactcatcttttacttgaagtggcgtctccattcatctttctcttctccattccactgcaatcaaacctcaagaagcaaaggaatctattgatgaagaagatccaaggcctacaagctccacatggagctacatcagacaaatttagaaatggatatgatgggaagggtacaaccaatacctttatggctaacacaaatggacccaaaatgatttgggtacttaagaaaaagattattcctgttgcaaatgtccttgatagcaagaagcagatgtttatcatggtacctagacagtggctactcacaacacatgacaagagaaaggtgtatgttccaatgtctaactccctatcatggtggaacagtcactttcataggaaatcaaaaaagaaaggatag

SEQ ID NO: 94689 - DNA, 822 bp, Glycine max
  Peptide Sequence Number=SeqID_211467
atggacacgtccgatgcagccacaggttatcaagatgcaaccgcattggcttgtactttacacccaacagtggatttttctatcaacagaatcctggagaaaccttcaaaagtgcaaggacaagaagagcacacaaaacagtatccccaaggatttatgccacttacaaagcttttaccagtgcatccaacagatctctacctatctcaagaagacctcacctctcttggcaacctccatgcacaaatgtataagagagatcaagccactgcctacccttctagacggcatatcttaagggccactgatgtcaagatggttgttgacaaggtatttccattacaacttatttgggatgctaccaaaaagaaagggttcaagttatactacaatgaagagatatcatcaaggcagataaaggtggaagtagtcaactgccttctcagttggagttccctattcagtgagcctccacctctggttatgatggaagtgacaaatttgtgcaccgcaatgtcattcaagtgttacatccaattaggaagtatcacttcaatgatgcttgtgtttgctttacaaaggatgccgacaactacttcgtctgctaaagttgtggatgataccattgtacatggggtcattattgatcttaccaacactagtatcatggatgaaacacctgaggcatccaatgcggccatagttgatgaggttgttcaccatatccaagaacttgtgtccaagcaatcaaaaacctcaaatgaagctaccttaagagacaatggtgaaccagatgtcatcattgtctactctagtagttaa

SEQ ID NO: 94690 - DNA, 2031 bp, Glycine max
  Peptide Sequence Number=SeqID_211468
atgaaagttgaagattcatcaatcctggaggactacagagaggagcaaatggcagcagatgattctgatttcctggagactatcagtagctggaaaactaaactatcaaagaatatgaaggcgaagattagaaagtgctttaaagaaccaatctctactcataccaaagatatcatgctagttgtcaaatctgaacctgaagagatcctaaacagtcaagagttcccatcctcttgtgaggagatccaaaacagtctagagttcccaccctctagtgaagagatcctagattgtcaaaagttctcaccttctggtgaagagattcaagactgtcaagagttctcaccctcccttgaagcgatccaaggcagtcaagagttcccaccctatagtgaagagattgaaaacaatcaagcgatcccattctttattgaagattcagttgcccttgttgaagtaaaatctgaggttcctgaaactgattgttatggtgagccagatgactattctattattgaaagccaagaaactgagataatccatgattggaatttggagaatgaattaaatgagtggcaggagcatgttgattttattccgttacgaatggtgaggccatcttgtatggatattgtgataaataattctcaactaagcaacgaccagtctccatacatgcctgcaatagaatttgaaagtgaagaatatatcaccaatccagatctccattacatctccccacaagaaatctctctggttgaagatcataactctgatattcatgacaatcaacctgacggtgacactgacactgctgtctcactaccaaatgcggttactcataaagaccttgactgtagtaatgatgaatttacaactggtgctaaggatcaggtagaatgtatctctactattgaacatgactgcagtaatgatgaatttacagctggtgctgaggatcaggtagaacacaactctactattgaaaatgactgcagcaatgatgaatttacagctggtgctgaggatcaggtagaacccagctctactattgaacatgactgctgtaatgatgaatatagtacaactggtgctgaggatcaggtagagctcagctctactattgaacatggcccaaatcctgatggatgtctggttcgtcactcagatgatccacctgaatatgaggagaagcaatcatttgcttctgtaaacattgatgagaagagacatgccaatgtggctactgatgaattgacttcttgggatgaatgtgatggtagttccaagctgcattgtcctgaaaagctattatcaaccagaaaggcaatttcaccatcttctgaggaaaggctctgtaaagccgtggagtcagttgatttgaatcataaaaaaaaattgaaatgcaagggaaaactgtacttttctgagaagactgataagatgaatggtacagatgaagggtttgatgatatcacaggaactcgacctaatgatatccccaacaaaattagtgttattcctaggaataaaagagtttcccatcctagaggaatttccaaggttcctcattcttctcgccatgcaacccgcatagggtgcaactctgtacagagttgctcaaagagtgcaattgcatttacacagcagcagatgcatgatgcagaatgccttgccatgagactcactaaggaattgaagtcaatgaaggacattgtggatgatatgttacgatctgaattctgtctaaatacatctttgagacataaagtaaatgaggcaagaatggctgttaagaatgccacaagagctgaagaagctacaaaacgatgtctggccttcatgtcaagggattgcagccgtttctgtaaaataatgaaattaactgatgatggtccatctcctcaaaaacctcctcaagaagtagtgcgtaaagagaggaagaaaatagcctttgctgatgaagcaggtggaaagctgtgccaggttaagttctatgaggatgcgcagtatctgtcagaatctaattga

SEQ ID NO: 94691 - DNA, 501 bp, Glycine max
  Peptide Sequence Number=SeqID_211469
atggcatcaacaattgctcctcttctttggaaacaacaccttcatagatctggagaagtaacaaacaatgtaatccaatcatattgtcaggcaatgccctctccagatcctagaattgaacctttgttggttcaagatgggtttttagatgttgcaaagctcaggcaagttaaaatcgacgatgttttagtgaatgctttggttgaaagactagttactaaccaaacatattatgattgggaacaaatgtgcaaagaatatataggtgttattcctccaaaaaatgcacaggtgggatcaacacttaaacttaaatggttaaaagaacacatgctaactctcccagctaaacccacaccacaacaactagcaagccattgtaaggcatatattttagggttgattggtggggtgttgatgtcaaaaaagtcaaggaacagagttcacctgatatatttacccctgttagcaaatcttgatcaggttggccagtacagctag

SEQ ID NO: 94692 - DNA, 762 bp, Glycine max
  Peptide Sequence Number=SeqID_211470
atgtcgcttccgcgaatattccagattacaaacgcctccataacatgcaagtctctatatatacgatccataccacgtcattatccaaatcattcattgctatctccaaattctcagcacacgcatttccgttctttgtccttgatgggtttagtgtttggaaagattagcgttgagacagcaaaatatgaagtgatcaaatccacaagcgagtacgaaattcgcaagtatgcaccctcagtagtggctgaagtcacatatgacccatcacagttcaaggggaacaaagatggtggctttatgattttggccaattacattggtgctgtggggaagccccagaacaccaagcctgaaaagattgccatgactgcaccggttataacaaaggacagtgttggtggggatggtgagacgattgctatgacggcccccgttgtgacgaaggagggtggcggtgaaggcgaagaagggaataagaataacaagatggtgactatgcagtttgttttgccggctgtgtatgggaaagccgaagaggcgcctaagccgaccgatgagagggttgtgatcagagaagagggtgagaggaagtatggggtggtgaagtttggaggagtggcgtcggagcaagtggtgagggagaaggtggagaagctgagggagagtttggagaaagatgggtttaaggttgttggggaggtacaatcctccttggacaattcctgcgttcaggaccaacgaggttatgatcccggttga

SEQ ID NO: 94693 - DNA, 309 bp, Glycine max
  Peptide Sequence Number=SeqID_211471
atggtcattacacaagcgttatgcaacagatatactaagactcaatcatatatgcaatgtggtatcatgtcagtgaaaaacctcgtcgggcccctaggagtacatgataagacaaaccacatactgttaggtcaagccactctcactagcacagacttaaaggagcactcaaaccgggtgtatttacccccaagggttagactccgaagagtccgacagagcgcctccctcctgattcaggtccaacccaaaaaatattttaacatgcagactttatctatgaactatacaaaacacacgactccttaa

SEQ ID NO: 94694 - DNA, 483 bp, Glycine max
  Peptide Sequence Number=SeqID_211472
atggaggagaaaaggaagcgactacaacaagaagctatgtatattgaggattcaacaatgattgttgaccctccatcccccattgtaagacatgtgaagcagaagatgacctgcacaaagagaaatgggcagatgacatctaacgtggcccaagaaatatctaacaaaataaagacacatggcacctttgtcccccacggttgtcacgacctattgaatatttccattggccgaccagagcatcctggtcgtgtttgtgcaacggggactggtgtgaccatcagccaatattttggacaggcatcatgtgcctccaatagttcctctgcattgatcaacccacaacaattccttgacatgatcaaagacttaaaggaagagttgaggagagaagtggaagaggaaaacaagaaaagtttggagaaaattaaagagtttaaggaggccatcatagttgagttatcccaaagggcatcgtggtag

SEQ ID NO: 94695 - DNA, 429 bp, Glycine max
  Peptide Sequence Number=SeqID_211473
atgccttactttggagtgattgaagaaatctgggagcttgattatagtgaatttagagtgtctatctttaagtgtcagtgggtcaacagaaataccgatgtgaatcaaggcgaaatgggatttactttagtagaccttcataaggtgtcttacaaggacaaacctttcataatggcagaacaagccagacatgtcttttacgtccaagatccatgtgactcaagatggtcagtgagtaaggcaacacccccaaggtcccctctacattcagatgatccttcggaggatatgtctcggagtagtaaacgatcgacccgactgagaagcttaatgttagaagcttggatcagccaagaccaatggttaatgtcaatcctaccactgggagaggatcatgcccacataaagaaaagtttcatagctatctag

SEQ ID NO: 94696 - DNA, 357 bp, Glycine max
  Peptide Sequence Number=SeqID_211474
atgacaatgcactacatgtctttatctttggtacatttattcacattaacagattctttgccaatagttgttaggaaaatcagtataccttgtcttggtcgactcttggaggaagatcttaaagttgaaaaatttactctagatcccaataagaagtttgtaagtcaacaacttcatgagactgataaggaagagagtgattgggaagatgaagttaaacctaggaaaaatatttttccaaaaggcaacgtgaagaattttgtccaacccaaaaaccataaaggaggggagactgatctatccaataagaaaagggtcaaatatgctaaagcagcttcagaagacaagagggattga

SEQ ID NO: 94697 - DNA, 174 bp, Glycine max
  Peptide Sequence Number=SeqID_211475
atgaagaatgatcacgaaaacgaaatgaggggaggaggttgcacagcagctcgcccaaacgagctgcttgcttcctccagaagtaaccttgctcacccaagtgagctggttacttcatccctaagctttctggtggcccaggcgagccaggggcctgaaaaagtcaccaaatga

SEQ ID NO: 94698 - DNA, 975 bp, Glycine max
  Peptide Sequence Number=SeqID_211476
atgggtgaagtagacgaggtgcaggagcggatgaaggctggcatagaggccctaaaggagaaaatggccacaatgatggaggctatgatgagcatgaagaagataatggaggtcaatgcagttgtagctgccgctactagtgttattgctgaggtggacctgactctcccatctggcctcaaccaaataaatcatccaaccttagatatggtaggtcaagggagcaaagaattacgaagtaccggcgccccccattttgtgcaagttcagaacaagcatgccttcccgccatatggcttgcctcccaactacacaccacccaatgtggcacgcactcccgatgagaataactccactcccatactcattgagagccaacaacctcaatctgatcatgcacatatctctcgacccatgggggagacacatgaagtaccgcaccacaatctagttgacttcgagccttacctcggatacgccaccgaggggcaagcagttggtggtgtacccctgccaagcactttcgaaagccctcaatttcacccacaaccacaaccctttcattttgcaacgggaagaatccctcctgctatggcgaaaaagggaaagttggatcatataaaggaaatgctcaaggacattgaaggaggcggagattatgcttttgctaacttggcagagttgtacctagtgtctgacatggtcattcctccgaagttcaaggtgtcggacttcgatatgtacaaggagactacttgccctaagaatcacctgaagatgtactgcaggaaaatgggaggatatgtgagagatgaaaagttattgatgcatttcttccaggaaagtcttactggagtagccgtcacctggtatactaatttagaaccttcccaagtccattcttggaaggacctaatgatggccttcattaggcagtatcaatacaattctgatatggatccggataggacgtag

SEQ ID NO: 94699 - DNA, 465 bp, Glycine max
  Peptide Sequence Number=SeqID_211477
atggtgttgggtgaaggtggagtctggtggacaagtaggtttgggagagaggtcaagaaagagcatagtataaatgcaaaagaggagttgcacggatgcagagaaggaaaaaggaggaacaacacggatgccgaaaaaaaaggagtcacagaggggcaattggagaaaagaataatctacaagggtgtgctatcatttgggggactgaaggctagcaatggtgttgtctctttggggtttcctatgagcactgagaagtgctttgctaaggttgtgagttcagtgaaaacaacaacatcaaatggaaaaggaaagagtggaggggcactctcctccacgtgcaacgctgtaagtaagatattcatgattgctactatcatcaatggacttgttcttgttggggttgtagttgggtttgtgctcctgcgagttgaagcatgggtcaaggagtttgaggcaaaatga

SEQ ID NO: 94700 - DNA, 544 bp, Glycine max
  Peptide Sequence Number=SeqID_211478
aggtacttattgggtacatgtactattttcagcttttgaatcctgattgtaaatctgctcaacgactcaaagcgatggtgtccttcacttcattaacagaggaagagaaagataaggccaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 94701 - DNA, 225 bp, Glycine max
  Peptide Sequence Number=SeqID_211479
atggaaactttactgaagacactattaagtcttgtggatgtgtatattgaattgattgacggtgaggatgagagtaatccgagagagaaaccggaggagactacaactataagagatgatgcattgcggtggttgacaatgttaaggcttggagggattgatgggaacccggtgatgagaggaacgaggagaagaactacatacgcgtacatgagctcaaattaa

SEQ ID NO: 94702 - DNA, 1602 bp, Glycine max
  Peptide Sequence Number=SeqID_211480
atggacgcgctggcgcaggagcaggaggccaacgcgcagatcggcgccgcgctgtgcctcgcggcggcggtcgaggcggcgccggaccccgatgcggaggcgctccggcgtagcgcgctgccgcggctcgggaagctcgtgaagagcgaggcgtgcagggcgcgggcggcgctgctggttctgatcggaagcgtggtcggcgctggcggcgcttcgagccgcggtgcggtgaactggctcgtgccgtgcctagtcgagttcctcggcagcaaggactggacggtgaggaaggccgcggcggaggcgctggcgaaggtggcttcggtggagagagatctggcgtcgcagcataaggttctgtgtttgaattcgttgcagaatcggaggtttgataagatcaaagtggttcgggagactatgaatcgtgcattggagacgtggaaggaggtaaccgaggatgctcctgcttacgttaaatctgaatgtgcttctgttggggtactaggccatggccgaggggtgctaggccatggtcgagtcgaagacctaaggtttcttcctaccttagagggcacagatgatggtaaaagtcagtgtgtctctaaaagttcacccgatgttggctctaagttgtcttctaaaacagcccctgccaacaggtcccctccatcagtgatttcattcatgtcgtccatgaaaagagagagttctctaaagagtaatgagaagcatttgagaatggggacattgaatcatcagggtcatgagaaatcctccaatgagaaacgtgaaactccattttcgaggtcctcccactcaaatttgtctagggaagatgatattaaaaggtgtgatgttgaagtttctaagccacccccatatcaaaacggggtaaattcgagggcagagataaagcgtgttctctttagcaaggtgtctgatgaaaaaatgaggagattcagtagttcaaaatcttgtgtggttccatgtattgatgatgatgatcttgatgcaaatgaagtttgtgagagcccacaagatgttgaagactttgctttgatccgtgaacaacttcttcaaattgaaaaccagcaatcaaatctgttagacctactccagagatttattggaagctcccaaagtggtatgaattctctggagtcacgtgtacatggcctagagattgccctggatgaaatatctcaggatttggctgttccaggtgctagggtttccaatattgatgccacagaagacacttgttgcaagctacctggtactgactttttgagttctaaattctggaagaagacagaaggtcgttattccacatcaaggttctctttaggaagcataccatcaacaaatgctgtgcataatgcaaccaataaagatggaagcagagaaatattaactgcaaataacagccgattgcaacatggtaagggtggatattttgtgaatccatcggcagaagttcaaagcgatttgaaagggcatcatacgtataaagtgtctaaaaacatggtccaagacgccatgaggagatatgatggcattcaacctgctactgaatcactgaggaaccagaatatcaggtaa

SEQ ID NO: 94703 - DNA, 228 bp, Glycine max
  Peptide Sequence Number=SeqID_211481
atgtcttcccggcgccactcactaagcgggccgccaccactctccggcaccgagtcgactcagaaccttggagtgcgagtcatcacgtgcctcaacaaactctccgagcgcgacgctttcacgggcgccgccgcggaactggagtccatcgccagaaccctaaaccacgactcgttctcgtccttcctctcttgcattcacaacactgattcctcttccaaagcacca

SEQ ID NO: 94704 - DNA, 843 bp, Glycine max
  Peptide Sequence Number=SeqID_211482
atggctctatcacgtttgtcccaccgcagcatcggatccactctcacaaaacccttctccgccgccgccgcctccgccgcctcctcccgttcgatctccacctcggacacccccttaacaatcgagacctctgtccccttcaccgcgcacaactgcgaccccccgtcacgcgcggtcgcgacctcctcctcggagctcctcaccttcttccgcgacatggccctgatgcggcgcatggagatcgccgctgactccctctacaaggccaagctcatccgcggcttctgccacctctacgacggccaggaggccgtcgccgtcggcatggaggccgccatcactaaaaaggactccatcatcaccgcctaccgcgaccattgcatcttcgtcggccgcggtggcacgctcctggaggtcttcgccgagctcatgggccgcaaggaaggatgctcgaaggggaagggcgggtccatgcatttttataagaaggagagtgggttttatggtgggcatgggattgttggggcgcaggttccgttggggtgtgggttggcgtttgctcagaagtattctaaggacgagagtgtcacttttgctatgtatggagatggcgctgccaatcagggacagctctttgaggcgcttaatatcgccgcgctttgggatcttcctgctattttggtctgcgagaataatcactatgggatggggactgcggagtggagagctgccaagagtcctgcttattataagcgtggggattacgtgcctggcttgaaggatagaagtgcttttgatcaaatcatatctttaacactctccctcaagctggagcatgtgtga

SEQ ID NO: 94705 - DNA, 483 bp, Glycine max
  Peptide Sequence Number=SeqID_211483
atggtgttaatgaagcttgacttgcgtcaggaatcaagcagacatgctgaaaccattgatgtaattacaaggtatttggatatgggcacgtacagtgaatgggatgaagaaaagaaactggacttcttaactagagagttgaaagggaagagaccactggttcctcccagtatagagagcttccaaggagtggttgattttcttgctcaagagttgttcaaccagaatgcatctatcatactacacacctacacgatcactttacaaaaaaagatgagagagaaagagagagagagagggagagagacagagagagggcgcgagagaaggagagtgacaaacagagacagaagaaatgagagatggagcgaaacagacacggcgaggacgagtgtgaagcagtatcgaaacacggcgaggactagcacaaacagaagaactccaaacggttcccattcaaggagatggaggagtatggattga

SEQ ID NO: 94706 - DNA, 117 bp, Glycine max
  Peptide Sequence Number=SeqID_211484
agaaaatgaaggtcctataaggaaaaaggtgatttggttgaggaaggtcattaaaccaattgttcgtggccactgtcagattccgctgcgtgttgatcaagctctctatggatccag

SEQ ID NO: 94707 - DNA, 174 bp, Glycine max
  Peptide Sequence Number=SeqID_211485
atgtgggtgccgagggagcggtttccggcagatttcaggcgggaggagaaagagaagagcgatttcaggcaggaggatgacaaagagaagagggagggcaaggctcttgggttgcggaggcctcaccccctcccgaaggagaagactagacttctggccaagccacctgactaa

SEQ ID NO: 94708 - DNA, 369 bp, Glycine max
  Peptide Sequence Number=SeqID_211486
gttggtggactaattcgcttgacttttggtgctgctttaagctttgggcttgctcattatggttcctcagagtttgagttaatggccgaagagcttctgatgagtgactctgtagtcaaggcaactcttcgtatgtctgtcaagattcacctgatgttgaattccaagatgcttatagatgccaatggtgatcgaattgttgcaacatccttacttgaagctagcaacttagtcgttctcaaggattcatctgttattcattctaatgcaaatttgggagttcacgggcaaggatttttgaacttgtctggagctggaaacttgattgaagcgcaacatctgattttgtcattgttttatagtatcaat

SEQ ID NO: 94709 - DNA, 295 bp, Glycine max
  Peptide Sequence Number=SeqID_211487
ggtgtgaaacgcttccttctttcacagatccctttctccgatggaatgcttccctctttttccttccagtcaccactccctatgggaggagtgactgtgagttggatgattgtggtcatgtgtggggggaaagggaatgtaggggcaataatttggggattaggagtttcattggtgggaaagggattgtggggccgttgggaggtgactgagaaagccacgatggagagcctgtcagcggtgccaagcgataaccaaacgcatcgtgtgcttcagcatgagaagcttagcgccg

SEQ ID NO: 94710 - DNA, 285 bp, Glycine max
  Peptide Sequence Number=SeqID_211488
atgcagtatcacatgccaccgccacaactcttcattgcaagatcaggaagccttaggcatgcaaaggtgctctcgccacttagggaagggcttaattgttgggactccacacatgaagaaggaaggtgtgaccattggtctgaaccaacactaggttgggtgggtgggattagcacatgggtgcaccctcccataatggttttggtgcaagtgctactcacaatgatcgtgttgtgtcaattctcttcctcttacaaaaagtttgatttgacgttgggtggctag

SEQ ID NO: 94711 - DNA, 138 bp, Glycine max
  Peptide Sequence Number=SeqID_211489
atgaaagccgcgattaagtggatcaacaaattagcctgcggcgaactgtcagccgcttattgtgctcaacaatcagacaattgtgcttacttcttcggcaaaaatcaggggattcatccatctgaatgggctggataa

SEQ ID NO: 94712 - DNA, 1833 bp, Glycine max
  Peptide Sequence Number=SeqID_211490
atgggcggtggtctatgcttcggcccagccgcatattgttcggacatcgcgagctttctcatgattaagcgtttcgtagccgtagccctggcgggtatcacgctggctggctgtgttaataacgataccctttccggcgatgtttacagcgccagcgaagccaagcaggttcaaagcgtctcatacggtacgctggtatccgtgcgtccggtaaaaattcagggcggcgatgacagtaatgtgatcggtgccattggcggtgcggtgctgggtggtttcctcggtaacaccatcggcggcggcgcagggcgcagtctggcaacggccggcggtgcggtactgggcggcgtagccggtcagggcgtgcagggtgcgctcaacaaatctgacggcgtagagctggagatccgtaaggatgacggcaataccattatggtggtgcagaagcagtccgccagtcgttactcggtcggccagcgcgtggtgatggcctccaacggcagccagcctggcaatcagcgtcaccatctgattgatctcttcgaggctgatgccggagaggatgtcgtcacgcgtcgcgtcgatcacgttttcgacctgctcaatgatcggctcagcctgacgggtcagcttgatgcgcttggcgcggcgatcgttagcgcaggtggcgcggctgatccagcgtacgcaccagcgacggctgctcaataccgatggctttcgccagctgaatctgcgactgctctggcgggagttgatgaatattgtgcaacgtcacccagtgggtttgtgtcaactcaagcggcttcagacgctggtcgatcaacgcgcgccagatgcgcaccaggcgagacagatctgttccaagcggcgatgatgccacgtgtcaatcttcgcgctcaccgcgacggcgccgctgaccgatctggtgttcggtgcctcactgttcttcccgccgctgttcaaagcggtgctgctgggcttctttttctggctgctgattcatccgctgctgcgcggctggatctactccggcgatgctggtggatgtggaactactacatgcaggccccgtggacgcgcgatggcaaagtgcgcgctgaactggtggacgtgacgcccgaggtttccggccgcatcagcgcgctggccgtgcgcgacaatcagttcgtgcataaaggcgaggtgctgctgacgctggatccggtgccgtggcagattgcgctgaccaatgcgcaggcccagctggcgaaggcgcaggccgaccttgccaaagcgcagcatgaggcggatcgccgtgccagcctgccgcgtaacgtgatctccgctgaagatatggacgcggcgcgcctcaacgcgaatgcggccgccgccacagcaaaagccgcacaggcaatgctcgatcaggcgcgctggaacctgcagcaaaccacggtgacggcaccgaccgacggctgggtcagtaacctgacgctgcgtgccggcaattacgcgaccgctggtacgccactgttcgcgctggtcgatagccactcttactatgtgatgggctatttcgaagaaactaaactgcgccatatccagcccggcgcggcggcgcaaatcgtgctgtatagcaacggcgcacgactgcagggccaggtggagagcatcgggcgcgccatttacgatcagagcatcgccagcgacggcggtctggtgcctgatatcaaacccaacgtgccgtgggtcaggctggcgcagcgcgtcccggtgcgtatccggctaaacgcggtaccggataatgtgccgctggtggccggtaccacctgcaccatctctgtcgcgcactga

SEQ ID NO: 94713 - DNA, 231 bp, Glycine max
  Peptide Sequence Number=SeqID_211491
atgcatttttcacctgaattcgagcttctggagaatattattctggcaaacatcaaacggaaagcaaacaacgtagaccttccattttcgctgaggacaagaaaaagctacagtggaaggagtggcttagagagggagcttcacaatctcactatgcagatgagggaaattttgttctatgaagatcaacaagggattctcgaaaggttgcagaagtttgtttccttatag

SEQ ID NO: 94714 - DNA, 486 bp, Glycine max
  Peptide Sequence Number=SeqID_211492
atgttgttcaacatcatgagttttgcatacttcaccttcatcactagggtaggggcaaagtcgaagcatcgtatctcgaagcatcaggaataccttcacggtggtgttgttcgtgttccgatggagtgtattgaaggttatgatgatgcaatggcaaagtgggttaaagatcgagttatcggcgcagcaggaaggcttggaagtttaggcaacttaaggccggttacaacatatcacgagagtattgaatccgttgatgaacctaacaaaacaatcacttacaagatcttcggtgaagatatcgatcaccagtataaggtctttaaggtcatctttcaagcaattcataaggatcatgggggtgcattcatcaaatggactattgaatatgaaagggttggtgaggaagttgatcttccatttggcttcatcgaatacctcaacaaagggagtagagatgttgatggtcatcttctcaaggcatag

SEQ ID NO: 94715 - DNA, 468 bp, Glycine max
  Peptide Sequence Number=SeqID_211493
atggcattaggggtcatggcagctcgcccaggcaagttgttgctcaaacctgaagtaaccttgctcgcccaagcaagctgttacttcacccctaagctatttgggggcccaggtgagccagaggctagcctgggcgagccagggttcagaaaaaagcttaaaatgatcttttgccctcctttttgggtatttttcatattcttgatcaaaacattgaatgatcatttgttttgcactgtaactggcgttcaacactttagtgaggatccacttatggtaaaagttgatcatctcaagaaagaaagaaagaaaaagtgggatgacaaaaaccaggaggaaattgctatggctgtaaaacaacttgcagactttgatcatacatggcctacagaggctgaaattgctatggctaatgaaaatcaaaagaaaaagaagataaaaaagaggagtcttcctcatggcacttga

SEQ ID NO: 94716 - DNA, 465 bp, Glycine max
  Peptide Sequence Number=SeqID_211494
atggagtgcctagagggagcctgggagaccctcgaaggcaacacgaggtgccaattttggggcactattcgatttacggctacttcattggtgcatccagatgaaccggcgcgtacgcttcagcgcactgtggagtggatactacccacgcctacaccatatcgtctagtggagccagtccaattgattgaggtaacgtcgtccgaggaagaccctgaggaggatcccgaggagctacctcctgagcctgctgtggatgctcttgactttctagagggcgatgaggacccacttcctgaggtggattctcccgaggaagtcatgccggcatctgaggcagactctacggaggatagtggcccgagagagatggcgaccggtggaggctcttcatcattgtggacagttccatggactagttttatatactttttgagggtgggtgtatctaggactgactgttag

SEQ ID NO: 94717 - DNA, 345 bp, Glycine max
  Peptide Sequence Number=SeqID_211495
atgagacttcatcaacatgaagagaatgatataaagagaaaaggaatagcactcagagcctcatcatcttttattcaagaagaaagtgacaaagaggacttaactgaaacagaagaagatgatgatgatttcagactctttgtgaaaaggttcaataaatttttgagaaacaaaagaaataaaagggaatcaaacatcaatacaaagaagaaagaagaagactcctccttagccccaacatgctatgaaagtaatcaacgtgggcacgtgagattcgattatcttgtctttgaaagaaaaattgaaaaatccgacaagaggaatctcaaagaaaagaaagcatag

SEQ ID NO: 94718 - DNA, 255 bp, Glycine max
  Peptide Sequence Number=SeqID_211496
atggatggcgaagaattgccttcgcccatgaactccgatcaaagagcagaatcgtctcatgtcacagttagaagtcaagacaagttgactgcggaaatcaaccaaggtacatggggacggatgcaagtggggatagggtcacaaccgaccgatcgttcccctttcccggcgctaaacaagcagagaacatcgctgcaaggcagcccagtatcctttgcattcgcggtttcttttactattgtttgttttaaataa

SEQ ID NO: 94719 - DNA, 207 bp, Glycine max
  Peptide Sequence Number=SeqID_211497
atgaccattcgaatttctcgagagcttccggtgttcaatttcgagcgtctcgatgagttatgtacgcgtattggacatccgtgcgaaaagttacgaccattcgaatttctcgagtacttctgttgtgcaatttcgagcctctcgatatattacgtcccaaattcggacatccgtgtgaaaatttatgaccattcgaatttctcgtga

SEQ ID NO: 94720 - DNA, 141 bp, Glycine max
  Peptide Sequence Number=SeqID_211498
atggatacctcagagccctacactagggcaataagaggcaccgtgcataagcctcaagaaaacctaggggcatatcaaaagttcttacccgaagtttatccttcgctaccccctctgagccaaagcatacttgttttctaa

SEQ ID NO: 94721 - DNA, 417 bp, Glycine max
  Peptide Sequence Number=SeqID_211499
atttggctacgggcctctatcagtcctacaaggtgcccgtcccccccagcaaggtcatgccatcgtgacatagggatcgcacccctagtggacccggagaagtccaacagggtcctggggtttctagctctgattacgggcctttgtcagttctacggagtgcccgtcgcccccaacaaggtcatcaggccccctattaaccggactttcatcaagaagtattgcaccccccaggcaggcgcagggcaagacaccacaacagcctgtggatggccgacagtaggcaatagacgcaccgctgccacctccagagcccataagctcatctacaaaggctggagagttgcctatgacccgtggccgaccagcaggcgaccaagtccaaagccaaaggtgagcaaagtattaggtccgtga

SEQ ID NO: 94722 - DNA, 306 bp, Glycine max
  Peptide Sequence Number=SeqID_211500
atggctttgtgttcagtttttctcaatcttcatcttctattttttgtttgtttgacgatagaagcgttaggtgtggcaaagccttcagtagctagttaccttagccaggagatactggcagggcaagaagctgatagagtgcatggattacctgcgcagcctccggtgaagttcaacaatatggtggttatatcactgtcaatgaaactcaaggaagagcattgttctatttgttttttgaggccactcacaaaccagaacaaaaacccattctcttatggttcaatgaagtgttcactctcatga

SEQ ID NO: 94723 - DNA, 954 bp, Glycine max
  Peptide Sequence Number=SeqID_211501
caagacacgaggcatccatgtccgctccagagccatcgctcgtgtactgaaaagagaagaatagattggtaccagcttttggctgggataggaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgacggaagaaagcatgtctcctttccttgtaagggatttcggcgcgcaaaatttcaaggctatacaaagaatccataaggcatgggaaaccccgttaaggaaagatcaagaacttaggggcgttcgtaacggcatcattggtggttatcatgaatggctgaaagttcatatacgaggtttagattggctcgccaagttaaaagtcgtcagcgaagagagtttcgaagcaccggaagaagacgaagaagtccaagctctcaaaaacgagttaggaaaggcgaaacttgccaaggagaagttcaagttagccgctacacacatccggaaggaatgtgccggattacgggaagagaatgcaactaccgcaaaagcccttgaacaagagaccaagaatgctcgcaaggaagagtatggccataacaaatttcgcggagctctgtggggtagcaacagtgaactcaagctgcgaagggaagagagggaccagtcgcgagtacatagcatggtcttgaaagagaagttagttgcctgttcgaggtccaaaaggagcttgtctcagcgtttatgcgagacggagaccaacatgctggctatcatcgccaagtaccaagaagagttaagtctagccacggcccacaagcatagggtcgcggacgagtatgcccaagtatacgcggaaaaagaggctagaggaagg

SEQ ID NO: 94724 - DNA, 1131 bp, Glycine max
  Peptide Sequence Number=SeqID_211502
atgaagtttcaaggatcaataaatggattgggagtgcagattctactagataatgggagttcagataatttcctccagcctagactatctcaatgcctgaagttacctatagaaccaattcctaatttgcaggttttggtgggaaatggaaatgccttgactgctgaaggattaattctagacttggaggttaaaatccaaggtcatacactgaagctaccagtgtacctacttccagtttctggtgctgatctagtgctcggggctgcatggttggcaacaattgggcgtcatctttctgattatagtactctgacattgaagttttacttgggtaatcaatttatcaccttgcatggcgagagaccttccctacgacaacaggctcattttaatcacatgagaagaatgcatcatacgcatgccattgcggaactgtttactttacaatactcaaggttggatggtccacaggaccagttattagatataccggttgatatggaaccagaactggccatgatactttacacttatagaacagtctttgatgtgccatcaggattaccccctagcagaactcacaatcattcaatcccattggttgaaggtgctgaaccagaagggattattgcccctagcagaagccctttttcaccttcaatcattcttgtcaagaagaaggatggcacttggatattttgcacagattacagggccttgaatgccatcacaatcaaagatagctttcctattccccctgttgatgaactaattgacaatctgttgaacaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaggaacaacacccaatagcttttttctctaagaagctcacacctagtatgcaaagacagtcagcttatataagggagtcctatgctttcatagaagcagttgcaaaattcagacattatttacttgtgcaccgatttgtgatcaaaactgaccaaagaagcctcaagtcactcactgagtaa

SEQ ID NO: 94725 - DNA, 228 bp, Glycine max
  Peptide Sequence Number=SeqID_211503
atgtcccattcaggcgcatcatatatcgagacgctcgcaattgaaccacggaagctctcgagcaattacaatggtcataactttccaatcggaagtccgaatcaggcacatgagaaatctagacgcttgaaaatgaacaacggaacctctcgagaaactcaaatggtcacaacttttcacacggaaatccgattcaagcacatcacacatggagacgcccgaaattga

SEQ ID NO: 94726 - DNA, 129 bp, Glycine max
  Peptide Sequence Number=SeqID_211504
atgtctagaaaattgagaagagtacgtagacgtttatcatttgaagaaaatagagtagatgatcatggagatgacaaggaaggaggtactggtgttgtgggtgcttcagatggtccgtggcgtcaatga

SEQ ID NO: 94727 - DNA, 222 bp, Glycine max
  Peptide Sequence Number=SeqID_211505
atggaaaagagcggaggcaaacagaataattttgggtcaatgaaagaaagggaatggaaaatcttcagatcagataaattctcggcaagattgtcattctcgactggcgatatcccaccccacatgaacaaagaggaaaagaccgaaacacccagcttcctctccaaaaacaccaccctcgagaaaatcctattggtccgtgatcgtacgtttgatctttga

SEQ ID NO: 94728 - DNA, 144 bp, Glycine max
  Peptide Sequence Number=SeqID_211506
atggctacaaccaagagatctgtaatggggcttggcctaggcgggggctcactctcaatgtcttatcctaaggtagtgaagccaagagataaaggaagggtgaatatgttcaatttacttgaacttataattaaacaaggttaa

SEQ ID NO: 94729 - DNA, 318 bp, Glycine max
  Peptide Sequence Number=SeqID_211507
tatatggagatagcaaaggctagcaaggaagttgtgcggttagcaagactagtgaaagagctgggcattgagcaaggtggagttcagttgcactgtgatagccagtgtgctattgacttggcaaagaatgggatgtatcatggtaaaaccaaacatattgatgtgaggttccacaagatcagagagttgatgacatctggtcagattttgcccaggaaggttcacacatcagagaatgtagcttatatgttaaccaaggcaatcataactgacaagttcaagccatgcttagacttgttgaatgttgatgagtgctag

SEQ ID NO: 94730 - DNA, 192 bp, Glycine max
  Peptide Sequence Number=SeqID_211508
atgactcatcaggattttcaagtgcaagccattggtcagtttgctcaagcgacctgtgctcctgagtttggacttccaagaccgttcaatcagagattactcgtcttgcacgttggtggggagagaagtgagttatcaagaataggatgttggacaaatggcctcagttaccttaagaaaaaggggggttga

SEQ ID NO: 94731 - DNA, 213 bp, Glycine max
  Peptide Sequence Number=SeqID_211509
atgacggagggggtcggctcaacccgccattgccagtggcggcaaagcaggagagaggggtgtatcgcccctggtagtggcgacataggccacgtaggagtgagaatcgccattctcactggcgacacccaatctatgggactcgccattacgatgggcgggatagggcttcatggcgtgccgccagcccttctggcgggattggcagtgtaa

SEQ ID NO: 94732 - DNA, 912 bp, Glycine max
  Peptide Sequence Number=SeqID_211510
atggggaagacacatgaaataccccaccacaatctagccgacttcaagcctcgcctcggatacgccattgaggggcaagcaattggtggtggacccttgccaaacacttcggagcaccctccatttcgtccacaaccacaacccttgcatttcgcggtagggagagtccctcctgctatggcaggaaaaggaaagttggatcatatagaagaaaggctcattgccattgaaggaggtggagattattcctttgctgacatggaagagttgtgcctagtaccctatgtggtcattcctccgaagttcaaagtgccagattttgatatgtacaaggggactactttccccaagagtcacttgaagttgtattgtcggaagataggggcgtacgcgaaagatgaaaaattgttaatgcatttcttccaagagagccttactggggcagccgtcacctggtatactaacttggaaccttcccaagaatacgcccagaggtggagggaattggcagctcgagtggccccttcaatgacggagaaagagatgatcacaacgatagtagacacgttaccggtgttctactatgagaaaatggtgggttactcaccttcaagctttgctaatttagtttttgtcggcaaaaggattgaagtgggtctgaaaagaggcgaatttgattatcctgctttgacaaataaaaagcctggggcaaatagagaggatgagaaggaggaaggaacccatgctgtgactgtcgctcttacatggccaaatttcccaccagctcaacaatgtcattactcagccaatatcagcccttctcattacccaccatccaatcagccacaaagtctgcctgccgcacatccaataccaaactccacccttaacacaaaccaaaacaccaactag

SEQ ID NO: 94733 - DNA, 504 bp, Glycine max
  Peptide Sequence Number=SeqID_211511
atggctaacaacaaaaagcaagcaggaggttcttcttcatcaaccatgaagtttgaccatctttttggccccaaggactcctcctccactacatcttcctccaccggcctctttggctccatctttccacctccgccttctagaatcaagaatgcaagaagtgggagcaccagtaaattggctcagtttggatttgctttaggaactcagaccaataaaagtgaaagcagcagtcgcatcagtaacaagaatactagtaccaattatcagaatgagactgtggagcctagctacttcagctcttctatctactatggtggtcaagaaaattattccccaagaagcaggaccactcaaccccaccatgttttcaagaaagataaggatgatggtgattccaatagtaacgactcaaacagcgctgcaagagggaactggtggcaaggtaggagcaggatatatagtcttggaacagtagctaaaggaattaaaaatgttatctaa

SEQ ID NO: 94734 - DNA, 771 bp, Glycine max
  Peptide Sequence Number=SeqID_211512
atgtcctcgccttcagagggctacatgcccttgccatcagagggctacatgccctcaccttcagagggctacacgccctcatcttcaaaggactacacgtcctcgccatcagaggactacacgtcctcgccttcagaggactacaagtcctcgccttcagagggatacatgccctcacctttagaggactacacagggctacacgtcctcaccttcaaagggctacacatcctcaccttcagaggactacacgcccttgccatcagagggttgtacgccctcaccatcagaggactacacatccttaccatcaaagggctacacgccctcgccttcagagggctacacgcccttgcctttagaggactacacgtccttgccttcagagggctacatgacctcacctttagaggagtacacgtcctcacctttatagggctgcacgccctcgcccttagaggactacacgtcctcgccttcagaggactgcatgccctcgcctttagagggcttcacatctcagggccctggggtttccagctctggttacgggcctttgtcagtcttacagggtgcccgtccccccaacaagggatcgcgttcgcaagacacccagtggacccggagaagtccaacagggtcctggggtttccagctctaattatgagcctctgtcaattctatggagtgcatgtcgcccctagcaaggttattaggccccctactaaccgagctttcatcaagaagtattgcgtccctaggcaggcataa

SEQ ID NO: 94735 - DNA, 207 bp, Glycine max
  Peptide Sequence Number=SeqID_211513
atgggtctgaggcttcagtcctcactttggggcagaatcgtcttagacgacggtcagaggtcgagacaaggtcaaaggcagaaaccaatcaaggtacttatggacggacgcaaggaaaggctagggtcacgaccaataggtcgtcatcctttgcctagctcaggacaagcggaaaacacagctgcaaggcagcctagtatcctttaa

SEQ ID NO: 94736 - DNA, 792 bp, Glycine max
  Peptide Sequence Number=SeqID_211514
atgaagaagctctgtcccaatcttactcgcgaggatgggctcgaaacggtgctggaggttcccatccctgaggagattttcaccatcaagagtggaaccagcagagcttggcataacatgaagtcatggatgaagccaaatgttgaatcttcaagatcatcatcactctttggaggccaaaacacagatatccaactattgcttggtgttgttggagcgccattgatccctctccctgtcacctctcacaaccaacctatcaccattaaatcccataacattgaggcttcgatggcgaaatacatagtgaaacaatacgtggcggccgtgggaggagagagtggtttgaattcggtggaaagcatgtatgcgatgggtgaggtgagagtagggtcagagttttcagaaggggaagaatgtgtgagtagcaagaagacgaagaaggtacagatgaaagaggaagtgggagggttcgttgtgtggcagaagaagccagaactgtggtgcttggaactagttgtttctgggtacaaaatcagtgccgggagtgacggcaaagtggcgtggaggcaaacaccttggcatcattctcatgcttctcgtggcccaccaagaccacttaggcgtttacttcagttttttttccatttaattaaagttgttaagttgcaaagaggatttggtgtgttatgttactgtggggacattggggttaaagagaggattcgcgcaactttaaatttttttgctgattttcatgctaaattccctgctgtcggttttcaagtttga

SEQ ID NO: 94737 - DNA, 459 bp, Glycine max
  Peptide Sequence Number=SeqID_211515
atgttggttactgaggacaagtctcatgttgctgttgctatagacaatgatggctgttgtcaccggagctctgccggcggtgaggggtgctccgacgctagcgaccggacagataaggagcaaaggaggtcctcccatgtttctggcactgagattgtgggagtgtgtgaggagagaggatcagagtgttcagtggaggtggatctggttcctgaggttaaggtgcatttggccaatgaggagagggattgtaggatttgccatctcagcatggatatgaccaaccatgaatctgggactcccattgagttgggatgttcttgcaaggatgatttggctgctgctcacaagcagtgtgccgaggcttggttcaagatcaagggaaacaatgtctcaatagtggagtgtgaatctgattcttcttttgcaaacaaaaagatattgtgcgagctaaattag

SEQ ID NO: 94738 - DNA, 1121 bp, Glycine max
  Peptide Sequence Number=SeqID_211516
cttcaatcttgcctctcagcctgtgtctcgcatctcgtcgtccgtcgtgctaccagcagtcatcccgtgctaccagcagtcgtactgaaaaggttgtttacaatcgcttgttcgcccaaacaatttttagtgtttgggttgaatgtttggttgaaacgcataggtttggttgccggaagcgtgaagggaccttggtcaccggaggaggacgcgctgttgagccgattggtggcgcagttcggggcaaggaactggggcatgatcgcgcagggagtgccaggacgctccagcaagtcgtgccggctccggtgggaggaggaagtgaaccaaagatccacatgccatgcactagattagccggtcattacaaatatcttgactgtcaattatcaatatctaacagtaatgagaattcaatttctgcagaggaagaggataacatcatagtttcagcccatgcaatccatggaaacaaatgggcaataattgctaagcttcttccaggtagaacagataatgcaatcaagaatcactggaattctacactgacgcgcaagcgtatggaaatgggaagatatgtcccagcacatgctgatgtgatcgaagatggtactggtaactttgaaaaaacaaaagcatcctctgaagaaaccatgtcaattggggatatcaattcattgaatcctgcagaagtcagaaatgtcatgatgaatgatgaaactaaacctccaacaaaagatgatgctaaagtggaggaacatgctactcttcatcgaccagtagcacgtgttagtgcatttagtttttataactctccaggcaggccaacaatggggtcatgttcaaagatgttcccaaggcagagccctttgatccaatcccccaaaccagacgtaggaccctgcaagcaggccaacaatgggatcatgttcaaagatgttcccaaggcagagccctttgatccaatcccccaaaccagacgagactcgagggaaagccatttgcatggttcacttctaggtcccgagtttgttgactatttggagtcacctttctctagtcatgcatttctttctatagctacggacttgaactgttgtccaaagtatcacagaaaatga

SEQ ID NO: 94739 - DNA, 915 bp, Glycine max
  Peptide Sequence Number=SeqID_211517
atgaatggaaggacttgcttgggggattttatttaccattacatcacatcagagaaattctctccagagtgcctgcttgattgcctagacctctcctctgagcatgttgcactagagattgcaaactgtgtggaagcctcgatatacgtgtggcgtagaagagctcactctaaacccccagctaatcctaatcgttcatctacaaagtcatcctgggaaattgtcaaggacttcatggctgatggagataagagagaactactagcagaaagagctgaaaatgttctactttcattgaagcaaagattcccaggtctcactcaaactaccttggataccagcaagatccagtgcaacaaggttccattccatgcttctgttaccttattttcatccaatttgcaatattttctctcaaagcctttaacattaacacatttcatttcaaacattcaggatattggaaaatccatactagagagctattcaagagtgttggagagcatggcatttaacatcgtggctcgcatagaagatttgctatatgtggatgacttaacaaaacattcagataggtttcctctggttccaatgacagtgtctgtctcaggcactcctcataaagcaattggcacaccaagaagcttttcacctgcaccaccactaattagtcctgcaaggggagagagatcccctttccttggcaacaaccacaacaacaataataatatcaaacctcaacgtcgtggcttcggggtgagaagagtattgtcaaattatctaggggcagaatctaaagaaacaaagattttaagcaattcaactgtggtgaatggttcaaacacaagcaacaataaggaagaacaaccagaacgtcaaaagaaatcacatgccatgcatggcaagacaaaatga

SEQ ID NO: 94740 - DNA, 609 bp, Glycine max
  Peptide Sequence Number=SeqID_211518
atggatgctttatgcaacaagggtgaaaattttcaaaagaaaaaagatggggttccttcttcttctagtgattcaactcacgaatgttcttctccttctcttggctggcctattcggaaggctacactctccaaatgccgcaaatcagatgaaaaagaaaatgaacctgtttctcacttggaagattcaaaatttaccactgtcagttccaaaatgtcaggaattgatgcaatgaaggaaaggtttgcaaaattactgcttggggaagatatgtcaggatctgggaaaggagtgtgcagtgctttggccatctctaatgctatcactaatctctgtgcaactgtgtttgggcaattgtggagactagaacctataccttgtgaaaagaaagaaatgtggcggagagagatggaatggcttcttagtgttagtgatcacattgttgagttaattccttcttggcaaacatttccagatggaagtaagcttgaggtaatgacttgtaggccaaggtcagatcttttaatgaatcttccaactctgcgcaaacttgacagcatgcttcttgttagtgtaggatcttactttcattgtgtgctagtagagtag

SEQ ID NO: 94741 - DNA, 219 bp, Glycine max
  Peptide Sequence Number=SeqID_211519
atggctcactctcctccaacatgtcccaaaatagcaacagttacagtatttgcagtaacagtgaatgaattatcgtgtatgaagggaccgttgaggttgctgtgggcacagcatcctggaaaagacgagggaatgaagaagaacattatggctttttgggaaaagtgtggaatgccacatgacataccaacgtctctctggctttcgctctcagagtaa

SEQ ID NO: 94742 - DNA, 871 bp, Glycine max
  Peptide Sequence Number=SeqID_211520
accgtcgtctcaaagccttggaagaatccggcgccatcctgggctatcacgcacgcttggggcccagcgcgctgggcctgaacttcgccgcactggtgttcgtcaccctgcgcgaggtcacccgccagccggtagcggatttcgaggctgcggtggcagcgatcccacagatcgtcgaagcccagcgtctgttcggcgacccggactacctgctgcatgtggtcactcgcgatctgccggcgtttcagaagctgtacgacgaacagctcaccagcatccccaatgtgcagcggctgagctccaccttggtcatgaaggaagtgctgcaggatcggcaattgcccatacgaaatcgagcacctcgcgcacccggatgtgcgccgcggccgggtgcagggggttgaccaccaggttgcgttcaagctgcaacaccaccgagggcacgaccagacccaaatggctgcgggcctggagccagcgcgtgccatacgccatgctggggctgtcggcgggcagcgcatcccagccgggcggcaggtcctgcggcccgggcgccaggtacagggcggggtcgtcaggcagttcgaagcaggtgatcttcaagggaaactgcggacgcccggcggcatgcacgaacgtctccaaggtgcagatcgccggtgatagccccatgtacagcgcagggacatcgacctggttccaacggccaccaaccaaggccgctcccttgccgctcaggtcatcggcccgggaggccttggccacacgccaggccagcatcagacgacgccgccccactccaaggccgccagcacccgacgcacttgtcgtgcaccgatctcggtctggcacagcatcaccggcgtcatga

SEQ ID NO: 94743 - DNA, 225 bp, Glycine max
  Peptide Sequence Number=SeqID_211521
atggcacaattgatttctgatgtcatctattgtttgcagggatcgcacccacaaagacacgcagtggacccggagaagttcaatagggccctggggtttccagctctggttatgggcctctatagtcctatagggtgcccgtttcccccggcaagggatcgtgcctgcaagacacccagtggacccgaagaagttcaacagtgtcttggagttgtcaagctctaa

SEQ ID NO: 94744 - DNA, 228 bp, Glycine max
  Peptide Sequence Number=SeqID_211522
atgccactaaagggctcgcttagcaagctagattggctaagcgaggcttatccgcttagcgaggaagcttgctcgctaagcaagaacaaaaccctagagaatgttgagccagagagcagcatgcttggcgcgcagccaggtttgagtattggaaaatgcttaaagtccttagaacttggtagagcagctagaagtctgcatttcaaggaatatagtgcagtaatctag

SEQ ID NO: 94745 - DNA, 519 bp, Glycine max
  Peptide Sequence Number=SeqID_211523
atgaggaggaagaggttttgtccaagtagagtggcttcatcaaccatcatatctgtcataaagtcacaatttaggaaacttgttgcttggaaacccgaagatgaatatcaagttaaggaaaatttcaaatctaaaggatcaaagcatctatctcaaattcttttagagaagttctccatccaagccaagaagaattattcatctgaacaagggcgatctatgcacacaaggggatctatctcagcccttgattggatagtgcatttgtttcataggtttggaaaacctccccacattgtgaagctgttcaaagagacacgcagtaggaaaaaggacaacacttgggtggataagagatcaaagaaaaaacctatggagactttcgaaagaaattacaagaatgctctagtggtgggacacaggcaattaaacctacatcaagaggaaaattgtgggatgatgttgctgaaggccttggggacgtctttatggggtaggaaacgtgtcctcccattatag

SEQ ID NO: 94746 - DNA, 465 bp, Glycine max
  Peptide Sequence Number=SeqID_211524
atggatccaatgaagtatatttttgagaagcctgctcttacagaaaggatcgcttattatctagcacaccaacctgaagattatcagtcaatgcaatgtgaattccccgatgaaggaataatggcgttgtttgacaatgaagattcatcaaaagaaaaaggatggatcatgtggtttgatgatgcaaagctaattccttaccaaacccacatcaaggaattggtgaaacaatttgatgaaatcatgtttaagcacattcctcgtgtagataaccaattggcagatgcactagccactttatcatccatgttcgcattgagcaaggaagaggacatgccacttataaggatccaacatcatgatcagcctgcatattgtcacttggtagaagaggaatctgatgggaaaccatggtactttgacatcaaagagtcaagattatcctccaaatgccctagagaatga

SEQ ID NO: 94747 - DNA, 2270 bp, Glycine max
  Peptide Sequence Number=SeqID_211525
gattgcatcaaacacgctctccaggaaagatcatggatgagtttgaagagctgaggagtgacgttgatcaattgaagcaacaaatgacgtcgattatggagatattacaagctctccaaatgaaggctttagagaggacccctacccgagaacaacctatcactttgcaccttaataggcatggacaacatgctgaccttgctcaagcttacccatatggtctcccgcctgattatacgccccccattgcaaacacaacagaacccactcagccaagggttgaggttctgatcccaactaaccaaccggttcattccatgcctccaatcaaccacaacatgatacaggccacagaagaagtcccaatggcctgttcaaatgagcaactgcaaatgttggaggagaggtcgaaagctgttgagggtagtaattatggcatggcagaagctgcagacctttgtttggttcttgatgagtatgctcaaagatggcgagcagtggcagctcaagtggaaccccctttatcagagaaagaaaccacaacattgtttaccaataccttgcgtgagccattttatgacatgatgattgggtgcacctcgtcaaacttttttgatatagttgtcataggggagagagtggagaacgacatgaagaaagggaggattgattctcctaaagcagcgaattcaaaaactcttccaagcgggggatacgatgccaaagccaaatatgactatcatgagaataaccctaacatagggaataatcttttgccaggacatagagagccattggttactgtcattgaagagggtggagagcaactcagaagaatgaggatgaggtataacttacaccctaaagcaagccaagacttcaagaagatcttgcaagacttgatggataggcaattgatgaaaattggttatttcgaaattgatgtatcagtagttgactccagttcgaaccttccaaaacccttagcggtgcattatacaaagtgcactactagctcgacctctagtggaccaaagctcatcactatacaagttccaatagcttttccttgtaaggataataaagtagtgccttggagatatgaagtcaaagtgtgtgttgatggttctgatgaaaaacaatccaagaatgccaactcagaagctaccaatgttacaaatattgttggacttggtagtatgactcggagcgatcaaatctatagtcctagtgaatcaaggaccaaaccagttaaagaaacaaagagtaaagaagttgtgaggagtccagaggaacaaaggaaagaaatttctaatgaagaggctcgcaaattcctgaagcttataaaacaaagtgactacacagtgatggaccaactcaatcgcacccctgccaaaatatcacttttgtccttgatgttgaactctgaaccccataggaaggtattgttgaagatattgaatgaggctcatgtcattcatgacatctctgaggagaaatttgaaggtattgttgttgataatggtccctcattgaatgtcatgccaaagacaatatcagtaaaactaccatctgatgagtcatacatgaatccaagcactatggtagtatgcactttcaatgggtctcgtagagaagtgattggggaaataagtttgcctatccagattggcccaattacctttgaggtagtatttcatgtgatggacattgcgccaacatatagttgtcttctaagaaggccttggattaatgacgcaagagctgtgccctctgctttgcaccaaaaattgaaattcattgttgatgacaaactgatcattatttttgttaaggaggacctactagtcaacaagccatcatccattccttatattgaagtttttgaggaatccttggagacctcattccaagggcttgaaattgcaaattctaattgtgtgaaggaagggaaagcgattactcaaccttcaggtgcttccatgatggtagcaaaagttatgctagagaatggatatcaatatggccatggactaggaagacataggcatggtcctacacaagtgcttgatttggtggaaaacaaagaccgattcggtctaggctacaaaccattagaagctaataaaaggcaggctatgcttgaaaaaaagaaagaagactggcccgattggaaaacagagagcctagaattgagggggtcctcatctgcgatttacaagagagcttttggagtgttgggtagctactgtagagaaagacatttttga

SEQ ID NO: 94748 - DNA, 810 bp, Glycine max
  Peptide Sequence Number=SeqID_211526
atgtatattatgcagacaaagacacgaaacatatttcctttatggtatcagcctaagtttcctctcctccatctagccgtcattcccacaacctctctttactttcttccactccccttcttcctgttcgtcaccctcaatggctgcccaacccaagtttcacctaactttagcaatcaccaacatgaaatccctcctacgattcaagcacgagtccataacaggcttgatcacggcatccctcctacggatgagaaggctaagaaggcaatagatgattcaaaagcagtcgatcctgatctttggcatcgtcttgatgtggccatgttacaatggatagttgcggctattttccaagacaacaaacactcgagggttgtccaccttgaaaatcaattctcaaacacgaatttggaggattttcctacgggaaaagcgtattgcaaccgcctcaagcttctagccgatcaattggcgaatgttgatgctctagtctctaatactcgaataggggtaacaaaaataacaaaaatttgggtggccagaactccggcagaggaggtcgtggctctagcgacgatggcttcagtggtgggcaaggtgttggcagtggcaatcgcggacaacagcagcaatgacaaactccttggcaatggccatggcagcaaggtgctccttggattgtgccgccatgtccatatcccacatatagttggaccaagcccaatgcaactcaaaggccacaacagcctggtctccttggatccaggccattgcaagcagcatttaatgctatcacatccagcctga

SEQ ID NO: 94749 - DNA, 552 bp, Glycine max
  Peptide Sequence Number=SeqID_211527
atgtctttcttctatggaaatcgtttcatgggctcaagcaagctcctagagcctgatgaaatcatcttagttgcttcttctgatactcttcacaagtctatcatgactcttctcagctcagaatttgctatgaaagacttgggtccactgggttacttcttgggtgataatttgctctcatggtcttccaaacatcaagccgcactttctcactctaatgcaaaagcaaaataccaaggcgttgctgatgttgtttttgagtcatgttggttatgcaatcttcttctggagttacattttcctatccataaggctacactggtttactgtgataatgttagtgcaatatacctttctggaaatccaattcaacatcaacacactaaacacatcgagatggatattcactttgttcgcgagaaagttgctcatggacaaatattttcacaaaaggacttcctttggttttatttcaggatttcagggatagtctcagtgtacgagaacctcccgcttcaaatgtggggatgggctgtgatagaatatatgtaa

SEQ ID NO: 94750 - DNA, 330 bp, Glycine max
  Peptide Sequence Number=SeqID_211528
atgagaggcaccatgcatgagcctcaagcgaacctaggagcagatcagaagttctcacctggaaaaacaatcaggagtgtgtttatcaggggattggtcctgaaatgcaaactgcaaaaggatcttgtaaaaatgatgacaaaaagcctaaagaatgattttaagattgagtcaacaagttcaagatcaagtttaatttcaagtttcatgagaagaaatcaagaagattcaagaatcaagagaagtttgatttcaagattcaagaatcaagagaagtttgatttcaagattcaagagaagatgaattcaagattcaagagaacaaattaa

SEQ ID NO: 94751 - DNA, 174 bp, Glycine max
  Peptide Sequence Number=SeqID_211529
atgtatgacaaatgtaattttgagatcgacatgagacacctggagaaccctcatttcctagttaacaatgcattaggaatgatatgtccattacaatgccatgaagagatgcatgatgcgatcaaggaaaaagccagagtgagattgctatgtgcccataattcaggaacctaa

SEQ ID NO: 94752 - DNA, 435 bp, Glycine max
  Peptide Sequence Number=SeqID_211530
atgaaacagataaatgcagaattggcctgtgataaaaatgcggcatcgtccgaatcctcaggattaattaatcaacttcgtcaaatagatatcggtgcggtgccgatcgcgttgttcatcgcgatctgcgcgatcgtggcgatttccgcctacgccaacttcctgccgaagaatatgatcggcggcctggcggtgataatgacgctgggctatgcgctggcgcagttgggaaaaagcattcccgtgctgcgcgatatcggcgggccggccattctgtgtttgatggtgccgtcggtgttggtctatttcaatgtcttccagcctaacgtcatgggcaccgttcatctactgatgaaagacgccaacctgctctatttcgtcatcgccagtctggtggtcggcagcattctcggcatgaaccgggtgatcccctaa

SEQ ID NO: 94753 - DNA, 736 bp, Glycine max
  Peptide Sequence Number=SeqID_211531
gccgtgctcgagctcgagcggctcccccgcgaccacagacggcatctcaccgggggtcacgtccaccaccgggagcgtgccggagagcggctcgcgcgtcggcaggttcaggtgcacggggccggcgacgccgcgcacgtgccccgccccctcgtgtgcaccgatcgccgcggtcacggcccgccgggcaagacccgtccacacaccgtcgcccggaaccggggcgtcgacctggtcgcgcacgaaggcgccgaagaggccgggctgccgtgtcgcctggttcgccccgaccccccgcagctcgggcgggcggtcggcggtcagcagcagcagcggcacgccggaatggaaggcctccatcaccgccgggagcagattggcgacagccgttcccgaggtgcagaccacggcgaccggaagcccggtctccctggcgatgccgagcgcggtgaacccggcgacccgttcgtcgatgcgcacgtgcacgcggaggtgcccgtcggcggcgaaccggaccgcggcgagcgcaagcgcctgcgaacgcgagcccggggacagcacgacatcgcgcacaccctgctcgatgagctcggcgagcagggacgccgcggcagtcgtggccggcgacgaggtcacgggcgctgatccgtggcaggcggctcgtcgttctcctcgtccaggcgcgcgagctcctcctcgaggcggcggatgcgcgcatcctgctcggacttgctga

SEQ ID NO: 94754 - DNA, 154 bp, Glycine max
  Peptide Sequence Number=SeqID_211532
atggataaccatcagcatggaaatcatagtgatccagcacaagccaggataaagaaaaaaggtatcaggcagcacaaagttaatgatcaggctcagaatattgattctaatattcctgattcatcagaggataagagttctgaatcaacacaag

SEQ ID NO: 94755 - DNA, 303 bp, Glycine max
  Peptide Sequence Number=SeqID_211533
atgtctagcaaggtactaaagtgtttgttagccataaagggaagcacacaatttcccttttcatatgaaaggacacaatggaagagagtagaatgctttggcaaaatattcctcaatggtcgttttcattatcgaagaggaacacatgcaactttctgtacttttattcctgtccttgccattcagagcatgccacatgttttcacctccagttgtgagacaatggtcatatcaaggttgaagaccgatcccttaataaatccttcactgaagtctataaaaggtgtctctcctttagaataa

SEQ ID NO: 94756 - DNA, 414 bp, Glycine max
  Peptide Sequence Number=SeqID_211534
atgggtgccaaatacctcgaagtggtcaaacgagggtcgcatcccaacaacggatggtccccggacaaaattaggggttaccttatggttacccgcatctttcatcaaccaggggcaaacaagcccgttgacgcgcagagactaacatcgtctcctacaccttttgtcgtcctgactcgtgaagtcagtcaggtgatatgcgggattacctcatggttacctgcacctttcatcaaaccgggggcaaacgagcccgttgacgcgaagagactgacatcgtcttctacactctttgccatccagggacatcaagtcaggtggcaggcggagataccttatggtcatcggcgcctttcgtcaatcgaggggaacgacttcgacggtatcaggatgatgttggccgttcggtgctga

SEQ ID NO: 94757 - DNA, 186 bp, Glycine max
  Peptide Sequence Number=SeqID_211535
atgtgtggtgcacctagcaaagcccccaaggaagcttgcaggggaggaggggctttcaacatatgcacactcataggcaagggcaatccctctgggagtgcaacacagattcagacatcatgtgacacgaggggcaaatgtcttgatctgacaggtctctactataccgcatgtcattcctcataa

SEQ ID NO: 94758 - DNA, 291 bp, Glycine max
  Peptide Sequence Number=SeqID_211536
ccggcgagtcaagccggcgaagaagtcctcatcgtcgctactctcagtcccggtcgaaccggaatcaaccggttctgtcccgaccgagtcaaactcgtagggaaactcagatgggaacccaaacgcggcgtcgaactcggcgccatccatggctcagtgagtgaacaaaagattctaactttgaagttgagagaaaaacagaaaaggaaaggtccgggaatgggacccaggcaagggagagaaaaaaggaagagagaagtaaaaggcgaattggaggataatagaatgtaa

SEQ ID NO: 94759 - DNA, 348 bp, Glycine max
  Peptide Sequence Number=SeqID_211537
atgcagcaagctgaactagaaaagcttgacttggtgaaacttcggaagaagggtttcctagggattgatcccttcaactatcctttatgggaaacacttcctaaagaagaagtgaatgctctaagtctatatggggaaaaggaaccagtgctcaaggattttcccgtcaaacacattgttgcccctaatcttaacaatctggatcacaccaagattgaggaaaattttcaaaatgagggcatgcctttggaagtgcgagaagaaagccctcattttcaagagtggaagaagtcaaactatggatatgaactacgaatgaagtcgttagcctataaagatgagatttga

SEQ ID NO: 94760 - DNA, 963 bp, Glycine max
  Peptide Sequence Number=SeqID_211538
atggtttacaggaggtacagacaatactatcagcagatgcacgcggtagtaacttcatttgagtatgtctctggcctgagcaatgcagctccttatgcaagtttggctataaaagccatgtccaaacattttagatgcttgaagaatgccattactgatcaacttcagtttgccaataaagctcattttcacatcagcaataacaggaaagatgaatctccatggtttggcaacagtgataaaggcccttatggccaaaggcctgggtttcttgagcaccaacctgtttggcggcctcaaagaggactccctgagcgcgccgtgactgttctgagagcttggttgtttgagcactttctgcacccttatcccactgataccgacaagctaatgttggccaaacaaactggtctatctcgtagccaggtgtctaattggttcattaatgcaagagtaaggctctggaagccaatggtggaagaaatacatttgctagaaacacggcaagctccaaagaatccgcagaaggaagagcattgcaggaacaagctaagtgatcatttgtcttctgataactccattgtttctgagaatccatctacctccacagataaatttcaggaagctccttacaagcacaccataaacgaacttcctaatgtaccaattaggactcaggaacagctgaatctaccctgcacaagcaatcagccaggaggagggggtgttggagtgagcatgggtggtggcagtgctagcaatagtgtgtcactcacactaggcctttatcagaatcatggtattggtctggctgaacctttccccttgaatgcagcgcagcgatttggtgttgctcttgataccaacaatgaaggctatgttatgagtggttatgagtcacaaaataggcattttggaagagatgtcattggaggacaactgttgcatgactttgtaggctga

SEQ ID NO: 94761 - DNA, 1263 bp, Glycine max
  Peptide Sequence Number=SeqID_211539
atggctgagggttttgaggcttaccatgtgccacaacaaagcagaagagataagcttagagttgtggcgacacagaaccaacaacatggtctcattgagccctcctcgactttgcttcctttgtacgacccttcttcttttatatcttctgatttgttgttgacgagcttccacaacggccaaaaacataacttgggtggttgtggtgtgaaggaagaacaacgtgcgaatttgatgatgggttttgcagcagcaggaggaggagttgttatgaacaatggctcttcttcttcttcgtgttgttcttctaactcctcttctgtttcttacttggatcctgaatcgtctttgcatttgaaccaagccacaattcaggttattaacaacaacaacagcaacaacatgtttctctaccaagcacagaacctgagagagtttgatcagggttataataataacaacaacaacgacgacgacaacaataatagtgagatcatggtgtttaagcctgagcctttgtctttgtctctgtcatcacacaacaacggtgtgaatcttcagcgatacggatctgtggtttatggtgataaggttggtggtggtggggtgatttatgggagttctggtttgaatgaggtttcgaggtgcacagtgccaatggggccatttactggctatgcttcaatattgaagggatcgaggttcttgaagcctgcacagcaattattggaagagttatgtgatgttggtggggtttgtgctgagaagattgtggctgatgcatcgttgatggagcctattcctcctccacagagttcaagtgaagatccactaggggatcatgggggtgatcaaggtcgcaaaaagtcaaggctcttaactatgcttgatgagttagtcattttgtccagttttgttactgtttttagtttggtttatccagaagataaatgggttttggctttcatggatggtcttttaactgtacattctatgtgcatcatcaagattcttgtatttcctgtgatggatggcctcggtgaactcaattgtccttttggaaaagttaatggtagggaatatatgcacgaagatgagcatggtattcgtaaagtgtctgtcaactatataaagatttctaatgtgaccatgacatccagtttgggagggataatttgcataaagttgttgaaggaatccatcggaaaagatttatactccgaaaaagtgtgtgttgatatgatcatggggttcaaaggttaa

SEQ ID NO: 94762 - DNA, 411 bp, Glycine max
  Peptide Sequence Number=SeqID_211540
atgtcatgctctcgtgcgttgtcatcacgttggaccagcgtgaatgaggaactcgaacagcttcttgcaaatgtgcccaagcatggggaatggaaggaattgacaaacacgatgcaggatgtcgtgactccatcagaggcttttttccataccattagcgccaaggaccaaattttcagtgaagttggtaaggatgtttcaagtagcatgtattattttttgaaagacaaaggctggactcatttgcacttggaggacgttgcagaatgtcggctcgtgttcaataattggaggaagacactaaaaattggagccagatggaaacatttctgcgagaccttgtcgttcactgctgacatgaaaataactttcgaattcattaatcccaatgttaaccgcgtgctttattag

SEQ ID NO: 94763 - DNA, 309 bp, Glycine max
  Peptide Sequence Number=SeqID_211541
atgggtgccaagcacctcacgaggaccaaagaatggtcgcacgtcatcgagcaaaggttcccggacgaaattagggaacaaaaggtgcagaagactgtgtcagcccttgcatgctatcaagcgttctgtcttacagatagcaaaagaatgggtgcgaataaccataagggtgcggataaccgtaagcaaaggggtgcggataaccgtaagggtcagtatgacaaagattatggggcggccgacaaaagcaaagctcttgctcctacgtatcctccaatgaggaactcagacctacgtagttctggataa

SEQ ID NO: 94764 - DNA, 976 bp, Glycine max
  Peptide Sequence Number=SeqID_211542
atgggcttaagtcaaatgccttcacttaaaaagaggttctatcaagtcaaagtcaagagcctaggaatcaccagtctaaaagagttagggcagttgatgggtcagctccagcggcaagcttatcgcaaagcttacggtaaaatctgggacctagccatggcagaagtctccacagaggccattgcctcccttgttcagtattatgatcagccgttgagatgcttcacttttggggacttccagctatcacccatggtggaagaatttgaagagatcctaggatgtagaggcgaatgggccccgttcatagacatcctcacgcttttgatcttcggaggagtcctctttccaaatgtggatgggttggtggacctagcggcgatcgatgcttttcttgcctttcatgaccgcaaggaaagcccggttgtcgctatcctagccgatctatatgacaccttcgaccgaagatgtgaaaagagcagtacaaggattgtttgctgtactccggccctctacgtatggctggtttcacaccttttctgccaagaggtgagacatgcttgcccgctagaaagccaccgttcatgcacagagaaaaaaaaggcaagttgggaccgactcttagcaagcaaagaaggagcatctatcaactggttccctcgatggaaagaaggaagaaccggggttcttatttcgtgtggaggatttccaaatgttcccttgatggggacaaggggttgcatcagttacaatcttgttccttctataagacaactcggctaccctatgagaggggcaccactagaggaagagcttgcacctattattgcacgaggtttcaataacaccaacgcggaggcacttcagaaggtccgcaaggcatgggagatggtgcaaaagaaggacaaggaactcagaggcagtaacaacgggcccatcggcggctaccgtaggtggttgaaagcccacatgcaag

SEQ ID NO: 94765 - DNA, 1002 bp, Glycine max
  Peptide Sequence Number=SeqID_211543
atggaagcgcgtgtggggatggtggtggaagggggccagagaaccctcaacgccgacagcggtggtgccgcgaaattcctggtggcgcagaacaaccgccagctcgggacggttcaccagcttctggccggcggcatctccggcgcgtttagcaaaacctgcactgctccccttgcgcgcctcactatcctctttcaggtgcaaggtatgcattctgatgtggcagcattgagcaaccctagcatattgcgtgaggcatcacgtattatcaacgaagaagggtttagagcattttggaaaggcaatatggtgactattgctcatcgtctcccatatactgcagtcaacttctatgcttatgagcgctacaagaatgtattacattcactgatgggggagaatgttagtggaaattcaggtgcaaacctccttgtgcactttgtgggtggtggtttgtcaggtataacatctgcttctgccacctatcctttggatcttgtgagaacacgacttgcagcacagagaagtaccatgtactacaggggcatctcacatgctttcagtaccatctgtagagacgaaggttttttgggtctgtataagggacttggagcaacattgttgggtgttgggcccagtattgctattagttttgctgtttatgagtggttacgctctgtatggcagtcacaaaggcctgatgattctaaagctgtggttggtcttgcttgtggcagcctttcaggaattgcatcctcaacagcaacatttcctttggatcttgtaaggcgtagaatgcagttagaaggtgttggtggtcgagctcgtgtctataacactggcttgtttggggcatttgggcgcataattcaaactgaaggggtgcgaggtttgtacagaggaattctgccggaatactacaaggttgttcccggcgtgggcattgtctttatgacttatgaaacattgaagatgcttctatcaagcatttcaagttattag

SEQ ID NO: 94766 - DNA, 243 bp, Glycine max
  Peptide Sequence Number=SeqID_211544
atgaagtctaaaggtgagacgatgtcccacgatgaagggaacagtcagagtggttttgcacttgcacaaactcatggtggtgtcgaacttacgatgaaacttgaagttgcaaaggatgaggcatatgacaactacggtggaatgatggtggtgatgacaacaacgatggtggtgtggaatagtggtagtggcaacgacaacgacgatggaggtgacaataataatggtagtgatgacgattag

SEQ ID NO: 94767 - DNA, 336 bp, Glycine max
  Peptide Sequence Number=SeqID_211545
atgactagagtatgcaagtggagtagttgctttccttcttgtatgcgaggaaacctcttccatggtctgccaaatgaagattcgtatacttatttggctacttacatagagatatgtaatacagtaaagatagcagaggttctggaagatgccattcgccttaatttgttccctttttccttggtcagtgaagcaaaaagatggcttcattcattcaagggaaacaatttgagaacttggaaggaggtggttgagaagtttttgaagaagtatttcttggaatccaaaaccgccgagggggaaggtagagatttcctcatttcaccaattccctga

SEQ ID NO: 94768 - DNA, 1035 bp, Glycine max
  Peptide Sequence Number=SeqID_211546
atggccacggttcacaagtggctcactcatttctacgacaccaaaaaatgcagcaacatcctcgtacctcttggttccaagggacagcaatccataccccatcatagatgctacctttcaatgaacggttgcagagagggacaacaccaacatgcaagaacaaggaacaaccctgttgggaccatagaaaccagaaccttggcagcagttgcatcacctgcaatggctatgtacagcctcaacatggccatttcggagcttaaatcggatgctctgtttggtacctcttcgggcattgtaaggttgcaggttccaattgaagagcaagttgaagccattgattggctccattcgcagaaccatcttctgcttcctcgctgcttcttctttggaaggaaacagtgcagtagtccctgctgcattaatggtgaagaaaagttggtcagtgttgctggggttggttcagctgttttcttttcccagccacatccattttcctactgggattggatatctataagaagatgccctttaatccgtgcatatggagctatccgtttcaatgcaaaagctaaggtgtcatcagagtggctggcttttggttctttctacttcatgattcctcaggttgagttcattgagcttgaaggaggatcaatgcttaccataactattgcctgggataatgatctttcttggtcatgggaaaatgcgatcaatgcactccaagaaacactttgcaaagtttcttcttccattgtgaagtttccaaaacaaactcctccaaccttaatatcaagcagccagaacattcctagtaaagtagactgggatcttgctgttaatagagctttgcagatgatagggcaaaatgattccttactaaccaaggttgtgctcgctcgtagcactagggtggtgcctactgttgatattgatcctcttgcatggttatcttgcttaaaggttgaaggtgaaaatgcttaccagtttttacttcaaccaccaaatgcaccagcatttataggaaacaca

SEQ ID NO: 94769 - DNA, 819 bp, Glycine max
  Peptide Sequence Number=SeqID_211547
atgggctccgaaattagcgaaccaacctccccgaaagtgacgtgcgcgggtcagataaaggtccggcccaaaacgactgcgtgcaggagctggcaatcggtgatggaggagatagagaaaatccacactgacaagaatcagaagaagcgtctgagctgggcggagacgctcggtttcaagaaggagataatgcagttcttgacgtgtttgcgaagcataaggttcgacctgagatgcttcgggtcattctccggaaccgacattgccaccgaagaagacgaggatgatgatgaagacgaagtcgaagttgaactcatagaagaagaaaaacacgtgggcgtggaagaaagcgacaacgaggcatcgaaaactgttttgtcgaaatggttcatggtgttgcagcaagagaatcagaccaacaaccggagagaagagacagaagagagaggtgatggtaatgaggaggaaagtgtgtctgttcctcctccgaatgcattattgctcatgcgatgtaggtctgctccggcaaaaagttgggtgagagagagggaaggtggtgatcatgatgatgatgatgaagaacaacagggaaaagaagagaaggagaatgcagagagagaaaaggaaaaagaaaaaggggaaaagaaagggcagagtttaaagtcgttgatggaggaagacaagagaaagaaggagaatgttgtggtgatgcgatatgattctgatttttacgacatttcttctgatattgccaaagagacgtggattgttggagggatcagagatctcatgtcaaggagtcgaagttccaaaagatga

SEQ ID NO: 94770 - DNA, 276 bp, Glycine max
  Peptide Sequence Number=SeqID_211548
atgccgatctccccctgcgaaagtatcggttggtttgtgccgtcacgacataggggtcacacccacaagacacccagtggaccccgagaaatccaacagggccctggggtttccagctctggttacgggcctctatcagtcctaccgggtgcccgtacccccccgacaaggtcatgtcatcgtgacataggtaaggatcgcgcccacaaaaagtttagagtgttgcctacgacacatggccgaccaataggcgaccaagtccaaggccaaaggtag

SEQ ID NO: 94771 - DNA, 2097 bp, Glycine max
  Peptide Sequence Number=SeqID_211549
atggcagagaaaaccaagaacaaggtggaggttcaattgggttgcggtttgatgggaagaattttccatctcaaaaccaataacaggactagaaaatcctctgttcattcactacccgtgaaggtttgcaacaacactgcacagcaacagagggatcaggccaaaaacgaagccaaaccctctccaaaccatgaatcaaatgttccaagagatagctccattggaaccattcctacactgaaagtggagcagaatccagcgagaaagagtagctctagtcaccgtgcaccttcagcataccaaaacactcaaaacgggagagcctcggacgctgcaagaacctcaattcaacgaagccacgactcaaatgaagagagtaaacaacaacagaaagagcacgctgttgttaactctctggaacttgctaggataagtacaagtgctaatcatcatcatcatcaaaacaacgagacgaaatccctggcgaaagaatttgtgttaccaatcactgggaatttgcttgtgaatagcagcccaagaactagtattaccaagagcaaagagttgaacaccttgtccggctcctgttcttacaacagtaataatagtactaacaaaggcatgatggggaacataatgaggaagaacagcgacgagcttgcgcaatttcggagtccgaggaacggcagagtggaccctgaggtgttgaagtccatggggaatgaagcgtacaaacaggggagatttgaagaggctttgactttgtatgaccgagccattgctgttgactcaaagaaagcaacgtatcattgcaataagagcgcggctttgataggtttgggaaggtttcttcaggcaattgttgagtgtgaggaagctatcaagttggagccttcgtatggcagagcccacacgcgtttggcaacaatttatttcagattgggagaggcagagaaggcactgaattgcaatgaaacaagctcatgtgttgattcggtactcgctttccaagctcaggctcttcaaaatcaccttagcaaatgcactgaagctcggaaagtcaaagattggaaagttatattaaatgaaacacaggctgcaatatccttgggtgctgattcagctccactggtctattctttacatactgaagccctgctgaagctcctaagacatcaagaggcacacgctacctacgagaaaatgccaaaatttgaccttgattcttctaacaaattatttggccccgttcgtagtgcttacctattgatgacaggcgcgcaaatttacttggcagccggcaggtttgaggatgctgtaacagcatctgagcaagcagctaaactagatccaagtaattttgagatgaatgcagtggtgaggagggccagagcagtgacatcagccagaatgagtggtaacttactcttcaaggcatcaaaattcacggaagcatatgctgtatacaatgaaggactagagcatgatccacacaactcagttctgctatgcaatagagcagcgtgtcgttctaagctaggtcaattcgagaaagcaattgaagattgtaacgtagcacttataattcaacctagttatagcaaggctaggttgcggagggcagattgcaatgccaagttggaacgatgggaagctgccattcaagactatgaaatgctattaagagaaaagccaggggatgaggaggtggcaagggctctgtttgagacccagctccaactcaagatgctacgcggtgaagatattaaggacttgaaatttggctcaaatttgtttttcatctcaagcaatgatcggtttagacattatgtaacatcacctgggatgtctgtggtactcttttgtaacaaggcaacccataagcaagtgttgttggtgttggagcaaacctgcaagagatttccatcagttaatttccttaaggtggagattgaagaccatccatacttggcaaaatcagaaggtgtgaactgcatcccagcctttaaaatatacaagaatggatcaaggattaaagaaattccaggaaacaaccacgatttgttggaaaaattagttaaattatatagcagctga

SEQ ID NO: 94772 - DNA, 2930 bp, Glycine max
  Peptide Sequence Number=SeqID_211550
gcgatgaattgctcaagaacaaagctgattcatcatctagttcaagcatgaaggctgaacagttctttgattattataatacaccggatgatcagagattaaccattgctgctattcaccttgacaatgagttgatgcaaactgggtctgttcaggattattatgttcagtttactgcattagctaatcgagtacaaggtgttaccactgaggctttgcttgattgttttatcggaggcttaaaaactgaaatccgtcgagatgttgtggctcaaaggtctactggggtgggcacgatgagatttaaaggatctatcaatggtattattatacaagttctgcttgatagtgaaagttctggcaatggaaactctttagttgttgaaggtttagtcagcaagttggacgttttgatccaaggacatgcactccaattatcagcctatctgttgcctgttactggtgttgatttagtacttggaactgcttggctagctactctgggcctacacatatctgattacagcacattgacactgaaattttacttggacaagcaatttgtgactcttcatggtgaaaaatcaacaacaggtagtcttgcacaattcaatcatttaagaagaatgtactgtactaatgccattgctgaactatttgcattacaacatgaaattccagtctgtcctcaggatgattggttggatatacctagggacatggaacctgaattggctatcttgctgcatacatacaaacaagtctttgttgttcctaaaggtctatctcccaatagatctcaaaaccacgctattccattgatgcatggcactggacctatgaaagtgaggccttatagatatccccatagtcagaagctgcagattgaaaaaatgattctggatatgttggaggaggattacaaggctttgaatgccatcactattaaggatagttttcccatttctatagtggatgagctacttggatctggggtgtccatggaaaaagaaaagattaaagttgtgttggaatggcctgttcctattaatatcaaacaacttagagggtttttgggcctcacaggttactacagaagatttattagaggttatgcgtctctagctacaccattgactaatatgttaaagaaagataactctcaatggagcaatgaggcattgacaacgtttgattcactcaaagcagccatgacacaagctcctgtcttggcattacttgattttaataaaccattcacattggagactgatgcttcggcatacaccagggaattttacacaatcactgaggctattgccaaatttcgacactacttgctaggacacaaatttataattaaaacagatcaaaagagtttgagaagtttaactgaccaagccatccaaactcctgagcagcaaacctggcttcacaaattacttgggtatgatttcaccattgagtataaacctggtaaagacaacattcctactgattctttatctaggtccttttacatggcatggtctcaacctcaatttcacatcgtcacaaaaattaaacaagccctattgaataatgataaattgcaaaaagtcatagagttatgcttgaaaaataatccccatgatcctcattacatggtatatgatggtctcttatactggaatggtagattggttattcccgatgatatttctctcaaacagcaaatcgccatgcataagttcatcaaggattatgttcagacgtgtttagtgtgtcaacaggcgaaaactaccattacaacccctataggactgttgcagcccttacctattccagatcaggtttgggaagatgttgccatggatttcatcactgggttgcctttgtaccatggttacatagtcattatggttgtagtagatagattatccaagtatgctcatttctcttgtctgaaggctgattattccaacaaggttgtagccgaaacattcatgaatacagtggtggtatatggtagagaacctcctcaactactgagatacactcctaatttgcaagattcaacttcagtgcaagatcagctcatgcttagagatgctactttagctaagttgaagtgtaatttacaaagagctcagcaggtgatgaagaaatatgttgatgagaaaagacttcctaaggaatttgctgttggtgatatggttatggtaaagcttcaaccttataggcaacacactgttgctttaaggaagaatcagaagctaagtttaaggtactttggccttttttctatggtggagagaattggtgttgttgcaaataagttattattgcctctttcgaccaagatccatccagtgtttcatgcctcacaactcaaaccttgccatggaaatcacactcaacattatgttcccttaccattcacttttaatgaacagctaccaatcattcagccacgagctatcctgcaagatcttgttattctcaagggacaaaaacaggttcaacagttattaattcagtgggaaggtcttgatgagtctcaggcaacatgggaagataaggacgtgtttgaagttgcatatccatcattcaaccttgaggataagattgtttttaaagggggaggaattgtaatggatgaaaataacgtgggactcgaattagaggttgataaccaaaggaggaatcctggacacatggcaaatgatcctcaggatgttgggtgcaggagaagcacacacatgaagtttactagctcaaaattgcatgggtttgaggctgaaaaggggtacaaatactttgttagaggaaagagaaagagggcccacaactccctcatccactccaaggctaaccccgacctcctcgccgccttcaagaccggtggagaggtgaagagggggatacagttaggggtgggaataggtcag

SEQ ID NO: 94773 - DNA, 336 bp, Glycine max
  Peptide Sequence Number=SeqID_211551
atggacaaagatcaatggatatatgacaacataatgtctaaagaagttaatatgaatgaagaaaatggagaggaacctagagtgattgttatccgtgatgatgttttgcattgggctcgctttgttgcatatgatattggttttgtgttggtgattatgaggtcagacacatatactggaaatagaggaagaaccacatatgttttaattggttgtgaaaggagtggaaaatatagggcatataggaaagatttagtacgaacaattattggcaatagaaaatatgggtgtctatttaagctgcgagggaaaccagtgttgggaggtgaaggatga

SEQ ID NO: 94774 - DNA, 365 bp, Glycine max
  Peptide Sequence Number=SeqID_211552
atgggtaaagtaaaggaggtgcaagagcagatgaaggctgacatggaggccatgaaagagcaaatggccaaattgatggaggccatgatgagcatgaagcagataatggaagccaatgcggttgcagttgccactaccagggctgttgctaaggtgaacccgatgcacctttctgatatcaaccaaatgaatcatccaacctcaaatatggtgggcaaagatttgggaagatatgccactaaagggcaagcagttggtggaatacccctacgaaacactttggagggccctcagtatcacccacaaccacactccttgcattccacaccgggtaaaaaccctcatgctatggcagaaatgggaaa

SEQ ID NO: 94775 - DNA, 444 bp, Glycine max
  Peptide Sequence Number=SeqID_211553
atggttgggcaaaaagtgttattgtataattctaggcttggactcatgagtgttgaaatcaaaagcgactccacaaacaagagcttcaaggtcaatgaacaccgacttaagtcattcctaataaacccttctttagtggccgcagtggtggaagagacttccttactccaccatgacttatggagttcttattttcctatctccttctttgcttttattacacttgtccgattctatttgatggtgttgcaacctccccttcggcgggagggcgacgcgagggctcacgggtgcgtcatccaagaaaggaaaatgcgcggagttgccaccaacatttattcaaggaaaacgtcgaaaaaactaaaaaaaaggagagaaacattaaggtgttggacaattaatgatctcttgttttttgaaagtagcgacaaggttacatgttga

SEQ ID NO: 94776 - DNA, 357 bp, Glycine max
  Peptide Sequence Number=SeqID_211554
atgtcttcagtcatttacgctttcaaagactacaatgtcttcatttacatttcaaagacttcaatgtcttttgtcttttacattttacaagacttcaactcttctggactcaatgtccttgtctttgtgcttcttaggactcaacgtcctctatttctatgcaaaaaaggaaaacaaggggtgcaaatagcaaccaggtccacttgggccttccaggatgttcctccagaaggcaccgccttctggaggaagcaacctagctcgcctggtcgagctgggtggcaagctcctcccttattttcctataaatatggggaggagggaagaagaaaaacgttcaaccctcctggtatctga

SEQ ID NO: 94777 - DNA, 357 bp, Glycine max
  Peptide Sequence Number=SeqID_211555
atggcggaaccatcaaagaagcgcaagggatcttccagtcgaagccaacggcatcccgaggctcaggaaacgcaaattccctcctccatttcctcttcctcgctgttctcatcagaagaacaatggatatggtacacaaaccgtttctcctctcgttccattattgatcctaagttcatagacattaacttcttttccaatgagagctttgaatgcattcaggcatttgagaactcaaatctcattccttttatgtcttcgaaattgtctatctattctgaattagttaaagccttttattctaacctcgaaattcaagaaagcactttgatttatgaggttttcgggataaaaatg

SEQ ID NO: 94778 - DNA, 719 bp, Glycine max
  misc_feature (12)..(12): n is a, c, g, or t
  Peptide Sequence Number=SeqID_211556
gtcgggggttgnttttgaatgctgaaggccaccctgggaagattctcaggaaatatttaacaactcttgctcagatggacatgaatgtgggagctctcatctctggtcagattacatctatggcccagtctaactcttctagacttgggttccctgctcttatcaccgctttatgggccaagagagcgaggacaaggccaactgaggccccttccacatctatagctcctcctctagcacataccccaatagctccttttgccccagcttctacagattttcagcgtcttgaagccatgcttcaaagcatccatcaggggcagattatcttattacagagtttacagatggtggcacctctagactccattccttcagtaaaggaagatgaaggtcccacagcccaggtaccacagcagatggaggatgattcattcaagactactactccagagcccttggttagaaagaagaaggtagatgaaacacaaaaagttgcagccacttctgagaaatctcttgaggccacttttgagccttcagaaccagtggtagatacaacttcacctcaacaggcagcatacccttccactcctgaggatcagactacaccagtcctgtctctgaacacctctcctacagctacccctatgcttcacttaacagacgaggaggatgttcagacacaggatactcaggaccaatcacaggatttttaa

SEQ ID NO: 94779 - DNA, 501 bp, Glycine max
  Peptide Sequence Number=SeqID_211557
atggacagaaaccaatcccgcaggcaggttgccgcaatgaaacagtccctctttgatcagtctttgcaccaggatcattcattagcaggtgtaaaaatgcatagtcaattggtagttaatgaaaattacatattccacttcatcagaatcctgattaccttaaatcacaagacacaggaaaattgtgccatgttcatagcaggcatggcattagcaactatggggttcctggacgaacagtttatccaactggaagaattgcaggatgatgcaaatcctaactttgttgaggaaatcgtgactcttcactaccgtgattcgtcacggcttatctcaagcatagagcaggctctcaaagagaggaaccctctggatttcaacaagctggacacacttatgcatcagttcaaaggaagcagttcaagcataggagccaaaaaggtgaaagcagagtgcaatctgttcagggaatattgcaggacaggaaatgcagaagggtaa

SEQ ID NO: 94780 - DNA, 153 bp, Glycine max
  Peptide Sequence Number=SeqID_211558
atggcagcaaatcaggaaaatgcagagacagcagaacagagggttgcgccatggtcatggtctgagccatggcattgccatgctactagaattatagcaacaaagaaaacaaggaccttcattctcctcactggctctgcctattacaactaa

SEQ ID NO: 94781 - DNA, 1341 bp, Glycine max
  Peptide Sequence Number=SeqID_211559
atgaaggagacacttgtgtggactgctgatcaagtcaatcataaggctcatgtaccctatggatggatcgttgggggtttaggagttgcgcttgttctaataatattaactgttattctctgtgtttgtctgagatcatcaaattgttttgctgataccagaactcatgagaaagatgctgagggcaagatctctcataaattccatattcttcggaacccaagttttttttgtggttctggaaggtacatatgtggcaaacatgttgatcagaagcaaacagatggtgaatccagcaatcacacaattatggttcccaaagcttcaactctttggcctgacgtatttgacatggataagcctgttgtctttacatatgaagagattttctccactactgatggtttctctgattcaagtctacttgggcatggaacatatggttctgtttattatagcctcctccgtgatcaggaagttgctattaaaagaatgacagctactaaaaccaaagagtttatgttagagatgaaagttttgtgcaaggttcatcatgctaatctggtagaattgattggctatgcagctagtcatgaggagcttttcctagtatatgaatatgctcagaagggttcactcaaaagccatttgcatgatcctcaaaataagggtcactccccgctttcttggatcatgagggttcagattgcaattgatgctgctaggggccttgaatacatacatgagcacacaaaaactcattatgttcaccgtgatatcaagacaagtaacattttacttgatgcttcctttagagcaaaaatttcagattttgggttagcgaaacttgttgggaaagcaaatgagggagaaatttcaactaccaaagttgttggtacatatggatatcttgctccggaatatttgagtgatggtcttgcgaccactaaaaatgatgtctacgcatttggtgttgtcctttttgagatcatatcaggaaaagaggccatcatccgatcagaaggcacaatgtcaaaaaatgctgatagacgttcactggcatccataatgctgggagctcttaggaattcgcctgattctatgagcatgtcaagcttgagagaatatattgatccaaatatgatggatctgtatccccatgattgtgtatttaagttggccatgttggcaaagcaatgtgtggatgaggaccccatcttacgacctgatatgagacaagttgtgatatccctttcacagattctgctgtcttcagttgagtgggaagcaactctagctgggaatagccaggttttcagtggccttgttcagggaagatag

SEQ ID NO: 94782 - DNA, 1980 bp, Glycine max
  Peptide Sequence Number=SeqID_211560
atggcctcttacaggcccttccctcctcaatcgagtcaaattccaaaccctatcccaggtgggaatcatcagtataataataatcaaaatcaaaattggggtgcttatggagatccctctacttcttcattcccccaaatccctccaaattccaattatcatcaaaatcaacaacatcatgttccatatgcacctccaaatccccaccaccctcactatccatatccaccaccacctccgccgccgccaccggaggcttcataccagcctccaccaccaccaccaccagctcctatgtattatccctctaataatcagtatagcaaccagccacctccaccgccgccgcccttgtccccaccaccaccacctcccccggtttcgccccctcctcctcccgcggtaactcagaacaacgaagagcggcacttcaaggagccttccacgtccggccggcgtgaatacgagcattccaatcacggcattgctcacaagcagcacaagcagcagcctcctgtgccagtgaagaagatgaacaacgggcctcctggcagggctgagaccgatgaagagaagaggttgaggaaaaagagggagtttgagaagcagaggcaggaggaaaagcataggcagcagctcaaggagtcccagaacactgttctgcagaagactcacatgttgtcctctgggaaggggcacggcatgattgcagggtctcgaatgggagaaaggagatctactcccttgttgggtgctgagagggttgaaaataggttgaagaagcccacaacgtttttgtgtaagctcaaatttcgaaatgaacttccagatccaagtgctcaacctaagcttatggcctccaaaaaagataaagatcaatatgcaaaatatacaatcacatctctggagaaaatgtacaaacccaagctttttgtggagccagatctagggatacctctagatcttcttgatctcagtgtttacaatcctcccagtgtcagaccacctcttgctccagaagataaagaattgttgcgagatgatgaagctgttactcctattaaaaaagacggcataaaaagaaaagagaggcctactgataaaggtgttgcatggcttgtcaaaacacaatatatatctcctctaagcatggagtcaacaaagcagtctttaactgagaaacaagctaaggagctgagagagatgaaaggaggtcgtggcattttggacaatctcaacagtagggaaagacaaatcagggaaattgaagcatcatttgaagcagctaagtctgatcctgttcatgcaaccaacaaagatttgtatcctgttgaggttatgccgttgctgcctgattttgataggtatgatgatcagtttgttgttgctgcatttgataatgctccaacagctgattcagaaatgcatgctaagatggacaaatctgttcgtgatgcctttgaatcaaaggcagttatgaaaagttacgttgcaacgagttctgatcctgctaaccctgagaagtttttggcttatatggtcccagcaccaggagagctgtcaaaggatatatatgatgaaaatgaagatgtctcgtactcttggatacgcgagtatcattgggatgttcggggtgatgatgcagatgatcccgcaacattcttagttgcatttgatgagtcagaagcacgctacttgcctcttccaactaaacttgttttaagaaaaaagagggcaaaagagggaagatcaggtgatgaggttgagcaatgtccagtacctgcaagagtgactgtaaggcgaaggtctagtgttgctgcaattgagcggaaggattctggggtatatacaagttcaaagggaaattcctcgaaaagaggtggcttagaaatggatgatggtctcgaagaccaacatagaggtgcaccacaccaggacaactatcagtctagtggagcagaagattacatgtctgattga

SEQ ID NO: 94783 - DNA, 1173 bp, Glycine max
  Peptide Sequence Number=SeqID_211561
atggatttggttgaagacgatcttcatcgccttcgctccaatctttcttctctgctccttcagattgacgaggttgtcgtgcaagccattgaagtgaattacaagaacaacaaaaccataagcaaagagggcaaaacgcaaatcgagtctttctcccgtgtcctttctgacatgctctcttctttgaagccatggcttcccaaaattcaaaatgcccttaaccctcaagacatagtttctgacgatgaaaccagagaatgcgaccgtcccaaacccgaagagacaaccttaaatttagtatctccttcacccctggtgtcatggcgtgccaactgcactgtcaaaagaggtagacagatgttcatgctgacacctcttccattatcgtccaaacaccaccaacctaaaccatatttccctcctcccaccacatcatcaaccactaccttcaaggatagtgatatggtgaaaccaacaccaattaagcagaaacttccaaacaaccaagacagatccatgcttgttatgatgactccgtgcttgaaaatgtcacctcctagatcctgccttttgctcgaacccatatccgaaatctcgcgtttgggtggggatcacaaggttcgcaagggcactccctatcctgttgggattcattgcagtgattcaaaatcttctggcagtgatgattcttcgcgtgatttgtcgttgatgtatccggagctccaagggatacacaagtcaggaattgggaagaaaaccgtggaagtgtcgcccgattggttaacctctcctcctaaaacttgtgttttgttggagccacctgacgaaaaaaagattgatggtcacttgtgtgttcagatagctgacaatatttttaatgaacaagtcagcaagtttgaagatgatgatgtttcaaacgatcataatcaagccaaagaatcttgtaaccaagataattttgttggcaatttatcacatgtagagagcactcccatgcctgaaagttcgtttcaaaggggaaaatgtcctggtgaaaatactttgaagaaggagttatggacgaagtttgaggtagcatccacttggggatgtcaacctaaggtacccacagttcaaaagagtgctcacaaagggtttcttgacctactggaagaagcttcctgtgatgaataa

SEQ ID NO: 94784 - DNA, 294 bp, Glycine max
  Peptide Sequence Number=SeqID_211562
atgcatagctccaaactcgaaggtggaggccacatgaatgaaaacgcaattcatggggctccgaaaatattgagaatggagaattgcactaagcaatcactaggcatagcgccaaactcgaagattgagaatgaagaattgcaccaagcaatcactacgcatggctccaaactcgaaggtggaggacacatgaacgaaaacgcaattcatggggctccgaaaagattgagaatggcgaattgcactaagcaatcactacgcatagctccaaactcgaaggtggaggacacatga

SEQ ID NO: 94785 - DNA, 114 bp, Glycine max
  Peptide Sequence Number=SeqID_211563
atgtcagagagatggagaagtgagattgttcagaattgggttgcgaacgtggtgctcgaatttcacgacgatccaacggtgaatgagtctgagatcgtcatttttctgagatag

SEQ ID NO: 94786 - DNA, 159 bp, Glycine max
  Peptide Sequence Number=SeqID_211564
atgacaaagcctttagatcactcaaaatcttggatatctgatgcaatccttccaaggaggggacccatcactagagccatggctaggagactccagaaagattgggttaggaatacaagagaaggtcctagggttctcatgagtcttaggggcacctag

SEQ ID NO: 94787 - DNA, 411 bp, Glycine max
  Peptide Sequence Number=SeqID_211565
atggccaattctagattggtgtccaaattaaacttggagactaagccacattctaggccatacaaacttcaatggtttagtgaagatggagaaatgacggtgagccaacatgttgaggtgtgcctttcaattggaagatacaacgataagaaatataaggatgtgtttccaaaggaggttccaaatggattctcacccttaaggggaattaagcatcacattgatctcattcatggagcttcattgcccaaccagcctacatgtagaagtaatccccaagagaccaaagagattcaaaggcaagttccgatgattttggtacctaaaaaggatggaacttggaggatgtcactgattgtagggctatcaataacatcacggtcaagtatagacaccctatccccatattag

SEQ ID NO: 94788 - DNA, 530 bp, Glycine max
  Peptide Sequence Number=SeqID_211566
ctgtgtctgattcagtggtgcttctgtttggtggaagcttattgaaaggagatgctgataatcacttaaaaatgttgggaggatatctagagtttttcatggagcccagtgttgctgaaatgtaccagagtataaggagagaacttgatgacttcattcagagcaaatacgactgccgatttcaaatgacaaatgtgaagagtggacctgggggagataatcctaaaagtcagctccaaaccttgcttacgagagcaggatatgcagcacccatctacatgactaaacaattgaagaacaatcagtttcaggctacagttgaattcaatggaatgcagataatgggtcaaccttgtaacaataaaaagagtgtagaaaaagatgctgcagctgaggcactgcaatggctgatgggtggaaagcaaacaggcagggagtatattaatcacggcatcgttactagtcctggatcattgagtcaatttgctcatgaaaacagccaagcccctatcccgcatcaaacagattga

SEQ ID NO: 94789 - DNA, 147 bp, Glycine max
  Peptide Sequence Number=SeqID_211567
atgatgattttgtgcttcaaggaaggaggagctgcaaacctgatcttgccacatcaaaagaggataattgatcaagtggagatggtgaagatttgctatagtgaagctacaccttgccacaatgaatctccaagctggagaccttga

SEQ ID NO: 94790 - DNA, 222 bp, Glycine max
  Peptide Sequence Number=SeqID_211568
atggtgaaccttactccaacccagagagatatcaaagaatgggaaggacccctaattgataaatgttctacttcaggttattttgtatcaattagaggaaatgttgtttcatggaaaagcaagaaacaaagtgttgttgcttgctcaagtgttgaagcagagtttaggccatggccttggctacctgcgaacttgtctggattaaacaacttcaagagttaa

SEQ ID NO: 94791 - DNA, 213 bp, Glycine max
  Peptide Sequence Number=SeqID_211569
atgcgccattacttcagaatataccctaggccaaggccatcccttacaacccctcaattcaacaaaaacaagcaacaatttgaggataaatccctcacgtttcttagcaaacacatgcaatttagagcaccaaaatatatcaatggaaagctagaaagcccaagaatgagaggtggctcgcccaggcgagcccagctcgcccaggcgagctaa

SEQ ID NO: 94792 - DNA, 210 bp, Glycine max
  Peptide Sequence Number=SeqID_211570
atggctccatcagatgtttgtccaaccgaggatgcagttcaggcattcatagagcacttggttgacccgttgctgccaacaaaagcaactgtccagggtaatccgacaccatctcaacagaagttagttgcaaaacagatctatttacattacttctatgttttgcctgcatggagtgtagagagcatagataatagtttccccgagtga

SEQ ID NO: 94793 - DNA, 1032 bp, Glycine max
  Peptide Sequence Number=SeqID_211571
atgtggcaaagaagccacaagtcatcagaggagaggaagctggagcttaggcttggtccacctggtgaagagtctctcaatgaaagcatcagaaaatgcaacagagaaagacgtagaaatgaatcaccactcactcttggttgcttctcaactcagaaaatttttacttctgacacgccaggtccaggtggagctatgttgccctctgcatggccttccacatcctatcatcaccaagaccaggctaaagctaaagcttcatcatttctacagctccaatcaagtccgcaaaacatgatactgatgggaaaggatgtgtcacaattctcttgtgtagagaagaagtcattctcaccctcttgtgcaaatccagcggtgtccaaaagaactgcttcaggtccagtagtgggttggcctccaattcgttccttcaggaagaacattgcaagtggaagcacttctaattctaagttgccttctgggtcccagcagcaacatcaaaatgttgttccaggcaaggttgctagccaaaaacctacagacaactcaggtaaaggcttgtttgtgaagatcaatatggatggtgtcgccattgggagaaaagtggacatcaatgcttatgacagctatgaaaaactttcctctgctgttgatgagctctttaggggcctccttgcagagatgaagttatctcatattgcctcttcccaatgctgttctggtcaaagagattcctgtgctggtggaattcaaaacaaggaacaggaagagaaatccaatacgggtttattggttggaagtggggaatatactcttgtttatgaggataatgaaggagacaggatgcttgttggagatgtgccgtggcacatgtttgtgtcgacagtgaagaggctgagggtgttgaagagttctgatcttcctgcttttacccataaagaaaaagatgcagaagctacatgttataacatttcaaacgcatgtcccaacatgcggaaaattgattttgctctcaaaaacacgtttaactag

SEQ ID NO: 94794 - DNA, 786 bp, Glycine max
  Peptide Sequence Number=SeqID_211572
atggcacggtcctttgccagattctggagatatggtgagcaattcttgtcttattttcctttgattgagtccttagtcttaacaaaggctatcaacatggagtggggaaacttccggtcatcacaccttccattgactgagtatgattgtgcattagatgccgagagtttaaatcctagtgatcagatttttgagaagatgacgtctggcttgtacttgggagaaattgttcgtatagtgtttcagtacaagtgtgagaagtatccttttggctattgtccattgtcaaaggaaacaaagtggttagagaagagaaaaacaaagaatcttacagctgataagatatctgatacctccctggaagtgaggaaggtggttgttgagatctgcaatattattgccacacgtggtgctcgtctttctgctgctggaatcttaggtatcctgaagaagttgggaaaagacaccatcagtgaagttgtgggtcagaagaatgtgatagccatggatggtggattgtttgagcattacactgagtacaccgagtgcttagagaatacccttaaagagttggttggtgaagatatctccgaaagtattatcattgagcattccaatgacggttcaggaattgatgtgaaaaagggaggacgcgcccaacgtgcaagaaggcgaggcgctaagcgcacgacacgcgctgagcgcgaggtggcgctcagcgcaaggcttcgcgctcagcgagactacgatgacccaaagcccaattttgcacctataaataagagg

SEQ ID NO: 94795 - DNA, 195 bp, Glycine max
  Peptide Sequence Number=SeqID_211573
atgggactaactgtgccatctatgttgaagccttttgtccacttgataaggttcccagaagcaagagacgtttgcatgacaggaaaggaaaagggtatcctccaacaaagagataaagacgttgtctttttttgtctgcaagaggcaaagactaatctcttgctcttgaacaccgacatccattcaaggaactaa

SEQ ID NO: 94796 - DNA, 1191 bp, Glycine max
  Peptide Sequence Number=SeqID_211574
atggggaaagctagcaggtggttgaaagggttgttggggatgaagaaggagaaggaccatagtgacaattcaggctcattggctcctgacaagaaggagaagaaaaggtggagttttgccaagccagggaaggatgtgccaccttcagttcctgccactgataacacctggctcagatcctatatttctgagacagagaatgagcagaacaagcatgcaattgcggtggcagccgccaccgcggctgctgctgatgccgccgtggccgctgcgcaggcggctgtggcagttgtgaggctcacaagccaggggagaggggcattgttcagtggaagcagggagaagtgggctgctgtgaagatccaaactttttttagaggctacttggcacggaaggctcttagagcactgaaaggattggttaagatacaagctcttgttagagggtatttggttagaaagagggctgctgcaactcttcacagtatgcaagctctaataagagctcaaactgctgttagaacacagcgagctcgtcgctcgatgagcaaagaaaacagatttctacctgaagttcttgcaagaaaatctgtggaacgatttgatgaaacaaggagtgaattccacagtaaaaggctacctacatcctatgaaacatccttgaatggttttgatgagagccccaagattgttgaaattgacacatacaagactcgatcaaggtctaggcgctttacctctacaatgtctgagtgtggagaagacatgtcctgtcatgcaatctcatcccctcttccttgtccagtcccgggtcgaatctcagttcctgattgcagatacattcaagattttgattggtactacaatgttgatgagtgtagattctccacagctcatagcaccccacgtttcacaaactatgtgaggcctaatgttccagctacaccagccaagagtgtttgtggagacaccttcttcagaccttactccaatttccccaactacatggccaatactcagtcattcaatgcaaaactaaggtctcatagtgctccaaagcaaagacctgaacccaagaaaaggctctcactcaatgaaatgatggcagcaagaaacagcataagtggtgttagaatgcaaaggccatcatccaatttcttccagactcaagaagactcatggaatttttga

SEQ ID NO: 94797 - DNA, 2366 bp, Glycine max
  Peptide Sequence Number=SeqID_211575
atggggggctctgaaggggtgggagcatcgtcgaagcaattcggtgtcacaaagcccatatcaatggctggcccatcggctactgatttgcaaaggactcgtgagttagagaagtttctcgctgcttcggggctttacgagagcaaggatgaagctgccaagagggaagaggttcttcaccggcttggagagatagttaaaagttgggtgaagcaactgacccgccttaggggatacactggtcaaatggtggaggatgcaaatgctatcattttgacttttggttcttatcggcttggtgttcatggtcctggggctgacttggacactttatgcattgggccgtcctatgtaacccgagaggaggattttttctacacattgcatgatatcttagctaacgtggaggaagtcacagaattgcaaccaattccggatgctcatgtcccagttatgaaattcaagtttgatggaatatcaattgacctcctctatgccagtatttctagattggttttacctgaagacttggatatatctgatgtctctgttctacacaatgttgatgagcctaccgtgcgaagtttgaatggctgtagggttgcagatcaaattctaaagcttgttcctaatattgaggtgactggttttctaggtggtgttaacttggcacttcttgtagcccgagtgtgccagttttatccgaatgcagttccaagtatgcttgtttccagattcttcagggtatatacacagtggcggtggccaactcctgtcatgttatgtccaatagaggagaatgagcttgggtttcctgtttggcatcctggtaaaaatccccgtgacagatcccatcatatgccaatcattactcctgcctatccctgtatgaattctagttataatgtttctacgagcacccttcgtgtaatgatggaccagttccaatatggcaacaagatctgtggggctctgtttgaacagtacagtttctttgaaagctataaaaactacttgcaagttgacgtagttgctgctgatgctgatgacttgcgcagttggaaaggttgggtggaatcacggcttcgccagctgactttgatgattgaacgtgacacttttgggaagttgcaatgtcatccctatcatcatgagtttgtggatacttcaaggctgtgtgcacattgtgctttctttatgggtttgcagaggaaacagggagaggttgttcaagaaggtcagcaatttgatatacgagggacagttgaagaatttcggcattctgttaatatgtacatgttctggaaaccggggatggagatttatgtttctcatgttcgtagaaggcaaattccattctatgttgttcctgatggttataaacgatctcggctatcaaggccaacatcacaagttgagaattgtaaatcatttcataatgaggtttcggggactgaacatgttgagagaatccgtaagaggaagaacaatgacggtgtggatgtgaggggggatgctatagttaaaaggcaatctgctagtccttctgaagatagattggcaagacacagcagccttggtactggtggtttgtctgttgaagctgtatctgatagacaagagttgagaaatgttgagtgcaatcatttgtcaaacagtgggcaagatgagttggatagaacagagtctccagaagctgcttcaaattctagtgtgattacatctgttggttcttctgaagatactggatctgtaacagtggcaggatgtgttgaggaaagcaccgggggtgttgaaatgatgaacaatggctggtttgaggatagcacttatgggaatgattctgtcacactggtgaaaaatatagtggcaagtggaaatgaagtgtttcaacatgagctacaggagcagtttcagccgaatgcaacgctagggatggttcttgattctgcagaaaaggttatttcagaagttgtgcaagagccggagattgagactatcatcgacagcttgcttgatcattcaagcttgcaaattgggactgatccgaatcaagctgaagagctggagctgagattttccgagaaagcaaaactgaggaaggtggtggtgtgtgctacggtgattggagcgtgcacggaggccgcggcggcggcggtgcataggaacgtgaggaaatgtcaacggtggggaagggcagtagaaatattgaaggagttggaggagaagattgcgaagccaacgtggaagctgaagctgaagctggttgtgcatgccatgaacgttgagatgcacgctggtcttgcttccgaaggtggtagcaagctcaagatgctcatcacttacgttgctaagctcccaacagg

SEQ ID NO: 94798 - DNA, 378 bp, Glycine max
  Peptide Sequence Number=SeqID_211576
atgtcgccacacgggggcgacatggatgggggtgaaaaaaaggaaagagagggatggggtttctcttgcttttggcatagcgggccccggcgggaggccccgcacgacgggctattagctcagtggaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 94799 - DNA, 1137 bp, Glycine max
  Peptide Sequence Number=SeqID_211577
atgcaacactacatgcatcatgctgtattacctagggttgatctctatctactagagctgaatatgattcttgtactgtggtacagttctctgatgactcaggtcccgagggttctgatgacagggaaatggggctttttcctatcagccaatcaggcggagtcatctatatttttacctgctgcaaaagaagcattctcaattagtttgcaagattcaagggtaacagagaaaaacgtgaaggtggacacccctgaagcaacagacttctatgtaaataaggacacatttacttctcttggtagtaagccaaacagtgataatattgattcccagaagcagaaagagaacaatggaagttgtacacctgcattatcttattatatcaatgagcccatggaaatggatgtgaatgaaaattcaattttcaaatctcaaaataaagaaaaatgccaggatattattgccagtactgtacaagttggtgtagatcaagaaaataacaatccatatctgaagtataattctaatggctctgcaagtgctgttaaggctttaaaggttgattcgacaaggatgctcattgctgaaggtggagtcaacaatcttgcttctttgcacaagaattatgcccataggcccaatacctcatctgaaaaaggcaaacttgttagctttactccgactgcaaatcattctaactcagatctagagaagctccaaattctttcagattcgaaaaagatattatctcaaactgccctagctgctttgatacgaaagaggaatgaattggcccttcagcagcgcaaaatagaggatgagattgctgtttgtgataagaaaattcagagaatgctaactgatggggaagacgacttcaaattgaagattgaatcaattgtggaaggctgtaatgatacatgggaactagacaatacatgtcacgaaaacaattgggtcctaccaacttatcatttatcccatgcagatggtggattcaaagccaatgtaactgttaaaggagtggactttcagtgttcatttgagggtaacgtgggttccaatccttctgaagcaagagaatcagctgcagctttgatgttgactaatttaaaggaaaaaatagtccagtga

SEQ ID NO: 94800 - DNA, 198 bp, Glycine max
  Peptide Sequence Number=SeqID_211578
atggcagtggcggtgcgaggaggtggcgatgttacggtgcggcagaggtggtgtaacaaaattggtgaggaggaggtggggaagaaatatttggcgttttggtttggagctaagtgtgaatggggagaagagaagaaggccgagaacaacaacggaaaagggtttttggttttggactctgaaagaaactcaaagtga

SEQ ID NO: 94801 - DNA, 2502 bp, Glycine max
  Peptide Sequence Number=SeqID_211579
atgtatccaaaacagtcaggccaagatggccctgattccagacaggtacgctcaagtgataggatcaagacaaggccaaacgtttatggccggccatatttgtattacaaccaaaatcataggcacaccaggaaaagcaagatcaagacaaggacagcagcttcacagattgctaagatgttgcgtccagggaatcgaaaatcaaaagattctaatactaattctggctctgccaaccttcgacgttcaacaaggaagagaaggcttaatgtaaatcttgaagattttacagacagctctggagctcaagatgaagacttaatggtgaggtatgtggccatgtttcagagaccacctacatattcatcattgagaaaccggatgaaaaatagtgtcagacgggatggtttgatgtctaataagcgcaaaagagcagcggagactaaacaaacacctcgacgtgaaggtctacgtcctcgccgttcaaagggtgctgcaatagaacgattaattttagaatcagatgatgagcaagacctttcagaggaaaaggttgatgaggatgaaacagaaaatggaaatgatgcagatgatggccaaaatgagattgagggggacgctgaggaggaagatgaagatgaggacgaaggtgatgaagatggtgatgatgaagagggtgaagaagagcaggatggaagaaggcgctatgatcttcgaaatcgttcagatgtccgcaggttctctatggaggaagggaaggcccggccaagatctccaagaagagtgttacatcaaggtatgggaactaaggtcaacagagatgtaaggaaaggtggatcacgagttcataagcgtcatcgtttagcgaggcctgaagattctgatgactcccttcttgtggatgagctggaccaaggccaagctattccatgggggcgaggtggcaacagatctggtccgccttggctatttgggggcttagagatgcatggaacaacagcttttggattaaatcttgctgcatcaggttggggtcatcagggtgatgctgtggctactctaacttcggggattcaaactgctggaccaagctctaagggaggggcagatatccaacccttacaggttgatgagagtgttagttttgatgatataggtgggctctctgaatacattgatgctcttaaggaaatggttttctttccattattgtatccagatttttttgcaagttaccacataactccacctaggggggtattgttatgtgggccccctggcacagggaaaacgttaattgcaagagctttggcttgtgctgcttctaaagcaggccagaaggttagcttttatatgcgcaaaggagcagatgtgttaagcaagtgggttggtgaggctgaaagacaattgaaactactctttgaggaagcacaaaggaatcaaccttctattatcttttttgatgaaatagatggacttgcacctgtgaggtctagcaagcaagaacaaattcacaattccattgtgtctactttgcttgctttgatggatggccttgactctcgtgggcaagttgttttaattggagctactaacaggattgatgctattgatggagccttacggcgccctggtagatttgaccgtgagtttaactttcctctgcctggttgtgaggcacgtggtgagatattagacattcacactcgtaagtggaagcatcctcctccaaatgagctgaaaaaggaacttgcagctagttgtgtaggttactgtggtgctgacctgaaggctctttgtactgaagctgccatccgtgcattccgtcaaaaatatccacaggtttatactagtgatgacaaatttgtcattgatgttgattctgtcaaggtagaaaagactcattttattgaagccatgtctaccattactcctgctgctcataggggagctattgtgtactctaggcctttgtctctagtagttcaaccatgtcttcagagacatttagagaaagccatgtgtagtatatctgatattttccctccagcttcaattacatcagagttgaccaaactttcgatgctctcctacgggtctgcaattccacttgtgtatcggcctaggcttctgctttgtggtggtgaaggtacagggctggatcatcttggccctgcggttttacatgagctggaaaaatttcccgtacattcattaggacttccatctcttctgtcagatcctagtgcaaagacaccagaggaggcattggtacatatatttggtgaatctagaagaacaacaccatcaattctctatttaccacaatttgatgtttggtgggagactgctcatgaacagctccgggctgttctcctgactttgctagaagaattaccatctgacttgcctatcttactgcttggtacatcctcagttgcactttctgaagttgaggaagtgcctacttccattttccctcatcgctcagtgtacgcttga

SEQ ID NO: 94802 - DNA, 1611 bp, Glycine max
  Peptide Sequence Number=SeqID_211580
atgattaatgaagcagttgatcttgccaaacgtagaaaggatgaatgtttgttgtttaaggtagactttgagaaggcatatgactcggtttcctggagttttttgacttacatgttgaacagaatgggttttgataagagatggattgggtggatacaggcgtgtgttttttctagttctatgtcagtcttggttaatgggagccccacggatgaattcacagctcataaaggtttaagacaaggagatccactatctccatttttatttctcattgtggcacagggactttctggtttggtacaaaaggcaattcaggttggaaattttgatggttatcaggtggcagatggtttgaacttgtctctattacaatttgctgatgacacaattttattggataaggggtcttggaagaatctgtggagcatcaaaactattttcagaagctttgagttagtatttggtcttcgggtcaatttccacaaaagtaagttgattggtttgaatatcaacgaaggttttctagagtcagcatcaatctttctctcttgttgtatgactttaataccttttaagttcttgggtgttccggttggtgccaacccgcggcgaagatcgacttggaaaccgatggtggattctatgagggctaaattgtcttgttggaggggacgtaatctatccatcggaggaaaggtaacacttattaattcggttctctcaagtttacctctatatcttttctcctttttcaaagctcctaaagtggttattaaggaactaacacaaattcagagagattttttgtggggatcacatgaggaggaaaggaagatttgttgggtgtcatgggaagacatttgcaaaccgaagaaagagggagggttgggtgtgaagaatttagaggttttcaacatatcttttcttgctaaatggaagtggaggtgtattcatgatcataatgcactttggagggatttgctagcttttagatatggtaatttaatagcaaagcaaacttgtagtcttgatcgatcatggggcacaaaagattcaatatggtggcgggatttgatgttgttggagaaagatttgtcacaaaaccagaatttttttcaaagagcagtgagttgtgatgtaggagatggacaatcaattctattttggtataataaatggttagggtccgagccgttgaaggatgcttttccggagctgtttgcaatttcatctcagcagttggtgtctgtaggaaacgcaggttcatggaggagagaccaatggacgtggggcttgacttggaagagacagttaaatccgaatgaggaagagtcacttcactctttggagaccattctggttgatgtgcatctagcggcagaatctcatgacaggtggaagtggtccttacacaactccaaattattcactgtgagcaataatagcatcttcaaggaggaggaaaaagacattcccaagactatcaatcaaattaagcacatatgttgggcctggttcatgggaaaggtaggagggaaaattaatagcaacactatgtcacggtgtactttaataatcactcaatggatacaaaaaccttttcggtaa

SEQ ID NO: 94803 - DNA, 522 bp, Glycine max
  Peptide Sequence Number=SeqID_211581
atgggggttatgtccaggcaggttgtgcctgtctgtggcaacctctgttgcgtctgtcctgctctgcgggcaagctccagacaaccggtgaagcgttataagaagttgctagctgatattttcccacgcaatcaggaggctgaacttaatgatagaaaaattggaaaactatgtgactatgcttctaagaaccccctaagaattcccaagattactgataacttggagcaaatatgttacaaagatttgcgttatgaaacctttggctcagtgaaagttgtcttgtgcatatacaggaaattcttatcgtcatgtaaggagcagatgccactttttgctggtagtttattagagatcattcggactcttctagaacaaacccgaacagatgaaatcaggatcttaggctgcaacgctctttttgagtttttagattgccagttcatgaaggcagtaaaaatggataccactgaaggtcaaaaatcatacttcccctttgtggtggtggcttggtggtgctaa

SEQ ID NO: 94804 - DNA, 1392 bp, Glycine max
  Peptide Sequence Number=SeqID_211582
atggatttggatgaaattatatcagtgactttggagaattacccaagtctccaatctaactccaaacgtgtcatggaagataaactgaatttagagtccctggacctgttagtacagggatttcccaaattagaagacccttcaacagatatcactaagaaggatcctttgttgctgaaagctgtgactggaactgagatagactatgtgttgaatactgctaaagatcctacatattggtcaaaggtttgcttgtatcatatggtcaaattggcaagggaagctacaacattacggcgtgtcctagagcctctttttcactattttgatactgaaaatcaatggtcttctgaaaaaggagttgctgatcatgttttgatgtacttacaatctcttttagcagaatcaggagataactcctgtcttcttttgtccattttggtcaagcacttggatcataagaatgttgctaagcagcctatccttcagattaatatcattaacactacaacaaaacttgcacaaaatttgaagcaacaggcttcagttgcaatactcggtgcaatatctgatctcattaaacatttaaggaagtgtctgcaaaattcggctgaagcttccagcactggaaatgatgggcttaagctgaatactgaactccaatttgccttggaaatgtgtatattacatctttccaaaaaggttggggatgtcggacccattcttgatttgatggctgtggtgttagagaatatctcaagtacagccatcatagcaggaacaacaatctctgctgtttatcaaactgcaaagttaatcatgtccattcctaatgctttccctgatgctttgtttcatcaattgctcctggcgatggctcatcctgaccatgaaacacgagttggagcacacagcatcttttctttaaaggtaccaagcgaaagcttctccattcagcatgaaagctttttgggagcagaacagatcaatgggaaatctatggaaggaaaggcagtatttagtgttagtgggaaatatgcagttcatccatatcatggccacatcctttctggtgctctaactgatggacaacatgagctaagttcttttcggttaagcagtcaccaagtgagtctcttgctttcttcaatctgggttcaagcaacatctttggacagtggccctgcaaattttgaggcaatggctcacacttatagcattgctttattgttcactcgttcaaagacatccagttacatggctttagtaagatgtttccaactggcattttccctcatgagcctctctctggaccaagaagcctcctggggctgccttcattgtgctggttttgagaggggtctgtttggtcctgtgttcgtagtgatatga

SEQ ID NO: 94805 - DNA, 1116 bp, Glycine max
  Peptide Sequence Number=SeqID_211583
atggttattctggaattgccattatggaatggctattccaaaatgcttgttccggaatggaggaagggaacgaaagaggaatcatgggaggagcaccacgccgtggaaggggtgcgcaacgtcgggggaggaggtgcgccgctggggaaggaggagccttcacgccggagggaggtgttaggattaggggaaaagatgctaattcatatggtaaatgcttattgggcgggtcacagagaaccggatgagatccgttttgtacggatccgggttgcacactacagaaatatttggcgttttggtttggagctaagtgtgaatgaggagaagagaagaaggctgagaacaacaacgaaaaagggtttttggttttggactctgaaagaaactcaaagtgatgcgtttcatcgttctttcgcccaaaccctaacctcgtcctcgtgcattcattccccgcgatcagccattagccttcttcaaggaaggcaaagacttaaaggtagaggaaccttgagaaataaatttccaagcactagaatgagaggcttggaagacatttttggcatcattcctttttggatcttctacagattacctggtgccagaggaatcgaggttccaaaggagaatagcaaagcaatgtcagagcaatgtgtgtttttatccattgcaaacagcatgaattttgcagcatcattgtgcagaagattgaatatcaaggaacttgtgacatatgttcctgtgtatagaagcaccagtggtgtttctggagaaggtttgaatttggcgttcaggcgttgggcttccaaaaagactgctggttccacaaagaatggacgggattcaaaacccaagaaccttggagtgaagaaatttggtggggagagggtgatacctggaaatatcattgttcgacagcgtggcactcgttttcatccaggaaactatgttggacttgggaaagatcattctctgtttgcattgaaagagggatgggtgaagtttgaacggaacaagttgactggtcgcaagtgggtgcatattgagcctaaggaaggtcatgttctccaccctctgtatgcagcagatggttctgcatctgaactcaaagttgct

SEQ ID NO: 94806 - DNA, 204 bp, Glycine max
  Peptide Sequence Number=SeqID_211584
atgggaatgctcaccaatgaaacgcacctatccgcagaaaacgggggaaaagcaaaaggaatgaataagcaatttccaaaagacataactgataaaccagagaaaggaacagtaccatatatgatagagcttgtagtccagctgaacgtagccgcagagttcgttcgtcttcccccacttcttgagccagttgacatagtttag

SEQ ID NO: 94807 - DNA, 978 bp, Glycine max
  Peptide Sequence Number=SeqID_211585
atggaagtgtctgcatcagcatcaaggaggaggaacaacagcatatgcataaaaatctcgttgcttattctcgtaatctttcacttttcatccacaatcactgctatcaggaaagatgttggctttcaaatcattcatccctgcaaaaccaccgttcaaggaagatacctcctttcagatgataacggttatgtgtgtaatgccgcgtctgttaattcacgctctcgatgctgccctcaaagaggggagaaattctcttgccatggatgcaaccttctttcacaatgttgcaactcttatgaatattgtgtttcctgctgcctcaatcctgctttaataagtaaggaacaagtgctgaagatgaaggttgccaagcctactactgcgagtaatagttttatttggagccttggattgactagcctagacatcttaccgatttcatacatatttgcctcaacgatgaatgcgtttctgattaggatcgttgcatatacacatcatttgattttttggccagggacttattcaagtgtttttgactactgtgctgggagatgccgtcatagttctgagagtgtggtccatgaaaatgcttatattagtgacttccaccactgcttttctctgtcatcaaattcttctgggaaaaatagtactctcacagaagcaagactgagtggcatcaatgttgttgttgggaggcaaggtgaatcatgtaattcagtttgcaaatcaagaggacaatcatgtgtcccaaataaacttgtggtgcttaatagttgtgacattattcagaaatatatgagctgcaagggatcttgcttggcaagtgtcggagctgatcaacctgctgaagttgtttatgatgccccagtgcatctgaatccaggatcatgtttgtacactgaaacacagtctatactttcttgtgatggtttacatcagcacacaagaagactgtgcccctgtgcatag

SEQ ID NO: 94808 - DNA, 1704 bp, Glycine max
  Peptide Sequence Number=SeqID_211586
atgatgaaagccctcacaagctcttgttctaaggccatggtcgagactctaggacccttctctcccagagttcccctttgtgtttctgatagacccgaattctgcttcacccttcgttccaaaaatgagaaaaagggatggaatttattgctcctgaaactggttcgaaacaatgatctttaccctgttcatgcagtgccaccaaaggaccaggtggacttggagactgtggagcctcaggctcaacaaagtgaacaaacaaatgaatcaaagtttgttcatgtatcgttccagttagaaaagagttgtaattttggtgaacagtttcttatagttggaggtgatcctgtgcttggttcatgggaccctttagaggcattacccatgacatggtctgaaggacatgtatgggctgtggagctggatatgcctgctggacaaacattccagtataagttcatactggaaggagaagggggggatattatttggcagccagggtcggatcgattgatccacacttgggaaactaagaatagaatagttgttctcgaagattgggagaatgtagaacttcagaaaataacagaggaagatcaacttgccgagccaaatgaggaaccccaggttgactttgaagtgccaactttagctgaatttcttaataatcctcaagaagaactggattccaaagcatcggaaatatcgtctgtagaagatacccaaattcagtctgtggaggaaccacttgctgaaacagttcggcaacaaatcactgaaaacataagttcttcgggggatctcatcagcagtataagccacaaaagtaataaaaagagtatacttcaaccaagtgaagaatctgcagatagtccaggaaatgatattcggacattaaaggaagatcaacttgccgagccaaatgaggaaccccaagttgactttgaagtgccaactttagctgaatttcttaataatcctcaagaagaactggattccaaagcattggaaatatcatctgtagaagatacccaaattcatgctgtggaggaaccacttgctgaaacagtccggcaacaaatcactggtaatagtatttcttcctcaatggaaaagccaatgtctattgttgtagaaaacataagttcttcgggggatctcatcagcagtataagccacaaaagtaataaaaagagtatacttcaaccaagtgaagaatctgcagatagtccaggaaatgatgatataatacatgatcttggtcaaaatggaaatcctgcatcactggagaaccaggaaaagacaattgtggaaagcagcttatttgatcttgaagaaggtcctgttcttgtacctggcttaccaataccaccaactgagccaactgatgaagcagaccaaggtgaagttcaagaaacgactaaaaaggacacttcagttgaagcttttgaaactcaggatcagaacatagctaagttcagtaaggaggaagaaactgatgatgccataccccaagagataaatgcaaccatcaataatggaccagagctgctttacaataaacaacatgaagagtctcatttgtccccagaaatggaagactggccaaactacgagccagatgatgacaataccgtgcaaaatgacatcaaatggggccaagacacggtaaacaagtttctaacaaaacttggattcttttga

SEQ ID NO: 94809 - DNA, 711 bp, Glycine max
  Peptide Sequence Number=SeqID_211587
atgtacgagccgctgtggaagggttgcgcgggaccactggtggatgttcctcgtgttggccagagagtcttctattttccacaaggccacatggagcaattagaggcttcaacaaaccaggaactgaatcagaggattcctttgctgaagcttcccacgaagatcctttgtcgagttgtgaacgttcatttgctgatggtggaagggggcatcttggtttttttggagtttctgttatcatgtaaggttttaaattgtggttgcagtggcaattacgacacaacccttgttgtgacttgtgagaaattgtggacaaatgaggctgagcaagaaacggatgaggtttacgcgcagatcactttggtgccggaatctaatcaagatgagccgatgaaccctgacccgtgcactgctgaacctccaagagcaccagttcactcgttcagcaaggtcttgacagcttcagataccagcacccatggtggcttctctgttctcaggaaacatgccatggaatgccttcctgcgttggacatgtcacaaccaacaccaactcaggaattggttgcaaaggatcttcatggttacgaatggcgctttaaacatatatttagaggtcagccgcgcaggcacttgctcacgactggctggagtacttttgtgacctccaagagattagttgctggagatacctttgtgtttttgaggtaa

SEQ ID NO: 94810 - DNA, 375 bp, Glycine max
  Peptide Sequence Number=SeqID_211588
atgaagccttactcatctccgactactcgtatttttactcgtcactatataagaccaaaatcgcgccacctccatcacttctcattcatttttcgatccatttcgaaaccgaaaaccctcttcttcctcgctccgacttccgaaatcgtaaccgaatcggattcagctgagaatatggcacagctcgaagaagaaaaagcgcggcggcggcgggagcggtcgccggagcaagggaagaacacagtccaaagatcacgcttctcaattcggcgccgacgattacgatcagctctccgaagatattaccgcattatgcgcaattttcgaagaagactgcaaggttcttccaggatcgcctcctcgtgtagttattaa

SEQ ID NO: 94811 - DNA, 348 bp, Glycine max
  Peptide Sequence Number=SeqID_211589
atggagactattaagtttgcatttgggctggtgtttttcttcaccgccttcttttcttgctttacatttgttgcaattgatgcgctctatgatataggcactggcttggaagtgctttctccatggtgcccacatctttttcttgaaatggcaggcttaggaaattttgcaaaggggatggcagttgttgcagcaagagcaacaaggttgcctatatattcttcattttccaaagaaggaaatctcagtgacctatttgctaaagaagaggaattttcaactctctttaatgttattggaattggagttgggattcaattagcatctaccatctgtgcatcaatgtag

SEQ ID NO: 94812 - DNA, 573 bp, Glycine max
  Peptide Sequence Number=SeqID_211590
gctcatgagaaccctagggccttctcttgcatttttggcccaatcttcttggagtcttctatccaatgcccttggggggtaggattgcatcagacaccacctttcaggccattcgaagttactgcgaatggagctcaagctatcaccagaaaactggccaaacgcttctatggattctttcaggtcttagaatgcattggaccagtagcttacaaattacaattaccagagggagagcaaatccacccagtatttcactgttctaagctgaaaccttttcgcaggtcaacggaaaacgtggagggaactcctctgcctgctgaagaagtccttgtccaatgggatggcctctccctggatgacaccacatgggaggattgggagcagctctgcaacaactaccaccttgaggacaaggtggtctttcaagggtcgaaggatgatacgaatgagctagcagaagcacaaacagggacacaagcaggaggtataagtgatgagagggaggtgcaggtagcaaccaagaccaaaagaagaattataaagcccgcttacctcaatgactatgtttaa

SEQ ID NO: 94813 - DNA, 402 bp, Glycine max
  Peptide Sequence Number=SeqID_211591
atgctgaaagattttgaccctatagataaggtgatgagaatcctgaaactggccaaatacaggctaaaggcccaagtggagaaggacgaaggcccaagtggagaaggacaaagcccccgagtggagaaggatgaaggcccaagttccttgttgaaccaatctcagacttatcaaggtaatccttgtggcgtctaccctgacttatcttccttcaccggaagtggcgtctaccctgacttatcttccctctccagaggtggcgtcatccaaaagaactccataacctgtatcaagcgatctgttcctagtcataccctaacttatcttccttcaccagaagtggcgtctaccctgacttatcttccctctccggaagtggcgtcatccaaaagaactccataa

SEQ ID NO: 94814 - DNA, 291 bp, Glycine max
  Peptide Sequence Number=SeqID_211592
atgaagcagactctcgagtccgtcttcaacaggcacaggtatattgtttgtctacctatccctgaaccagccagatcttttgtctattattgggctaattttgctagatttacatgcttccagttacctgaagaaaacaatttcaggtcattgttgccacctcttatccttgtcctccttgtcactgtgattgctctcttcatccacttcttactctccccgaaggaattagccattgaagtgaaaagaaatgaagatggatcattcactagaaatgatggagtagcttga

SEQ ID NO: 94815 - DNA, 366 bp, Glycine max
  Peptide Sequence Number=SeqID_211593
atggctgttttaattaggatggaaagcatttccataaaacgtgtgcatggattagccaagattttggggtccgttctaagccttgttggggcaataacatttgctttagttaaaggacctcacctgggtttcatgaaatggtatctagaaaatcagaaccatacttcttaccctttaacaattgtgcactccaaaggtgatactattagaggctctcttttgatgctctcagctaacactgcatggtccttgtggtgtataggagcctcaacaatggatgaatataggaagcacattgaaaaggatccagctctggagaggcgattccagccagatgaaaccatacaaatactgaaaaggacttag

SEQ ID NO: 94816 - DNA, 2015 bp, Glycine max
  Peptide Sequence Number=SeqID_211594
ggattaaggtttttgaagttgctgctggtgattactttacttgtgcagttcttgctgacaaatctcttatgcctttatgttggggtgttggctttcccacttctcttcctttagctgtttcaccaggaatgtgccaaccttctccatgtgctcctggctcctatgcaattgataagcataagagtctttgcaagtcaccggattctcgtgtttgcatgaggtgcagtggtgcttgtcctcctgaaatgtatctgaagagtgcatgcaatttggcatatgatagagtgtgtgaatataactgttcctcttgttcttcatctgaatgcttcttgaactgctcctcttcatattccaatgctgctgcttctactgagaagaaaagtgaaaaaatttgggctctgcagttgccagttctcattgctgagattgcttttgcagttttcgtagttagtattatgtcaataactacggttttatacgtccgctacaggctaagagattgtgagtgttcaaaagggtcaggggtgaagaaacttggtggaaattcttccttccaaaacgagaacaaggtgaggccagacttggaggaacttaataagatcagaagggctcaaatattcacctatgaggagcttgaaactgcaaccggtggattcaaggaagagtccatagtagggaagggaagtttttcttgtgtgttcaagggagttttcaaagatgggacagttgttgctgtcaaaagggctatagtgtctcccaacatgcagaagaactccaaggagtttaacactgaacttgacttgctctcaaggttgaaccatgctcatttgctcaaccttctagggtattgcgaagaaggtgaagagaggcttcttgtgtatgagttcatggctcacggatctttgcaccaacacttgcatggaacaaaccaagtgttgagagagcaactagattggataagaagggtcacaattgcagttcaagcggcacgtggaatcgaatacttgcatggatatgcttgccctccagtgattcatagagacatcaagtcctcaaacattctcattgatgaagaacacaatgcaagagtggctgattttggtttatcattgttaggtcctgcagacagtggttcccctttggctgaactcccagctgggactcttggctatcttgatcctgagtactataggcttcactacctcacaacaaaatctgatgtctatagctttggtgttctccttttggagattctaagtggtagaaaagcaattgacatgcaatatgaagaatgcaacatagtggaatgggcagtgcctcttatcaaatcaggagacataactgcgatttcagacccggttttaaagcctcctcctgatcttgaagcattgaagagaatagcaaatgtggcttgtaagtgtgtgagaatgagagggaaagagaggccctcaatggataaagtaacaacagctttggagagaggtcttgcacagttaatgggaagtccatgcattgagcagcctattttgcccactgaggtggttttgggaagcaacagattgcacaagaagtcatctcaaaggtcttcaaacaggtcagtttctgagactgatgtggcagaaactgaggaccaaaggtttgagtttagagcaccctcatggataactttccctagtgtggcatcttctcagaggagaaaatcatcagtgtctgaggaagatgtagatgggaagaacaataatgcagaagggaagacttgggcaatgttgatgctcgccatcgcaccatcgttgtcgtcacaacatcgacattggatcaccggcgttgcatcaggtcgcgtagcagcatcgtcgtcgcaccaccgtcctcacggattcaagaagttgtggtggttcaccacatcaaggttgagcgtttgtagagtggtggaactcgcaaatgagtttggtattgcaggcgaagttcgctgcatcagcaccatgtcgcaaaagaatgagagcaactttgttgcggag

SEQ ID NO: 94817 - DNA, 314 bp, Glycine max
  Peptide Sequence Number=SeqID_211595
atggcaaatgaagaattgaagttgcaggatccacgatgtcggatacaatgtcctgacatcctgcccgagaatactggagttgctattttcaggaaagaagatagatctcctccagcacaagccgttgcagcccagaaacgcagagtgctatataatcatgaacgctgcacgagttctgtaccaagtccgggattgaagaggttgatctctttggttcagaagttgatctctggttgtaaacaggggctgttagaccttgaactaacactattgagagtggatttcctccctggcttggtagcccccagatgtag

SEQ ID NO: 94818 - DNA, 1683 bp, Glycine max
  Peptide Sequence Number=SeqID_211596
atgatgtcagtgaaaaattttcctgaagaatgctgggaattggtgttcagattcattggccatggtcgtcatttggaatctctatctttggtttgcaagcagttcctttccatcacaaaccggcttcaattttctctcacaatacatgatccaaccattccagtccttcctaggctactcctgaggtttccaaggctcagaatcttagacctcagtcacttgaatagccaccatgaaggcttgcttcgtcaaatttcacaatccggtttggaacttgatttgcttaatctgtccaaccagagaacacttcctgttgatggcttgcgagaactcggctcaaagatgaaaaatttgagggtgctgatctgctcaaacattggttctcttcgcgatagccatcttgtagtcatggcttattgtttcccatttctcgaagagcttgacataagcttcccattggattctcaagcatctgattttggggtgctaaggctgtcttcaatgcttgagaatcttcgcaagattaatatctctggtaattacttgatcactgataaatccttgttctctctatgccaaaactgtttgtcattgcaagagatttcattcttcacctgttttaagatcactcaattaggcattgcctccgcgatccgcctcagacccggtttgaattccatttcctttaacattgaaaagaaaagaatacatggacctggtttaacactcgcccccattgacttggatttgattgattcattcagcagtttgaaaaggttaactgctattgatttgtcaaattctgttatctcggatgagtttctctttgcagttgcagaaggtggaggtcttctgctaaagaaacttatcctccaaaactgctgcaattgcacattttcaggaatctcttatgtgctatccaaatgtcaatctgttcaatgcttggatcttcggaaagctgattttttaactgatcaatgtatccgcaagttatctctatttcttcttaacttaacttctataaaccttagtggttgttgccagctgaccaattcaacatttttcatactcacaagaaactgttcttcgctcagtgagatcaaaatggagagaacatatcttggggtggaaggggaagaagaagaagaagattcaatgccagattcttttgtcaaccttgaagtgaaaaaactttatttgggtgataatgttttgctgagtgatgcaagtctgataaaatttgtttccatttgccccagtttgcagcttcttgacttaaccggttgcgagggtgtttctggtgaatgtattggtgatgttttgaagagatgctgtgagataaggcatttgaacctggcctatacaggaatgaaagtgtttgagatgatggactttgaagtttcccaacttgaggtgttgaacttgtcagggtcaagaattgaggatgaagcactttcaataatctcaaagaggtgtagtggactactacttctggatatccagagttgctggcatgttacaccaaagggtgtaggtgaaatagttgaaaaatgcaggacgttgaaagagttgaatctaaagaattgtaggttggtgagtgatgattttgttgcttgggtggagatttcaagaccatcattgagaacaataacaacaccttctgatgttggtgtttattgctga

SEQ ID NO: 94819 - DNA, 763 bp, Glycine max
  Peptide Sequence Number=SeqID_211597
gctacattttccatggaactgtcagagaacctgctactctgaaatatcaacacttgctcaaactccacggagcactctcttcaaggcagatttcttgaattacgaatctctttgctcagcaatttctggatgcactgcagttttccatcttgcttgccctgtagaaacgattgagcctgctgtgaaaggaaccactaatgtacttgaagctaaagtgcaacgacttgtctttgtatcatctatagttgctatttccattaaccccaatttacctaaagataaagtcattgatgagtcctattcgtctgataaagattactgcaaaagaactcggacagaggcagaggagcaggcccttgactttgccaagagaactggccttgatctgtcaaccactgttaataccagtagcttggttctcctcaaacttttaaaaggtgttgactcattggagaagaagatccgttggatagtggatgtacgatatgtagtttatgcaatacttttgacttatgagaagcttgaggcaaaagggagatacgtattccattcacataacatcaagacacgggatatgctggagaaactgaagagtatatatcccagctacaaataccctgcgaactatactgaggtggatgattacataagtttcagctcagagaaactgcaaaggttgggttggaaatacaggtcactggaggaagcactcattgattctgttgagagctatcgggaagctggcctcctgcaatcagaataa

SEQ ID NO: 94820 - DNA, 2835 bp, Glycine max
  Peptide Sequence Number=SeqID_211598
atgattgtttttaaagagaaaatacctttggagcaagtcttcgcacagttaaattgttcggaggagggtctcacaactgaggaaggcctaaagaggttgcaagaaagtaaggtgctgaaattcttggggtttatgtggaatcctctgtcatgggtcatggaagcggctgcagtcatggcgattgcaatggccaatggagggggcaagccaccagattggcaggacttcgtgggaatattagcattgcttgttatcaactccaccattagttttattgaagaaaataatgccggcaatgctgctgctgcacttatggcaggtcttgctcccaaaaccaaggttctaagggatggaaagtggaccgaggaggatgcggctatattggtaccaggagacatcatcagcatcaagttaggagacatcataccagctgatgctcgtctcttggatggtgatccaatcaagatcgatcaatctgcacttactggtgaatcattgcctgtttcaaagaatcctggtgatgaagtcttctccggctctaccgttaagcaaggagagcttgaggctgttgtaatcgctactggggtacacaccttttttggcaaagctgctcacttagtggacagcaccaaccaagtagggcattttcagaaggtattgacagccattggtaacttttgcatttgctcaatagctgtgggtatggtcatagagatcattgtcatgtacccaattcagcaccgaccttataggagtggaattgacaatctattggtgcttctcattggagggattcctattgccatgccaacggtcttgtcagtgactatggctattggttctcatcggctgtcccaacaaggtgctatcactaagaggatgaccgccattgaggagatggctgggatggatgttttatgcagtgacaagactggcactctaacgctgaacaagctcactgtagacaagactctgattgaggtttttgcaaaagatgctgacaaggacattgtaattttactaggagctagagcgtctagggtagagaaccaagatgctattgatgcttgcattgtcggaatgttgggtgacccgaaggaggccagagatggcatcaaagaggtgcacttcttaccctttaatccagtggacaagcgtacggccatcacatatatagacatcaatggcaattggcaccgagcaagcaaaggggcaccagagcagattatacatctctgcaatgtccgggaagatgtgaagaaggaagctcatgctattatcggaaaatttgctgatcgtggtcttcgttcccttgctgttgccaagcaagaagttccagagaagaccaaggagagtccaggaggaccgtggcagtttgtgggtctgttgcctctctttgacccacctaggcatgacagtgcagagaccattcgccgtgctctccatcttggagtgaacgttaaaatgattacaggcgatcagctagctattggaaaagagactgctcgcaggcttggcatgggaagtaacatgtacccttcttcctccctccttggcgatcacaaggatgagtctattgctgcacttccagttgatgagcttattgaaaaggctgatggctttgctggtgtctttcctgagcacaaatatgagattgtgaagatactccaggatagaaagcacatatgcgggatgactagagatggtgtcaatgatgctcctgccctaaaaaaggcagatattgggattgcagtggctgatgcaaccgatgcagctcgaggtgcatccgacatagttctgacagagcctggcctgagtgtgattgtgagtgcagtcttgacaagcagagccattttccagagaatgaagaactacaccatctatgctgtttctattacaatccgaatcgtgctgggctttttgctgctagctctaatctggaaatttgatttctcaccttttatggttttgatcattgcaatactaaatgacggaacaattatgaccatttccaaggacagagtgaagccatcacctcggccagattcatggaagttgaatgagatttttgtcacaggcatagtgcttggtacctaccttgctataatgactgttgtcttcttctgggcagctcatgcttctgatttcttcaccgaaaaatttggtgtcagacctatcaggaataaccaggatgagctcacagcagctgtttaccttcaagtgagtattgtaagccaggctctcatctttgttactcggtctaggaacttctcttttcttgagcgcccgggtctcttgcttgttacagcatttgtaattgcacagctgattgccacaatcatagctgtctatgcaaactggggctttgcaaggatgaaaggaattgggtggggctgggctggtgtcatttggctttacagcatcattttctacattccgttggattttcttaaattcggcattcgatattttttgagtggcagggcatggaataatattaccgagaataagtttgcttatacatatgcatgcctttttgttcgctacgacatgcagactgctttcacaacaaagaaggattatggaaaggaagagcgagaagcacaatgggtcacagctcaacgcacactacatgggttgaatcctcctgaaacagaacagatatttagtgaaaagaacaagtaccgtgaattgtctgatatcgcagatcaggctaggaaacgagctgaagttgcaagattgcgggagctttacacattgaagggacatgtcgaatccgtcgtgaaactcaagggactggacattggtacaattcagcagcattacaccgtttga

SEQ ID NO: 94821 - DNA, 699 bp, Glycine max
  Peptide Sequence Number=SeqID_211599
atggtgaatggcgacggcggctcttcaggatcaggaaccaaattctcccgtggctcctccggcaattctggtggcgctaagaaaacatccggtgtgccctccggcagctccggtgtttcgggcacagtaaaaaccggtggcgttgaaagaaacggcgtgggttcaagtggagggggaaaggaaatgtctggcagtgttggcgttgaaaggaaaggtggcgaaggtgagaatgggacatgtggcggtgcattactgatgaaggggttcggagggggaagaacaagaggtggaaaaagggtcggagcaggcggcgccggcggaagaggtggtggggagggtgatggaggcggcggtggtaatgggcagcagggtgaagccggcggcggtgaacattccggtggtggtggtgacagcgatggacaggcaggaggcggcggtggcggtggtggtggtgcagaatattgcacaggtggagggattcttggcttaaatgcagcgtgtacatgcattcagacaagaagtaacaactatacagagataagaacaagagatacggcagaaaaaaaacatggtgagttaatggaaggaattgaagagatgcctagttgtacgtgccaatacaatgcagttgtgagtgaggtgttcattggtcgttggcatagctccttaaccgagggtctacattttgcaaagaaataa

SEQ ID NO: 94822 - DNA, 351 bp, Glycine max
  Peptide Sequence Number=SeqID_211600
atgggggtgcaaatagcaaccaggcccacttgggccctccagaagattcctccagaagacggttgcttctggaggaggtcaccttgctcgcctgggcgagctagaaaatccgagacgaggcgcttccgtaaggtttccgtaacatttccgtggggattttcgcgaatattttcagccgttcttcaacgttcttcggtcgttcttcatcgttcttcggtcttcaacggaaaggataaagacaacttaaccaaacactttgttcacaaagaactacgtaggtctgatttccttatcgcaattaaggaatacataggagcaagggaaaccccctcgtcgaccgcaaaaagataa

SEQ ID NO: 94823 - DNA, 174 bp, Glycine max
  Peptide Sequence Number=SeqID_211601
atggtgagcaaagtttggagctttgatggaggcttcaatggtgaggaagaagaagggaatagcaacatgagactatgccacatgtctccttttgagtggagcaaaaaggggcccactttttctcttgatgtgactcatactcagccacaagaagagaaaaatctgaccttttga

SEQ ID NO: 94824 - DNA, 1035 bp, Glycine max
  Peptide Sequence Number=SeqID_211602
atgacggtagcagcaggaatcggttacgctctggtagcactaggaccctctctctccctcttcgtttccgtcatttccaaaaaacccttcctcattctcacagttctctccagtacgttgttgtggcttattagtttgattgtgctgtctggaatatggaggggggttttgcctctcagcacaacagcttcgtggccttttggaatactcattttctcatctgttgcttttcaagaagccctcagacttttcttctggaaaatatataagaggttagaagacatgttagatgcctttgctgacagagtatcaaaaccacatcttcacctgacagataagatgctgattgctctggctggtgggttgggtcatggtgttgcccatgctgtgttcttctgcatcagcctattaactcctgcatttggtccagcaacgtatttcgttgaccgctgttcaagagttccatttttccttctttctgcaattattgctcttgcatttgtcataatccacactttctcaatggtcatcgcatttaacgggtatacagaggggaacaaagtggatcaatattttgttcccatcgttcacgttgttgctggaatggtgatttgtgaagttggcaaaatgattaactcaaacatgttaggatgtagagaaaggatcagtcctaacaaaactctggtgaatttggcgcctggcggttgtgctgttggcattcctcttctttatttggttgcaatcttgaccttgattcattgtgggaggatggtttggagaaaattgacagaaaacccaatcaggccagttcactcatatttcttggtgcttgccattcctgttggaatacataaagataccgaaagttataatgcacaaaagtttttccttgacgttatgttctcatcttacaatgggttactatgcgggcaagtcaactttctgcatttgtcagtttcacttatcgtcactgcaatcaggtttactgaagttttggttgcagatgcgggtttgctgaaagtcttgatcgtttag

SEQ ID NO: 94825 - DNA, 108 bp, Glycine max
  Peptide Sequence Number=SeqID_211603
atgtggttttcagagtggaagcaaggttgtcttttggctttatttggtaaaggttacatgtggaatttgatccactttaacattctcatgtatggcttcttaaactaa

SEQ ID NO: 94826 - DNA, 813 bp, Glycine max
  Peptide Sequence Number=SeqID_211604
atgggatcagatgcgattccagtggcaagtgaagttgcttcaacaagatctagtggtgagtcacctgcccaatgggaaaaggtgcttgaggggattcgcaaaatgaggtgttctgcagatgcaccagtagatactatgggatgcgagaaagctggggaaacactacctcctaaggaacgaagatttgctgtcctggtatcttctcttttatcaagccaaacaaaggatcctgttactcatggagcaatccaacgtcttcttcaaaatgatctgcttactgctgatgcaatcaatgatgctgatgaagaaaccatcaaaaagctgatttatcctgttgggttttatactagaaaagcctctaacttgaaaaaaattgcaaatatctgtctcatgaagtatgatggagacatacctagctcaattgagcaactactgttacttcctggcatcggtcctaagatggctcatttggttatgaatgttggatggaacaatgttcaaggaatatgtgtagatactcatgtccaccgcatttgcaaccgccttgggtgggtctcaagactgggcacaaaacagaaaacttcgacacccgaagagacgagggaggaattgcaacggtggcttccaaaggaagaatgggttccaataaatcctctattggtaggatttggacaaacaatttgtacacctctaagacctcgttgtggagaatgcagcataagtgagttatgcccctcagccttcaaggagacctcaaactcaagcccatcttcttccaagtccaaaaagtctggactaaacaagagggtttga

SEQ ID NO: 94827 - DNA, 870 bp, Glycine max
  Peptide Sequence Number=SeqID_211605
atgagtttgactggaactgtgaatgatgatgccactgctacaaattctccgtgttgttctgaagtttcagggtctgtgtcttattgtggatgttcatcttacaacagttccactcatctttgcgtcaagtgtgacttcaattgtgattctttactcactcttgaaaatgaagactccaagtggatgatctcagattcaaagccttattatggatgttgttcatctgagaaaccttcatctcctcttagcaccaatggaataatacattttgacagatcagaagataataatatttcagtggagcatctactagaaattgaaggcatgcaagagttcaatgctgatgaaccacttttttggccatttgaagggaaattcaactggaattattctgaggaatcaaggagtccattttgtatctcaccaaggaaaaaggttgtgtttggttctagatcaatgacatcaaggatagaggaaagtaaacgtaaagacgatggaagcgaatgcagtgtaacatctgaaccatcaaggatagtcatgccatctaaaggttcagcattggtagtaaattcagagttgaatgatgagaaagttgtattgaaaagcagagatggcaacaaactaatatttgttgacaaccttaatgaggatcatgggccaaactatgagcttcttccattggctagaggagatttttctttggatcaagagcctgagattccaattgaggcattggtaggactcaaggaatttgatggacatgaagggcttgattcagaatttaatggtgatgatgttttcatgctggaggaatctctcttaataactcatgcaagtgaatgtgtagtttccaaaaaggatgaatattga

SEQ ID NO: 94828 - DNA, 171 bp, Glycine max
  Peptide Sequence Number=SeqID_211606
atgcctagaaagaatagagcacagtgcttaaatagcaaagaagaaaagaagttcaacccaaaacaaagcatggggcagaaattggagttttgcaagctcagtggccatactgacgtctcagaattgagctccattggcaaattcgatggtccactcattgttgtccattaa

SEQ ID NO: 94829 - DNA, 405 bp, Glycine max
  Peptide Sequence Number=SeqID_211607
gggaggtggtcggcggagatacgcgaccgcatcgggcggtgccgccattggctggggaccttcgacaccgcggaggaggcggcgcgtgcgtacgacgcggcggcgaggcgcctgaggggggcgaaggcgagaaccaacttccagataccatcggtgttgccactttctccggaaggggttcatggtggtgccgtgaagccgaaaaccgcgcgtaacaacgctaggaagtgttcttctgtggaacaattgttcagtggggtgcctcaacttcgaaaagatgatggtatcggtgagaatgggaatgtggaggtatcttgtcgcatatataagtgtacaactgagattcaattcctgctggacttgcaattggcagtggcagttgcagttggggagaaacttccatga

SEQ ID NO: 94830 - DNA, 753 bp, Glycine max
  Peptide Sequence Number=SeqID_211608
atgtgctgggaagatggggcaagaaggccgcagaggctactaagaaggctgagagaaagagttgaactgcaggagttttcgcaaggatcgtgccctcctagcttggctttgcaagggatgttgtggtcaactattggtgatcagcttcttgcctcaccaattctagatggaaaagcacttctgtattctttcatatcaactcctgaagtaagaataggagttgcctttggaagcaatggaagccaatcacttcctgccactgaatggcctggtatttcttcttggctgttggttcctgggggtgcaggggaattgaagaaaatgttaacagaacctacaggattgcacgttcaggatcggaaattgatttacaagaaaaaagagagggattcaaagtcatatcttgatgttgagagggtcaaagatggatcaaaattggtgctgcttgtggacattgagagtagaaaaagaaggttacttgagatgttaaaaattgctaagaaggagaagacattaaaatccttgacagaaataaaggtggaggttgataaacttgccaagaagagaagagagcagggaatgacaatagtaggtggttgcagatacaggcgggccattcctgttggtcttcgagggctcttagacattgatgccgattatggtatcaggaaagctttcctaccacagatgcgtcaaaggctccttttggaaatcaatcaacaactaatcaagcagctagccagaactgcttaa

SEQ ID NO: 94831 - DNA, 348 bp, Glycine max
  Peptide Sequence Number=SeqID_211609
atgtatgagctattttacgacggttatagaaaccgtcgttgtaaggggaaaaatttcagaagaatacacttacactcgagggcacacaaagaactatgccaagaacaacatcagtatgcagctccagctattgaactgagtccagaaaggtgtgagagtttctgggaagggagccacggtcttctctccttccattccttggaagcgctagaggtagcctttgagaagctccacgtagtcctcgaagcccagagtggtcatcgcccagagcaggtcgtcgccgttgatcgccttgcacttctcgcgctggaaacatgctttgcaaattttgagaaaaattgtaattaa

SEQ ID NO: 94832 - DNA, 261 bp, Glycine max
  Peptide Sequence Number=SeqID_211610
atggaaaagaatctcttggcaaatttgatgcaaaagccgatgaggctatttttcttggttttcaggataaaggatactgcacttgaagatgaaaccaaagttgaagagcttgagcaaagcaaagaaatcactgtcactctcctcctcagatgtccattccaacagcttcaaaagtatctgatactccttgatctccttgaacaacatgtccgagtggtctcctcggttctctgtaacctgcactgggtgcacttgctctag

SEQ ID NO: 94833 - DNA, 375 bp, Glycine max
  Peptide Sequence Number=SeqID_211611
atggatgtgaaacatgatgcaactgtatggaaggcactccttgctgcatgtagagtccatggaataacaaaggagcctggatgtagttggatcaagatgaactacagagtgcatacattcatttctgaagatagaggacatccaagggaagctgagatttgttccaagattgatgaaatcgtaagaagaactaaggaagttggttatgttccagatatgaattttttgttgcatgacatggatacagagggaaaagaggttggtcttgcttatcacagtaagaaatcggatgttgctttgggattacttgcttctcaaacaggtgcaccaattcgaatgttaaagaatgagtttgtggagattgttctgctatga

SEQ ID NO: 94834 - DNA, 339 bp, Glycine max
  Peptide Sequence Number=SeqID_211612
atgacactctacggtttctacaatttctcaaatgaccaagacctagacaaagtatacacctttggcctctgcagaggaaatcaaccttcaggtagagacgtgcttgatggcaccaagaacgaaatgggattgatggatcaatttaatgaagcgctcaatagtttggtgaggaatccatttgtggatctttcccccctaccatcgctctgttggaaacctcccaagcctatgcctgcactggcacgaggcccaggctttgatcggcgtgagcaagaatcacctcgtagagagggtccatcaacaacgatggggataggtttggaaaattttgagagttag

SEQ ID NO: 94835 - DNA, 324 bp, Glycine max
  Peptide Sequence Number=SeqID_211613
atgtttcgccaagcggggatgtcttcaaggaaaagaaagaacgtcggttcaaggcccactgctcaatatgatacacggagattccattcctttgaggcatggaccagatatactgacaatgtgttgggaagacacatattagctgagaggaaagtggaaatctatcacacaaagctggatgaattcaagggcgagttggagaggcgtaactttcacaagcgcctcaccaacttagctgatagtagcattgacctcgcgttggtgaaggagttctacgccaacctctacagtctgtggaagcaacgccttccaagattattttga

SEQ ID NO: 94836 - DNA, 342 bp, Glycine max
  Peptide Sequence Number=SeqID_211614
atgggtcgcttagtgggtttcacaaaaaacaacactgggcttagcgacacaggagttccgcttagtagaaattgttacggtcctgctgcgcttagcggcactaaattgagcaaaaatttcactaagttatggaggcttagcgaacaagaacgctcagctcaacaaatgccgcaaggattttcgcttggtgtaggagattctggcttagcgtgcggccaatcagtcagaaaaaattttactaagttacctgaacttagaaaatcagcctcgcttagcgcacaatgcgcgcttagcaagtgctcatataaacacctatattcagggaagaactcgcttagggcg

SEQ ID NO: 94837 - DNA, 141 bp, Glycine max
  Peptide Sequence Number=SeqID_211615
atgctatccatcttagatgatttttgcagggggcttcgttggggcggttatggcgtagaaggaggagctgctcggcggcgagggtgtcgtcaaccatggccctggcaacccactggtcgtcgtcgaagttggacatcatga

SEQ ID NO: 94838 - DNA, 534 bp, Glycine max
  Peptide Sequence Number=SeqID_211616
atggttaagaggagaagaagattactgaaataccttaaaagaactgattgggattcctattgttttgttatctccaagctagaactacgtgataatcctgatcatggttataaaacacgatcgatctggtgtggcagcataggatcacatatctggtggtcagatgaacgaaaacccaaaataagaaaaatggaaaaagacaatcagccagttgatggaaagccagctgggttgtgcaggtttcattcaggtcagtcagggtgtagtgcagaatcaccagtttttcagaaaaacaacttgaataatatacaagcagtgaatcaaactgctgcccaccttataccaatcctaataacatgcagtagccacaagtggcgtatgaatgaacattgggtcaaaggatcagcagctgcaagagaggctcaaggatggagagcacgttgtaagtggggaggttatgacaatgtgtgttgtggatgtataaatatggaatggaatagaaaagggaggatagctggacagtttctcatctga

SEQ ID NO: 94839 - DNA, 180 bp, Glycine max
  Peptide Sequence Number=SeqID_211617
gaagttcttgtatggggtcatccaatttggttcctcctcttctccgaccataatttccttaacatctatggtaggagtttggagcgtctcctagatgatagtcttgaggtgtccgaccttcttggtgctggccagcttggagagcaagtctgctctggtattgctttccctggggattaa

SEQ ID NO: 94840 - DNA, 153 bp, Glycine max
  Peptide Sequence Number=SeqID_211618
atggaagaagattataaacttgtagctcagccacaaagacgccataatccaacaatgaaagaagtggtaagaaaagaggtagtcaaactattagagaaaggaatgatatatcctatttctaatagccagtgggaagctcaacaaagccactag

SEQ ID NO: 94841 - DNA, 432 bp, Glycine max
  Peptide Sequence Number=SeqID_211619
atggcggggccatggcccttctctatgtggggaatagatgtcatcgaggccatcgagcccaaagcttcaaacagacatcgcttcatcttggtggcgatcgactactttaccaaatgggtcgaagccgcctcatactccagcatcatgagaaacgtggtagtcaggttcactaaaagggagataatttgtcgttatggattgccgaggaagattatcacagacaacgccaccaatctgaataacaaaattatgaaggaaatgtgtgaggactttaagatccagcacagcaattctacgccttacaggcccaagatgaatgaggcagtggaggcggccaacaagaacgttaagaagattattcagaagatgaccgtgtcatataaggattggcacgaaatgctccctttcacgctgcatgactactggacctcg

SEQ ID NO: 94842 - DNA, 774 bp, Glycine max
  Peptide Sequence Number=SeqID_211620
atgcacttgtcgggttggagcacctgtgagatgaactactctctactggaaagaatatgctacgccttggtatgggcatcccatcgcctaaggaagtacatgctgagccataccacttggctggtatccaagatggacccggtcaagtacatctttgagaagcctgctcttacagggcagatcgaggagaagctagaagacaaggacaaggaaaaatgggtcatgtggttcgatggagcatctaaccccctaggccatagggttggggcagccttggtctctcctgacaatcaatgcatacccttcacggccatactaggtttcgactgcagcaaaaacatggccgaatatgaggcatgtaccctcgagatccaagcatccattgacattaacatcaagttgctcaagctgactctgcatggagacctgccatacattgagtttagatgttgtggcaagctcgcacattgttgtctgatagaagaggagcaagatggtaaaccttggtatttcgacttcaagcgatacgtcgaaagaaaggaatacccaccagaggcttctgataacgacaagagaatgttaaggacattggtgactggtttcttcttgagtgggagcgtgtcgtacaagagaaaccatgacatggttttactccgatgcgtggatgttaaagaggctgagcgaaggatagtggaagtccatgaaggttcctttggatcacacgctaacgggcacgccatagctaggaagatcctgagggcgggctattactag

SEQ ID NO: 94843 - DNA, 792 bp, Glycine max
  Peptide Sequence Number=SeqID_211621
atgatggatttctttggcggtgccacacaatgtctaatcaaagacttggcgggaaaagaaaaacacgagcatttagtcaatggacatacaatcaatgcttcttcaatccagacgaatctgttgtccaagtttgggaaagaaaatataacttcatcaaacctcaaaccgccatcaacttctaaagtacatacaaccacaggtgctgttccaattcaaaatggcaccacgtctcaacatatacattcaggaagatatacaatacacaaatcaaaactaatagagcacatctcagatgatagtgaagaggaattcaatataacccagggaaacattcatataggtccaacttacaatgatattggagatctattttggcaatgcaaccactgtaaagctatgatgtggtacgatgagaggattaacaaatgcaaacagaccaaaaacctaaggtttgcattatgttgtggtgatggaaaaatacaactgcctctactacaacatgctccacaaccgttgaggcaactactgtttgacaccaacagctcacaagctaagaacttccagcaaaacattcgttcatataatctaatgtttgcattcacatcgcctggtgtcaaagttaacacaacctataatactggaagaggtccttctacatttcgcatacatggtcaaggacatcatcttattggaagcctcttatctatgcctaataactcatcgaagtttacacagctatatatttatgatacagacaacaaagtcaacaacaggctttcccagagcccataa

SEQ ID NO: 94844 - DNA, 699 bp, Glycine max
  Peptide Sequence Number=SeqID_211622
atgaaggattcaactagacttgacataaaaagcggtttcccaatactcattaactgctacagcagttacatcaatttcgtcattcatcttcatgtttgtcattctgtctggcaccatattgagcataacctcattgaggtaccaacaacatatcatagaaaatgggctccgcactacccactttatgtgttattcaattacaatggagacaagcactatataaaggttagaaaatattataacaaatgctactttgctgatggactaaaggagctcagaagaattatgggcattcatgaaggtgtgatgatcacttttgctgcacctgagaaaaattggattttccatctccgcttcatgccaccactggatatacaaacatgtggaaggccacctacaattagcagaactcatgtttttactatagatgttaccaacgtactgcaactggatgctcttaattttgttgatgttacaacaaaatatatgattgtcctccatattcatggccgtcgtcacctatggaagctgatcatgcataatgggctacaatctattgctgaaacatggtaccaatacttgacggaaaatgacttgcatgtcgaagatgaggtagcgttctattacaggcctaaccaacatgtatgggagttcatcttcaagaaagagctgacatggaatgaagaggagtccatttga

SEQ ID NO: 94845 - DNA, 153 bp, Glycine max
  Peptide Sequence Number=SeqID_211623
atgctaagcgcaagattggcgctaagccaaatatcacttactcgcgctaagcacgagaatggcgctaagcgtgccttcaagagaacagaggaaaagcttagcaaggaagcaaaggttcttagaggtggaggagacattcccactgctttgtaa

SEQ ID NO: 94846 - DNA, 1014 bp, Glycine max
  Peptide Sequence Number=SeqID_211624
atggttgattggtgcatagacgtggaagctgtgacattcggagccgtcgtcggaactcggaagtgggtttgcgtcgttgtgaggtttaacgagacgatgagggcgctgtttctgttcttcgttctcttctctttcagctatgccaccgaacaaatctttcctgctcatatcggtcttcaccatttccttctctcttctttcttagggtttcagtttcaattcttcacatcaagtagcattttcggtggtggcggtggtggccgctctcgcgaacccaaatacaagatcgaatttcatcccgaagattccccttttcaccctgatgatgatcaggaatctatagtcatgccggataaaactggacagaaatatatatgttacttacctaaagtggaaaaggaaaaaagtggaaagcctgttatccaacacaatattagcagcatgattgtggaaactgagaaaaggattaagcagaagacaccagatgaactgctagaacaagaaggttggtggtcatatgaattttgctatcaaaagaagttgaggcaactacatctggaggatgataaggttgtccaggagtttgtcttgggagtgtatgatccggaggctacagctgcatttaacgaaaatctgtccgacatttctacattgaaggatccccggtcaaaagatgcatctcaaaggtatcatgctcatcaatatactaatggcaccgtatgtgatcttacaaataagccacgagagaccgaggtgaggtttgtatgctctgaaccgagagcaatgattagttcaatcacagagatttccacttgcaagtatgcacttacagtgcaatgtccgcagctatgcaagcacccattatttcaagaggagagaccagtatggcacaccatcgactgtaatgtgcttccaaaagatcacgtggatgccaaagtgagacgacaaaacgaaaatacggagattgttatagtgaaagacttcgaaaatagtgacttagagtcagaacaatga

SEQ ID NO: 94847 - DNA, 231 bp, Glycine max
  Peptide Sequence Number=SeqID_211625
atggagggagggggtaaaaccctttcccgttttggtcatgtgagaccatgtagaatgaaacgagatcgtgatgaggataacatgtcgttcgagaaatatgatatccttgtgatgctagatgtgaaggcaagctttagagaggttgtgtggggagctttgtctgtgttgtgtgttatatttgtgaaggacgggtttagtaccattgatagaggagcccacacaaacatgtaa

SEQ ID NO: 94848 - DNA, 183 bp, Glycine max
  Peptide Sequence Number=SeqID_211626
atggaatattggaaaaagcataggcatggaggcagagggctaggtagaggtattaaatgggcctctatcaggaacttggtggggaaactcaaggtggaccttctctgtttgcaagaaacaaagagggactctcttgataaggcagcttgtcaggctttgtggggtcatccagagattgattag

SEQ ID NO: 94849 - DNA, 282 bp, Glycine max
  Peptide Sequence Number=SeqID_211627
atggatacgcgtcttcacatccatatacacatatccatgaagcctccaaagacacgaaaccacattctatccatctgctcccacgcatgccagatacaggatcgccataggcatggaccacacgtgcaacaacacaaagcattgcataaagattcaatcaacatacaccattgtcatcatcagcccatcaatcatcaggtgccaaagtatctccatgaccaaggttatcaatatcgagagtctacgcagactcgtgagaacttcgtagagtcaactcgttga

SEQ ID NO: 94850 - DNA, 498 bp, Glycine max
  Peptide Sequence Number=SeqID_211628
aatgatgtgttacttgatgagtcgtggacatggttgtcaagctctagagtcaactcgtatactcttacgagtttaagagtttacttcggccctgcgagtcgactcggaagcaaactcgtttttgggcagactcgaagaggactcggtggatcattcgctaagcacgacactcagtggctaagcgcgaggaagaatccagaagaagatgagctgtcagatcctagaggtggaggagacatcctcaccacttgtatttttgcaatatttcatcttgttcttctctatgttgtaaaggaggtttccggactatggaaagctaaatcctctgttggatcttcccttggaaactggtctgattctaaagtccttgatagtacggggctaagttgttgtactgtcacgaggaatcggggcttgatcaggattaggctaggctatcatgaggaatcggggtctagcagtccaggagacaacataggaatacatgagcattgttag

SEQ ID NO: 94851 - DNA, 252 bp, Glycine max
  Peptide Sequence Number=SeqID_211629
atggttcatgctggaaaaactcttcaagacaaaatcaatttgcaacaagttgcttctaaaacaacatttgtttggcctctgaatgagagaaggtacaccactgaaagaacatcatgcatcttagatgttccttactggattttagatctattagctggtcttagaacacaagctgagggtggtgaggagttccacttagaattcaccaagtgcatcattgttcctatcttctacaaggacttagaaccatag

SEQ ID NO: 94852 - DNA, 366 bp, Glycine max
  Peptide Sequence Number=SeqID_211630
atggagttagagcaactcgatgtccaagtagcctttctccatggaagtttggaggaagacattataatgcaacaacctaaaggttttgaggtgcaagggaaggaaaattctatctgcagattgaaaaagtttctctatgggctgaggcaatctccaagtagacacccctatgatttgtgtgtctatcatattaaggtgaagaatggttctcacatctattttctactctatgaggatgacatgctcatagcatctcaagacaagtctgaaattcagaatttgaagtcactactcagtagtgaatttgagatgaaagaaattggagctacagaaaagattttgtgcatggagataaagagggattaa

SEQ ID NO: 94853 - DNA, 240 bp, Glycine max
  Peptide Sequence Number=SeqID_211631
gtggccttgttcgtgctcgtgcgcttagcgcagatctggatcgcttagcgcgcataagtggattttggcttagcgcgcttgtttcacttagcgggaggctagaagatatttggatgtggatgcttacgttcaaggatgctgtttttgggattgttgtggagggaacctttgtggagggaataaaagaagaggttgtactctcccctatgcatgctctgtcccttatagttgccggagaag

SEQ ID NO: 94854 - DNA, 1398 bp, Glycine max
  Peptide Sequence Number=SeqID_211632
attgccaacaatgacaaacatggagagaattctccatattttgatgggttgaaggcatatgatagaaacccatttcaccctaaaaaaaatcctcaaggtgttatccagatgggtcttgctgaaaatcagctctgctttgatctgattgaagagtggataagaaataatcccaagacttccatttgcactcctgaaggagtgcatcagttcagaaatattgctaactttcaggactatcatgggttgcgagagttcacaaatgcaatggcaaattttatgtcaaaagtgagaggaggtagggtcaaatttgatgcagaccgtatattgatgagtggaggggcaacaggggcaaatgaactaatcatgttctgcttggctgatcctggagatgcttttatgattcctaccccattttatccaggattcgtccgtgacttgtgttggagaactggggtgcaattaatccctgtccactgtgatagctccaacaacttcaagataacaagagaagctcttgaagtagcttacaaaaaagccaaagaagacaacatcaacgtgaaggggttgatcataacaaacccttctaaccctttgggcacaacattagacaaggacacgttgaagagcctagtgagcttcatcaacgagaaaaacattcacttggtttgtgatgaaatctatgctgccactgttttcagctcccctagttatgtgagcgttgctgaagtgattcaagaaatgaaacattgcaaacgtgacctaattcatgtgatttatagtttgtctaaggatatggggtaccctggcttcagagttggcatagtttattcattcaacgatgaagtggtgaattgtggaaggaaaatgtcgagtttcggattagtctctacgcaaactcaacacatgttggcatcaatgctctcggatgaaaagtttgtaactaggtttctttcggagaattcgaggaggttggaacaaaggcatgacaagttcatgaaggggcttgaagaggttaacattactcgattcccaagcaatgctggacttttctgctggatgaacctgaagtgtttgttggaggaaccaacgtttgaagctgagttgaagctatggcgtgtgattattcatgaggtgaagctcaatgtttcaccaggctcttccttcaattgttctgagcctggttggtttagggtttgctttgccaacatggatgatgaaactgtggatgttgcactcaacaggattcgtgcattcgtgggtaaagaaactaagaaacctgtgggattcaaacgttggcaaccgaatcttaggctcagtttttcttcaaggatgtttgaggagagtgttatgtctcctcattcacctattcctacgtcaccacttattggagctacttga

SEQ ID NO: 94855 - DNA, 345 bp, Glycine max
  Peptide Sequence Number=SeqID_211633
atggtgttggaaaaatatggtatcgaggatttagatagattcatccatgaaattgttgtctctgaggggtcccaatggtggaatgacttaatactcacatgtggggtggggggtgagagtagagccattggcgtgagagcacttacaagggacgaagagaatggttggaagtggaatcaaggggaagaagagaagtatgtagtgaaggagatgtatctacagccacatgcagggaatatctcgaatgaggaggaatcttcttgccaactgtggaagctaaaagttccatcaaacattaaaggttttgtgtggaagctgagttatatcgtgtgcaaacaaagctga

SEQ ID NO: 94856 - DNA, 347 bp, Glycine max
  Peptide Sequence Number=SeqID_211634
cattgatcacgggtctctgccagtcattcggggttcccgtcacacctagtagggtgattcgaccgccgatcacccgggccttcattgaaaagtattgcacgcctagacaggcgcagggtgatgctctgcaggccgcagatgcaccaccaccacctcatcaggctgatccagctgggtcatttggcatggagtggtatttacagcacttggttcgccagcaggcggccaaccacagggggcaggcaggggaggtgcccgcagaggctcccggcaatgcaaaggaggcccgcatggatgagaagatgacagacttactcggtttcttgggagggagtggagccacgtga

SEQ ID NO: 94857 - DNA, 271 bp, Glycine max
  Peptide Sequence Number=SeqID_211635
actcatcttctccttgaagtggcgtctcttctctctcttcctttctccattccgctgccattcatcttccaagaagcaaaggaatccattgatgaagaagatcctaggcctacaagctccaatggagcttgcatcacatcttttcctaccttcaagctcttattcatggtttcctatggtgaagcaaatgactctattgatgaagaagatccaaggcctacaagctccacatggagctacatcatgtggtatcaagagcatcttcatctag

SEQ ID NO: 94858 - DNA, 279 bp, Glycine max
  Peptide Sequence Number=SeqID_211636
atgacagaattgaagactttgagcgttgactatgtcggcaattcctctagtgtgactagtttttgtgatgatcgaaagctaaaggtccacttcccatgccgcaacacaaacacaaacaggataaggcatttgcatttacgggtttcttgtggggctgtcgagcttcatttgtacaatgtctactacaccaacaccaaaatgcgtgtccataacaccagtaaaacaaatatatatataaaaaccttaggctctctgccaaaacaacgccagaaactttga

SEQ ID NO: 94859 - DNA, 354 bp, Glycine max
  Peptide Sequence Number=SeqID_211637
atgaaagtagatcaggaaaattgtattaagcctaaggtaatattggattttattaatcatcgcacattagaaaacaggcccaggagcaaggctgttaagaatctaagctatttttggaggcctaattcctggatttgtttccaacgattcataatcaaggctgttaataatctaagttatttcatgaaaaccttacctcaacaaagtcgtggaacggtggaagggaagaggcggagtcgcggagaggtcgagaggggaggcagcggcagcgcacgatgcagtggaagaataggcgcagttcaccgtgaacgagagagagaaggaaacctaggtcgtgcaacacagcagcaatga

SEQ ID NO: 94860 - DNA, 228 bp, Glycine max
  Peptide Sequence Number=SeqID_211638
atggcgaagaaggaactagtggctcagcgcgtgaaagagcccgtggaatcctattttgaagcctcattgagccatggtttaaagtctcagcaccttgaggacaaggtgtttttttattggctagggaatgataggaatgaggaaatacagcaggagcacaacatatgcttgaatgggaggcccaagaggaagatcattccaccaagacaccttgaggattttgtttaa

SEQ ID NO: 94861 - DNA, 426 bp, Glycine max
  Peptide Sequence Number=SeqID_211639
atggggaaaaagggaaggagaaaggaagggatgaggaaaggaaaaagaaaagaaaggaagagagggtggtgggaaggagtgtgttttgggataaacctggccaaggacccatggtgggtactaggcttcaccgttgtagtaggctttcttcttccccttgcttctgcgcttgtttcttccccgtgcacccaacaatctccattcgtgcttcttcttccccgatattggccttcttcctctgcgccctcatttccttcctccgagccctcgtgtcctccattgaagttgttgtttgtgtcctccgccatcaagacgaaggttcttccacgcataggaaaggggcttctgggaactcccgcggaagaactgtggaaggttcttccgcgaattcctgcggaagaagcttctgcaggatcttccgcgtga

SEQ ID NO: 94862 - DNA, 162 bp, Glycine max
  Peptide Sequence Number=SeqID_211640
atggagtatgaacatagagagctacgtatgtcttggcttgagcatgctgtgttatggggcgtcaatggctgcatgggttcgccaactgtgtgggaggtgatgctatcagatggtgtcgggtcagtgaggctggagagggttcagtgtgcaattggactataa

SEQ ID NO: 94863 - DNA, 303 bp, Glycine max
  Peptide Sequence Number=SeqID_211641
atggtgatgttgcagaagaacaacaagaacaagggaagctatgatgatgagaaaccaaggagtaagaggtttttggtgaacatcaatatcatggggagtgcagggcctattaggtttgtggtgaatgagaaagagcttgtttctggggtcattgatactgctctcaaatcttattcccgtgaagggaggcttcctgttcttggttttgatgccaccaatttccttctttactgtgctaatgctggctttgatgtttatcttgaactttatgtaagcttttattacgtagataaccatggctaa

SEQ ID NO: 94864 - DNA, 646 bp, Glycine max
  Peptide Sequence Number=SeqID_211642
gtctcatctcgaaacacagggaatattcttttcaaatgtttcaagaacgataggatgggaaagcaccaagaaacttccatgtaatgtggcttcccagagttcaagatgggactttcacagattggcctcttcccatcaagcttttactgcagtgtatcctagaaggccttttatctgtagagcaaattctatgccaattagtttacaggaatctgcatcatatggagataattctattgaggatgaggatccatctacagacttggaagaggaaactttggcaaaaccacctaccagtgaacaggccttggccagattagcagaagaaatagctcaatgtggtattccagaaggttcaaggaagatcaatggaaagtacattcattctcaccttgttgctagattagaaggtatagtgcttctcagcaatggtcttttcttgccaactttgccccatttgtgtccttatcagtgcaaatgtgttgtttttgcctacatagctgtaaatgaacaactgaaggaacaaataaaggatgttgatgcggcacaatcaaaggaggtttctgtgttttgggttggcatggctgaggtaaacacttcaagattagacttccaaatgttcaataagaatcagcttgatcaataa

SEQ ID NO: 94865 - DNA, 366 bp, Glycine max
  Peptide Sequence Number=SeqID_211643
atgacgacgaaagaggttatgatgacaactcacgtaatgaaagaagagatggatgactacatcgttaacaggtcattatcgttgaaaccgatggaagggttgcacgaggtgggtcctctactgttcctgaagaagacgttcggaatagcggaggaccctcacactaaccccattgtgtcatggagccaaactcatgacattttcattgtttgggactctcacaaattctttaaatcccttctcccaaagtacttcaagcacaacaatttttcgaacttcttcgctagctcaacacctatcttcatggacttctgcaccttcagtccctttcctttgcaaaactgtgaaaggaacatttgggtatga

SEQ ID NO: 94866 - DNA, 711 bp, Glycine max
  Peptide Sequence Number=SeqID_211644
atgctgttcattggagacttgtatcagcttccgccgttggtgagagatgaacatattctgaagatgtattatcagtctccgttctttttcgatagccttgcaatcaaggaaattcctttgattacaattgaattgacaaaagtctaccgtcagtccgatcaggaatttctggaaatcctgaatgctatccgggatggcgatatcgccaatattgattttgaacatcttaatgagaggtatgaccccgatttcgaaacgggacaggattcatatgtctacctgtgttctcacaataaaatggcagatgaaatcaatcagaaaaaactcgcagaaataaaagttgatcccagcatttatgaagcgaaactctttggagaatttaaagaaaaccagtttccgaatgatcagtttctggagctgaagataggagctcagattatgtttatcagaaatgatatttctcccgaaaagaaatattttaatggaaagctgggggaaattgtgggactggatgaaaatgagattcgtgtagctttagaaggaagtgaaaaagaaatcgtcgtcaaaagagaagtatgggaacagaaaaaatatttcctggatactgataaaaatattaaagaagaggttttaggaagctttgagcaatttcctataaaactggcatgggcagttaccatccacaaaagccagggattaacctttgataag

SEQ ID NO: 94867 - DNA, 504 bp, Glycine max
  Peptide Sequence Number=SeqID_211645
gatgagcctactacttcaccttcttctagtgaaagtgtggatgcaaaaggggaagaatctagtgaagaaatctaccccctagaagatggacaaccattagtggttaaagagaagtgtaaggaggtaagtgtctcctccaagaggttagctaagaaggaaactcattttacaataaagacaaacactaaagaaactttccttcttagacaacctccacattttctcttttgtaaaaatacacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggtgttgagggaaggagccctgagtatgaagaacctcgggatttga

SEQ ID NO: 94868 - DNA, 165 bp, Glycine max
  Peptide Sequence Number=SeqID_211646
atggaatatcctttatatggcatctccatgagaaaggtggccaagcaaatgcttcgatgcaggcagcgcattgcaccctcaaaggtgagaccgacgatatggaacttcccaacactccttccacatatgtttgccaaaacaagcgagtgctactctaataggtga

SEQ ID NO: 94869 - DNA, 321 bp, Glycine max
  Peptide Sequence Number=SeqID_211647
atggtgcaacttttgttagaaaatgagtttttcatgagtttagctcaaccctacaaaatcggcttctactacccttacgaaactgtaatcagtttgttcactttcattacacagatcttagaggaatctgatgagcgttttggagatgaaggtgtaactgaaatagtagagctggtgaagaaaacattgccactgcctctcaatatgaagaaggaagaaatcaccaagggtgacgaagaaaccgcaacactgaaaaatgaaaaaggtaataagattcgtcaagaccaaaacgaagatggagaagaaatggacacaagttaa

SEQ ID NO: 94870 - DNA, 417 bp, Glycine max
  Peptide Sequence Number=SeqID_211648
atgaaaacaaaaggtgctcagaagaaactgatgaccaaacaacaaagatcaacaaagcgtgatctgtcttactggaagtatgttgatgcattacattttgtacagaagcgtagtgcatcatcatctgagcaactaattcaaagaaggagcatgccgatgttggatcaatttcatccatgcattcatgatttcattgtaaacattgttgatgtcaaaactgatggtaattgtggatatcgtgcaattgctgccttattaggtatgggtgaagattcatggtcattgatgcacaaccatttgcataaagaacttacaaaatggtctgataagtatatcaacctagttggtggcatagacaaatttaaggaattaaagttgtccttgttgatggattatccatggtatataactttaatg

SEQ ID NO: 94871 - DNA, 333 bp, Glycine max
  Peptide Sequence Number=SeqID_211649
atgcaacaactaatgaagcttcttgaatgggatcaatatattcattggcatagattaaaggatgaagatgttgtatgtgacatattttgtagtcatcttgatgcagtcaaattaacaaatgtatgtaatttggtatttttgatagatgatacctacaaaacaaacagtaaatctgtatttcctgaggctaccaatttgttgtatcggtttcacattgataagaatgtgaaggcaaagtgtaaaaccctggttgggttgagtctgctcattgagcctttaagagactactacaaaatagccttggagacctatgtagtgtttaggaagccatga

SEQ ID NO: 94872 - DNA, 1470 bp, Glycine max
  Peptide Sequence Number=SeqID_211650
atgggtttctcacaagacccctgcactgattccaatgccccaacctcaacctcttccaccttagttgtagatcactactgtgactacgacaagctcaaattcaaaacctttctcagaaaaatgttctgggaattcggtctcgcctgtgtggccaacccttcccagcgccggagaagctccggctctggtcaaaaagacgaacatggagaacaacaaggcgtggctgcttgcggagtctggttcagcttctgttctcaggttgagttggagtccctgaacatgagttcttcggctgctgcaacggttttgatggtgaatttggacaatggggtgagtgaatcgcgcgccaatgaaatgaagtggaggagaatggagtcgttggagaagagcatatcccctgtggctcacaccttgatcaggtttagctatggtgaaattatgtctgctactagaaatttctccaaagggagggtgttggggagaggagcattgagctgtgtttttagagggagagttgggattttgaggactgccgtggcgatcaaacggttggacaaggaagacaaggaatctgccaaggccttttgtagagaactgatgattgcaagttctcttcatagttcaaatgttgttccccttttggggttttgtattgatcctgaggagggtttgtttttggtgtacaagtatgtctcagggggaagcttggagcgccacttgcatggaaggaagaagggtagctcgcctcttccatggcctgtgaggtacaaagttgcaattgggattgctgaagctgtggcttatctacatagtggaactgaaagatgtgttgtgcacagagacattaaaccctcaaacattctgctttcttcaaggaagactcccaagctatgtgattttggattagctacatggacttctgcaccttcagttcctttcctttgcaaaactgtcaaaggaacatttggatatttggcccctgagtatttccaacatgggaaagtatcagacaagactgatgtatatgcttttggagtggttttgttggaactcattactggccggaagccgattgaggcaacaagaccttcaggagatgagaacttggtcttatgggctaaaccttttctacaaaaagggaaaggagcaattgaagagttgctcgatcctcaactcaagtgcagtcttaaattctcaaatcaaatgggtagaatgattgaagcagcagctgcctgtgtcacaaatgaagaatctcgacgacctggcatacgtgagattattgcaatactgaaaggtgaagaagaacctcttctctccaaaagaaagaagtccagttttcttgggaatggatgtgtgattgattgttattctcagttacaacaaacaaataatgagatgaaaagtcacttggcattagcaatgttaggtgttgcagagtttgaggatgatgattatctctatggtcgataa

SEQ ID NO: 94873 - DNA, 159 bp, Glycine max
  Peptide Sequence Number=SeqID_211651
atgcttgctgatgcagaatgcagagtgggagaaggatatgggattgggttggttaggaaagggaatcttgtggttttaagagctgaagaagactgggaacccacaggaggacaacatcctttagttgttagggaccagggtctaatgaagttagaataa

SEQ ID NO: 94874 - DNA, 309 bp, Glycine max
  Peptide Sequence Number=SeqID_211652
atggctgatgatgatccacaagatgtagccgatagggaacgcattttcaagcattttgattccgatggtgatggccaagtctcttcacaagagcttggtgatgcccttaaagcacttggatcggtgaccccggaagaagtgcaacggatgatggcagagattgatacagatggtgatggcttcatttcacacgatacagatggtgatggcttcatttcacacgaagagttcataaattttgcacgagccaaccgtggcctagtgagggatgtagccaagatttttggttttttaagttcttgctcttaa

SEQ ID NO: 94875 - DNA, 390 bp, Glycine max
  Peptide Sequence Number=SeqID_211653
gaaaaagattctactcttgaagatgacatcaaggctgaagaacatgaacaaagcaaagaaatctctacaacaatgcctaaagaatttctaagaaagtggagaactcagaaagatctctccttggataacataattggagaaatttcaaagggtgtctctacgcgttctagactcaggattttgtgtaacaacatggcttttgtttctacggttgaaccaagaaacattgatgaagccttgtgtgatgaacattggttaatgccaatgcatgaagagctaaatcgattcaagagaaatgaagtgttagacttagttcctaaaccaacctctcacaagtcaatcggaaccaaatgggtgtttcgaaataaacttgatgatctggcatcatag

SEQ ID NO: 94876 - DNA, 390 bp, Glycine max
  Peptide Sequence Number=SeqID_211654
atgggtgccaagcacctcacaaggaccaaagaaaggtcgcatgtcatcaagcaaaggttcccggatgaaattaggcaaaagaatgtttatacggataaccactcgggtatttccgcgtatcatcgggcccgccgcctctggatgatacaagggtgcagaatgaccaaacttggtctctgcttgtcatcgggcccgccgcctctggatgacaaaaagggtgcggataaccgtaagggtgcggataaccgtaagggtgcggataaccgtaaggtatctccgcgtatcatgggtatctccgcgtatcatgggtgcagaatgaccaaacttggtctctgcttgtcatcgggcccgccgcctctggatgacaaaagaggtgcggataaccgtaag

SEQ ID NO: 94877 - DNA, 228 bp, Glycine max
  Peptide Sequence Number=SeqID_211655
atgaggggcatcgtgcatgagcctcaagtgaacataggggcatatcaaaagttctcacccgttgatgtttttccattgtcgtcactccaaaatggtcaagtgactaaatcaaacagaacatacactctgagggagttcccggagagatttgcaaaagataggatagggttgcatgaattatcacctttttcaaaaggacagtcaatctgtgttttccaaaaagattaa

SEQ ID NO: 94878 - DNA, 204 bp, Glycine max
  Peptide Sequence Number=SeqID_211656
atgacgggagacacatcaaaattcacacatatctctcctaagaaaagcggacatgtaacttatggtgacaacaacaaaggtagaattcttggagttggaaaaataggtacaaattcttcaacctccattgaaaatgttctacttgttgaaggtcttaaacatagtctgcttagtgtgagtcaattatgtgacaaaggctatctg

SEQ ID NO: 94879 - DNA, 334 bp, Glycine max
  Peptide Sequence Number=SeqID_211657
ggcactggaagagtctagagcgactctcttcgtactgctaaggagaaggtgcggagcggaaaggcagaaaggaagtcagaagggaggtcacactggtgccaaaaaggcaaagataacatcctccaccaaagaaactcaagtgaagggacccgaacaagcaagggattcagatgaagcgcaaacgcaacgcgctcaagccaacaagcaaagagcgatagcagctctcccgagagggaatctttctctttctttccttctcccaggcgttattgtattgatggagaggattgagaacgaagtgagaggttatcagacccaagaagcaagggcttga

SEQ ID NO: 94880 - DNA, 240 bp, Glycine max
  Peptide Sequence Number=SeqID_211658
atggttagggacaaaagtcaccaaactcttattcctcatttcttctcgtgttgcatcgaacttatgctcaatgtcacttctcactcaaaacttcattatggtcctctcgccatcgtgcattctctggtcatcgcgtcaatggcgttatgcacctacgcggccatgcgacacctgattcgaactcatgtatgtgcctcctcatccgttaatcaagcactgggtttcgattttgaggaatga

SEQ ID NO: 94881 - DNA, 329 bp, Glycine max
  Peptide Sequence Number=SeqID_211659
gcattaaatgtcacctgtatcatcctccaaaagcgccttctatcaaagaagttcgttggctaaatccgcctgttggttgggtaaagggaaattctgatggggctgccaagggtttctcagggcatgcaggttgtggagttatatcagctatggaagtggctcatgagaaggattgggctcgttttgggcttgaatgtgattcgtccatggtgattcaagcgtactctaatgccaacatagtgccttggaagcttaggacctattgggataattttttatatcatatgaacactcttcatttcagacttaataacataggaaataaatag

SEQ ID NO: 94882 - DNA, 1005 bp, Glycine max
  Peptide Sequence Number=SeqID_211660
atgtctgcgtcatgcggggtggtggagtgtgtgttcgtgctgggctgcgcgcggtggctgtggaagcgctgcacctacgtgggcagctacgacagcgccacgtggccctccgccaccgccgacgagttcgacccggtcccacgcgtctgccgcctcatcctcgccaactacgagcccgatctccgtacccccaaccaccgcctcaaccccgactgcatcatcaagcgcgtgacctacgaggacacgctcggccacgcgccgccctacgtaatctacctcgaccacgaccacaaagagatcgtgctcgccgtgcgaggcctcaacctcgccaaagaaagtgactataaagttctcctcgataaccggttggggcagcagatgtttgatggtggatacgttcatcgtgggttgttgaaatcggcggtgtggctgctcaaccgtgaatcggagacgctgaagcggttgtgggtggagaatggtttggagtatgagatggttttcgcggggcattcgttgggttctggggtggtgtcgctgttgacgattttggttgtgaatcatagggaccgtttgggtgggattcccaaggagaagattcgttgctatgcgcttgctccagctagatgtgggagatttcctcctgaagtgaggactgctattcccgttgatggaagatttgagcatatagtcttgtcctgtaatgcaacatcagatcatggaattatttggattgaaagggaagctgagaaagctttacaagctcagagctctgaaactgtgacagaccctccaactgtacaaaagtttcagaggttgaagaccatagagaaagaacatagagatgctttggaaagagctgttagcttaaatgtacctcatgcagtggacactgcagagaacgaaccgtctgagaacaatgaaggtgatgatgcatccggtaatggaagaaataacgtctcaagtaaccaatcaaaatctagtggtggaaggtcaaactgggatgat

SEQ ID NO: 94883 - DNA, 1398 bp, Glycine max
  Peptide Sequence Number=SeqID_211661
atgcctcaccccactcaagtagtagcactacttaaagcacagcaaattcgacatgttaggttgtatgatgctgaccaagctatgctcattgcccttgcaaacacaagaattcaagttgctgtatctgtccctaatcaagagatcctagcaattggtcaatcaaataccacagcagcaaaatgggtttcccataatgtgatagcacattaccctgccactaatataacaactatttgtgttggttctgaggtcttaactaccctcccctatgcagcgaaagtgcttgtcagtgcccttaagttccttcactcagcacttgttgcttccaatcttgatcaccaaatcaaagtctcaacacccctttcctcctccatgatccttgattcattcccaccttcacaagccttcttcaaccgctcgctgaatccggtcttggttccaatgcttgatttcttgcaaaccactgactcttatctcatgctcaacatctacccttactatgactacatgcagtcaaatggtgtgattccattggactatgcactcttcaaaccactccctccaaacaaagaagccattgattctaacacccttctccactactccaatgtgtttgatgctgtgattgatgcagcatactttgccatggcttttcttaattacactaacattcctgtggtggtgacagaaacaggttggccatcaaaaggtgactccaatgaacctgatgcaacagtggaaaatgcaaacacttacaacagcaacttgatcaagcatgtgcttaacataaccggaactccaaaacaccccggaattggtgttagtactttcatctatgagctctacaatgaggatgcaaaggcaggaccattgtcagagaaaaactggggcttatttgatgcaaatggaaaacctgtttatgttttgcacttgacagaatcaggaggagtgttggcaaatgacaccaccaatcaaacttactgtgttgctaaggatggtgctgatcctaagatgctgcaggctggaatagattgggcttgtggacctggcaaggtggattgctctcctttgctgcaaggacaaccatgttatgaaccagacaatgtggttgcacatgcaaattatgcttttgacacttactatcatcagatgggaaagtctactcagtcttgtgatttcaatgacatggctacaatctccaccaccaatccaagtcatggatcctgtgtatttccaggaagtcttggaatcaatggcagcttccccaacgtcacgttatcatcactgaattccacaaattcagtttcttctgcctccaatctccatagtggtgaattgggaattagaagccttctaatggtgatagtacttctactatggggagtggttttgctataa

SEQ ID NO: 94884 - DNA, 912 bp, Glycine max
  Peptide Sequence Number=SeqID_211662
atggcttcttccttggacatgtcacttgatgatagaataaagaacagaagtaacaacagagggagaggtagaggaggacgtggcagagctcattctggccgtggaccaagcggcactcttaatggtagaagaatggttggtgctgttaatagtagaagaatggctggcgctggtaatggtggaagaacaactggtgctgttcgtagagggcctcttatggttaacactcggccgtcgtcgtatgctattgccaaggcaagctcaaaaaactctattcgcagagctaggccttttccatggcagcatgatttgtttgaagatagcctaagagctgcagggattcaaggagtagaagttggcaccaagttgtatgtttccaatttggaccatggagtgaccaatgaagacataagggaacttttctctgagcttggagagttgaagcgttttgctgttcattatgacaaaaatggacatccaagtggttcagctgaagtcgtttatactagaagaagtgatgcatttgctgcccttaaacgatataataacgtacttttggatggaaagcccatgaagattgagattgttggttccaattcagaattgcccataagtgctcgggtaaatgtcactggggtgaatggacgtaggaagaggactgttgtaatgacgtctagaggtggacaagctggaggtggtcctgctatgcctacacgtggtgctggttggggacgtcgaggtggcccaaggagtggcagtggacgtggtggagctggaggtcgaggtcgtggtcgcggcaggggtggagctggaggtagaggtcgtgggagaaaggacgctgttgagaagtcagcggaggaacttgacaaggagctggagacctatcatgctgaggccatgaacatctcttga

SEQ ID NO: 94885 - DNA, 327 bp, Glycine max
  Peptide Sequence Number=SeqID_211663
atggatttgctctgggttgtattgcaaatctgcgcggctcaggccgcatgtcacacgctggttgttgcgtcagcggcagaagagccattcgcgcaagaagcattgtcgcttttcgaccggcaccgcccccctcgatttccagtttggccgaccgccgtctgcggcgtcttcgctgacacgatcaatacaagccttcgaatggcgggcgatttccccgccgaagcagcccggcgtcgcaccggcttctgtggcgtgcgacaggttgtgtcgcattcatcgatcaagctcaaggcaacggcgtcgctgaacgtcgcactatcgtcatga

SEQ ID NO: 94886 - DNA, 513 bp, Glycine max
  Peptide Sequence Number=SeqID_211664
atgtcctcaccaaagccaaggggtcgccctccaaaggaccctaatgctccacaaaattcaacaagtgtcaaagtgtcaagtgggagtagtgggaccatgtttcggaagaacaacaatatgaagtctaacctaagagttccaccaaagagaggatgtggaaggccacctaagcctaaagttccccttcctccaagtactattttgttctcaccaaggccgagggatcaccctccaaaggaccctaatactccacaaaagtcaataagtgttaaagtgttaagtgggagtagtgagatcatgtttaagaagaacaactatttaaagtctaacacaaatgcttcactaaagaaagtgcacccaagcctaaagtttcatttccctcaagtactggtttgtccccaccaaggcctaggggttgccctccaaaggaccctaatgttccacaaatgtcaacaaatgccaaagtgtcaagaccaagggggagacctaggaaggttgttaggattggggtga

SEQ ID NO: 94887 - DNA, 246 bp, Glycine max
  Peptide Sequence Number=SeqID_211665
atggcggatggcggaaggtcgaaattccaccatataaacatgccattgcgccttatggaaccaccatggcaggtctcccttcacaaattgcctatagtgattggcaaaaaaatcaccacgccattccatcatggcggcaccttaatttggaatttcttcagaacacaaaactcaaatatttcactaaagatgcagaagatgtttttgcttctgcataccttgaatgttttacaggtagttgtttga

SEQ ID NO: 94888 - DNA, 381 bp, Glycine max
  Peptide Sequence Number=SeqID_211666
atgatgttgtggaaacgttgtatagtgccacgtaaacatcgcgggaaccaaaagcacaacaacgcaacatcatcatcagcttcagcaatgtccactgtgagagttcaagtttcggcgtgtgtgttttctgccaccgtcaacaacctttgcctccgccaaaacgccgtcgtttccttcagaaagaagaagcttctcagattggtctcaatgtcttccgttcctccttcccaacccttcgaaatcgccgttaaagcttccgtcaccacacccaacaggctcggcgactgccctttttgccaaagggtgttgctgacactggaggaaaaacatctaccttatgaccccaagttggtggatttgaccaacaagccagaatggtga

SEQ ID NO: 94889 - DNA, 345 bp, Glycine max
  Peptide Sequence Number=SeqID_211667
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaacttccacttgcagacatggacaaatcaagtgaacaagcagcagggactgagcctcagagtagaagaagaagaagcaactcagcgtgggaagaagaagaagaagaagcaaccagcagcttcgtaaaccctaatttttttggggaagaagaagcaaccttgcatgtgagagagaatttatag

SEQ ID NO: 94890 - DNA, 187 bp, Glycine max
  Peptide Sequence Number=SeqID_211668
atgcccctgcccgccttcaaggcctacgatatccgcggccgtgtgccggaagaactgaacgatgacctggcccgccgcatcggcgtcgccctggccgcgcagctcgctcccggcccggtggtcctcggccacgatgtgcgcctgaccagcccggcgttgcaggatgcgctggccgcaggcctgcgtg

SEQ ID NO: 94891 - DNA, 525 bp, Glycine max
  Peptide Sequence Number=SeqID_211669
atggtcgaggaaggccggcgggtcctggtgttctcgcagttcaccggcatgctggcactgatcgcgcatgcgctggaggagctcgggctggcctatgtgaccctgaccggctacacccaggaccgggctacgccggtgcagcgcttcatgcagggtgaggtgccggtgttcctgatcaacctgaaggcaggtggcgtcgggttgaacctgaccgccgccgacaccgtcatccacttcgacccctggtggaacccggcggccgaaaaccaggccagtgaccgcgcccatcgcatcggccagcagcagccggtgttcgtttaccggctgatcgccgcaggcagcattgaagaacggatcgccgagctgcaggaacgcaaggccacgttggccgactcgattctggaaggcggcggcgctgcggggccacgcttcagcgaggaagacgtgcaggcgctgctggcgccgttgccgggcgtgcccggcaaacgttcccgtaaagcgggcaaacggtcgacgcgagcctga

SEQ ID NO: 94892 - DNA, 133 bp, Glycine max
  Peptide Sequence Number=SeqID_211670
atggcagaggtgggggtttcggataatttgaaaggtctaatactggcgatgggttctagtgcattcatcggttccagcttcatcttgaagaagaagggtcttaagcgtgctgctgcacgcggtactcgtgcag

SEQ ID NO: 94893 - DNA, 1066 bp, Glycine max
  Peptide Sequence Number=SeqID_211671
ttgagtatatgaaaagattgtatgacaaagtgaaggtgcaaattgcaaagaagaatgaaagttatactaagcaagccaacaagaaaaggaaggaagtggtacttgaacctggtgatgatcctggacatttgagggcaaatgttttccaagaaggagggaatgatgagaatcctgaaattggccaaatacaggctaaaggcccaagtaatccttgtggtgtctaccctgacttatcttccttcactggaagtggcgtcatccaaaacctccgtagcctgtatcaaatgatccgctcctactcaggttcacatcaggcaggatcaccatcagaacctagaaaacgtagtagattatggctttatgagaatattgttgatgttttagaaaatgacaagggaactgatacaattgaagtaatcatgctacacttgccgaagaataaggaagttcgatggaatggaagcgagctcaagaagatgacaaacctaaaattactatctattgaaaatgctcacttttccagaggccccgagcatctcccaagtagtttgagagtgccgaagtggtggggatatccttcaccgtctttgccacctgaatttgatccaaggaggcttgatatgttagacctgtctaagacttgcaacatattaagcaaacaactcaaaatcatgaatttcgagtctttgagtgaaatggttttaagaggttgcacattcataaaacaagcacctgacatgcttcttgataaaattacatggttcagtgctattggatgcatcaatctaaggattcttcctcacaacttcaagttaacatcacttgaatatctgtctctcacaaaatgctctagtctccaatgtttgccaaacatattagaggaaatgaaacatgtaaaaaatcttgatttgtctggaactgctattgaagaatttccattgtcatttaggaaactcactgggcttaaatatctagtgctggacaagtgcaagatgcttaataagatctcaacaagtattttgatgttaccgaaactcaagagattgatggctgtacaatgtggacg

SEQ ID NO: 94894 - DNA, 270 bp, Glycine max
  Peptide Sequence Number=SeqID_211672
atggaaaaactaaaagttagctatgagggtttgaaaggaaatgagaagggaattttccttgacatcacttgtttctttagaggctacgatttgaaagatgttgtgagttttttgctccaaggtcgtggtttctcactagagtatgttattcgagtggtgatcgataaatctctaataaagattgatcaatacggttttgctaaaggcccaagtggagaagggcgaaggcccaagtggagaaggataaagcccccgagtggagaaggatga

SEQ ID NO: 94895 - DNA, 501 bp, Glycine max
  Peptide Sequence Number=SeqID_211673
atggccatcgtggtttttcgtcactgctactggcgaaaaagccaatggttttgctgctcgtgctggcggcgcaggtctagggcagcagggctaggcagtaggtcacaggccaaggctggtttcgccacagggcctagcgaaatagaaaaagaagcacaacatgaggaggctgtttcgcaaactctgttggcgaaaactgcctgcacctctgcacatctgcacctatcctccctgccacctgcacacccacttgcacacctgcacctcctctacccatcacgcaagctaattcgccagtcaaactggcgggatcaagtggatggcgatatcaccaaaaccagtagcgaaaccactggctttttcgccagtggcagtggcgaaaagccatgtgttgctcagacagccattttgctagttgcaatggcgttttgcatggcgttccatgtaaaaaacgaaccccctttagaaatagtttcgaaacagatccattcaaggaaatag

SEQ ID NO: 94896 - DNA, 357 bp, Glycine max
  Peptide Sequence Number=SeqID_211674
atggttaaaaagtttggtatcatagttttactggaacaggtttggatgtatgcgggaaaaagagagggttttgatagaggaataagggagaacgaatttgagaggaagataaagtatgaacatgaactcattcagacaattggattggagtctagagtgcaagaggggaactcacttttggatgttggatccaatcaaggagtaagtatggtggggatttatggtatcggggttataggtcaatgtttccttggtgatattagagaaaaatcaatgaagcatggcttagtacaacttcaggagacaatactttctgaaatggttgggggagaagagtatcaagtttgggagtattaa

SEQ ID NO: 94897 - DNA, 129 bp, Glycine max
  Peptide Sequence Number=SeqID_211675
atggaatgtgatgattcacttcccgtgtgttgtttgtgtttggatcctatgatgatctcaaaccttgagttcatgggagcagatggcttgatggattactttagggaacctcgtgctggaagatgctga

SEQ ID NO: 94898 - DNA, 240 bp, Glycine max
  Peptide Sequence Number=SeqID_211676
atgagtagagctgtgagtgggagcgagaacgagagtgcgagagtgagagcgattgtgcaacgccaaagtggaatgtggcgggtacatagtgacacagtgagcaacacggtgggcacgtcgcgttgtgaggagttgagtgactgcgagagagcgagagtgagagtcacagagggagaatgggagttgcaacgcctcaaggcagagagtgagagtgagacaacgcgagaacggtatgagtga

SEQ ID NO: 94899 - DNA, 315 bp, Glycine max
  Peptide Sequence Number=SeqID_211677
atggcgaacccaattctactagctagatggacagaactcaaacatttctatggactcattagaaatcatcaaatgatcatgacccattttggacagagtgttttgttcctcaccatcttcaaaagcagctctaaaccaagagcttatcttaaatggcactacttgtaccaccaagtttctaactcagacacttttgaagtccttctgtctgagtacaaagtgacttgtaatagtttggatgtgccgagtatcatgtactcatttatgaaagctgcaagattcacccatctgaatttggaagagattacaaagtga

SEQ ID NO: 94900 - DNA, 420 bp, Glycine max
  Peptide Sequence Number=SeqID_211678
atgcctcccaagctcgctgtcgtcatcgccgacgacgaccttccctcttcgctcggccagcttgctgcctccctctgtgattctaactttgcactaacctcctccggcaagcctctcagttccgttgccaaccactcctccaccgttgccagcaaggtcaagaaggccttcggcctggaatcgccaggtttggcctccagaaagagacctggctctgcttcgagccaaggaaagccgaaactgcctctcatcgtcggcaaactcatgcgcaaccagatgaaggtttccgaagccatggattcgcacgtgcgacgcgtgctgctcaggatttctgctggccaggtcgttaacactcttcgcttaaaccactcctcacattttttcgcacgtgccgcaatgcatgttgcgagggacacttga

SEQ ID NO: 94901 - DNA, 534 bp, Glycine max
  Peptide Sequence Number=SeqID_211679
atgagttattgttgtgagagagagaaagaagagagcacgacaacgaggtggttccaaaagaactgtcgtaaaataactatcgtaaaaactctcatttctaatagtagaaccgacaatctctacaaagctctttgtgacagaggaattcacaccttcatcgatgaccaacagccccgcaaagggcaccatatcacctctgcatttgagaaggcaatcgaagagtccataattttcatcttcctccttttgcttaaacttgattatatcctcaagtttatcaagggaaagggtctgttgattttgccaacattttatatggtcgatccttctgatttgagacaccacacaagtagttttggagaggcattggctaatcatgataagaagttcaacactaatgaggagacttttaggtgtaacgttaacatggataagctggagacatggaagatggctctgcaccaagtggctaacttgttggctaccatttcaaacatgggtacccttcctcgccaatcttttatcttgttttaa

SEQ ID NO: 94902 - DNA, 1167 bp, Glycine max
  Peptide Sequence Number=SeqID_211680
atgtcaaatgtcatcacccactcatggaaaaatagccggacttctccaggtgagccggtcatgccagatcctgttgttatgattaaagatgatggccatattttaattattgccgatgcagatacggatgccgatggtagtcctgatgcggaggaaatcgatccgacaggtaattggaagaagatcaccggagtcgctgtaaatatgggggatatggctaaaataaattatagagatagtcatatctatgcaatctgtgcagacgtcggtggaaaagagtctatcggagaggcttccattgccgcagttgaagcgcttggcgttaacccatggagtaaaaataagaaaaaaataatcagagggatcgggtatggagtgacctatgagatcattgcaggctctgcaagcttgggggccacggtgagttttgaaacgatccaggcatatggtcgagagttgttcaaggaaaatttgccttttagtttgccgatgaaaatcgaagatatctcaggtgttatgttaggtagtaatggaaagggaacgccgacggtagttatctcgtcgaaatcgggagaaagtcatgttaaagaatatagtgatactcaggaacttgctctgatattgcaactgctgcccaaaacaaaggtcacgatagatgcaccgtttgtcgcgcaactggctgatgccgtggtgtgggatgatcatttttacagcagcgctgagcggtttgtcgggatgtttaaagaagattaccgttcaatccgggaagcggtagaagactggtttgtgccggaatacagccctaccgcgacaagcaatgcctgcgttgcacaccaggttagttgccttaagctctgtggcttgccttatccgaaacttggcagcatgcagtctatcaatgttgattacttcgttgaatgggctctagagcagggatggcagaagataacccaccgtgcgagtctggcgccgggagatatttgtgtctccgggccgattggccaccccaaggaatttgaccacgtttattgctttgtctcgttttctaccgagcaggttggttatgcagttatttttgataatcaatattttggcatccatacacgttctctcgacggtataggttcaaagataggggaatggcgttacgcaataagaatgccctag

SEQ ID NO: 94903 - DNA, 1081 bp, Glycine max
  Peptide Sequence Number=SeqID_211681
gaagggattgatcaaacggtggatatgcgtattgagggcggaggtagctctttcacctggcaaatcaggcgctataaatatagccttgagtatgaccgggaaaggcagcttcttcttgctaattcagtgagcaatcgtacggggcagatcccttcacccgttattatgttactcagtgaacccgaaagaaaggcaatattgcttgtgtctagaacaagcgaaggtgtaccggttggtgagttcgaattaagttcgacgatacaaaataatggcccatggctagttgttcccaagcaaggtgatgaagcttcatttcggccttgctacattgcaggcgagccggtaatccaaagcgatactacgacaatacagtctctgcaaaaggcaacgcagcttttcaatccccggtcggatgtaaataccattacgttagttctggaacaaatggcgagcgaccctgcacactcgggctggcagttcttacgtaacttatacaatcagtttggatatttaccgctggcaacctttgaggtatggcgtgccttggtccagcatccacaggcattggcaatgtcactgtttaaatttgagatgtccattgattatctcagccgtattgaaagcgagtttcctgttttctgggagtttttgcctattactgaggttaaacgtgcctcaatgcgttttcgagcgtttctgactcataaaggtgccccggaggaaatgcagatcaagtcattgggtcgaatgttccagagattaggaactgtatttccaacctatgccagcgaggtgcaaacatggttagaccaagggaaattaccgccgacttttccggcacaaacgatagaaggtatcattcatgagtggtatcaggagctcttacgtgaacatggtgaatcacgttggccagagtttggtgggccgggtctttttcgttggtacgcctcgcaaaaggatcccattatagaggtttcgcctgataccagttatcgatattccgtcactttgctccccatatttgctgctgctgttacatgtggcaaaacaacatttgacagcgtttttgaaaataaaccag

SEQ ID NO: 94904 - DNA, 668 bp, Glycine max
  Peptide Sequence Number=SeqID_211682
gtgaggcatgcttgcccgctagaaagccaccgttcatgcacagagaaaggagggccaaattgggaccaactcttagcaagcaaagaaggagcatctgtcaacttgttccctcgatggaaggaaggaagaaccggggttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacatggagacacttcagaaggaagttgaggcaccggaggaagacaaagaagtgcaggcccttagggcggaactcgagcaggcccaaacagttaaagaaaagttcaaatcagcagctctgaaaatccgaaaagagaataccgaactgagagatggtagcaaaagcaagcttaaactccgaagagaggaaagggaccagtcacgagtagacagtttgatcttgaaagatgaattgaaggcttgcacgaggtccaaaagaagtttgtctcagcggttatgcgagacagagaccaacatgttagctatcatcaccaagtaccaagaagaactaaatctagccgcgacccacgagcatagagtggcggacga

SEQ ID NO: 94905 - DNA, 666 bp, Glycine max
  Peptide Sequence Number=SeqID_211683
atgttccagccgcatactattttagatgcagatggttatccggtctatcgtagaagaaataatggtcacacaattgagaaaaatggtgttataattgataataggtatattgtaccttacaatccaagattgcttagaaaataccaagcccatatcaatgttgaatggtttaaccaaagcacttctatcaaatatttatttaagtacatcaacaaaggatatgatagagtaactgttgttttgattcatgatgataatgatccaattcacaatggtagcactcataatgatgagatcaaagaatatctagattgcagcaagaagaaaagatgttgtcaccttatgaagaaaggctacaccattggtagattactatgggtcccaccaattacaagcaaattattttacttgaggatgatgcttactattggcaaaggacctacctcatttgaggatttaagaatagttggtaatgttcaatatcctacatatagagaagcatgttttactatggggtttttgcaaaatgataaagaattcattgaggcaatcaaagaagcaaaagactggagctcagcacattatataagaaagctatttgtgttgttacttttaactacaacaatgaacaaacctgaacaagtttgggaccaaacttggcattga

SEQ ID NO: 94906 - DNA, 702 bp, Glycine max
  Peptide Sequence Number=SeqID_211684
atgactacacgtcctcgccttcaaagggctacatgccctcaccatctgaggactacacgtcctcaccttcatagggctacacgtcctcgccatcagaggattgcacgtcctggccttcagagggctagacgccttcgcctagccttcagagggcaacacacccttgccatcagtggactacacatcctcaccgtcagagggctacacgccctcgcattcaaagggctacatggccacgccttcagaggactacgtgtcctcgccttcagagggcttcttgccctcgccttaagaggactaaacgtcctcgccttcagagggctacacgccttcgccttcagacggctgcacaccctcgccttcatagggctacacgtcctcgccatcaaaggattacataccctcgacttcagagggttgcatgcactcacgttcaaagcactacacatcctccgcttcagagggctacacgccctcgcctatagaggactacacatcctcgccttcaggcggctacatgcactcgctgtaagagggatgcacgtcctccccttcagagggctacacgccctcgccaatagaggactacacatccttgccttcagaggcctacacgccctcgccttcagaagactacacatcctctccttcaaagggcttcaccccctcaacttcagaggattacatgtcctcgccttctga

SEQ ID NO: 94907 - DNA, 414 bp, Glycine max
  Peptide Sequence Number=SeqID_211685
atgattatgaggggccaagacatttatagtagtcaagacaaggctactacttcaccttcctctagtgaatgtgaagaagcaaaaggggaagaatctagtgaagaaatctacccccaagaagaaggacaacctttaatggttaaggaggagtgtaagaagattggtgtctcctccaagaggttagcaaagaaggaaagtcattttgaaataaagacaaatattagagaaacttcccctcttagaaaacctccacatcttctcctttgtaaaaagatacttgttagcactgtcacacctcttaggctcaaggttattcctcaagtaaagaagttgttgaatgagggtttggttcgtaagagcctaaatccttgtgctttattggtgtccaaaatagtgatcaaagggttcccatga

SEQ ID NO: 94908 - DNA, 372 bp, Glycine max
  Peptide Sequence Number=SeqID_211686
atgttggtgcgcatgatccgcactcgtctctttacagcggcacgaatgaaatcttgccccggtatgcatagtagctgtgtaatagcctccctctctggttgtgctcgcacagttggccctcctccaatatcagggggtggcccaggaaccgtgtggatatggagcccaccgaaagtgaggacgcgtagccctctaaaggcgagggcgtgtagccttctgaaagcgaggacgtgcagtcctctgaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaag

SEQ ID NO: 94909 - DNA, 288 bp, Glycine max
  Peptide Sequence Number=SeqID_211687
atgcggaaattgattaaggaaaggatggaaaataaggtggttaatttcgtgggtcttaataaggtggtttctggcataaaatggatgaatgggatgaaatatagaaatggaaataacggaagctacagggctccaaatgaggtgattctaaaacgagaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 94910 - DNA, 243 bp, Glycine max
  Peptide Sequence Number=SeqID_211688
atggcgcctactaggcaccctttggacccagagaagtccaatagggccctggggtttctggctttgatcacgggcctctaccagttctacggagtgcatgtcacccccaacaagtactgcacgcctaggcaggcgcagggtgacgcacatcaggccgcgggcgcaccgtcaccacctcggcaggccgattcggctgcgccactaagcgtggagcagtatctacaacatttggttcgccattag

SEQ ID NO: 94911 - DNA, 147 bp, Glycine max
  Peptide Sequence Number=SeqID_211689
atgggggaactacttcaagctcaggagaagaaggtggattcaccactggagattgtggatcagctggctctggagcagcctcgttggatctcaccaatggaagttaagcttcaggccaggctacttgctcaagaaaatgctccatag

SEQ ID NO: 94912 - DNA, 963 bp, Glycine max
  Peptide Sequence Number=SeqID_211690
atgcatcattcacatacatccatgattttcattggttgcattgctcatggcattcttgccttgaaaacgaacttaatcattgttatcaaaaggaaagaacacgcttcgcgaagcccttaccggacccgtgctagagctagagtaatgggtgaagtagaggaggtacaagagcagataaaggccgacatggaggccgtaaaagagaaaatggccataatgatggaggccatgataagcatgaagaagatcatggaagtcaatgcggttgcaattgccgctaccagcgctattgcaaaggtgaacataactccccaatctggcctcaaccaaatgaatcatccaacctcaaatatggtaggcaaagatttgggaagtacgggcaacccccattttgtacaagtccaaaacaagcatgctttcctgccatatggtttgcctccgaactatactccacccaatgagaatgttaataactccactcccatactcattgagagccaaaaacctcaatctgatcatgcacatgtctctcaacccatgggggggacacatgaaatgccccaccataatctagtcaacttcgagccttgcctcaaatacgccaccgaagggcaaatagttggtggtgagcccctaccaaacacttcagagggccctcattttcgcccacaaccgcaacccttgcattttgtggtgggaagagcccctcctgctatggctgaaaacagaaagttggatcggatagaggaaaggctaagggttgttgaaggaagcagagattatgcctttgctaacatggcagaattgtgcctagtgcatgatgtcatcatcccttcgaagttcaaggtgtcggagtttgataaatacaaggggacaacttgccccaagaatcacctgaaactgtattgttggaagatggaggcgtatgcgaaagatgaaaaactgctgatgcatttcttctaa

SEQ ID NO: 94913 - DNA, 921 bp, Glycine max
  Peptide Sequence Number=SeqID_211691
ggcgtcagcctggccgccggcatcaataaagacattgcggaaaagctcggcgcgaaatacgccaagctcgccaaggatttggaggcaggaattcaaggcagatatatccgcaatgtgcaggatgcggaaaaaacctacgagcaattgacgaagggcttgaacaaaaagctcaaggcgcaggataaagcggcgattgtcgcctggttgaaaaagatcgatgcggaacagtatgcccgcaatgcgcgggtattgggcaaggcgtttaccggcgtggattgggcgattaaaggggcggacctgacaaacgccgcgatcgagggtttctctaccggcagctggaaagcgttccgtaatcagcttgaggcgctcgggttgtccatcggggcaggctacacgctctccgctatcgccgcgtttttcgcgccgacgctggtgtcgtcgacgggggggagccccctctttttatcctatcgacatgtccctttctcacccccccggcgccaccgtcagcagcaggttggcgaagcggcgctgttcgccggaggcgatcaccagcagcgttcgatccgatttgaccgccgcataaaaatcctcacgcggcaggtgctctaccgggcactgcgccggcagcagctgtcggtattcggcttcgatggtgttggtgaaatccggcgggcaggccatcagcgccgcgctttccacgttgatgcaggccagcagtttttccaggatcggcggggcggcgagcgtgccgggcgccaggttcagatagaccacggtggcgtctttcggcgcgtgcgtcacgcaggcgtagttgccgtcggcgatcagtacctgggttttatgcccgcatcgcgccagcgcggcgagcagcggcgggtgggtgatggcggatttgatcataaagcgattcctgaatga

SEQ ID NO: 94914 - DNA, 207 bp, Glycine max
  Peptide Sequence Number=SeqID_211692
atgaagatgaaagctaacgaaacaagaaatgaattgaaagtctcggattcaaaaacttaccggttgaagaacgaagagcgcacgaagaatggaagaagaacaacggaaaatcttcacgaaattgctcatggaaatgtctcggaagcattacgaaaacacttcggcttggattttcttcatggaaacacgctttttcaccaaaaatag

SEQ ID NO: 94915 - DNA, 270 bp, Glycine max
  Peptide Sequence Number=SeqID_211693
atgccaggagctgatcacaagcaacccaatcacaaaggtggtgagacttcaagttcaactgagagcaatggtggcagtcaaaatgtccgtttgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcaggttcctggaattgctccttatag

SEQ ID NO: 94916 - DNA, 171 bp, Glycine max
  Peptide Sequence Number=SeqID_211694
atggccggtgtcggtcgttatatggccccgactgatatctttcagccgacattgcgcaatttcttttacaaacgctggccgataatgacggctaggtttttccgtgcgagctcaaccgagggttcgttccgaccgacactggcatgttgttcttctcatttaggaggataa

SEQ ID NO: 94917 - DNA, 261 bp, Glycine max
  Peptide Sequence Number=SeqID_211695
atgtcaccatcgatcataagaatcatgaagatatatcagcttgaacgttcaacttattatataaccatacgttcagaggaaaccgcgctattgcttgtgagctttattgttctaacccttataattacactcacagcatatgtgtgctctaataacattccacgcactgttccatctgtgcctggtggtgccacacactccaacaacaaccacactacaatcactgtggagccacccgagccacgcttagatcacaccaat

SEQ ID NO: 94918 - DNA, 462 bp, Glycine max
  Peptide Sequence Number=SeqID_211696
atgtgcattttatatttgataaatgatgacaacatacaggtatcacagaaagagtacgagcattgcacatcacttgaacctctaaggatattcaatactagcccagtaattcttccactgagggagagaggtgtgatgttcttcatatgcaacatcccaaactactgttgtctaggccagaagattgtgatttctgtacatgaaggttccatagaaaaacccccatcaccatcaccatcaccttctcaagtgccaatcaatatctctccacaaccatcaccaaatgcttctgctcctcaacctcatggatctagtggcatgagtagccctccatctcccactacaaacacttcaggaggtaatggtgggaattctcctgttccatcttccactcaagagggaaagtctaatgcagtggcattgaaatacaagatgcaaggatgggttaataagttgaaataa

SEQ ID NO: 94919 - DNA, 978 bp, Glycine max
  Peptide Sequence Number=SeqID_211697
atgaggagtttctcatcaacattggcctctgaaacagaccacaaaggcaaaagtgacaactcattagccagacttccacttcctcctgcttacaaattagagttaaattcagttccagagaggaatgctggaaatgttccttttgagtgggagaaggcaccaagaagaccaaaagatgaaagcaaattacagacacaagattttgagaagcctcccttcacttcaaactttctacttgggagggtatcaaaaactaagcaacaatcacttgctgagacgagaactggaagcacactttccaactctcaaagtgttgcatccttggacaaaaaagcaacaaaacattcaaaagcggaaactagggagaaagaaagttctggttcaaatgatggagatgaggcctatgaagatgctcgtgactcactttctaggactgaatcattcttcatgagttgtagtgtgagtggcttgagtggatgggatgaacaagaggtacaaccatttggaagtttctcaagtgatcaccagaaaggtcgcaatttcatgattgataggttcttgcttgcagcaaaggcaatgacatcagaatctcctcaatatgcttccaagaaagcacatattggacaagaacaacaaaagcagagaaagaaagaagtgaatacagaaagtccatgtcccattaaccagcataggccaaaagctttgccatattacactcaagatattgatggggaagaaagtgatgattgcagtgaatatgaaaactacacaactacaacttgtggcctatgtcctcggttctgccttttgaatccaatgcctggattaagaatggtggaaagggttccaacaaatgcagctcatggaatgcaagctaaatcagctgcttctcacattggatcttcaaaagaggaacaaagggaaaacttctccaaagaaatgattaatgcagagaagaaggaaaaggaatcctattaa

SEQ ID NO: 94920 - DNA, 872 bp, Glycine max
  Peptide Sequence Number=SeqID_211698
atgaagggggtgaaaggaaaattcctgaagaagctcaaatccatcaaaccaatcctgaagcaagatttaattctccagatcaaggcctcagatgggtacgtccattttctcccaaagattccgagtttcaatctgcattccccgtttgtttcccgagaaaacaagcccgagaaagttgttcagagctgcgagaaaatgcaggacgaacccgaggtgatcgacgttgcagagctgatgaaagaccttgaggaagaagatgattacaatgacaacaaagagaacataggtccatgttcacagaaaccccaacaacaccacaagggtgttttgcagaacgggaacagagcaaaaacagattcaaaacagagaggggttttggaggaaaaaaagtcttcaccagaaaatgctgacaataacaacaacagaaacagcaacagaaaaatccctttgttagacactgatgttccatcgttccggcggccggacttgaactccggcagcctattcgatccgaatctactggccgcgttcgagcaagccgtgaaggaacattctagaataacagaagaacagaggagaagcagagtcgaagaagagtcttcacagaaagtggaagatgatgaccctgaccctttgatgttctttgaagagaagtgtccacccgggggcgacggaatggttattttctacaccacgacacttaggggaatcctgaagacattcgaggattgcaacaaaatccgcttcctcctccagagtttcaaggttttgtattttgagagggacatttcaatgcacaaggagttcagggatgagttgtggagcagtttggaggggaaattagtgcctccaaggctttttgtgaagggcag

SEQ ID NO: 94921 - DNA, 222 bp, Glycine max
  Peptide Sequence Number=SeqID_211699
atgctgaagatgggagatttagctaaagttgtgataaaacaagacatgaagaggggaacgagcaacaatttgaaggttgtacattcaggaactaaagaattcaaaatagctagtaataagagggatttgtttttgggattttctgagcaccaagagcggctatgcaagaagcttgcagttgaggagggaaggatatttgcagctaatgaacaagtttcttaa

SEQ ID NO: 94922 - DNA, 207 bp, Glycine max
  Peptide Sequence Number=SeqID_211700
atgagcatgctcttgacatggctgctcctgttcatgagagattgggtgatatggatggttggtcctactgatggcaatgcctcattgaagaagagaaccaatgtttccttctcggtgatcacaccggagacttgggaatgtctgatgattttctctagcatggttatgcctgtcagttttcccttcctagacatggctggtgattaa

SEQ ID NO: 94923 - DNA, 1049 bp, Glycine max
  Peptide Sequence Number=SeqID_211701
tgaaaaaacacgaagaagagagtggagatgatattgactatgatcgtaggctgctgagctcttctgatgattacactagtggaaagtggcataaaatagaaaatatcacaactagtccatcatttgttcctgaatttgaggagaacagtttcactgtagggagttgggagcaaaaagaagtcattagccgcgatggacagatgaagctccatacccaaatcttttttgcttcaattgatcaaaggagtgaatgcgctgccggggagagtgcatgtgctgtcctagttgctctcattgcagattggttgaaagcaaaccaagttgtgatgcctatcaagtgtgaatttgatagcctgattagagatggatcatcagaatggagaactctttgtgagaacaaggacttcataaagaagtttccagataaacactttgatcttgaaactgttctgcaagcgaaaatctgtgcagtatctgtagtgtcagaaaaatcctttgttggatttttcattccagaggaacctgagggtgaaggttttgacttccttcatggtgcaatgtcctttgatagcatatgggaggaaataagccattctgcttcagaacttcacatgtttagggagcctttggtgtacatagtaagttggaatgaccatttttttgtcctaaaggttgagaaagatgcctactacattattgacactttgggggagagactacatgaaggatgcaatcaggcctacatcttgaagtttgatacaagcacaaaagttgagaaactgagtaagaagggaaataaaacagtggaggtaaatggttcacaagaaaatgtagttgataaatctttcataatcaccccaaatgaaagcaatgatagaagggaagggatcatatgtagtggcaaggagtcatgcaaagagtacataaagaaattcttggctgcaattcctataagagagcttcaagttgatgtcaagaaaggcttgaaagcatccatgccacttcatcatagactacaaattgagttccattacacacacctcaagtaa

SEQ ID NO: 94924 - DNA, 324 bp, Glycine max
  Peptide Sequence Number=SeqID_211702
atggctccgagaaagcttcctgcaaagagatccaggaaggacaaagcggctgaagggaccagtgccgctcctgagtatgacagccatcgcttccggagtgctgaacaccagcagcgtttcgaggccatcaaaggatggtcattccaccgggagagacgcgtccagcttagggacgatgagtataccgacttccaggaagagatagttcgccggcagtgggcatcgctggttacccctatggccaagttcgacccagacatagtcctggaattttatgccaatgcttggcctacacaggagggcgtgcgggatatgcgatcttag

SEQ ID NO: 94925 - DNA, 192 bp, Glycine max
  Peptide Sequence Number=SeqID_211703
atggagcaagttagcataggacaccataattggggtgaattctaccggctttttgctgcaaaactccctccttggttggtgggttttgtggttgatttagggatggcctttgtggataactgggtggtgggtaaggagaagggttgttattggctgagtaatgacattgttgggttgctgggaaacttagcc

SEQ ID NO: 94926 - DNA, 405 bp, Glycine max
  Peptide Sequence Number=SeqID_211704
atggttttgtatcatcttgttagggttgaaccattcactacccttgcaatcaaactacaaggtggaaaatttgatcattcagatctaatgttttcaaatatttctgctacatggaatggagttcttaagggcatgagtgatgtgaaggaattggttcctaatctattttatctccctgaggtcctcacaaatgaaaactcagttgattttggcacaacacaattgggagaaaagcttggtatactcattaagattttctgcacaagcataggatggctttggagagtgagtatgtatatgctcatttacatgagtggattgacctcatatttgggtataagcaacagggcaaagaggccattacagcaaataatgttttcttttatattacatatgaagggatag

SEQ ID NO: 94927 - DNA, 348 bp, Glycine max
  Peptide Sequence Number=SeqID_211705
atggaaggaatcataatggttattctgcctcaagttcagcattcgtgttcccagcaacaactttctgatatttttaattttgtacaatcctgtcaacaagcagaagatgctcttgcacaaggcatggaaaaactccaccaaatccttgataaagcatcagcagctggtgacaaaggattaaaattgacgtgtgtctcacaacaaatgtcatttttaaagcaggccgatcatgttcgccagcaattcttgattcaattatctcgtcttcttacaatttgtcgttatgctgaattcttaattgccttcggtgaacgcctctataagccccagccttggagctcactttga

SEQ ID NO: 94928 - DNA, 243 bp, Glycine max
  Peptide Sequence Number=SeqID_211706
atgggggtgcaaatagcaaccaggcccacttgggccctcctttctggaggaagcaaccctgctcgcttgggcgagctgggtggcaagcttctcccccaattttctataaatagggggagaagtgaagtagaaaagggaaaatccaagccgagacgcttctgtaacgtttccgtgagtaatttcgcgaaggttttcgaccattcttcgacgttcttcattcgttcttcagtcttcaacgggtaa

SEQ ID NO: 94929 - DNA, 4221 bp, Glycine max
  Peptide Sequence Number=SeqID_211707
atggcaggaaacttcagattcacaatggaccagaaggatattgttagattcttgactacaactattgatagtttcattcaagataggttaatcaacaaagaacaaagaacccaacacaaagaacagtgtgcagagaggttggcagctgaagatggaagttgtgacaaggacactgaggtggaatactctgatcaagcagtattagcaaatctggattggggtattgaagcccttgaagaagctatcaatacctataacatggaaactaagcttgcaaggctagattatgccgaaaaaatgctgcaagtgtgtgcaatgttgaatcctaagcaaaagactgctggagtgccaaactactacctctcagcttgggcacacctaaatctatcctacctatggaagttgaggaacaatgttcaaaattgtgttttccatgctcttgagatgttcattgttgatccctttttctcgaggattgattttgctcctgaactctggaaaaacctgtttcttccacacatgagctcaattgtggggtggtattcagaagagaggcataggcttatgatggaagtgatacctgactcttctgatttgtcctttacagctgactttgatcaatttttcaatgagtctttggtattttctatgaggccacatcaattagacaagttgcaaaagatggagcagctctatggagaatccttggatgagaacacacgactatacgcaaaatattataaggattgcatgaattctgattccacttcaggcaagaaggtggctcctatgttgcctattgctgagccaccaatgactcctatgcatgagttgagccggtctgttcctgattttgtaaaatttggtcctattttgcccaagagtgctggcttttctttgacaccaagatctaaagatggtgtaaatgaaacaatcagagataattcaacttccagccattcaaaggtggagaaatcatccatatggggtgctaagtttgaggtacatgaatttggagtggcattgtgtataggccttatgataaattatcacatgcaggagagtatcgtgaaagagaatgagaatgaagaggatttagattctgagcttgatgatgcttcaatggattcagataacaaaaacaatattttctcgccagaaatgaagatggtcaaggatgaggatatcgaagcaatggcgcctctatcaaaccagaagaatcaatttcattctcctgatatcttctctcccttgggttccccaagaactggaccaaataattcatctacaaatcctgatacaaacagtaaaagagaacccaagtatcttcgcttactgtctactcgtttgagggactcaactatttctgatcatctatctctggacatgagcaaagatcatatattaaactctgataacgaagtaatggctttgaagaatactcagaggaaaaacaataaccaaacactcagtatgaatgatgacaatgagaatagccaaggactaaatgacagttccctttgtgaaagtgacgagggaaatcaaagctgcatttcgctgccgaaattgatgattggatcaaaaccacccaaagactttgtttgcccaatcacaggtcagatattttgtgatcctgtcacccttgaaactggccagacctatgaaagaaaagcaattcaagagtggctcagaaccggaaacacaacatgccccattacgcggcagcctctatctgcaaatacgttgcccaaaacaaactatgttttgaagagattgataacatcatggaaagaacagaatcctgagctagcgcaagaattctcgaatgctaacacgccaaggggttcttcttgttctccatctgcaaaagacttctcaatgctctccactacacaaagaataactgattcaccaagtcttaagggcaaagaaaattacattagacaaaggagcaacagatttatgcgtgtcgcaacatctccaactagtgtgctgactcaagctgcagttgaaacaattatgaattccttgaaaccttacatttcaagtctttgtacatcagaaaacttgcacgaatgtgaagaagctgtattggaaatagcaagattatggaaagattcaaagactgaccctcagattcatgcttatttatcaaagccaactatcataagtggtttgatggaaatactttcagcttctctgaatagagaagttttaagaacatcaatttatattctttctgagctaatctttatagatgaaagagttggagaaacgcttaacagtgtagattctgactttgattgcttggctactctacttaagaatggtttggctgaggctgctcttcttatttaccaactaaggccagtttttgctcagctttctgcgcatgaacttataccatctcttgtggaagtgattcggaacaaaaatgaggggtcagatgattttcagttagttttagaccccagagatgctgccatagcaattcttgagcaaattttaataggaggggatgaatatagcaggtcccttaatgctttgagtgttgtttctgaaaatggtattccagccttagtgaagtatttggagaggatggaaggaaggaggtctgttgtttccatacttttgtgttgtatgcaagctgaaaaaggttgcaagagcttgatagcaaacaaaattgaattgtctcctgttcttgaattatttcatgctggaaacgatagtgtgagaggcatctgtgtggagtttctctcagaattggttcaattgaatagaaggacagtctgcaaccagatattacagacaatcaaggatgaaggagcatttagtacgatgcatacatttcttgtgtatcttcagatggctccaatggaacatcagcttgctgttgccagtcttcttcttcagattgatcttctggttgagccacgaaagatgagcatttacagggaagaagctgtagagacactaattgaagcactttggcaaaaggatttctcaaatactcaaatgaaggctttcgatgctttaatatttcttattggacacgtaactttgtcgggaaagtcatatactgaagcttggttgctcaagattgcaggatttgagcaaccttacaatgctttaattaaggcggagcagttggggcagtatgacaatgattcaatggaaacaatggaggatgaaaaaaatgctatgaactcttggcagagaagggtagcttttgtactttgcaatcatgaaaatggttcaatattccaagctttggaagaatgcctaaggagtaattccttaaagatggcaaaatcttgccttgttcttgtcacatggctcacacacatgctctctacttttcctgataccggcataaaggatgttgctcgcaaatccttgcttgatgagcttataaatgtcctgcagtcatccaagaacctggaggaaaagatcctagctaccctagctttgaaaaatttcataaatgatccaagtaggagtactaaattggaaattgtcaatggttcagttgctcaagaagcacttagagcttatgctaaaagcatctacagaatcatgaggaagctgaagaaatattcaacagtagctgctgatattatgaaaaccttactaaacttaaactccgttgatgtgacagagttgtggagttgtaaagaagttgttgagttagatttgagctcaaatggagaggtgctttgtttgctttatatgaatggtcaggtcttgagtggacactctgatggaactatcaaggtatgggatgcaagaaagagaataccaagagtgattcaagaaactcatgagcacacaaaagctgtaacatctctttgttcttcagatgataggctatacagtggttccttagacaaaaccatccgggtttggacagtcaaaccagatgagattaaatgcatagatgttcatgacgttaaggagccagtgtatgagctgacggtcaatgccaaattggcatgctatgtatctcaaggaagtggagttaaggcaagcttaatatgttgcttgaacatctcaaatacaaatgtttttaattggtcagaggctccaaagctcatcaatttcaacaaatatgtgaaatgccttgctggtgctggagacaaactgtattgtggctgctctggttacagcatccagtttctttacctaataaaccaaccaacaaagagtgctaaagcattttga

SEQ ID NO: 94930 - DNA, 279 bp, Glycine max
  Peptide Sequence Number=SeqID_211708
atgattatcataatgagatttattagacacttaaaagaaaatccccaagctagcatctcaaggtacaaaacaacaacgaagaaagatggaaaaataacagtacttacctgtaaggcagcgtgcgacgcgacgatgacggagggaaccaatgacagtgactgtagagttgacggtggagggcacaacagacattggttgacggagagcacaatggaatatgtattacgaatgaggtacatagggatttgtcttagaacatggtggcaattacgtaattaa

SEQ ID NO: 94931 - DNA, 213 bp, Glycine max
  Peptide Sequence Number=SeqID_211709
atggatgttctagcaggtgatggtggtgcacaaagagaagctttgacttcagttttgatcaaagaagaagctttctatggacataacgaatgggccaacatgttgaagccatataggggagaatttttccaccaaaaacaagaagaaaattcagaggaagactatgatgcaaggttggaagtagctatgccggcattggaccaaggcacgtag

SEQ ID NO: 94932 - DNA, 1476 bp, Glycine max
  Peptide Sequence Number=SeqID_211710
atggcaattgctaattgtgatgataagaacgcaaaagctttgcagttcattgaggatatgacccaaaacactgacagtgtccaaaagagggtccttgctgagattctgagccaaaacgccaagaccgaatacctgaaacggtttgagctgaatgcagccacagaccgtgacactttcaagtccaaggtacctgtcgtttcatacgatgatttgaagcatgatatccaacgcattgctaatggtgaccgctctcctatcctatgcgctcatccaatttccgagtttctcaccagttctggaacatctgctggggagagaaaattgatgccaacaattcgtcaagagatggaccgtcgtcaattactttacagccttctgatgcctgtgatgaaccaatacgtgcctgatttggataagggtaaggctctactcttcttgttcatcaaagccgagacaaagactccgagtgggttagtggcacgtccagtgctaactagcctctacaagagcgaccaattcaagaacagaccctacgatccattcaacgtgtacacaagcccagacgaagcaatcctctgccccgattccttccaaagcatgtacacccaaatgctgtgcggcctcatcatgcgccaccaagtcctcagagtcggagccgttttcgcctcgggccttctccgagccatccgcttcctccagctcaattgggctgaactagcccacgacatctccaccggaaccctaaaccccaaaatctccgaccttgccatcaaacaacgcatgacccaaatcctcacaccaaatccagaactcgctgatttcattgtgaaagaatgctcgggagaaaactgggaccgcataatcacaagaatctggccaaacacaaagtatctggacgtgattgtgaccggtgccatggcgcagtatattccgaccctcgattattacagcggaggcctacctaaagcttgcaccatgtacgcctcatccgagtgttactttgggcttaacctaaaccctatttgcaccccctctgacgtgtcctacaccatcatgccaaacatgggttacttcgagttccttccccacgaagaagatttatcttctagctcttcaagctccaccttgtcacgtgactcgctcgaccttgcagatcttgaactcggaaaatcctacgagctcatcgtcaccacgtactccggtctgtgccgttaccgcgtaggcgacattctccaagtcacggggttccacaacaccgccccacatttcagcttcgtgaggagaaaaaacgtgcttctgagcatcgactccgacaagaccgacgaagcggagttacagaacgccgtcgagaacgcctccgtgctgctgagggagttcaagacgagcgtggcggagtacacgagcttcgccgacacgaagtcgatcccggggcactacgtgatttactgggaacatctatctctattctttttataa

SEQ ID NO: 94933 - DNA, 243 bp, Glycine max
  Peptide Sequence Number=SeqID_211711
atggattttgtcccaaatttcgtattcatgaacacaaccaagaaccctacaaagtttggaggtggaaagagaagattgaagccaagtaagaagtatttgatcctgttgtttccacacaagatactcaggattgatgcaattattatcaagatccagttcggtgagaaatcaagaaggaatttgagaagcaaccacgaagtgatgaaggacagaagagtgatctctccatacagcggaggatga

SEQ ID NO: 94934 - DNA, 243 bp, Glycine max
  Peptide Sequence Number=SeqID_211712
tggagatttgcatttgtgttacatggtcctcctgaatacctacaagattcagatattgtttttgatcggtttcagagaagggatatatatggtgtttgggagcaatatcttggattggaacacgatgacagtgctccaaaaaagtcctatgcagtcaaccaggtttcagaagtctacaatgattatttctcaattttgcagaaccgtcacacatttgagaagcctgtgaaaatctacaactag

SEQ ID NO: 94935 - DNA, 1620 bp, Glycine max
  Peptide Sequence Number=SeqID_211713
atggagttcactgaatcttacaagcaaacgggtccctgttgtttctctcccgacgctcgcttcattgccgttgctgttgattatcgtctcgtcattcgggagaccgtttctttcaagattattattgatgcaatcctccctaggaagggaccaatcactagaaccatgagcaagaggctccaagaagattgggctagagctgctgaagaaggccctaggattctcatgaaccttagggttgtgcagttgttttcatgcttagacaagattagctatattgaatgggcccttgattctgaatatattctttgtggtctctacaaaaagccaatgatacaggcttggtcactgacccagccagaatggacatgcaagatagatgaaggacctgctggtattgcatatgcgaggtggagcccagatagccgccacatactcaccacatcagatttccagttgcgtttaattgtttggtcattgttaaatacagcttgtgtgcatttacagtggccaaagcatgcttccaaaggagtttctttcactcgagatggaaaatttgcagcaatatgctcaaggcgtgattgcaaggactatataaatctgttatcttgtcacacatgggaaatcatgggcaattttgcagtcgacactctagacttggctgatatcgaatggtcacctgatgatagtgctatagtgatatgggattcaccacttgattacaaggttctaatatattctccagacggaaggtgccttttcaagtatcaagcatatgaaagtggattagggattaaaagtgtgtcctggtctccttgtggtcagtttctggctgtgggcagctatgaccagatgctgcgggttctgaatcacctaacttggaagacatttgcagagttaatgcacccatctacagtccgtggtccttgttatgctgctgttttcaaagaagtagatgagccactacaacttgatatgtctgaactatgtttgagtgatgatttttcccaagggcatgatgattctcctgaagaaccctttagagtcaggtatgaggttatggaagttcctatcaatttaccattccaaaagcctcctgccgagaaacctaaccccaaacaaggaattggtattttgtcatggagcactgatagccaatacatatgtactcgtaatgatagtatgcctacagtactttggatatgggatattcgtcatcttgagcttgctgcaatattagtgcataaggatcctatcagagtggcagcttgggacccaacatgcacacgccttgttctttgcaccggaagcactcacttgtatatgtggaccccatctggcgcctattgtgttcatgttcctctatcgcaatttactataacagacctgaaatggaattctgatggcagttgtctacttcttaaggacaaggagtcattctgctgtgcagctgtacccttgttgccagaatctaacaagactccaaggtttaagatcatacaaagtcctgttggtgtaaggggaaactatggtgatcaagcattttcaggaggggcaatggagcaaagctatgtagtagcatttggaaaaattcaatggccatctcggcccttgttgtag

SEQ ID NO: 94936 - DNA, 1248 bp, Glycine max
  Peptide Sequence Number=SeqID_211714
atggatatctccgtttctttctccaaaacccgtcctcctccgttctctccctctctctgccgccaactttccctccgtccaaacgctccgcaactgctgcgattctcccgaaacaacggaacctttcgccggaagcctccgccgacgatttctcgcccaaacaagctcgctgtcacagccattcagatttcaaacctatccgagaatgaagacgattttgtcctcgaagacgttccacacctcaccgactttcttcccaatttgccgtcatatccaaacccattgcaaaagagccaaggctactcaattgtcaagaaaacttttgtgagccccgaagatgtggttgctgaaaatgttgttattcaaaagggaagtcctagaggagttcattttcggcgtacaggacctcgagaaaagccagaagaagtacgtgcttgcatagtgacttgtggaggattatgcccaggaattaatacagtgattagggaaattgtatgtggcttgaacaacatgtataatgttgaagatatacttgggattgagggaggatataaagggttttattcaaaaaataccatgatgttgactcctaaagtggttaaccatatccataaatgtggtggaacctttcttcgtacatctcgtggaggacatgatacccacaagatagtagataacattgaggaccggggaataaatcaggtatacattattggaggtgatggtactcacaaaggagctgcgctcatttatgaggaagttaaaaagcgtggtcttcaagtggctgtggctgggattccaaagacaattgataatgatattgctttgtcggatattgcttgtgatgctctttctttaaatacttgtcaagatcttagtgagagtagttatcataagagggttggagtagcgcctattgtagagaagatggtgaaaaatagacttaggtggtttgggcatgtagagagaagaccggtagactctgtagtgaggagagtagaccagatggagagaagacaaacaattcgaggcagaggaagacccaaaaagactataagagaggttatcaagaaggatctcgaacttaatgatttggatagaagtatggtgatagacaaatcttttggatttgatactgctgtggaagaagcccagagagccattaacgctgcacatgtggaggttgaaagtgttgaaaatggagttggaattgtcaagctgatgggcagatacagtggtaaacagtag

SEQ ID NO: 94937 - DNA, 318 bp, Glycine max
  Peptide Sequence Number=SeqID_211715
atgactctcactagatatgctctctttatatatccaacatacatgattcgggctattccaagtaatgcctcggacaacatttactgcactcttcttgcacatggtgctgttcatggagctatggctggatatactggcttcacagtcgggcctgtgaacagtaaacatgcttatatcccaattgcccgtgtgacggagaaacaaaataaggtcaagctgactgataggatgtgggctagacttcttgcatcgacgaatcaaccaagtttcgttgcctctgatcaagaaagagttgagaaagagataatgaatatataa

SEQ ID NO: 94938 - DNA, 1116 bp, Glycine max
  Peptide Sequence Number=SeqID_211716
cttcatgtggttatgtttccattccttgcatttggtcactttaacgcaggggtgcaactctccaacaagttgttctatcatggtgttagtatcactttcttgtcagctgcatccaacattcccagaatcaaatcaacccttaatctcaatccagccatcactgttatcccattacacttaccaaatggcataaccagcactgctgaattgccacctcacttggctggaaagctcatacttgcaattgaccttactcaatctcatgtaaagtcccttttgttggaactcaaaccccattatgttttcttggactttgcacaaaactggctcccaaaactagcttctgaacttgagatcaaatctgttcgctttgtgtccttctctgcaatttctgattcttgcattaatgtgccttcaaggcttgctggtgttgaaggaagaaacatcacttttgatgatcttaaaaagcctccaccggggtatcctaaaaaatccaacatttccctcaaggcctttgaggccatggacttgatgttcctcttcaaaagatttggtgaaaaaaaccttaccgatagtttccctgccaaatctgtcatattatgctcctttggcaatgagaaatttctgaatgatgatcaaatcaaagaagtggccagtggcttagaactcactggcttacctttcgttttggttctaaatttcccatccaatctctctgccaaagctgagttggagagagcattgccaaaagagtttctggaaagagtgaagaataggggactggtgcacactgctctgaccagtgactgtgaactggtgctgttgcctttcaaggctgaccagtttttcaatgctaagctcatagccaaggatttggaggcagggattgaggggaataggagtgaagatgggaactttaagaaagaggatatactgaaggcagtaaaaactatcatggtggaggatgataaagagcctgggaagcacataaaagaaaatcacatgaaatggaaggagtttttatcaaataagggaattcagaacaaattcatcactgatctgcttctactgtatgaattctctaaacaaacatgctggctgcataatccaccttag

SEQ ID NO: 94939 - DNA, 252 bp, Glycine max
  Peptide Sequence Number=SeqID_211717
atggggttgggtgagattgagaacaaagatggctcggccaaaggtggaaggagtgcaccagattatgggcatggtggcctcaaagccggtccaaaaagtaaatttaggcctcacttattgttgatcatgagtggcctgtttcgggattctgctagttggtggattgctggttttgcaaaagtttgcaggatacacgtctgcataaatatgcatggacaaatttggcttgcaatcaagagctcaattcagtaa

SEQ ID NO: 94940 - DNA, 615 bp, Glycine max
  Peptide Sequence Number=SeqID_211718
atgccagatatacctgggacttcttcagcaagaatggcagcttctgaaacaaattctagaagaacaggtcaacgaaacaatagagttgtttgggagaatttatctgaggaagagaagcttgctgcgatagagagtcttactgtttattgcaggcctatagagctctacaacataattaagagtcgtactaaaaaaaagccattataccttcggagatgtatggactaccatataaaggctaagcgcaagaagaggcttgtattgacggcttcgttgtcatggaaagatgatgataatcgggcgctgtttcctttgtgtgtctgtctgggaaggctggatcccaatacggaagctcgaagcgcacaaaggtatcatgttggtaagatatcctcatttaaaggactctcaggagttgatgggaaggggaatactcaactcgaagtaaacttcatgcttcccgaatttgataagttagctggggaagttagcactgccaaatattggttcttggtctttgcttctgcggggaacccaatttcattatctagagccaattcgagcccgtggcctgtggaggtgtcttctaatgaatgtgagatatgcttcaactactaa

SEQ ID NO: 94941 - DNA, 417 bp, Glycine max
  Peptide Sequence Number=SeqID_211719
atggcacttgaagaagcgctattagatgaagatagtgaggatgaaatgaatgagggtgctcaggagattgaagatcgaagggaagcattgacacacactgatatgcagagacttgctattcttgatgcgccagaccatgtgaaagagttcctatctctgtggaacgcatttattaagaaacatcgagtgctggcagatggtcacataaattgggcttgtgaagctttcacaaaatatcattctgctgagtttgcccagtccaactcgttagcctggaattggagaatgtttatgatcaaactaattaatcagggtcttctaaagacatcgaccttcgttgcatgcaataatattctcgaacaatgccggaagcagaaccaagatccccaaaggcagaatcaagatccccaaagctaa

SEQ ID NO: 94942 - DNA, 369 bp, Glycine max
  Peptide Sequence Number=SeqID_211720
atggttggagcattctcgcaaaacggagtgaccctaactagtcaccttatgattttacttagtgagagtgacccaacatacctattgtgtgagggtgtcacaatcagcttccattcaagggttgaaaataatcttgaagagggctgcaaacatttcttggggaagaccggagaggatcgacttcctaggttggaattggatttaagattcaagaatattatcaaccttcaacaaagagaagatctcatgcatgctcttgacctcactcaagcaaaaatagagacacatccggagaaaaatgatctttgggatgttgttgaggaagactacaaagttctttccttaccaactaatctaacaatggcttag

SEQ ID NO: 94943 - DNA, 726 bp, Glycine max
  Peptide Sequence Number=SeqID_211721
atgtttaagtgtaaaaagtgtatcacatattgctatgacaatgcagaatcaaaagctattattttacatcctggtccgcgctgtgttccatcaatatttgatcatgataatgggacacatgcaatgctacaatatgaccctgaaggggtttcagatgaaattttacttcctggtccggattgtgtcctatcagtatctgatcatgatgatgtgacgcatgcaatgatactagatgatcatgaaggggtttcaaatgcaactttacatcatgaaggggtttctaatcgtgatgatgggacacgtgcaatgctattagatgaccatgaagggtcaaatgcaactttacatcctggtccagattgtgtcccatcagatgatgatgggacacatgcaatgctagaagatgacagtgaaggggttacaaatgcaattttacttcctcgtccagattatgtcccatcactatctgatcatcatggtgggacacgagcagtgccacaagttgaccatgaaggggtttcaaatgtaattgttttaaatcctagccaggattgtgtcgcatcaacgtctaagcatgatcatggggctcctaaagtgcggaaagctaggaagaaagacaagttaccaattgagcaatatgacccaagaatcagcttgtcacacctggcatcttcttcgtatgtggctggcaggctgttgatttgtttgagttttgttaacttctga

SEQ ID NO: 94944 - DNA, 348 bp, Glycine max
  Peptide Sequence Number=SeqID_211722
atgatggcacatcaaaaccccccatacttagccttttgcactcctgggcaaaatgaaacaaagaacaaaatccaaggatatcaaagagaggcaaacgaaaacattcacatatttgtcaatgaacatcaaggaatgaaaggaatggtgagcttcaaaacaaggaaagggaaacaaggctcaaaagggatatcaaaggaattaagtcaaggtaagtccatttggctagaagcttataagaacaaaattgcctcaatcatatccaaatatgcatgtgaattaggaagcatcaacaagaatcaagccaaggctattgtgcacgcaatcaatggggcaaaacacaccaaatga

SEQ ID NO: 94945 - DNA, 956 bp, Glycine max
  Peptide Sequence Number=SeqID_211723
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcctccaacatttgggtggtaacctccgagcgctatgccgacatcgtgcgcgaacaattacccgatgtcccagcagacaacgtgctcctcgagccttgtatgcgaggcactgcgccttgcatctgctatgcttcgtggaaaatcaaaaagcgtgatccacgcgccaccatcgttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 94946 - DNA, 771 bp, Glycine max
  Peptide Sequence Number=SeqID_211724
atgaccaagctccgactggccatcgtcggtgcgggcccggccggcatctacgccgccgacatcctgttgaaggccgagcgcaagttcgacgtctccatcgacctgttcgagcagcttccggcgccgtacggcctggtccgctatggcgtcgctccggatcatccgcgcatcaagggcatcgtcaacgccctgcgcgatgtgctcgaccgcggcgacatccgcctcttcggcaacgtgcgtttcggcgaggacatcaccctcgacgacctcaagcgtcactacaacgccgtgatcttcgcgaccggcgcgatccgcgacacctcgctggacatccccgggatcgacgccgtcgcctcctacggggccgccgactacgtcagctggttcgacggtcaccccgacgtgccgcgcgagtggccgctggatgccgcgtccgtgggtgtgctcggcaacggcaacgtcgcgctcgacgtggcgcggatgctcgccaagcacgccgaagacctgctcgtcaccgaagtcccccagaacgtctacgaggggctcaaggcgagcgaggtcaccgacgtgcatgtgttcggacggcgcggccccgcacaggtgaagttcacgccgctcgagcttcgtgagctcggggagctgcgcgacgtcgacatggtcgtctacgacgaggacttcgactacgacgaggcggcgaaggacgccgtggccagcaacaagcaggtcatggtgatcgaccgcatcctgcagtcgtggcggaagcgggagtcg

SEQ ID NO: 94947 - DNA, 291 bp, Glycine max
  Peptide Sequence Number=SeqID_211725
cgggcgcaggcgaaagagatcgccggctgcgaaaaccgtgtctggctgggggatcaggttgatgctgagggcaagatgcacttctttggcgatagcgaagggcgtatcgtgcgcggcctgctggcggtgctgttagccgcctgcgaaggaaaaagcgccgctgagattttagctaatgatccgttggcgttattcaatgagctgggtttgcgcgggcagcttagcgcttcgcgcagccaggggctgcaggcgctaagcgacgcggtgctcgccgccgcccgcgagaactaa

SEQ ID NO: 94948 - DNA, 162 bp, Glycine max
  Peptide Sequence Number=SeqID_211726
atgatgatttggaaacaacgtgcaaaattagtcgtggccacagctaggtgggcactcaagcatccagtttatggcattgtgatactacggacgatgttcctaaatgaaaaactctacacggctccggaatttcaacaaacactattgacaacaacgaagtaa

SEQ ID NO: 94949 - DNA, 429 bp, Glycine max
  Peptide Sequence Number=SeqID_211727
atgcataggtctgcaagctggaacaggttttctgatgattacttcaagcatgccacgacgagttctccatcttcaggacatagatcatcttattctatgtttgatggcaacaatttgcctacatatgaccccattgcagagttggctaagagggagagggcacgtgtgaagttcgctgagaatgcagtgcatgttatccctttagtgctaattatttgtgccatcattctttggctcttttcaaatccagatgtgggaatcataggagatccaataggagcaagaatcgaaggattaagtcttgaaggagaaattgaaaatgatagtgacggtactcaaatgggtttcttacctattgtgacctcagaagaaatatcaacgacagaaattggtgctgataaagattcgataattccaaagaatttttag

SEQ ID NO: 94950 - DNA, 627 bp, Glycine max
  Peptide Sequence Number=SeqID_211728
atggacccaaaaacagacgaaggcgagggagggtatggtgagagcggcaatcctatggatcagttccaccgtaacgaagctatatccgttgttgccaacgagggtgtcggtggcagtggagagggtgtcggtggtggtggaggaagcgaggttatggaatctagggttttagggagggttaatgggtttcagaatcaagggtttagaggaaacaaggtgggtgtcataggtgggattggggttgaattagggaaccaatttgggaatttgagtgaaattgaggatgaaggtgggaatgatggtgttatgggttttgtgatacaaggtcaaggtggtgttggtggtggtggaggaggtgggaatgttaatagggttggtggaaatggtgttgggaataatgcgagtgttgttagtagtattaatgctaaaggagttgaaggtgtcggtggtggtggtgttgttggttctgatgctactatattgtttcttcaaactgagtttagtaaatatgggtctgtgaagaaggtgaaatttttcaatgagaaggcaagtgggaagtcaaaagggtgcccatttgagtttttttaccattttgttacaattgcttgcaaggtaggaatggaatga

SEQ ID NO: 94951 - DNA, 789 bp, Glycine max
  Peptide Sequence Number=SeqID_211729
atggcgagacacaaacgtgtaagtcaagaagttaatgcgttaagagttgtttggccgacatcattaagaaaccgggagaaagatcaggctgtaacggttctgtcggggtttgttctgtctgagaataatgtgtcgtgggtttggagaatctctttgagtgcgtttggcgaagagattatgatggtggttgcttggcctatcttgatgcgcattcttgtacagttcaatggagtttctgatgatagtgaaaagggaaggtcctggtggaaagttctgattatcacatgctcagccactacttacacggttggagatagctctggctgggacattagcacaaatcttgatgcatggattgcagataagaatttcagagtaggggatgctcttgttttccaatattcatcaggccaaagtgtagaagaggttacaaaagaaaacttcaacacatgcaacaccaccaatgttttagcaactcatggaaatgggaacacaacagtgccattgacgagagctggagacaggtattttgtatctggaaacaagttgtattgccttggagggatgaaacttcatgctcatgtccaaggcgacgataaatcactagcaccaactctagcacctaaggctgtggctggatcagatcaaaacaccgccacacttccacagtctccttcatcaaagaagaacacacatctttcggcaggagcggcaaatcctgcaagggatgcacttcatctagtttatattgctcctatggctgctatatatgggatgatgaagatttga

SEQ ID NO: 94952 - DNA, 1164 bp, Glycine max
  Peptide Sequence Number=SeqID_211730
atggcaacaggatcaaagtttttggacaatgcaattataagaggccattctcactttctcactgcctctaatcatcttcatgtattaaaaagtggggcaaactcatcaatagcatcatcacctgaaaaccttttctcatgttcaaatcctacttcaatgaaagaagaggcacctttagccacttggattagtcatatccctgcaaagttcaatgtccatcaagacatcaagaatggcaaagagaaaaaccaatccaattctatcttcccagcctcagacacaaaaaacagctccattcctctaaatcttttagaaactctcccaccattaaccatagcaccatgttttgatgaaccagtaacttccttagcatcctcttctgccataccaaaatttccaaacttgactttgtttttgcaggaaccttccatggtgtactcatcaatatcatcctcaaatatcaaaggtggtgaagtcatgtcagcaacttcagacccctcatatcatgtgtctcagtttgtccaaaaccagcatcaagcaggtagtggggatgcacacaaaatgaacaagagcctatcaaattcacagtccaagtctttcgacgagaattggttgagtgccactaggactcagcctatgaagaatggtggaagaggcaagctgtttaaaggtgtgaggcaaagacactgggggaaatgggtagctgagattagattaccaagaaacaggacaagggtttggctagggactttcgacacagccgaagacgccgccattgcatatgacacagcagcatatatactaagaggcgagtatgctcagttgaacttccctgacctcaagcatgtaattcaggcaaattctctaaatggaaccactgctgcacttgtggaggcaaaactacaagcaatatcaaaaggtggttcttctcataggaagccaactgattcaccaccagggtcaagcaataagcacaatgatgagaatggcaaattgaaaagtataagtggcaaggattcatccataaggcttggagctgagataactgagagaagcaaaagcacacaccatgagacatcagatgtggaaggtgttcagttaagtagaatgccctccttagacatggacatcatttgggatgaactttttgtctcgaattcataa

SEQ ID NO: 94953 - DNA, 252 bp, Glycine max
  Peptide Sequence Number=SeqID_211731
atgacttcaccacctttgatatttgaggatgatattgatgagtacaccatggaaggttcctgcaaaaacaaagtcaagtttggaaattttggtatggcagaagaggatgctaaggaagttactggttcatcaaaacatggtgctatggttaatggctgggaagatagaattggattggtttttctctttgccattcttgatgtcttgatggacattgaactttgcagggatatgactaatccaagtggctaa

SEQ ID NO: 94954 - DNA, 732 bp, Glycine max
  Peptide Sequence Number=SeqID_211732
atgggtagacctttgtccaaaatcctcactccagccacacgcctcagtagaccatggcctcattgggtgggtccaaaagtcaatgcgaagttcgagctgaagccgccaccatatccactgaatggtttggagccggtgatgagccagcagacacttgagtttcattgggggaaacaccacaagacatatgtggaaaatctgaaaaaacaaattgttgggacagagcttgatgggaaatcactagaagagattatagtgacatcatataataagggtgacattcttccagctttcaacaatgcagcacaggcatgcatgcttgtatggaaccatgacttcttctgggagtgcatgaaaccaggtggaggtggaaagccatccggggagcttctagaactgattgaaagagactttggctcatttgaaaaattccttgatgagtttaaggctgctgctgcaacacaatttggttcaggatgggcttggcttgcatatagagcaagcaaatttgatggggaaaatgcagcaaatcctccttcaccagatgaggacaacaagctagtggtgctcaagagtcccaatgctgtgaacccccttgtttggggaggctattatccacttcttaccattgatgtttgggagaaccggcgccctgattatatatcagtgttcatggataagcttgtttcctgggatgcagtgagttctagacttgaacaagcaaggctttaa

SEQ ID NO: 94955 - DNA, 261 bp, Glycine max
  Peptide Sequence Number=SeqID_211733
atgtcctccagcaggcaacgtaccaagggaatctcctatttcagaagaggtcaactgagtagtctttccttgaaaaaagccatattatccagttgttatccagattatcctccagtgttgttctggttaaatcccaactgtccatacttccagtgctccctaagtcctacaagcaatggacagtgttttcagatcagtgttgtaggacatgatgcaggtgtagcaagaccccaggtcaaaacacaggtcattcattggtag

SEQ ID NO: 94956 - DNA, 2442 bp, Glycine max
  Peptide Sequence Number=SeqID_211734
atgttcgtgaagctgcaactcttgtacccccatacacccctcctcgcaaacgcaaacgcaaacgcaaacgcgtttcttctgccagagaaaaccgaacaagtctcccccacacgcagaaaacaaagactccctcttcataacggcaccgttaagcaagagacccattcgaagaaacgccgtccggagaagaatcccgaagagggtgttcccagaaagagcaaaccggagaagtcgcacaccaagtgttcgacgaaacgcgtctcttatggtggatgcattccggcgattttagaagcattggacgcagttctcggtgtggacgaggctcttgggccgtgggaggagaggcttagcaacaaggagaggagcatcattttgaaggagcagctgaggtgggacagagctttggagattttcgagtggttcaacaaaaagggtcatgaattgaacacgattcattacaacatcatgctgaggagccttggcagggcccgtcagtggaggcgcgtggagagtttgtggaatgagatgaatgctagaggcattgctgccacctgttccacttatggaactttgattgatgtttatagcaaaggagggcgcagagacgatgcgctttcttggctcgacatgatgttgggacaaggggtgcagcctgatgaggttactatggtgattgtggttcagttgtacaagaaggcaggagagtttcagaaagctgaggagtttttcaaaaagtggtcattgggtaatgataacgcaatggctactctggaattggatgagagggttgtgtgtgctaatgcttcttttggctcgcatacttataacaccttgattgatacgtatggaaaggctggtcaactgaaagaggcatctgagacttttgcgaagatgcttaaacaaggcgtggcaccaaccacggtgacattcaatacgatgattaacatttgtggaaaccatggacagttagaggaagtaagtttgcttgtccggaaaatggaagaacttcgatgctcgccgaacacaaggacatataatattctaatctctctttatgctaagcatgatgatataggcatggcaacaaagtattttgaaataatgaaggaggcctgccttgagcctgatcttgtgagttaccgtactcttttgtatgcatactcaataaggaaaatggttggtgaagcagaagagcttgtaaaggagatggatgagaggaggcttgaaattgatcaatatacccagtctgctttgactaggatgtacataaaagctggaatgcttgatcagtccttgttatggtttctgaggtttcatgtagctggcaatatgacatctgagtgctatgctgccagcattgatgcatatggggagcatgggcatacattggaagccgagaaagtcttcatttggagccaaaaacagaagaatctcagtgtccttgagttcaatgtgatgattaaagcttatggcatagggaaatgctatgagaaggcatgtcaattgtttgatagtatggagcaacatggtgtagttgcagacagatgcagctatacttctctcatacaaattttgaccacttctgaccagccgcatatggccaaaccatatctgaaaaaaatgcaggaggcaggattagtaagtgattgcatcccatactgtgttgtgatttgcagctttgcaaaattaggccaattggaaatggctgaagatatatactgggaaatgattaggcatggtgtgcagcctgatgttatagtttacagcatattaatcaatgttttctctgatgctggaagggttaaagaagccatcagttatgttgacgaaatgaagaaagctggcttgccagggaatacagttatatataattcattgatcaagttgtatgcaaaaattgacaacctggaaaaagcacaagaagcatacaagttgcttcaattatcagaagaaggtcctaatgtatattcttcaaactgtatgattgatctttatgttaagcaatctatggttggccaagcaaaacagatatttgataccttaaagaaaaatggaggtgcaaatgaatttacatttgcaatgatgctatgcttgtataagaagattgaaaggtttgatgaagccattcaaattgcaaaacagataagaaaattgggacccttgacagagttaagttataacaatgtgcttgacctgtatgctattgctgggagacccaaggaagcaatagagacttttaaggaaatggtaagagcttccattcaagttaatgattgtagtcttagatcacttggaaatcttttgttgagatatggagtatcaaggctggctgttggcaaattagaagcattggtgaaaaaggatgcttccaacggtttgcaggcatggatgttagcactctcaagtgtgcttgaagtagatgattatgatcatgactag

SEQ ID NO: 94957 - DNA, 267 bp, Glycine max
  Peptide Sequence Number=SeqID_211735
atgccacgcaagcacgcgctcagtgcaccattagctcgcctagcaagtcatttgtatcttctggcgcccagcgtgccagactcgctcagccaaaaatcactaactcgcgctaagcgagcctttgagaacagaaaacccttaaaagctgaagttgacgtaaaaaaaggggagtctttagcttttggaagaagagaaatatacgtgagagacgcagtagggcaggggagcaccaaaaaccttagctttccagaggattctaggttttag

SEQ ID NO: 94958 - DNA, 468 bp, Glycine max
  Peptide Sequence Number=SeqID_211736
atgtcgtcgcggcaagtggtgaagcgtgccaaatacaaaaccactgtcaaagaccctggcacccccggcgtcctcaaattgactcaagataggttcgttttcaagccgaatgatcctacctcgaaaaccaagctcgatgtggagttcagatttattcagggtcataaagtcactaaagagggatcaaagcaaccaccattgcttaaccttatccgtgcacagggaagttgcattttcgagttagaaagttttgcagatcttcatgtttgccgggaattggtgggttttgcccttaacaggaatgtgcctggagaagctacaaaagttatttctgaggaacagctcagccctgctgaaatggcactcaggataaagctattgcaggaagatagcaagttgcagaggcttcataaggaacttgtggctagtggtaagctcacagaatcagaattttgggctacaaagaag

SEQ ID NO: 94959 - DNA, 213 bp, Glycine max
  Peptide Sequence Number=SeqID_211737
atggcgaatcccgtacatagatttgaggttgtagagaaggcgtgttgttcgacaggaacatttgaaatgagctacttgtgcagtgacaagaatccacttacatgcacagacgccgaaaagtacgtgttttgggatgcctttcatcctacggagaagacaaaccgcattgtctcaaattatttgattccaaagcttttagcaacctttagatga

SEQ ID NO: 94960 - DNA, 819 bp, Glycine max
  Peptide Sequence Number=SeqID_211738
atggagatggaacacccaagaacagtagcagaaattcttgcccggagaaaacaggatgaggagcgacgaaacagaatttctaaaatgaccccgattgaggatcttcaggcacaagataatcatccatatgcaccactctgtatcaagttaataactcgatttatgaaatgtgtgctcgtgggcacatgtaacaatattaatatagggaagagaaagaggcatagcctcgtaggtaagggtgaggtacacgtacaacaactcaggagagagaaaaatatgcattgtagtgtgtggcagtggtacaggcgtataacaagcaacagaggaaaaagaaaaagaggcatagtaaaaagtgagcatgcagacagacatcggggaggcttgaaccagggcactggttcccgggttaatgagttgacccggtcggatcctcgtgactattttgattcccaacaagctaatgctgtaaaaacattggatgattcccaagctggaatggagcaaatgaaatgcagtttgggttctgaggaagcctatgactctttgagggcatcaatatctaaaatcaaaactactggattaagggatcctctctttagtccagatgttgctcttaaggtccttaacggattgactaaaaatatcacaagcaccaaatatcatcttgggaaaagttctcaagagagtgtccttgatattttacccaattcaactaaggagaaactactagatcattgggtgtgcagtcaggaattgctgaggcacttttggtcttcatatccagtttcaacacaaaaccttgtcagtaaggctaagtaa

SEQ ID NO: 94961 - DNA, 795 bp, Glycine max
  Peptide Sequence Number=SeqID_211739
atgactgcaactagaaatgtgatacaacggcttcacaaggagtgggacctacccatgacacactgtgatgttgctgtggaccagagatcagggcgtgtggacaatgaccctttgttctctaactctgtcggtaactgtgagcaatgtgagaaggataaggagcgtgttctggttcattgcatgtcaggaaagagtaggtctccagctattgtgattgcatacttgatgaagtccaaaggatggagacttgtacacagttatcagtgggtaaaggaacggagaccttctgttgaattaactcaagtaaagccatcagattgcagtgttggtcaattgaagactcttatctggccaagttatttatttgaagaccattatggaaacttcatcaaactaaaaggaaaacatttgcacttccaatctgtccacttgtttgaccatctattcgctattgtttttcctttgttaagccccttgttttctggtgacccactaatgcctgagtttgaggaaaagatctatggacggatcgatagtggaagctctctggtgcctggtttcttgcctgcagcacctccttcaattagctttggttttccaaagatcaatgatccagctcaacttccctcattcagcgctggaactccttcaatcttcgcgcgagcacctctagacattgctcctaccgagtttacatttggtgcaggtcagactcagaagaatgtggctggaaatccctttaatgcaaatccagcaaatccaaatggcactgatatccaaatggatggttcttga

SEQ ID NO: 94962 - DNA, 345 bp, Glycine max
  Peptide Sequence Number=SeqID_211740
atggccaaatataccaaaggcatgctcgtttttggtcttggagttctcattgttagcatgtggtgcatgaagggcaccgaggccggcgatgacgacgacgacgacgacgatgaaccgatcattcatgccgtgaggcgcgaagatcctcgtgaagggtgcggatccagccacccggaaggaggagtggaagaatgcacggatgaagatgactctcttggattgtatggtgatattgatgacactttcaaggctgcagtgaagaaggttgcttctcatttccatcatgatgatggtaatgactctcctaatattgcaaacaacaatgtcaatgtcttggggcattga

SEQ ID NO: 94963 - DNA, 159 bp, Glycine max
  Peptide Sequence Number=SeqID_211741
atgcagacaagaagactgaaagattccatatcacaaatatattctaaacttgaggacataaaggtatctgctgagtcagacctgcggcaccatgtttcccttgttgtccatcctatgcagcagattggatttgacaaacacaaaccacttcctacttaa

SEQ ID NO: 94964 - DNA, 947 bp, Glycine max
  Peptide Sequence Number=SeqID_211742
ctaaccgtgtggcctcgagacacaagcgtgtgtgggtgtgcgaagcgtgtgagcgtgctccggcggcgtttctatgcaaagctgacgcagcttctctttgttcttcctgtgatgctgacattcactcagcaaaccctctcgctagccgccacaaccgtgttcccattctcccgatctcaggttccctcttcagggaaccagagcacaatcacaaacgcgtggaacacgcgttcgtgaatgaggttgaggaggaagaggaaggggtttttgatgagtatgaagacgaggttgaagctgcttcgtggttgttgccacatcctatgaaaaataatgatgaaattgaggagaatgattgtggtgacgagggttttttgtttgttgatgagtatttggacaatcttgttgattgttgtaactcatgtggtcacaatgacaaccagtttagcaacgtttatcagcaccagcagaattacaacactgtccctcagaactatgtagtggttccagttcaggtgccgcagcattttcaacccggtttggactttgactcatcaaaagctgggttcagttacgatggttctcttagtcaaagtgtttcggtttcatcaatggatgttggagttgtacccgaatcaacagtaagtggcatctcaatgtcccactcaaagtcaccaatagggacaaatgacctatttcctccccttctcatgccttcacatctcacaccaatggacagagaggcaagagtcctaagatatagggagaaaaagaagacaagaaagttcgagaagaaaataagatatgcctcaaggaaggcctatgcagagactagaccccgcataaagggtcgttttgcaaagagaactgatgtagaagctgaagtggatcagatgttctccacaaaactattcaatgaagttggaggtagcatttttcccactttctag

SEQ ID NO: 94965 - DNA, 951 bp, Glycine max
  Peptide Sequence Number=SeqID_211743
atgggcctgtacttcctggcgcccggtgcggtgcaccgcgccagtgaagtggtgtatgaccgggcggggtctgcattcgcaaacagcagcgccgaggatcatgcgtggcccgctctactgtccggcgcgcagctgctgcatgtctccggcatcagcccggcgctgggcgacaacgtggccgggtccgtgctgggggccgtgcgtgcggcgcgcgcggcgcgcgtccaggtgtccttcgacggcaattaccgtccctcactgtggcgacgttggggtggcgacgccggggcgatcctgcgcgaagtcttcgccgaggccgacattgtctttgccgatcatcgggacatcgaactggtgctggggctgcactttccgcaggacgatgccgtcgcccgaaccgaagccgctgcggccgccgcctttgccgcattcccgcatctgcagtggttggcgtgcacccagcgcgatgtggtgagcgcagaccatcacatcctgggcgcgctgctgctcggccgcgacggctcgcgggcgcaggcaccaccgcgcccgctccccggtatcgttgatcgcatcgggggcggcgatgcctttgccgccggcatcctgcacggaatgctgtccgggctcgacgcagaaagcacagtgcgcttcggactggctgcgggcgcgttgaagcacgccattcccgcgctgaatgccgaacgcgcgtggtcaccccgccggggtggcgacgaagcgacggttgggacgcagatagatgctgccggaacgggcatccagcaggatattgaactgctgcaggacttcgctgccaagcgtcccgtcgtccgtggagccatcgtcatcgacggtgatcgagtgctttcggccccttcagttgcagggtcgagatgctggccacgggcacgcgcacgtccaccgcgcggatcttccggcccgcgctgccgctga

SEQ ID NO: 94966 - DNA, 207 bp, Glycine max
  Peptide Sequence Number=SeqID_211744
atgctttttgggtccatagtcaaatttcttgaggttgtagaagatactcttgaagtgaagattctggatgatgagaaattccctcacttgcattcatggtataataatttcaagaatgctcctgttattaaagaaaacctccctgaccatgagaaaatggtgggtttttttaagtttttcagagaaaaacttttggtgtcttcctaa

SEQ ID NO: 94967 - DNA, 348 bp, Glycine max
  Peptide Sequence Number=SeqID_211745
atgcaagtttgtgaagtgttgattttcatctactcgctaagccaatctgccaactcaacgagctatctgttgagcgcaacgctgagcacaaggaaatggagaagagattttaggcatttctcaaaaactaagcgtgcaagcaccaacaaggccacctattacgtcagttcagtgtgctttttccttgatcatgtagatgcatgctttgttaggatcattcaacagcggaaactggtctacttcttagaacttgatagggcagggctagtttatcgtattatcacgagggatcggggtacgttctggtcgagtttagtccaacaagaggaatctgaggatgatgcttga

SEQ ID NO: 94968 - DNA, 729 bp, Glycine max
  Peptide Sequence Number=SeqID_211746
atggcccagtctaactcctctagactcgggttccctgttcttatcacatctttatgtaggtccagaggagtcgtttttgacagcttagcctttgaacgtttgagcctgatcattaatttggcctacataaggaaaaactgttggaacccggatgattcaacagttattattagggggttcaaaagaccaagggcaaggccaactgaggttccttctacatcagcagctccttatccagcttctacatcagcagctcctcctccagcacatatggcagtagctctttctaccctacctcctgcagattttcaacatttcgagaccatgcttcaaagcatacatcaggggcagattatattactacaaagcctacagttggtagcgcctccagactccatcccaatggtagagcaatttattgaatgggtagcctggccagggactcagcctcctcttcatagggaacacgaagaccctgctactcaggtaccccatcagtcggaggatgagtcatcagattcttccactcctgagcccttgatcaggaaaaggagggtagttgtaacccatgaagctgcatccacctttgaaaagtctcttgaagcttctccagagcttccggcactagtggcagataccacttctccacagcaggcagcagaaccttccacgcctaaggatcaaaccactccagtcctgtctccgaacacctctcctgtagctactcct

SEQ ID NO: 94969 - DNA, 132 bp, Glycine max
  Peptide Sequence Number=SeqID_211747
gttggttcatttttgccatgcctagcaaatgaaaacatgctggtgtcggtcgaaacacaagttcggttgagctctgatatgaacccacatggcacaagggctgacttaggatcgtctaggattaaaccttga

SEQ ID NO: 94970 - DNA, 2934 bp, Glycine max
  Peptide Sequence Number=SeqID_211748
atggcggaagggagctccagcacagatattcagagagtactcgcagccattaaatcctccgaggcaagcttcttcttcttctctctatcgtttctgtttctatttgtaaacttcacttcatcaatgtggtctcagattttagggttttatgtacagattgtggaggatcgcgttgagttgtttaacgatcttcgacgcatagaattgaagaacgtgtccgagtccgactatggttccgtcattaactgcctcgtagcctgtgtctggtgtgacaagcatctaaagatgagtcttttgtcatccgaagattctcaggaagatgaacatagctctgtattttaccagcttcttgtggagatcctaaggttttctgcatcaacattttcaactttgttgaaattcactgattttggtgacaaggaattgatggacactgttgaaatcttcattttagaagcattaaatctgactaaagattctatatcagaggctaagaaaattcaatcatttggatcagaaatattgaaggttgcacacgtggtcattgatgccgtggtaaaattatgcaaggtgcgttctgaattaataaaccaggaggtaggtgatgaaaaatggttgaggcttgacaagcctgctattgttgaccatgttatcaacataacaaaatgtgcaatagaaaagctgtctcagattggtgtccttgctgcaaatgatggtggcaactcagtcaatattcttaatgtctcctggaaaggaattgtttctttgcttcaaattggtggtgggcattttacagaagttgacgtagcaaatatagtgttaacattgcttgcattgataacggagcctttgaaatgtgctgcccaggcttggtcttcctcactgaatgaagccatttctgtaactgaagctaaaaggatctttgtgcctgtgaaattttacctaattaatgctgttaaaatatgctcactgtatcctcatcaggcctatacagtgtacaaggaaattacagagtgtgttctcaagatcacatgtttttggatttttgtaagtaatgaaaaccttctgaaatgtgcatctgtggtaattaccgaactactggaggaaacaacattgaatttgcttttgtctttgctaaattcttataaactgaaactggaacagaagcttgaggtgctagaatggttgttcactaataaaggggattctcattctggccttgattgtccaaccttaagtgattgtaaccttgcatgggttaatgatatcttttgcaatagttatgaaagtatgagcagagcaaaaatactaatacttggtcgagttgtattgtttattaacttcttcagatattctcttgggctcgatggagatatgaaaatagcaataactcagaagctttattggtttttggatgttttagttgaggaagatgtctattctcatatacttgttttgcaatttcctttattgtatggatctggaaaaacagcagaactggtgaggcaacctatgtttacttccctcttgcaagcattcaaaaccttcatgattgtgatctgttcaagtacagcttgggaggagttggagtctttcttactagagaatttctttcatcctcactttctatgctgggagattgtgatggaatgctggtgctttatgctgcgatatgctgaaacacaaatggcaaacaacatccttagcaaactatgttcattacttaagctgttggcatcctcatactcagtttttgtgccttattcttccttcagaaagttggcaagatcaatatgcatgcttttaaccaatggtgcacaatcaatggttaacgaggtgtacatgtctcttgttggtgatgggaaatcacagttgtcatcaattttttgtttggctttgttcatggaaggttttccttttgatttactgacagatgaattgagaaagacttccattcaaagaattatatctgattattttgacttcatagacaactttgatgaagcgtcattggtggcatgctcctctggcttgtttggtgttccagtttttattctttctgcttctttgcaatcactccaggatggactatctcatattgatgaaagggcccggaagtttttggttgcaatttcttctaattacaaaagtactgtagacaaagtaatcaaggaccgttatcttcagcttttcagtgaaactctagggatcatctcatattttaaaaaactgtatacctcaaatgatattgaacaagtcatcatggagattcaaaatatctttttgtctgagcctccagcccttttggacaaatgcaaaccacatttggcccaattccttgcaggacttgttcacatggaaatttcagaaagtgatgatgatgcaaagagctgtgctgtgtgggaattatatcacttgctcctgaaagagcggcactgggcactcagtcacttggcaataactgcatttggatattttgcttctcgtactaggtgcaataagctatggagatttgttccagaagatgcagcgctttcatatgatatagtttcaggagtggagtcagatcagcaaagatttatggttgagtttggaaaatttcttaaaaaggagatagctcttcttacacttgcaccaatccctgaacagcttgagctgcttgggagagaaggttttgtgttgaaacagatggtccaaaagatttcagcaattgctgaagagagagagaaatgtgaggtcatggaagttgatcacaagagccaatcacataaaaagaggaaacttcctgatggaattaacagaggagtggaattgctgaaaaatggtttaaaaattattggtgacggtctatcccagtggcagcttaatgattttgataccactgaactgcatgaggcgaaaagtgagataaaaagaaaggaaaagaaaaagtga

SEQ ID NO: 94971 - DNA, 960 bp, Glycine max
  Peptide Sequence Number=SeqID_211749
atgcagaatattgagaatgatgatcttgaagaattgcaagagttaggatctggaacatttggaactgtttatcacggaaagtggaggggaacagatgttgcaattaagagaataaaaagtagctgtttctctggtagattgtcggagcaagagcggttgactaaagatttttggagagaggcacagattctgtcaactcttcaccatccaaatgtggtggcattttatggggtagttccagatgacccaggtggaacattggcaacagtaaccgaatacatgttgcatggatcactgaggaatgttctcatgaagaaggataaagtgcttgaccgccggaaaaggctcctgattgcaattgatgcagcctttgggatggaatatttgcatttgaaaaatattgttcattttgatttgaagtgtgataatttacttgtcaatctgggcgatcctgagcgacctgtatgtaaggttggagattttggcctatccagaattaaacgcaacacacttgtttccggtggtgtcagaggaacccttccatggatggcgcctgaattactagatggtaacagttgtagggtatctgagaaggttaggaacttcatctgtctttctgtcttgtttactttgatttttaccaggcactcgcatgtggacagagcaagcactgtcttggagaatgttgatattttctcatttggcattgcaatgtgggaaatgttgaccggggaagaaccatatgctaacatgcactgcggggctatcataggtggtattgtcaataatacgctcaggcctccgattccaaaacgatgtgattccgagtggaaaaagctgatggaagagtgctggagtcctgatcctgcagccaggccaaccttcacagatattaaaaatagacttcgcaacatgtcagattcagtgcccaaaaagagacataacattgctagacgatga

SEQ ID NO: 94972 - DNA, 2709 bp, Glycine max
  Peptide Sequence Number=SeqID_211750
atgagcaatgaggatcctggcatttcaggcaagcaatatatagatacggtgagtgttggtttaagcgacagaatctcttctgatgatgattcagacaatatatgtctacagacgggtgaagaattttctgccgagttcttacgtgatcgggttgccttaaggagatttcctgtcgttactaatgcagaccagcatatgccaaacaggttggactttaatattaaagaaaataattatcaactggtttatgaggatctaaagcatgttcttgggctaaggagaacagaatctgatagtaactcagatttgtctgagattgcttcagtcagaggatatgctgttgaagttgacggcagggcttatcctaataatttgagcagataccagtgtgaacacggcggtttcagacaagcatcaggtaaattttctagacaactatccggtaaattttccgagggaaatggttgtgatcaagttaattcgggaccaaatgctccatctgtttatgtcgttgagtctcctcattgccatccttatggatcagtattctcagaaggttctttctataagaagataaagtttctgtgtagctttggaggtagaatactaccaagaccaaatgacgggaagctcagatatgtgggtggagagacacggataatatccatcaggaagaacatcacatgggaggaacttatgaggaagacttctgctatttgcagtcaaactcacattatcaagtaccagcttcctggagaagatcttgatgctcttatatctgtttgttccaatgaggatcttcatcatatgattgaggagtgtgaagagcttgaaagagctggaggctctcaacggcttaggaattttctcataccttcaaatgaatgcgagagtccaagttccaatgaagcaagagtcaatcagccaagtgatgcagattatcattatgttgttgctgttaatggtttgctggatccaagtccaaggaagaattccaatgggctgagtttggcaagccatgccaatcagtttggaaatacctctgattacaacagtccacatttctatagagactcatccacatctgcatttgcttcagagatgaaggattgcaccccaaattctccaaatttggtaggcatactctcaaaacctggtactcaattctttccagtcctagcaggcaagtcattcagtcaaatgtctcctttatctcccacttgtgtacagcctaaagatcccaaaatttctaatgtacagctatttaaggataaaccatatcatgctattaatgaaagcattactccctttgttatggaaaaagttccatgcaacaattctttgtttgtagaaaatgccaattatgttgatccagttgcacaccataacaatcttgctcaagggcctacatgtgtgaattaccatcctaataaccaatatatagtggagcctgacctgatcaggaagcctggtgagaatcttcaccttcacagacggaacaacagtagcaatgagtttgtctcttctgcggcatgtagtctaactgatatgatcttcgagagacctttagtcaacaatgaaggttcataccattttaacaaggttgtctctcgtcctcatgagtcatcgagtttattctcagattctgatgttagagagggatcttggtacagaatgttgcatgcgcattctgactcaactcttaaggagaatgatgagaactataaagttcacttgcaatttcccctcagtgtagagagagacaatttgccatcactgaaaaattcaagttctttagaagaatgttcaatacagcctggagagatgatcgataggaaagaacacctggcaaagtatcaaaatttgcccatttttggaaagactgatagttttaatgtgtcagaaattggtaaagatatcttgcaacttgcagataaaagcaatgatttttttgatgaaaatgctggagctatgtcacaagacaatgccatagatttaaaacatttacagtacatttatagctcacatggtgtttgctcatcttcaccagatttccaaagcagtgaatgcaatttatctactgcatcatttatctctttagaatccacaagaaacctgagggggaaaccattagacagaactgcttctgagttttccaggaggagccaatactcatcgatggttcaccaatatgctatgccggagacaaaagacggtcaaccacttcttccttgctcttttgagtcccaaactgacagagggtccatactacctatctcatatatggacatgtgttcttccttaagagaggttgttatccctgttgaagatcctgcatactacctgcaccaaaaggaacataacacagtcattaagaatcagtgttctgagtatatcaatgaattttgtgtccacaagcctgtggcagaaccagtggctgttgtcaagggaccaagggattataattcttcaggtatccagtcgtgcttaaaagttgtctcaaatgtagatgaagaggctgatgttgaacctacatctcctgaaaaggaagggatagaatgtgataatccagaatctgaaagtaagcatgcagaatctgatagtggaaacttcaataagcctaatggtgatagagcaactgctgaaactgaggctgaaatttatggtttacagtattatcatgaatgcttggaatggtttgctgagtaa

SEQ ID NO: 94973 - DNA, 501 bp, Glycine max
  Peptide Sequence Number=SeqID_211751
atgaactcaaaaaaccaaacaccgattagggttttcgggcagcgaaccattgcttcaacgttccgcaatcttccaccacgcaatcctccttctgaaggaaacgagagaaatcaagcttcacgcaagagcgaaaccgcgcatcactcgctttcgcacttcctcaccctcaagccgcaaaaatctcctcaaacagttccggggaaatcgacgccttttctgtcaccactgggtttaaaaggtgaggagggtggagctgtgaaagaagttgaaaaagagaaaaacggtggcagtgatgataaggtgatttttaaaagctttaagcacactgaagaggacaaaagagactttgttgatcaaattgaggttggtgaattggaaaattcagttgcggaggatattcaggagtcaaataaaaggaaaactcctttcgaagtattattgcctgatcctttcttgaatagttgttgcacactagcttctttgcctaaaagaatttattga

SEQ ID NO: 94974 - DNA, 309 bp, Glycine max
  Peptide Sequence Number=SeqID_211752
atggatgtaatagcttgcctgaaaatatatccagaagccatttactacggaggtgcaaatgagagccaaactgcacgaaacaatgtggtagttcttggaggagcatcaaagttgaagccaaaaaaaggacaaattggaaatgacactagcaacaaaaggccaagacctcattataatcactatgcaaatggccgtggctggtgggattacgacatggaaggtgttgataatgaggaattgggcttcagtgatgaagtatgggagggggtgggatccaccacacttggtggaatagtagattggcattga

SEQ ID NO: 94975 - DNA, 924 bp, Glycine max
  Peptide Sequence Number=SeqID_211753
atggttagcggcaacatttttcattgtagaaaaaactcgtggcctccgcaagagtatatcagtaaatccactttgcagctgtttgattatgatagttctgctccccctgaacaagcttggagaaggagattaaacagccatgccaatcttcttaaagaatttagagttcgattaggtatacgcatttggtcatatgttagggaagaggcttctcatggaaggagtaatatgttgaaacttaggattccagacttcattttgttggcctgttttcttcagaaagcgcctattgatcctttcactcgagaaagttgcaagccatctgcatctcaaggagttccacttggagggatggggagtggcagcatatcaagaggatttagaggcgagttccgacaatggcaaattattcccagcttatgtgaagcatcaccagtcatgtcaaatcagttctctatttttataagtagagagggaggaaagaaaaaatttgcatcagtcttggctcctggccagcatgaaggtttaggatctagcaggaaacctgatgatcagggcatatcatcgtggggatggaatctaagtggccagcactcaacctaccatgctttgtttccaagagcttggacagtttatgatggtgagccagatccagaactaaaaatatcgtgtcggcagatatcgccgttcataccacataattatagagaaagcagtctacctgctgctgttttcgtttatacgttggtgaatactggtaaggaaagagctaaagtcagccttctgtttacttgggcgaattccattggtggaagctcacactcgtcaggagatcatgtgaatgaaccattcaaagctgaagatggagtctctggtgtacttctatatcacaagcaagttattgaaccttatagctatatatga

SEQ ID NO: 94976 - DNA, 405 bp, Glycine max
  Peptide Sequence Number=SeqID_211754
atgggtcacatgagctacaacaaagttagcactagcactagcagtggcaaggcatcatcaaggtgcagcagaggatttagattgaaccccagaaagttttatgttctcaggctacgcaagaggttcaacttcttccttaggctctttgatagttggaagctttcatatggtgaggctattcaactgctgaagaaaatggtttgcagaaaaagtggcctcaaaagaaacaacagcaacaacagcactagaagtttggtaagaagcagggaggaaaaaatcaaggaccatgaagattgcaagatgagatcatgtgttttagggttgcatgaaaagatagctattgctcatgctgtaaatatttcatctctagctagtttttcatcggtaatgggtcattctctgtaa

SEQ ID NO: 94977 - DNA, 2520 bp, Glycine max
  Peptide Sequence Number=SeqID_211755
atggatgatgaaagagaaaccctagatgagcctgtagaaaaggagggatctttggttggggatgggaaggacttaaaggttggggttttgggttctgatttgtgcacagaagatggtgtttgcactcgtgagggtgatgctgagctgaatggtgatgtgggttttgatggatctaaagaggagggtaaaggtgtgaatccttcaggtggagaagctgctgaggctcttggtgagggttctcaagttgtaagatccttagaaggtaagagtgagaatgagattgctgagttggatggaaatgatgctaccttgaaaacattggatgagaagaagaacattaatgacaggaaggtgaaaaagttagtagaaaaagaagcaattagtgatgttattcgggtcaagtcagatgttagtcaaagcattgaagagcatgctaaggctcttggtgagggttctcaagttgttaagttcttagaaggtaagagtgagaatgacactgttgagtctgatattagtcaaagcattgaagggaaagctggctttcctgagcaggttggttcacaaggagaactagagattgaaggtgaaaattttgatgatgctaaatggagaaaaccaacacatggaagagttacaaagcatgtgtcgaataagagttcaggaaacattcttcatgcaagttatcagctgccaaaggagagaggtgagttttctgtgtatgatatggtttggggtaaggtgaaaagccatccatggtggccagggcagatatttgatctctcggattcgtctgtggaggcaaagaagcatttaaaaaaggaccgccacttgagcaattcagatgcatttcagaatgctgtagattgtgctttggatgaagtcaggcaatgtgcagaatttgggttagcatgttcctgcatacctaaagatacttatgacaagattaagctccagactgttgaaagcactggtattcgagaagaactaagtttcacacgcagagtggatgagtctttaaatgctagttccttttcaccagataaccttttggaatacttgaaaactctatctgagtttccaactggtggctttgatcgattggagcttttaattgctaaggctcagttgcttgctttctatcgtttaaagggttactcttgcttgcctgagttacaatattgtggagttgtggataatgacaccgatgccttcttaattaaggacttacttaagggtactgataaaagtttgagtaaagttaataagcatgcaactcatgcgagtaaaaaaggtcaaactggtgctggaaatttgaagacaacaaatggctcctgtcgcaaaagcaagcataatttgaaagatgatttatatccagaaaagaagaaaagaatcttgtcagaatcagtaggtcggactccagattcttcacatggttattatcggtcaggtgatgccactgataatctgatttctcctgcctcttccaagaaaaggaagactattgatcactgtgctgctgtttcaggggtgaaagatcggagaaaaacaatttcccttgccaaagtttcaaattccataaaacaatcatttaaaattggtgaacgtattctaagggttgctaatcaacttactggaccaccgtctgtgttgaagtgttctggagacaggtctcaaatggaagatggaagtgctgatggcttttcaggaaatggatctggtttcttctcccctaatcttgagaagactcagaagtcaagcttgactgttccaacagaatattcatctctagatgatttgctacatttacttcagtgggtagcacaagaacccctgggagattatagttccttgaatgttatagtgagcttcttctctgatttcaggaattcaataattgtggccaatgattctggaaaagaaatttcgcctacaaagaaagttggtaaaaagaagaaacgacctgtgggtggatcacctgaaacaattgaatttgatgatctaagtgatacacattggactgacaagggcatccagagtggttctgaaaaaaagctgccgcggagaagcaacagaagagactatcagcatgcccctgctgagccagaaaaacctattatagtttatactcgtaggtcctattccaggaaacaatgttcagacagcaatcttgttgtggttcctgaaaagccttttgtttgtgcagatgagaattctccggctgagcttgtgttgaactttgctgagctggattctgttccctcagaaatgcacctaaataagatttttaggcgatttggacctctaaatgaatctgaaacagaagttgatagagggagcagccgggctagagtggtttttaagaagtgtactgatgcagaggttgctttcagtaatgctaaaaacttcaacatatttggatcagttcttgtaaattacaagcttaaccatactccaagtacattgttcaaagcttcatctcttgccacaactcaagaccaggagaatggagatgcatgttga

SEQ ID NO: 94978 - DNA, 1824 bp, Glycine max
  Peptide Sequence Number=SeqID_211756
atggatctccttcatcaatactcagacggcgacgatcccgactccccctctcaaaaccctagctccccgccgcgcctcctcgccggccgctccgccgcccccaaggtcgacgacaccatgctggccctcaccgtgacctcctcctcctccgcggccctctctcggcccatcgacccgacccagcacctggtgggcttcaacccctcctacgaccagctctgggcccccatccagggcccggcccaccccttcgccaaggatggcatcgcccagggcatgcgcaaccacaagctcggcttcgtcgaggacgcctccatcgaacctttcctcttcgacgagcagtacaacaccttccacaagttcggctacgccgccgaccccgccgccaacaacttcgtcggcgacctcgacgccctccgcgacaacaacgccgtctccgtctacaacatcccccgccacgaacacaagaaacgccgcattgaggccaaggagaagaagaaatcagatgaaaacaccggcgacgacgatgacaacaacgacgaggaggagaaccagaacccggcctcggaggcgtggataacgaagaacaagaagagcccttgggcggggaagaaggaagggttgcaaggagaattgaccgaagagcagcagaagtacgcggaggagtatgcgaagaagaaaggggaagagaagagtggttttggaggggagaaagttgaggttgttaaagataaaagcacttttcatgggaaagaggagaaggattaccaaggtaggtcttggatcgcgcctcccaaggatgcaaaggcgagtaatgatcattgttatatgcccaagagattgattcatacttggagtggacacaccaaaggggtttctgctattaggtttttccccaagtatggccatttgattctctctgctggcatggataccaagattaagatttgggatgttttcaactctggcaagtgtatgaggacttacatgggacactcgaaagccgttagggatatctgtttcagcaatgatgggaccaagtttttgagtgctgggtatgacaagaatattaagtattgggatacggagacagggcaggtgatatcgacgtttgccactgggaaaattccttacgttgtgaagcttaatccagacgaggataagcagaatgttttgttggctggaatgagtgataagaagattgttcagtgggatatgaataccgggcagataactcaggagtatgatcagcatttgggggctgtgaataccatcacctttgttgataacaacaggaggtttgttacttccagtgatgacaagtccctcagggtctgggaattcggtattcccgtggttataaagtatattagtgagccccacatgcactccatgccttccatttcgcttcaccccaatgccaattggctcgccgcgcagagcttggataaccagatacttatttatagcacaagggagaagttccaacttaacaagaagaagagatttgggggacatattgtggctggatatgcgtgtcaggtcaatttttctccagatggacgatttgtcatgtcgggggatggtgaagggaagtgttggttctgggactggaagacttgcaaggtctacagaactctcaagtgtcacgaaggtgtttgcattggttgcgagtggcatcccttggaacagagcaaggtagccacgtgtggctgggatgggatgattaagtattggtatgtaaactctcgtgctatgcagcagttaatcacagaatcttatatggtgtttgttcaaatatgcttttgctatcacagttgctga

SEQ ID NO: 94979 - DNA, 312 bp, Glycine max
  Peptide Sequence Number=SeqID_211757
atgtgggatctcattcaagtcacttgtgaaggaactccaaaagtgagaagagcaaggaataactctttcatccaagaatatgagacttttaggatgaaacaagtcattaaaatttcagagtctgaagaccttacctccatcacaaatgcagagctatttggaaaattgagaaaatatgaggtggacataactaggatagcaaaagaggaagaaaaggagaagaaaatgatcaaattggcactcaagacaaccacctccttaggggatgaaagtgaagaacaaaatgttgatggatcggatgctgaactataa

SEQ ID NO: 94980 - DNA, 1773 bp, Glycine max
  Peptide Sequence Number=SeqID_211758
atgactggtaaaagtccaattactcaacggacagcgagacatggctcacacaaactgtgcaaatttgatttagcggatctagaatggacaaatatgattccagagtgtccaacataccacccatcagagtatgagtttgagcatcctttagtttatctgcagaagattgctcctgaggcttctaaatatggtatatgcaaaattgtttctccaattgcagcctctaacccagctgcttttgtcttaatgaaagagaaaaaagatttcaagtttgaaacaaatgtacagcctcttcgtctttctaaatggaatgaaaaggatataataaccttttctatgagaggcagaaaatatacatatcatgactttgaggttcttgcaaacaaggccttttttagtagatttcacaattctagagaccttccttcttcttatgtggaaaaggaattctggcatgagatggctcatggagaaaaaggaacagttgagtacggagtcaatgtcgaaggtagtgccttttcatgtgatcctaatgacaggcttggaacaagcaaatggaatttgaagaatttttcacggcttccacaatccctgttacgtttagttgacaggaaaattcccggaataactgatcctatgctttacattgggatgctgttcagtatgtttgcgtggcatgttgaagatcattatttgtacagcataaactttcatcactcaggtgcaaataaaacttggtatggcgtgcctggccatgcagcatcacaatttgaaaagactgtcttacaacatgtgtattgcaataagatcataacaaaacatggagaggatggagctttcaagtttctagcacaaaaaacaaccatgttcccaccaaacgtcattttacaacatgatgtggcagtttacaaggctgtacaaaagccaggagagtttatcatcacctttcctagagcatatcatgctggatttagccatggttttaactgtggagaagcagtaaactttgcaaatggtgattggttttcacttggggctgcagctagcatgcgttatacacatctcaaaatgatgcctttaattccatatgaggaacttctttgtaaagaggcaatgttggttttcaagtcctcaagagtcagaagttccaagaacaaacctgaagacaaaacatcttatcaagctattatgctgccttttgtgcatcttgtgcaatcttataagacctccctcctgcgactgaacagttcaagaaagttgcctagttcttcaaatacaacaggttctcagatatgcagcctttgctacagggattgttatgtagcttacttcttgtgcaagtactgcttttctcatccaatttgtcttttccatgacattgcaccacagacttgtttatgtggaagagattatactattttcaaaaggaatgacatttttgcactggaagaagctgcaaaaagttctcaacagggaaaagaatgtgttgacaaattctctctatcaagtatattctcttgtagcagaaatgattgcatcaaagatcctgaaaataatccttggcagagagaaaaaagtgtaagaggaactgctagttctctaggggctgcatctaaaccgaaaacaaaagtggctgacagcaccaagcacagtgttgaaaggaataagtcaacaatgaaacactggagaaacaatgggcttccatctgtgaggggtaccgaaaggccaggaatcatttataacctgagaaaaagcaaatcaaagttgatttag

SEQ ID NO: 94981 - DNA, 354 bp, Glycine max
  Peptide Sequence Number=SeqID_211759
atggattcagtgactagtgggtgcaacactgatattagagcatgttttgcagagcagctagccctaccagttggggtgaccgatacaacttcggcacactttcgtctacaaagaggtggtggttcaaatgggtcagtaaatatgattactgacaagacaagacaagacaatgagaggttccaaaacaatcttccaagggaatgctctcttccaagttttaggctctatgtaattattgtgaagaagtcgagggtcaaggtgggtgatgttgccgaacggggatttttgaagttaacaactgctggtaacgttaacctcaatgctggtcatatcgtcgaagttcctggtacttaa

SEQ ID NO: 94982 - DNA, 540 bp, Glycine max
  Peptide Sequence Number=SeqID_211760
atgaagggtgacaagaatgttaaggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcagttaatacgtactttgtctgcactgttggtttatgtttctggcagcttgttcatcagggttcgctgaactatattggtttgcag

SEQ ID NO: 94983 - DNA, 216 bp, Glycine max
  Peptide Sequence Number=SeqID_211761
atgcctgagaaactgcccgagatggtgaaggcggaagaagacgagcctgattcatcttcatccttcagcacgatcacaaaatccttcgattcgaagggcaagggtccaacggtgtcggaaggaacgccgatggtggaagccggaggaggagcagatggtgcattcaccggagaaggagtgggaattgaagaggatttgtcacattggatagtttaa

SEQ ID NO: 94984 - DNA, 1980 bp, Glycine max
  Peptide Sequence Number=SeqID_211762
atggataatactagcatgcttcaaatggtttcaagtttggttctgattctaagtgtttcatcattggcttcagcatctctgaaagtgggtttctacagctccacgtgtccatctgccgaggaaatagtgagaagcacagtaaacaaagcaatttcagacaacgccggcatagctgcgggtctcataagaatgcatttccatgattgctttgtcaggggttgcgatggttccgtgttactagcatctaccccaggtaacccagtagccgagagagaccattttgccaacaacccaagcttgcgtggcttcgaggtgattgaggaggccaagacccaattagaggctgcatgccctcaaacggtatcgtgtgcagacattttggcattcgcagcacgagacagtgctctcaaagttggtggcataaactacgacgtaccatctggacgcagagacggacgcatctccattgctgatgaagtgccacggaatctgcctgccccaacctccagtgcccatgaacttgttagtaatttttctcgaaagggcttgtcagcagatgaaatggtgacactttcaggagcgcattcaattggtgtctcgcattgttctgccttctccaagcgcttgtactctttcaatgacacagtcacacaagatccctctatggactcttcatatgctgaaacgttgaaaagcaattgtcctgcaccaccttccaccatagattcaacagtgtctcttgatccttccactcccattcgtttggacaacaaatactatgagggattgatcaaccaccgtggcctcctcacatcagatcagactttgtacaccagtcaaaccacaagggaaatggttcaaagcaatgccaacaatggtgctagttgggctgagaagtttgccaaggcaatggtgcaaatgggttccatagaagtgcttacgggctccgatgtaacccctatttccaacgttcaaaccctgagttttgcaccagaacctacagctattctgtatggtgcgaattatcccctttggtcccaagttgtcgagatgtttgttgctggtcgtgtcaaattggttggggcgtacaggatgggcttgtctgttttgaagatttgcattaccaatgagttgactgagggcaaggagccaaagcgagagaattcgaaggaaatggccacgcttgctatgtccactttgttgtttgaaaggtatattctctgtgattgtttgcttaccttcatcggagagtacgctgaagcgattgagaagctagagggtgttcaagagttaacaaattcttacttgggtgttagagttgctgctcttgaaactcaggctgggcttcatctattgatgaggcaggatgatttggcagcagcggttgctgataagtgcatgaagacggtggagaatcaagaaaaaccactagaatatgagtcacgatttatagattatgaggcacaatttgtttgtgctaaagcactaaaagggctaattggcaatggcaatgctgactcagctgaagatttcttcgacaagtctctccgtgagaagtattgtgatgatagggaactatcaatggcaaaggaggtttaccaaaatgtcgtacaaggtgctattgaagtaaaaaatgctggcagaccatacttaggagcagagcaccatttgacacaggcattaagtagggcagaggaagcctatggagactctaaacatcctagggtgggggttgccttaacaagcattgctcttatgtataggcgtaaagcaattcatgaacattcaagttcgctgttggttcaagagggtctctaccgaaaagtgatagatattttgaaggttccaacgacggaaactgagtctgaggatgccgcaccattggtagatagaagtgatacagcagctcttgcaacaggcgtttcacttctttacagcgcggagggaggaagaacaagaagaagagaagaaggcaaatga

SEQ ID NO: 94985 - DNA, 522 bp, Glycine max
  Peptide Sequence Number=SeqID_211763
atggtgaccaatttttttctgcattggctgaacataaacctaatcaagaacgcaaccagacgcgagaaacaaagtcaaccaaagaaatatagatatggaattaaaataatcacgacaaagaaaaagagagcagaaaacagagagaaactgcaaggtgttgacgaagctcttattgtgctccatggaggcttcgttgtaggtcgtggtggagttgagcggctttgtcgatactctatatctatctcgtgtcaaaatggtcctaggagatggcaattgtgttgttcttcaaccttgaactctacgactgagtttttcacggaaagtttgtgggaggatcttaaacctactatattgcacctgtcacctaaagaactgaagttagtctataatgcttttatgctcatgatggtcagaaaagatgcagtggtgaacccttcatcattcaccaagtcgaggttgcacgcattttgggagaactttcgagtcatgaaaaaatgcttcccttttgccaaatttacttaa

SEQ ID NO: 94986 - DNA, 909 bp, Glycine max
  Peptide Sequence Number=SeqID_211764
atggacatggtaagaagtatgcttagcaattccaaacttccccattcattatggaatgaggctcttaagacagctacatacatactaaatcaggcaccagcaaaggtggtccctaaaatcccatttgaattattgaaaagttggaagccaagtttaaaacatgtgtgtgtttggggttgcccagctgaagttaggatttataatccaaatgaaaagaagttggacgcaaggaccattagtgtatatttcattggttatgctaaaaggtctaaggagtatagattttattttccaactcatagcactagaattattgagtcaagaaatgcaaagtttctagaaaatgatgtggctagtgagagtgatttaactcaaggcattgatcttaagaaaaatcaatgtgaaggagtagttcccacatcaagttataagctagtggtttttggcgatactcaccaaaatcgtgtaacacaagctccacatcaagttgatcttatcctagaagatccagttgaacaacatcaaacacaaaatgttgagcaacttgttaaacaacatcaaacacaagatgttgaacaacctgttgaacaacaaccaaaaggcgtggatgtaacattgagaagatcagctagaataaagaaacctgcaattcctagtgattatcaagtgtatttagagtctcaatatgactttggagttgaaaatgatcctgagtcatttttgcaagcgattaacaattgtaattctaagctatggtacgatgctatgaaagatgaattggaatctatggaaaataataaagtatgggatcttgttgaatgtcctaatgggataaagcctattggatgtaaatggattttcaaaaccaagaaggattcattaggtaacattgagagacacaagacctga

SEQ ID NO: 94987 - DNA, 708 bp, Glycine max
  Peptide Sequence Number=SeqID_211765
atggcaccaccatcctctcctccgctcgtcgacaactccgactccgacgccgagggccgccttcgcgaagcggaggagcgcttccgcgacgccattgaggagctccagcgccggcagcgccgcgccgccgctcacgcccagcagcactgccgcgtggactcgccgccctgcgatcacggccccgacgagtcctgcgtggctcacgccattggcaacctctgccagaccttcctcctctcctatggcgtcagagtcggcattggcatactcctccgcgccttcaagcttgttcgaggccaatcctactcctctctccttgatctcaagcaacttgtttcagaaaaagatctgatagtaagggaagaagcatgccgcattggtttactttttggtggtttcactggatcttatcatgctcttagatgcttgttgcgaaaattgagaaagaaagagacaccagctaatgcaattttagcaggtttaatagctggtttctcaattatggcattaaatgattcaaataggagacgcacactggctttatacctgttggctaggctagcccagtgtgcttataattctgcaaaatctaagaacaagtttcacctttgggggagtcattggagacatggagattcattgctgtttgcccttgcttgtgcacagggtaatagccataaaacaggcgggaagcatttttatgaatag

SEQ ID NO: 94988 - DNA, 234 bp, Glycine max
  Peptide Sequence Number=SeqID_211766
atggaggaaaacatgcaatgccccatgattgtctactcccaacgacaaccatggggtttgagttcacaaggaagaattcccccaagggttcgagcactcttgaaagagaaaggagatggagaagaccaagtttggcttgagttgctccaagcttgcttgcttgcaccacgaacaatgaagactggagcctcctcctccttcctccaatctctcagccatcacctccaacggtag

SEQ ID NO: 94989 - DNA, 372 bp, Glycine max
  Peptide Sequence Number=SeqID_211767
atggctttagaaactgttgaaaatatgtgtgcctggaacatctttggtgcagaaagcacaacagggaagctccaagtccacgtcctcggagaggaagttgcggaagcgcaagccgcgacgttcggcgacatcgagggagaggaaggagttcaagacgcgaagaagggaacggcacttgaggaggagaaacttctgatcggagtgcgggagcgtcaggagaagaagacagcagcgcagaacgagagaaagaggcagagcggagaaaaatcggcggaaggtggagttgagttggtcgaagagggtttcgcaaacgctgcgaaggtctttgtctttgaggattattggatcttgagcggtggcgttggagagtga

SEQ ID NO: 94990 - DNA, 342 bp, Glycine max
  Peptide Sequence Number=SeqID_211768
atggttggcaaggagttcatgctccatctcgaggttaagtgttcatggggaagtatgattagaggtgtgaatcacttcataaggtatctctgttatgcgctcatgcctgttgatgacgctgaggagcaacctcaaatctttgagtattacctattgtggatgcaacacactccatcatactaccgtcaaaccttaccagttcatgttatggacatattgatgtctacatcttcatcttcgtctaatggatgcaacacacttcatcgtcgagcacactatgattgtcttctactctccgtcatttatggtactagcggtgatgaccttttctccatgcactga

SEQ ID NO: 94991 - DNA, 1011 bp, Glycine max
  Peptide Sequence Number=SeqID_211769
atgtcttccaaaacaaaagctgaccttttggctgagtacattgcatttatgaaagagagacagtacatatttattgattcatgcagggacgtgactacctcaatcttagattgtattatccgtcaagctttctctcaggacaccactggagatgcagtataccatataaaggaaaatactagtgcccaagatatatgccttcttgcagccatattgaagttgatgagtgtttcattgctacaggcaattaagtatctaagcaatggtagtgattcagattgtttaaaaacaatgggtagtgcctctgtgcgtgagaaatatgatttcttgatcagcatcattgacctttttcaacaatttaagttctgtttaccaattcaaactttatttaataatgtgatgaaaactcagaaatcaaattacaaagtctccaaatcaatgcttgtgcactttataggcttgctatctataagttttggcaatggacttgatttgctagctaaggggtgtatactcgtgcttatggcactgatgtgtctatttgtttttgaagagggagatttagttggtttggggtcatttaggggtctgccattgcaaccttgctcgtctgaaattccatctgataagagtggaaagggggctagagataagcgatctgtctatacagttgcagcagagtttcgtagaattcgagaatgtaatttaagggctgagccatcggtttccttcacctcctataacttagaggtcggaacagagaaaagctgcaacgggggaatgttccttaattgcataatagaagaccccaaaaaattgtccgattatgatgaacttgcagatttccttgagtgtaagacggggaaaaattattccaagtggttgaatgaccgagaaatatatagaaaccggaggtatcagaaaaaaatagatttaaggaaaaataagaagaaaacattctggaactttacgaagcataaaaaaattggcaagtcgttgaagcgaccttaa

SEQ ID NO: 94992 - DNA, 474 bp, Glycine max
  Peptide Sequence Number=SeqID_211770
atggaggtggagagatcatcgaaggaagtggtggtgtttccattctccgggatgacgaggctgatgaaggaggtagttttgatgcacaagcgtggatctttcaaggaagagcctcaagatctcttctttggcaactcaactccctcaagttctccgtcacctcttgtgacagtgtcgacgaatttattcatggtacaggatttgactgaaaaaatggctttgaactggattgtagaacttattcatagggcattacctccgaagagagatttgactaggttcgtgaagtggccaaagaatgttcaaattcagaggattaagaggattctgaagtacaggttgaaggttcctaatgcaatcctccctaggaagggacctgtcactagagtcataagcaagaggctccaagaggattgggctagagctgccaaagaaggccctagggttctcatgaacctcagggtagatttatga

SEQ ID NO: 94993 - DNA, 270 bp, Glycine max
  Peptide Sequence Number=SeqID_211771
atggcgcctactaggcatcctctggacccagagaagtccaacagggccctggggtttccggctctgatcacaagcctctgccagtcctacggagttcctgtcacccccagcaagggcgacgcacatcaggatgcgggtgcaccaccgccacctcggcaagccgattcggctaggccattgggcgtggagcagtatctacacctgaagggtgaatgctgtgaaaaattttcccgaacgccccaaatggactcgaatgaatgcgtgaattaa

SEQ ID NO: 94994 - DNA, 1089 bp, Glycine max
  Peptide Sequence Number=SeqID_211772
cgtttgatgttggcaaaagtagtgagttcactattcagcaattaggagagctcaatcttcatggaagattatcgattagggagctgcggaatattgagaacccctctcatgctttatctgctgatttgaaaaatcaaacacgccttggggaactagagtttagatggaattcgcacgggaaacatgatgatcatgccaaagaaagggatgtagttgtaattgagaatctacaaccttcaaaaaacctggagaagttgtcaatcaggaaatatggtggtaaacaattccctaattggttatccgataattctttatcaaatgtggtgtccttagagttggacaactgtcaatcttgccaacatttgccttcccttggacttttgccatttctcaagaaccttgagatttcaagtcttgatgggatagtgagcattggtgctgattttcatggtaatagctcctcttcatttccatcgttggaaacattgaagttctcctctatgaaagcatgggaaaaatgggaatgtgaagctgtgataggtgcttttccatgtcttcaatatctttctataagcaaatgtcccaagctgaaaggtgacctcccagagcaacttcttcctttaaagaagctacaaattagtgagtgcaaacaactagaggcttcagctcccagggctctagaactaagcctaaaagactttggaaagctgcaacttgactgggctactttgaaaaggctcagaatggccggacccagcatggaagcatcgatgctggaaaaatctgatactttgaaagaactgtttattcattgttgcccgaaatatgaaatgttttgcgattgtgaaatgagtgatgatggttgtgactctctaaagacttttccgctagatttcttcccagcactctggatccttgatctcgtaggctttcgtaatctacagatgattacacaggatcacatccataatcatcttgaatatctgataatcagagagtgccctcaattagaatcattgcctggaagcacatctctgaaggagctaaggatatatgattgtccaagagttgagtcgttccctgaaggag

SEQ ID NO: 94995 - DNA, 183 bp, Glycine max
  Peptide Sequence Number=SeqID_211773
atgatgagtagagctaagctgaggtgcccttttgggatgattgtgacagagatgatgccgtggttcgctaaagagggggctaatggaaaagcaaaggctttgctggaaaataagtcatcattcagagacaagtggtgcaaaggaacagagcagcaaccaactgtgtcattctttgaagactga

SEQ ID NO: 94996 - DNA, 684 bp, Glycine max
  Peptide Sequence Number=SeqID_211774
atgtcacagtggaagtgtttttcgttaagggtaatagaatctcggtttccattggcacatagaaggaagaaaggtgttggttctagaaatagggattcttggaaagaatattcaattgggttggtgccacgaataagcagcatctcttatcctcattgtggttattttccatcaagtgggggtttcattgcaaaaaggaggaaacgtaacagtcttctgagactgaatgattgttcagacaacataagacaacatgcttctattttgtttgtgcggctggttagtggagtaatgttggtcatgtctgtttctttggcttctactgagccatcctataaggtgataagaaagatgcttgccacattggatgatccattcactagatttttggagcctgaaaagcagtctggaactgaaggcgctctaactggagtggggttatcaataggctaccctaccaaagctgaaatgcaacctggtgggcttgttgtcatttcagcttctccaggaggtcctgcatacagagttggtgttttgtctggagatgttatcctggctattgattgtacaagcacagaaaacatggggctgtatgatgcagctgaacgcctacagtgggttttttctcctgcattccacttgtgctttcaagtaaatattttcctccacaaattgggagaataa

SEQ ID NO: 94997 - DNA, 630 bp, Glycine max
  Peptide Sequence Number=SeqID_211775
atggctggagtgacaaaggaggaagagaggggtagtcctagttggggtgcttcattttttacgcagacaacagaggatgtggctagagctgttgccactgctatgaattctcagaggccatctgtggtatattcattgaaaaatgatcatggtggcagccaacttcaaaggctgcagtatcaagttacgaaaatgataaaaggattttctagccctccagaagttaaatatacaaattacaatccggaaatcttgacaactcagaagcgtcaatgggctgcaaactttcagttgcagtacacggaccataagtcttggaaggagccaacaaagctgtttgaaagcatggtggttgctggacttcatcctaattgtgatattcaggcactgcaaaggcaatgttttttaagaaagtctgaaggccctggtaaattgagaagtgcacttggttatcagaatcagtcccgtgtggaagtggaacccaatctagaacctcaggttttatttgtttaccctccagaaaaacagctgcctcttaaaggcaaggatcttctctctttctgcttccctggaggcttggaggttaggtgtatgcacaatgaacttctaattttctccctatccatttga

SEQ ID NO: 94998 - DNA, 828 bp, Glycine max
  Peptide Sequence Number=SeqID_211776
atgccattgctcgtatccaattgcgctaaatcctttatcctctccacgctcccaaagtccaagcaaatgtcccgtcaagctcccggcgtcgtcaaaacgcgcctgaggggcgtcgttttcgacatggacggcaccctgaccgtcccggtgatcgattttccggcgatgtacagggcggtgctgggcgacgaggagtacctgaggctcaaagcggaaaacccttccggcatcgacattttgggccacatcgacggctggccacctcacaaacagcgcaaggcattcgacgccattgctgaggtcgagcgtcagggtctcgagcgccttcaaatcatgcctggttgtgctgagctttgtgcgatgctcgattctaagaaaataagttattgtcccaacaataatgacatcattatcttggtggttgtgaaatgtgagcaaattactcatgttatatatcagttttttaggaggggtttgatcactcggaacacgaagtcagcagttgatttgttccatgaaaggtttgggattacattttctccagcattaagcagggaatttcgtccttataaacccgatccaggtccactactgcatatttgttctctttgggaagttcaaccaaatgaagttataatgattggagatagccttaaagatgatgtgccttgtggaaggcaagcaggagcctttacatgcttgcttgatcaaacaggagtatatgattctcccgagtatgctgatgttgaatttaaaccagatttcaaggtgacttcccttgatgaagttcactcagttctgaaggaaaattttgatttgtcaccatga

SEQ ID NO: 94999 - DNA, 1893 bp, Glycine max
  Peptide Sequence Number=SeqID_211777
atggttctgaggaggacattttcattcacccttacaacctctcgttattacacttctgccaccgtctccctcgcgcacacgccgcagagtctccttcatctgcttcagctgtgcatcgaccttcgatctcagaaactcgcccagcaatctcacgcgcaaatcctcgccaatgggttcgcgcaaaacgctttcctcgccaccaggctcgtctctgcttacgccacgtgtggcgagttagccacgtcaaggtttgtcttcgagtccgttgaggccaagagcgtttacctctggaactcactgatcaatgggtatgttaaaaatcacgactttcgtcaagcccttgctttgttccgcgaaatgggtcgtaatgggatgttgcccgatgattacactctcgcaacggttttcaaagtttttggtgaacttgaggacttggtttctgggaaattgattcatgggaagggtataaggattggatttgtgtcggatgttgttgttggcaattctctgatgtcaatgtattgtaggtgtggagagtttggtgatgcagtgaaggtgttcgatgaaacgcctcacaggaatgtgggttcatttaatgtagtaatttctgggtgtgctgcattggaaaactgtaattttacttcgcatgatgatttatcgaacttttttctgagaatgcaatgtgaagggtttaaggctgatgctttcacggttgcgagtttgctgcctgtgtgttgtggcgatactgggaaatgggattatgggagggagcttcactgttatgttgtgaaaaatgggttggatttgaagatggattcagatgtgcatctggggtcttctttgattgatatgtattccaggagtaagaaagttgttcttggaaggagagtgtttgaccaaatgaaaaacaggaatgtgtatgtttggacggcaatgatcaatggttatgtgcagaatggagcacctgacgatgcattggttcttctccgcgcgatgcaaatgaaggatgggatacgacccaataaagtatcacttattagtgcgcttccagcttgtggcttgcttgctggattaataggagggaaacaaatacatgggttttctattaaaatggagttaaatgatgatgtttccctatgcaatgctttaattgacatgtactccaaatgtgggagtttggattatgcaagacgagcctttgaaactagttcttacttcaaagatgctatcacttggagttcaatgatctctgcatatggattacatgggagaggggaggaggctattattgcgtattacaaaatgcttcagcaagggttcaaaccagacatgataacagtggttggtgttctttctgcttgtagcaagtcaggattggtagatgaaggcattagtatatacaagtcactgatgactaagtatgaaataaaaccaacagttgaaatttgtgcttgtgttgtggatatgctaggtcgatcaggccagcttgatcaagccttggaattcatcaaagaaatgcctttagatcctggtccaagtgtttggggatctcttttaactgcctctgtaatacatgggaattcaaggacaagagacctggcttataggcatctcttagaactagaacctgaaaacccttcaaattatatctcactttcaaatacatatgcttccgacagaagatgggatgtggtaactgaggtgagaacaatcatgaaagaaagaggtttaaaaaaggttccaggttgcagttggataactattagtgggaagactcattctttttctgttgctgacaaagcacatccttcatctagtttaatctatgaaatgctcggtgacctagtatcaataatgacagatggctgtgctgatattgatatcctgacttaa

SEQ ID NO: 95000 - DNA, 243 bp, Glycine max
  Peptide Sequence Number=SeqID_211778
atggttctgcacggtggtgtggatagtgctgcaagccctcgttttgcggcgttgagccctgactcgaggggacgtgttgcgagtcccacatcggatggcttagttgttgatgtggtgttgtggatgaattggcgtggagcggttgcggtgctcgtttatgccaccgcattgtggtacttcttcgagcgtgttggttacaatttcttgtccttcgtcatcaaagtttttgccaacaagctttga

SEQ ID NO: 95001 - DNA, 905 bp, Glycine max
  Peptide Sequence Number=SeqID_211779
atgtccatggatagttcttccaattcagtgatggaggatgaatttgagtcaacaaccttgcattcagccccatcatttgcaatatacaacaaccttcatggagatgatgaaatcacccctgcagaagttttcaagagagctattggaaagagtttggaagccacaggcagtggtgaattcagcttcgggagtaacaagatggatttgattgaggaagaagagaatgagaacaatgattggtcaactgggattcagaatttgagtattgaggaggaagatgttcagccagctagtccccccatgtatctggcagcagggcttggggttgatggtgatgtaggatttgataaatttatcagtgatgatgtatttaatcccagtttggaagaaagtgaggatcttgtagggtattacaagaggatggctgatgagtatccctgccaccctttggttctcaaaaagtatgctctgcttttacaatccaatggagaccttcgaggggctgaggagtactttcttcgtgctactatggcagatcctaatgaaggtgaaatcttgatgcagtatgcgaagctggtgtgggaaaaccatcatgacaaggatagagcaatggtctattttgaacgtgcagttcaagctgctcctcaagacagcaatgttcttgcagcatatactacttttctctggaatattgaagatgatgagaatgaagatggaaaacatgaaattcagagtgaaatggaaacacaaaaagctgaacctgtaaagccctccaaagatgaaagtggacaagagattgatggagcacatactacaacagctaattgtggtgaagaaaataatgttgaagattactttaagaagatgcttgatgaaaatccaaacaatcctttgtttctgaaaaa

SEQ ID NO: 95002 - DNA, 663 bp, Glycine max
  Peptide Sequence Number=SeqID_211780
atggcgtccgtgtacataccggtgcagaattcggaggaggaggttagggttgctctcgaccagcttccgagggacgcctccgacatcctcgacatcctcaaggcggaacaagcccctctcgatctctggctcgtcattgcggaggatacaacccttgacctttccttctttcttaagccagccaatcaaacttatatctcccaggggtgcagggagtacttcaagcagggaaaaattgatcaatttcgccagattttggaggaagggtccagtccagaaattgatgactattatgctgatgtcagatatgagaggattgctatcttaaatgcccttggagcttactacagctaccttggaaaaatagagacgaaacaaagagaaaaggaggagcatttcattttggcaacacagtattacaataaagcatctaggattgacatgcacgagccctccacttgggttgggaaaggtcagcttttgctagcaaagggtgaagtagaacaggcatctgctgcatttaagattgtgttagatggagaccgtgataatgttcctgctcttttgggccagatttcagcttttgtgattgaaacacataatttcaagagttgtgagatggttacaagttggtttctcttcaatcaactattttttatttga

SEQ ID NO: 95003 - DNA, 708 bp, Glycine max
  Peptide Sequence Number=SeqID_211781
atgcaccctggcaatatccaggtggtcaccgaagggccggataaaggcaagttcattgcactcgactttggcatcatgggcagtctgacaccgactgaccagtactatcttgcgcgcaacttcctggcatttttcaatcgcgattaccgcgatgtcgctgtcgcccatattgaatctggctgggtaccggcagataccaatgttgaagccctggaaactgcggtacgtgccatttgcgagcccattttcgaaaaaccgctcaaggatatttcttttggccgcaccttgctgagcctattccagatgtcacgccgatttggcgtcaacattcagccacaactgattatgctgcaaaaaaccttgctcaatatcgaaggattaggccgcgaactcgacccgaatattgatttatggcatagcgccaagcctttcctcaaacgctggatgagtgaacagatcggctggcgcagcctgctcaaatcggccaaacgggaattgccttatatcctgacccatgccgcggaaatgccacgcctgttcgagcaatacttgcgcaaccaaaccgagctcagcaagcaacaaagccgcatcgacgccctgctcatctcacagcaccggcaagccacttggcaaaagtgggccacaaccgccatcatcgtgctggcattactgcaatttgcaagtttattcctgctgtttagccactaa

SEQ ID NO: 95004 - DNA, 852 bp, Glycine max
  Peptide Sequence Number=SeqID_211782
ctgaaaacgccgggacgcgaggaggaggacaccatcacgggtgggtctgacgatcaaagcgaggccattgcccggtacatcgtggcgttgggtggtaaagaaaacctgaagagcgtcgacgcctgcattacccgcttacgcctgacgctggtggataacagcgtgctggatgaaccgacgctgaaagcgctgggtgccaaagattcgggcacagacagaagcctgacgctgagcgttcctgttccctctccacacaggagagggaataaaaccggaacacttcatctatccagaccttatttattccgcaaaacaccctacactctcaacatcccctatcgtcaccggaatgtcgctatgcgccagcttcagaaaatccgtcagtatcaacggctttatcagcattacggtgctgcgccaaagccgaccaccatcgcggaagtggcggaggtggcagtgtgcagcgaacgccacgcgcgcaccctgctgcgccagctggcgcagagcggctggctaagctggaacgcccagccgggacgcgggcatcgggccatcctgcattgcctggcgaccaccagcgaactgagcgcgccactgatgcacgcctgtctggagaaaggggattaccagagcgcgttgcagctggcagacggtgatccggccagcctgcatcacatcatcaccccgtttttaggcggtaaatggttaaaacatcagccgacgctgcgcataccctggtaccgcgccctcacgtcgcttgatccgtctcttcagcgccgccgtgccgaacagcatattatctgcgcggttcacgctgggctgacgcgctacgcgcccggccacccgcagccg

SEQ ID NO: 95005 - DNA, 372 bp, Glycine max
  Peptide Sequence Number=SeqID_211783
atgcatgctttgttagggtcattcaacaatggaaactggtctgactctaaagtccttgatagtgtagggctgagttgtcgtgctttcacgaggaatcggggaacagggccgagaggagaaggaaacttctgcaagacaaaacagttgcatccattcttgaggaggagactcatttctatgacttattatcacctgattcaccatcatcaaggtaatctgccactcaattacctgaagccattaccatggcagaagagcatgaccagaggattgcccttgaggattattcaagtagttcagtaccataatttttcaccaacattgcacatcctaaagtacaagctaacaacatcaactatccatattccttaa

SEQ ID NO: 95006 - DNA, 312 bp, Glycine max
  Peptide Sequence Number=SeqID_211784
atgatgagatgttgcacactgattgattggcctaactctctaaaaacagtccctagtggagtcgccaactgtcgcgacctacccttcagcaggagggcgacgcgaaagctcatgggtgcgtcttccaagggaggaaggcgcgtggagtcgccaccaatgtttattcgaggaaaacgtcagaaaaaccaagatgcgtgtggtcaacgaactttaggtgtgaaaggttcgggagttgtttttacgtatggggaagggtgtttccctcgctcatatgtattccttagttgcaatgagaaaatcagacttacgtag

SEQ ID NO: 95007 - DNA, 303 bp, Glycine max
  Peptide Sequence Number=SeqID_211785
atggaagttccagacatacatctaggagagacagagaggtcgtgtttgcaagaatcaaatgacagttcctatgtccaaactcctcctcttgttggtttggaaagcttaaaggtgtgtgacataattgatcaatccactggaaattggaatgtgaatgctattaatgagatttttaataaccgtgatgcccaacaacagattttgtccatggccacttacttaaataatgatgaggatactctgatttggaaagcttgcttagcaggtatggcaaattttcagtcaactgtgattattatttaa

SEQ ID NO: 95008 - DNA, 306 bp, Glycine max
  Peptide Sequence Number=SeqID_211786
atgtggaggcactttagaaggtcccgcaaggcgtgggagatggtgcaaaagaaggacaaagaactcagaggcagtaacaacgggcccatcggcggctaccaggaggaagttgaggcaccggaggaagacgaagaggtgcaggcccttagggcaggacttgagcaagcccaaatagtcaaagaaaggttcaaatcagcagctttcaagttccgaaaagagaatgccgacctgagagatgtaaatatagctaccaccaaggccttggaacaagagaccaaaagggctcgtagggaagaacacggatga

SEQ ID NO: 95009 - DNA, 291 bp, Glycine max
  Peptide Sequence Number=SeqID_211787
atggaagccatgaatgaccaaatgaccactatgatggaggccatgatgagcatgagaaaaatggtggaggtcaacgcggctgcgattaccattacaagtgccgccactgaggtagatccgactcacccatcgggtgggaatcaagggggtgaagtattaggaagcacgggcatcccccattttgtgcaagtccaaagcaagcatcctgcagaagcatcgagtaactactttgactgtggccgtaacccatcaatgaagatgttcagctgtataggctctgaaaaaccatga

SEQ ID NO: 95010 - DNA, 150 bp, Glycine max
  Peptide Sequence Number=SeqID_211788
atggatacctcagagccctacactggggaaatgagaggcaccatgcatgagcctcaacaaaagcaaaatagaaaccctaagtgggaaccaccgctaaaccgacgggaagagcaatgcaaagaacacatgcatgaagttgggcaacaatga

SEQ ID NO: 95011 - DNA, 222 bp, Glycine max
  Peptide Sequence Number=SeqID_211789
atggaagtctttcactcaaaatttggtgaggctttggttgcttcaaatccaatggtgctcctaggatgtttaacctccaaaactcaaaaatattccttcaagcaacgcaccaatttcctcttccaatccttattgataccacatgatgtagctccatgggatttgacaattgaggatatacatggacaagaagatgaagaacaaggaattaaagtgaattaa

SEQ ID NO: 95012 - DNA, 318 bp, Glycine max
  Peptide Sequence Number=SeqID_211790
atgaggatgcgcgttactaaggctttaggcttgagctcttggagttgcgggagtctgctgtttcccatgcttgtctttgttagcgatcgaaccatctcgaaaggcgcaggaaaatctcagtcgcattcaccgggcgcataccttatcttaggtctcgagcttcaatcggcttcaaacccgcttttctcgcgtggccctccggcaaaaagaaaagaagcttcaatctgtccaatttcgcccgagaaggagtgccggttttggattctttttttgctcgcgcttccttcctgctcatgcattccttctgtctgggtatag

SEQ ID NO: 95013 - DNA, 225 bp, Glycine max
  Peptide Sequence Number=SeqID_211791
atggacatagctgcagtagtggcattctcttacacgttgcttgtgttttctgatgggaagtaccgggaagcactaggtaaatgggaagctactcttgtgttggcacctgatgttccagttgtgcatgaacaaaaggcccaagttttactagaaattggagatgcttggaatgctttattaaaggctgcaactcgagctactgaattggacccatcatgggctgag

SEQ ID NO: 95014 - DNA, 483 bp, Glycine max
  Peptide Sequence Number=SeqID_211792
atgtccatagtccatacagctgaaatgcaattgataattcaatttttccttagtccaccttttccttccccaaaaataaacaaacagcagaacctaaaacaaaccacatggggtcgggaacacgcgcgccgtcttcagcgtcagtgttggagtgttggtcgtgttgttgttgttaatgattatcctcaaagggaagttgctacgtgcacccagcattattgttggggcacccaacaaagtggcgaaaatgaccttccgcgaagactatttccggaagaaccttcttccgaaatcattccggaagatacctttttcagaaactttccggaaaaaccttcttccggaagaaaatttcgtgattccggaagaactcaggaacactttttggaagaacgtcatccggaatgtttccggaagaaggtgcttccggaagataaccttctacttccggaagaagggtttttcggaaatttttttttttaa

SEQ ID NO: 95015 - DNA, 306 bp, Glycine max
  Peptide Sequence Number=SeqID_211793
atgacatcgtggcacggtgtggtggttccctggttcaatcctttcagtagggcacttctgagacatgggatttcattgtggattgatgtgcctttagattttgtggccggagatgtacaggataaactaggcgctctgtacgataaatacaaagttggatatgctacagctgatgctattatttcagttcaaaaagtagtttctcggctgggttgtgataacttagatgaaattacaagagaagacatgacttgtaatttttatgcaagcaatttgaagcatgccatgctaaccgcttcttgttag

SEQ ID NO: 95016 - DNA, 414 bp, Glycine max
  Peptide Sequence Number=SeqID_211794
atgagtggcacaagtggtgaaggtggcattgcagtgtttctcggaactaatcaaagggatagtgcacagaaaacttgcatggcatggccactagggttgcagagcatggtgggatgttgggatccaattgacagtgccaccgaactctcctcacctttcaggatgtcactagatcatgttgacgtgtccttcgcacaggtgctgcaagtgcaagtggatcaattggatttgactgcagttttaccccatggttctagaatgggatgggcggatggcaggggagggaaaaggaaaaaggagtgtgctagacatcaacatgtggctgatcatgttggtattgatcctcgttggggttgtgctcgaaggatttggatatggctgaatgtgctagtcttggtactcaccgcacattaa

SEQ ID NO: 95017 - DNA, 390 bp, Glycine max
  Peptide Sequence Number=SeqID_211795
atgaaatctgcatgctttggacatcctcatcacgcacagactcaatggcaaaaattatctccaatggtctccatttgttcccatttcatcagtggtaaaggaaaaggtgattaccttaccagcactgctgatcctccttccaagtctaatccaaatccaactaggaactggaaattggttgatcaacatcatgaacttgaaaataggtcaaaactttatgttctattcaactgcaaaggaaatcttgggcagcatcaaggaaacctactcaacctggtgaatacttctgaatttttcaagataaaagcatccttacatcctccagcaagcactgacatcaacttgatacattttgaaactgacagttggaattgccaagatgatcaataa

SEQ ID NO: 95018 - DNA, 399 bp, Glycine max
  Peptide Sequence Number=SeqID_211796
atgcctgatggtggaaatgtacagggatgcgaattgggaagactagcagtattatacagaatgaagcatgtggaaggcgataggcattttgttaaggaggaaatagagaaggttagatttgcattcctatactccaaccaaagatcaaatttgtcgacattacgatcaaaaccttgggagaaccacatcacgaaagctagctgttgtagttggagagtccaaggccttatcaaacccacactagaatcccataatgtgggactcaagtcccatgccttacaattggatcccaacatcccaccatgctctgcaaccctagtggccatgccatgcaacttagttcacaatcctgccacaacatgggtacaataccaagaactgaaactatgcaaagaatag

SEQ ID NO: 95019 - DNA, 816 bp, Glycine max
  Peptide Sequence Number=SeqID_211797
atgggcccgaaatctaccctaaggctcataagaaccctagggccttctcttgcatatctggcccaatctacttggagttttctatccaatgcccttgcggggaatgatgtgattctcaatgattatattaataatggtaatacaactttcaaggttaaggagaaaatgacactgattgcggtgaagaaaccatttgatttagctgttggcaacacttcaaaagatcattcacatgaccattgggggaatgttgtactaaagcatttatatcattcattaggcaatgacaatggtggcatgaagtggtgtataagggaagcactcatgagctgtcctaaaattagttgtgcccctacaatgaaggaaactcttaaaattgtcaaagatggtcaggagtgctctccgcaattagaaagtttgttttatagattacagagtgaagctaatggacatgaaaatgttgtgcacaacggattttctagtgagtcaaatggccgtgatacaactgaggggtgccagcgtgtgttccgcgatatcttagcctctgaaaagttcagttcattatgtaaagtgctacttgaaaatttccaaggaacgaaacctgaaactgtatttgactttagtttgataaactcaaggatgaaggggcaagcttatgaacaatcgcctacacttttcctatctgatgttcaacaggaatcgattataataattcctattaacctgatgtccttatcagaattcagaactgtccataatcttcattgcctaaccataaccatccctaatcttcatgtcccctcaagctggaagtag

SEQ ID NO: 95020 - DNA, 105 bp, Glycine max
  Peptide Sequence Number=SeqID_211798
atgggaggagaggaagcgtttttcgcttatgaaagaaccttcttccgcatgcgtgattgtttgaaaatgcttcgtacggaagaaggttcttccaattatacatga

SEQ ID NO: 95021 - DNA, 270 bp, Glycine max
  Peptide Sequence Number=SeqID_211799
atgaagaataaaaaggttgcagcagctggtgtctcgctaagcgaggcatatgcgcttagcgagcaacatctgctaagcgagacatcaactcgcttaaagagtgaggagaatctaccacgcatgcatgcgctcagcacgccatcagctcgcccagcgagtcatttgtctctttgggcgcccatcgctggaagaagagggatatacgtgagagacgcagcagggccagggagcactaaaaacctcagctttcaagaggattctaggttttag

SEQ ID NO: 95022 - DNA, 351 bp, Glycine max
  Peptide Sequence Number=SeqID_211800
atggcatccagatgcttgtctgggtctattgtcccatcgtattgctcgtctggatctattgtcctatcatactactcaaggttgagtggttttcaccctaagggtatatctgcttccataatgcgattgacaaaaggatgccgacggacaacccatgttggacggtgcacgtgtgagagactcagatcatctacaacgttgcccatgagtagagggtgtgattcctcatgggtgcattcaggaaaagtgtgggtggattactcatcatcatggggactgtacatgtctgtcataactgtcgggcgaggatgggagtctgtgaggggggtcttacatccgaggctagactga

SEQ ID NO: 95023 - DNA, 426 bp, Glycine max
  Peptide Sequence Number=SeqID_211801
atggccaatcacaccacgattctcaaggaagcattcaacctggagatactcatttggttacctcagatgaaacctcctaggtcggggtcagacacaatcaaatactgcagatatgaacgcggtattggtcataacatcgaagactgtcagacccaaaaagataagatagaagaacttatacaggctgggtacatagcccagtttgttaagagaacaaaaaatcaccaagtaggaccaagacctagaggacatcaagaggatcagtgtgggaaccaggaagcagatagaagaagagcagaagaccaaggcaaacaaagacaccagcaacaccagcataagcgagaacctccaccagaacaggaacctgcccaacacatcagaggtgtaatcaacaccattgcttgtgacttttcctatggaggatag

SEQ ID NO: 95024 - DNA, 225 bp, Glycine max
  Peptide Sequence Number=SeqID_211802
atggttttcattagatatcttacaactagaatcgctcttttttcctatccagttcctccaccaccgcgaaccccagttagattcaggcatgatatactttttagttattgggagaacccgagtactctctttcggatccaggaaatagctctcagagatctttttttcttttggaagatacaggagcggaacaatcaacctattgatattggaagactcagatga

SEQ ID NO: 95025 - DNA, 996 bp, Glycine max
  Peptide Sequence Number=SeqID_211803
atggaagaatattttagtatttggcacaagaataaaaaaagcttaccatgcagagagagtgtgtgcatcccaagtgagcgtgagacacttttgaagtttaagaataatctgaatgatccttcaaataggctttggtcttggaatcataatcataccaactgttgccactggtatggagtcctctgccacaacgtcacttcccatcttcttcagcttcacctcaactcttcagattctcttatcaatgatgattgggaagcttatcggagatggagctttggtggagagataagtccttgtttggctgatttaaagcatttgaattacttggacttgagcggcaatagatttcttggagaaggtatgtcaattccttctttccttgggacaatgacttccttgactcacctcgacctctctctaactggattctatgggaagattcctcctcagattgggaatctctccaatttggtctaccttgacctcggaggttattctgatctgtttgctgaaaatgtagaatgggtatcaagtatgtggaagcttgaatatctttatttgagtaatgcaaacctatccaaagcatttcattggctacacactctccaatctcttccttctttgacccacctatctttgtcacactgcacactccctcactataatgaaccatccttgctcaacttctcacctctgcaaactctccatctttccttcactagttattcccctgccatttcttttgtccccaagtggatattcaaattgaagaaacttgtttctcttcaattaccgggtaatgaaattcaaggtccgattcctggtggtattcgaaacctctcacttcttcaaaatcttgacttgtctttcaattcattttcatcttttatacctaattgcttatacggtcttcatcgtctcaagttcctcaacctaatggacaacaacttacatgggactatttctgatgccctgggaaatttgacttctctt

SEQ ID NO: 95026 - DNA, 348 bp, Glycine max
  Peptide Sequence Number=SeqID_211804
atgacatgcggagatacccaagtggttatccatacaaaccaacttctgttaatctcgacccgtgaagtcaggtggcaggcggaaataccccaagtggttatccgtacaaacacacttctgttattcctgacccgtgaagttaggtggcatgcggaaataccccaagtggttatccgtacacatacagttctgctaccccgacctgtgagaagtcaggtagcatgcggagacgccctatacggcttaacactcatcgcggtggaatccgtaaagtttcgtgacatttcggaaagaaaacggccaaaaacacaaaaatgtgggggtgaacttatcaagatatgggtgtaa

SEQ ID NO: 95027 - DNA, 2037 bp, Glycine max
  Peptide Sequence Number=SeqID_211805
atgaagtctctaacgacgctctggcctatggatattctgaaaacctcttctttcgttagaatcaccgccctgtcactcttctccttcaccctcttcctcttcctcttcatgcgcttctctcccacctcttattctgatctcaccttcttctcttcgacggcagaggcaccctcccccgagcaatcaccaccaaattcgcctcctcctcctcctcctcctcctccgtctccgccgttgcctacgccgccgggagtgaaaatattccgtgtgccgccgttaccgccggtggagaggatgggggtgctggacggtagcggcgtgatgacggaggatttcaaggtgggggagttagatcccggtttcgaggaagattctctaaacgacaccttttcgagcgtttcaggtggtgggggtgtgagggagaaggtggagaagtataaaatgtgtgatgtgagaatggtggattatgtgccgtgtttggataacgtgaaaacgatgaagaaatacatggagagtttgagaggggagaagtacgagcggcattgcaaagggatgggcctcaagtgtctggtgcccccgcccaaggggtaccggaggcccatcccgtggcccaaaagcagagacgaggtttggttcagtaatgtaccccatacacgtctagtcgaggataaaggcggtcaaaattggatatcaataaagaaggataaatttgtttttcctggtggtggaactcaatttatacatggtgcagataaatacctggatcagatttctgagatggttcctgaaattgcatttggtcgcaacaccagggttgctttagacgttggctgtggagtggcaagttttggtgcttttttgatgcaacgtaatgtgaccactctttcagtagcaccaaaagattttcatgaaaatcagattcagtttgctcttgagcgaggtgtgcctgccatggtagcggtatttgctacacaccggttgttgttcccaagccaggcatttgacctgatccattgttcaagatgcagaattaattggactcgtgatgaaagacaactcaatgctactcaggcacatggctacaccacagtggcaattgaagatggaattttgcttcttgaggccaacaggctcctgcgagcgggtggctactttgtctgggctgcacagcctgtttacaaacatgaagagacccttcaagaacaatggaaagaaatggagaacctgacagctagcatttgttgggaacttgtacgaaaggagggctatattgctatatggcggaaacctatggacaatagctgctaccttagtcgagacattgatgcacatcctccattatgtgagtccaatgatgaccccgataatgtttggtatgttggtcttaaggcatgcatcactccattacctaataatggatatggaggaaatgttacagagtggcctttgcggcttcatcaaccaccagacaggcttcatagcatccaattggatgccattatatccagagatgaactcttgagggctgacacaaaatattggtttgaaataatagaaagttatgttcgggctttccgttggcaggactacaacctgagaaatgtaatggacatgagggcaggatttggaggagttgctgctgcgctgcatgatctccagatcgactgttgggttatgaatgttgttcctgtcagtgggtttaataccttgcctgttatatatgaccgtgggctgataggagttatgcatgattggtgtgaaccatttgatacatacccaagaacatatgatctgctgcatgcagcaggtcttttctctgttgaaaaaaagaggcaaaagtgtaacatctcaaccattatgcttgagatggatcggatgctaagaccaggaggacgtgtatatatacgtgacaccacacatgttataggtgagcttgaagaaattgcaactgcactgggatggtcaaataccataaatgatgtaggagagggtccctattcaagctggaagatattaaggtctgataaagggttctga

SEQ ID NO: 95028 - DNA, 261 bp, Glycine max
  Peptide Sequence Number=SeqID_211806
atggaggagatctttgaagcactccaccaaatgcacgctacaaaggcaccaggggtggacaggacatcgactttattctatcaacatttttgggatttggtggaccctaatgtttgtacaactattatgaacattttgaatgagggaggtgatccagcaaagctaaataagacattgatagctctaatcccaaaagtgaagagaccttcccatgcgggtgagctaaggccaatcagcttatgcaatgctggtcgagcctag

SEQ ID NO: 95029 - DNA, 321 bp, Glycine max
  Peptide Sequence Number=SeqID_211807
atggaaggtaagtttccggtgttgttttctcttaagtatcaaacgcagctctccttgaggtacggccttgatcacaggcttagcgtgagtttggtgctgagcaaaagttcacttactcgcgctaagcacgagaatggcgctaagcgcaacgtcgagtttttgagtgattgtgagattcttggaggtggaggaaacatcctgatgcaatcctaccccgcaagggcattgcatagaagactccaagaagattgggccaaagatgcaagagaaggccctagggttctcatgagccttaaggtagatttcgggcccatgggctaa

SEQ ID NO: 95030 - DNA, 174 bp, Glycine max
  Peptide Sequence Number=SeqID_211808
atggaggaaaatacatctccaattaacaaaggacaatggcagcttcattctccaaatcttgctactgtcgaggatacgttcgccgaccttgtgatatcggatgcaactgctcttgcatacccatgtcaatcaagtcttgatgaaatttcaaaccatcctttgactagcctttaa

SEQ ID NO: 95031 - DNA, 354 bp, Glycine max
  Peptide Sequence Number=SeqID_211809
atgccacatcctatcagaccattgcgtcccgacatccttcagcacatgtcactctcactaagtaagatcatagggagaccagtcagggtcacgatattttgcgagaatgctccatccatatgggatcaacataggcttaaaggagcactcaaacccaatgatgaggacatgaccaagagcaagggcaaggatccacttgaaggacttggagggcctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 95032 - DNA, 195 bp, Glycine max
  Peptide Sequence Number=SeqID_211810
atgaaacttcaccgtaaagtcaagcaggtacttgagggcacctcggaaaacaatggagtttgccatgatccactagtggctcaggggcgagggccaggaaagatgaccgatccaggtctaaaaaggaagaagcaccggatgacgccgatcgaacatttcctaatagaaatcgtccaaatattatcgggggattga

SEQ ID NO: 95033 - DNA, 231 bp, Glycine max
  Peptide Sequence Number=SeqID_211811
atcataactaatggaaggcttgttggtgctgaacaccgagctgtgacgaattcgagcagtgcacgcacaagtgttgcctatttcgtctatccatcatttgaaagcatcatagaacctgcacaagctttgatcaatgaaagcactccagcaatatacaaatccatgacattcggagagtttcgtagaaatttctttcaaaagggtcccaagattgaagaagaactgcaatag

SEQ ID NO: 95034 - DNA, 318 bp, Glycine max
  Peptide Sequence Number=SeqID_211812
atgggaaatcgagcttccaaccaacttggacctatgatattggattttgcaaagggtgctaaatcttctatgaaagtggtgaagcttaagaagggaccaagaaaggcatgggaagagttgttcatggtaaagggtaacaatacccatgaatgtcaaatcttgagactttcttcttcgagtgtaggcacatgtacaaactttcttcactctacttatagctctattgcgataaaaatgggaaaaagtggaggaagagccatggaaggatgcaggagaaagagattgaatcttgatgagaagaatcacaatgattgttga

SEQ ID NO: 95035 - DNA, 219 bp, Glycine max
  Peptide Sequence Number=SeqID_211813
atgactgtaggggcaggaatatctgttgcagatgggaacttgatggtgttggggaacaaagtgctgagccatgtccatgacaaggttcttgttacccctgcatgtggtggtgctttgctcaatggggcattcattggggttcaatcccatcacaagggtagccgcacagtcttcccaattggcaagcttcagataactgcaattctgatcctaggatga

SEQ ID NO: 95036 - DNA, 219 bp, Glycine max
  Peptide Sequence Number=SeqID_211814
atggataacatcacagcaagtgaagtagctggtttcggagtgggtgctgtgctcctctgtgccactgttgctgccaccaaagtcgatgctttcttctcttcttctcagcgcagtcttgctgcttgtatatattatacccagcaggttatcaatattggtaaactacttcagtatttgattctatgccatggtgatattgaacctttcacagacccttga

SEQ ID NO: 95037 - DNA, 371 bp, Glycine max
  Peptide Sequence Number=SeqID_211815
atggagaccttggatcagatgcttgtgtctagttggtacaatgttcattcctcggtgcccccatcctttgtgcaattaccagaaaacaggcctggcagggtggttagttctttgcataaggcaataccggtgattgattttggaggacatgaccttggtgataccacaaaacaagttttggaagcctccgaggaatatggctttttccaggttatcaaccatggagtttccaaggatttaatggacgaaacaatgaacatttttaaagaattccatgccatgcctcccaaagagaaggactcactaacacatccttgtcctccttctggggaatacatggagtattggccacaaaaaccatccaaataccg

SEQ ID NO: 95038 - DNA, 300 bp, Glycine max
  Peptide Sequence Number=SeqID_211816
atggaagagacaacaacagaggcggcgagaactgggttttcctgtgagagtgagacgaaagaaagtggtgatgctcaagaacgacaagagaagggaactgtgagtgggggtgtgagaggagagaccgagagagacagagtggacgtgaagcggaccaaagttatgaaattcgatccgatgagtgatccaatccaggtcatctcgagtcaaatgcacaatcaatccaataaccaaaccaatccgattatgtcacaagatccgttagactggtccaacagttttgaacaatacgctaaataa

SEQ ID NO: 95039 - DNA, 372 bp, Glycine max
  Peptide Sequence Number=SeqID_211817
atgatagagacaatacaaaaatacaataaaataaagaattattcactagcggcgcggccaaaggggaaccaccacagagggtggcgcgctgcccccgacatcgctagtactaggcccgacaatacaagaccaccacaggggcaacaacggcgtgacggtggcagagatcgtgtaggcctcgccgccggccatggtggagtccctaaggagggcggcacggtgggtcaaaaaagaaaagaagaagaagatgatgaagaagaagaagaagaaggaggaggagaagaagaaagaaagagagaagaggggaaacgtgaggatgagggagtgaggaatgaggggttacctgatgacccatcttctagcaccgtctaa

SEQ ID NO: 95040 - DNA, 324 bp, Glycine max
  Peptide Sequence Number=SeqID_211818
atgaaggggtgtagggaaggagaagctgctacaggagggaggggtgccgctgttgtgagtgtgccatcaaagaagggatgttgtcgtgggttgagagaaaggagaaaagaggcgtttgggttgggaaatgagagctcctcccaagtgaagctcccaagcgtttcctccattgttgtcgtgattaggaggaaggcttcttcttcgcgtttctgcttcttcttagaggtaagtttctccttcgcgtttctgcttcttccaccattgttgccggcgatggcggaaaccgctatcaggaagttgctaggctgtttacggatcacttga

SEQ ID NO: 95041 - DNA, 165 bp, Glycine max
  Peptide Sequence Number=SeqID_211819
atgaggatgactggacagagaagaagtatacttaacaagcttttctcatcagttctagcatttgactcacattcacctgctaaagaaactaaagtagcaactgatctcgtgattcaacaacagcaagagccaaggaaaagacagactactctccagcacaagtaa

SEQ ID NO: 95042 - DNA, 495 bp, Glycine max
  Peptide Sequence Number=SeqID_211820
atgggcaagaaaaagttaatgcttttcctcttccctttcttccccttcccaaaatttgaaaaccagtttctaatcactgttctcacttgcgtagaggtgaaagatgctgttacctccttgagtgcccaaaagtctattactaagaaaaagaaaaagagcaaacaacaaaggcggcagaagaaattgaaggcatataatctatcttcacttttagagtcccttcctgaggtgaaggcatcaaagaaaccaggttgtgcgaatgacagcaaacttacgtgtaaatccaggcagatgctagtattgactgaaagagatcgaatttctgctgttctcaatgatcctaactttcaagcagatcccctgtctgccattcatcaatatatacagaacaaacaaccggtagtagaggaacaacccaagaaaaaagtgaacaaaaatggatccaggaagaagaaatcaaaggcttcaactgggctacaatctatggaaatgtag

SEQ ID NO: 95043 - DNA, 375 bp, Glycine max
  Peptide Sequence Number=SeqID_211821
atgtcggagatgttgaggagagaaagggtagacattgtttggagaatcacgaggttgaccttgccaaatcatgcatccacggactccgcaccacagtcctctgcatcgacactgtcatcggccgcactgactctatttaaggtgtccatcgagctctcaacttcaaagattgtcagcctatcgaaaagagggtggcacaggattattgtcagcgtccaacgacaaaaagtgcaagaaggatgttgtggtgaagatggtgggcgcgataagtgtatgcatacctatggtactctctcacatatctcaaaaaccactatatcgaacgcaccaccttatctttgcatggtgagagcatcgagccctttcccatgctag

SEQ ID NO: 95044 - DNA, 387 bp, Glycine max
  Peptide Sequence Number=SeqID_211822
atggaaaagagggataggtcttcaccatctaaatcctgcaagtttgataaccaatgtttatctcgtgagactcaactggatgcatctaatggttcaaatgttacaaaacctttaaccaaaatgcttctagatctgtgctttgttcaagaattcgatccaaagcattgccactatcaaaagatgacatgtttcgggggtctatcttccattgctttatcttttcctttcgaatccttttttggtgatggaatatcaatgaccttccaagtgcacgataggctcacaatctttgaagtcaagagctcgatggacaccttaaatagagttagtgcggccgatgacggtgtcgatgcagaggatcatggtgcggagtccgtggatgcatga

SEQ ID NO: 95045 - DNA, 804 bp, Glycine max
  Peptide Sequence Number=SeqID_211823
atggctgatgcttctgtggcaccaccacctccactgaaagatgagcttgacattgtgattccaaccataaggaaccttgactttcttgagatgtggaggccattctttcagccttaccatttgatcattgttcaagatggtgaccccaccaaaaccatcaaggttcctcctggctttgactatgagctctacaaccgcaatgacatcaacaagcttttgggtccaagggcctcttgcatctccttcaaggactccgcgtgccgctgttttggctacatggtgtccaagaagaagtacatctacaccattgatgatgactgctttgttgccaatgatccatcaggaaaagcgatcaatgcacttgagcagcatattaaaaatcttttgtgtccatccactcccttgttcttcaataccctttatgaccccttcagagaaggtgcagattatgttcgtggataccctttcagtcttcgtgaaggtgtgccaactgctatttctcatggactttggctcaacatcccagactatgatgctcctacacagcttgtgaagcctcttgagaggaacactaggtatgtggatgctgttctgagcataccaaagggcactttattccccatgtgtggaatgaacttggcattcgatcgtgatctcattggaccagccatgtactttggtcttatgggagatggtcaaccaatcggacgctatgatgacatgtgggctggatggtgctgcaaggtccacttctttgttttatttttcactataacatcaacacaatcttatagaaacagttaa

SEQ ID NO: 95046 - DNA, 657 bp, Glycine max
  Peptide Sequence Number=SeqID_211824
atggcaaaagaagaggaacaacaacaacccacttcaccgatgcacccaccttacgcttacaccataattctgaacatcttcagcaagagaagaacatgggcgtgtctatttctattggtctacggcacccttttgacttcttcgtggaacttcctcaaatccacgctttcttggtacaatctgcaggttgagtcctccaccacctcggcgtggcctgcactctatgcttcagtgcttctgggcaccgtgtttggggtactttccatggtggcggcgctggtggttatggttcccgcgctggtggtgacgtggatcacgattgtggtgcttctggccttctttgggaagcctaagaggacccttgtggtggaggggaggaagattacgagggagattttcgggtttgtgatgaggactctgctcaaggaagggaattttgtggctgcggtttgtgctgttttggggtactttgctcttgttagaaggaatgggactcaaggtggggttgttgttgttggtgaatcatatgtgattgtgctactgaagttcttgtactcaattttgctaattgtttatcaaatgtttctgaatttggagtgttcaactttggattatctgatcgagcaagcgtttgtgccttttaggttttacgcttga

SEQ ID NO: 95047 - DNA, 228 bp, Glycine max
  Peptide Sequence Number=SeqID_211825
atggctaagaccaagacaggctctcatgctggcttggatatggactctcaactttgtaaggtgtcgattctgaagcatgatcatgctgaatctttgaaactatgggagatctgccaacgcagtggtgcaaagtgtaaggcaggatgtaggctcaaatggaggaaagtgaggaagttgttgccagatgaggatgttgataaggctttcttccaagagacaaaactttaa

SEQ ID NO: 95048 - DNA, 159 bp, Glycine max
  Peptide Sequence Number=SeqID_211826
atgattctgtacctcttgcacaccttatgcaacatagaaccagagaaattcaacaaatttgtgagatcctcagatacccttttggattcttatccaaagggtcactttctattgatgaaatggggaatggctatgcttcaaccatgtagaaggaagtaa

SEQ ID NO: 95049 - DNA, 886 bp, Glycine max
  Peptide Sequence Number=SeqID_211827
actctttgcccgtagccattttgtgaaagcaattgagttgggactgatacttgtaatttatgcatcacatagtcctgtagcaactgacacatttgtttatatagccttgaccatcactagttggttcttagttgcatcatggattatggcaccatttgtgttcaatccttctggctttgattggttaaaaactgtttacgattttgatgactttatgaactggatttggtacagtggaagcgtatttgctaaggctgaacagagctgggaaaggtggtggtttgaagagcaggatcatctaaaggtaactggcctttggggaaagcttttggagataatcttagatcttcggttcttctttttccagtatggaattgtctatcagctaggcatttctgatcacaataccagtattgctgtttacttgctatcctggatttatgtgtttgttgtatctgggatttacgctgtggtagtttatgcccgaaacaaatatgcagccaaagagcatatctattatcggctggtccagttccttgtcataattcttgcaatacttgtgatagttggtttgctggaattcactaaattcaaattcatggatattttcactagcctgttggcattcatacccacgggctggggcctgatatcgattgcccaagtattccggccgtttttgcagtccactatcatttgggatggtgttgtttcagtggctcgtatatatgatataatgtttggagtcattatcatggcccctgtggcactactatcatggttgcctggatttcagaatatgcaaaccagaattcttttcaatgaagcattcagcaggggccttcggatattccagattgttacagggaaaaaatcacagagttga

SEQ ID NO: 95050 - DNA, 639 bp, Glycine max
  Peptide Sequence Number=SeqID_211828
atggggttcgcctggaaaatcctcaacatcaataacaacttcttcaacagatgcggtaagccttcgtcgctggggcatcattatcatcgtcactcacctctcttcttcgcggggcttttcctattgctcagcctaaagaagaaccatgaaccaccaacaagacgaagaactagaaagaagaagcaacgtgcatgcgagtgtgagactgaagatgaagaagtagaggaacaagaagcagaggacaaagaagaagaagaggcaacgcgagggaggaagccaaaaatgttgggtgtccaaagcaacaccctagtgggaaaatatgagtatggattcttgtggggggagagaatagtcttgggtgatttcaaaataacatctcgagaaaggtgggtgatcgaagagatgtatgcttttggaaagctaaatgggtggaatctaacatggaggagaccttggattcaatgggaaatacaattagtgaataagttgtgggacatcattggggtccatgggctaaaacagaacatgagtgatgggtgggtgtggaagctaaacggtggaagtgaatatgtaactagtgaagtttatgaggctctctatggggagggaggtgatgtggatgaagagttgtataaataa

SEQ ID NO: 95051 - DNA, 855 bp, Glycine max
  Peptide Sequence Number=SeqID_211829
atgagtgagagagattcacaaacacctggtgtggatagcttcctttacttgcatccaagcgaaaatccagcggtatcacttgtttcaccagttcttgattcttcgaactatcattcatggagcagatcaatgatgactgctttgagtgcaaagaataagcttgaattcatcgatggagtgaaaatggcctgtaattactatgggaagactggacatactgagaaagtttgctataagaaacatggagttccttcaaataatagtgaaaggaacaagtccagcagtcataggagtgggaaagtatgtacttattgtggaaaaatgggtcacattattgatgtatgctacaaaaagcatggattcccaccaggttacaggttttctaacccaaggagcagtgctaacaacttggtagcaagagatgatgtagtcaccaatgatcaaacacagcttttagagtccaaggagattcgtttttcacctgagcaatacaaagcattgcttgctttaatccaacaaccaactgatgggaacttagctaacatatcatccaatcttaaacagatagcctcctattctgttgacacaacaccagctcatgcctcacttgatctttttaaatcctacactcagttgaatcctcctactgtagttagactaccaaatggccatcatgatgtgatcactcaagcaaagattggtacaattgaagtgataaatggattgtattacctcaccccaaactatacggccatatccaacattgaaaccaacattgttcatccacattgtaccattacacctatagatctttggcacttcagaatgggacatctttcctttgaacgtttatga

SEQ ID NO: 95052 - DNA, 1263 bp, Glycine max
  Peptide Sequence Number=SeqID_211830
atgctgaagcatctcaacatgattgttggcttaaagcgatgcaagccgagttacaagctttacaaacgaataacacttggacccttacagacttaccagctaataagaaagctattgggtgccgttgggtttataagattaagtatcatactgatggctccgttgaacgatataaggcttgacttttgtgaagctcacaacagtccgattattgttagcataggctactattcatggttggcaccttcgtcagctcgatgtaacaatgcattccttcatggagaattaaatgaagaagtcaatatgcagctacctccaggaatgcaagtctcacaccctaatcaagctagtcgacagtggtttcatcatttgtcctcatttcttcttactcatggtttctctcaagcttcatctgatcattccctctttctctgtttcaatgataactcatttactgcacttttggtgaaatatgttctagatattctctctgattctggaatgcttgcatgccatccaacttcaaaacctatggattgtactactcatcttcaagcaggcataggagatcctttatctgctgaagactcctcttcatattgtcgccttgttggtagtctcatctatcttactaacactagactagatatttcttacactgtgcagcaattgagccaattcatggctaacccaactaccgatcactcaaaagtcgcctctcgggttcttcgctatctcaagagttcatcgggatgtggaattttctttcctacaattggttcaactcgtcttcaagcttttagtgattcagactgggccggttgccgtgacacacatcgctctattacaggcttctccatcttccttggtaattctctcatatcatggtgctccaagaaacaatccactgtctcaagaagttcatctgaagcagaatatcgtgctttagctaccaccacatgtgaacttcaatggcttaaatacctttttcaagaatttcgcattccattcactcagccagctaatgtattttgtgataatcaatctgctattctaattgcttccaatcaggttttccatgagcgcacaaaacatatcgaattagattgccatatcgttcgagaaaaatcactaaatggccttctcaagcttcttccagttagatcctccatgcagcttgctgatgtttttatcaagcctttatctcctactcaattcaagactctagtttctaagctaggaatgatgaacatctattcctag

SEQ ID NO: 95053 - DNA, 318 bp, Glycine max
  Peptide Sequence Number=SeqID_211831
atggacaatttgaagaaaaggaacattatttccaatagtactagcattgaatgcatatcttgtttgaatgcaagtttgcacatagaatttggacacaaatgctacactcgatttggagatttgagggttatgttggttgattgtatattccatttttggcaacacaagggtgcggtctttgggaagcaaacatgtcttgtatggtggtctatgtgggttgcggtgttatggactatatggaagaggagaaacaacatcaaattcaacgcagctcaaggtgactatgtgggagtgttggatgaggcaaatttctggtga

SEQ ID NO: 95054 - DNA, 255 bp, Glycine max
  Peptide Sequence Number=SeqID_211832
atggaaggtggtgttgggagtgagggaatcatcccaaagctcttgcattgtggtggggcaagggaagtggtccaaactgaaccatttgagaatgttgctcctctcataggtctagccgatgcaaaggcttacgaaggcgcgccaagcgagcatgtctcgctaagcgcgagtaagtggttgtgcgctaagcgggcttggatgcgcgaagcgcaagaagagacaacgtcttcgctaggcaggctggctgcgcactaa

SEQ ID NO: 95055 - DNA, 1905 bp, Glycine max
  Peptide Sequence Number=SeqID_211833
atggcagtagaattaattgctggtgctcttctttcttctttccttcaggttgcatttgaaaagcttgcttctcctcaagttctggacttctttcacggaaaaaaacttgatgagacgcttctgagaaagttgaaaattaagctgcagtccatcgatgctctggctgatgatgctgaacgaaagcagttcgcagatccacgcgtgagaaactggcttcttgaggtcaaagatatggtttttgatgcagaggatctcttggatgaaatacaatatgaattctccaaatgggaactcgaagctgaatctgaatctgaatctcagacctgtaccggctgtacttgcaaggtaccaaatttcttcaaatcttctcctgctagttcctttaacagggaaattaaatccaggatggaaaaaatccttgatagcttagaatttctctcaagccaaaaggatgatctaggcttgaaaaatgctagtggcgttggcgttggatcagaattgggtagtgaagtaccacagatatcacaatcaacatctttggtggttgaaagtgatatttatggcagagacgaagacaaaaaaatgatttttgattggctgacatctgacaacggcaatcctaaccagccatcgatactttctattgtgggcatgggtgggatgggtaagaccacacttgctcaacatgtattcaatgaccctaggatccaggagactaaatttgctgtcaaagcttgggtctgtgtttcagatgattttgatgttttcagggtaacaagaacaattcttgaggccatcactaaatcgactgatgatagtagagacctagagatggttcacggaagattgaaagaaaaattgacggggaagaaatttcttcttgttttggatgacgtttggaacgaaaaccgacttaaatgggaagctgtgctaaaacctcttgtttttggagctcaggggagtagaattattgccaccacacgtagtaaggaagttgcttctaccatgaggtcaaaagaacacctcctggagcaattacaagaagatcattgctggaagttgtttgctaaacatgcattccaagatgataatattcaaccaaatccagattgcaaggagattggcacgaagatagttgaaaaatgtaaaggacttcctctggccttgaaaacaatgggaagtctattacacaacaagtcatctgttagggaatgggaaagcatattgcagagcgagatatgggaattttcaacagagtgtagtggtattgtaccggctttagcactaagctatcaccatcttccttctcatctaaagagatgttttgcttattgtgccttattccccaaagattatgagtttgataaggagtgcttaatacaattgtggatggctgaaaattttctacaatgtcctcaacagggtaagagtccagaagaagttgctgaacagtacttcaatgatctattatcaaggtgcttctttcaacaatcaagtaacatagagggaacacattttgtcatgcatgaccttctcaacgatttggcaaaatatatttgtggggacatttgtttcagatcagacgatgaccaagcaaaagatacaccaaaagcaacccgtcatttttcagttgcaatcaatcacattcgagactttgatgggtttggaactctatgtgacacaaaaaagttacgtacttatatgccaacaagtggcagaatgaagcctgattcccgctaccgttggcagagttggcattgtaagatgccaatacatgaattgttgtccaagtttaattacttacatatcttatctctgtctgattgtcatgacctaagagaggtgcctgactctatagctgaattgttgtggaagtttgaaggagctgccctcaaatttgcataa

SEQ ID NO: 95056 - DNA, 1272 bp, Glycine max
  Peptide Sequence Number=SeqID_211834
atggctacagactttggtacattcatgcaccagttaccaactagaagggatgctgttatgaatgagaatccaactacagagcaatgcgcacagaataagaataatacaaatgatgaggatgatgtaacaggaacagagcatgcaatagagagcagaaaagaaggagaagaaagaccaaaacaagaggtgtctccctttagcactgcatttccaatttcctccaaggaaaacgaaaaacttgacgccctgattcatcgtattgaggccttggaacatacagtccatcactcaccgaccccttcgtcctcatcagtcacacctgtagtaaacccacccaacaatcaccctccacgaatgaaacttgacattcctaggttcgatggatcagccccttcggactggatattcaaaattacacaattttttgaatatcactttacccctgaggcaaacagacttactataacatccttctacatggaagggtcagccctagcatggtttcagtggatgatgcgaaaccatcaactcaccacttggccttgcttacttcagaccattgaggcccgattttctcactcattgtacgaggatcctactggactcctctgcaaattaacacaaaaaggaacagtaaaggattacctgaacaactttgaagcccttgccaacaggattgttggcttgcctccttcctttctccttagctgctttatctctggcctcgaccccgacatctgtcatgaggtgcaagctctccaaccattttccattgtgcatgccgcgggactcgcatgcctcatggaggacaaactccatgaaaaccgcaaagggtttcgtggccgccaatcaccaggacccacctttacttcgccacctccaggacccacctttactttgctgcctccaggacccacctttgcctccgcaccttcaagcccatcctttgcaccaccctcgtcaccaacccccttcgttcaacccttaccagcccttgttcccacaaataaccctaacctaccccttttaccctctccgaccaaaccccttcctcttcctgtctggcgcctcactgcaaaggaacttgccaaccgcagggagtgcaatttatgctttaattgtcacgaaaagtttacaaggggtcatcgttgtgccccacgattttttcttcttgccgcggacgaggactctgaagacacgaaccctaatatactctcaccacataaccctattttagaagacccgacccttatgacccgcaccgacccataa

SEQ ID NO: 95057 - DNA, 3042 bp, Glycine max
  Peptide Sequence Number=SeqID_211835
atgatcgttaattggctcacatctgacattgacaattgtagcgaactatcaatactttctattgtgggcatgggtgggttgggtaagaccaaacttgcccaacatgtattcaatgacccaaggatagaaaataaatttgatatcaaagcttgggtctgtgtttcagatgaatttgatgttttcaatgtaacaagaacaattcttgtggaagtcactaaatcaactgatgatagtagaaaccgagaaatggttcaggaaaggttgagattaaaattgacaggaaagagattttttcttgttttggatgatgtttggaacagaaatcaagagaaatggaaagatttgctaactcctcttaatgatggggctccagggagtaaaattgttgtcactacacgtgacaagaaagttgcttcaatagtgggttcaaataaaatacattccttagagctgttgcaagatgatcattgctggcgattgttcgctaaacatgcattccaagatgatagtcatcaaccaaatccagacttcaaggagattggtgcgaagatagtagaaaaatgtaaaggactgcctctggccttgacaacgattggaagtctattacaccaaaaatcatctatttcagaatgggaaggcatattgagaagcgagatatgggaattttcagaagaggatagctctattgtccctgctttagcactaagctatcaccacctcccttcccatctcaagagatgttttgcttatttcgccttattccccaaagattacaggtttcacaaggagggtttaattcagctgtggatggcggaaaactttttacaatgtcatcaacagagtaggagtccagaagaagtcggtgaacaatacttcaatgatcttttgtcaaggtccttctttcaacaatcaagcaacataaagggaacaccttttgtcatgcatgaccttctaaatgatttggcaaaatatgtttgtggggacatctgcttcaggttggaagatgatcaagtaacaaatataccgaagacaacccgtcatttttcagttgctagcaattacgttaaatgctttgatgggtttcgaactttatacaatgctgaaaggttacgcacatttatgtcatcaagtgaggaaatgagttttcattactacaatcgttggcagtgcaagatgtcaacagatgaattgttctccaagtttaagttcttacgtgtcttatctctgtctggttattctaacctaacagaggctcctgactctgtaggtaatcttaaatatctccattcattagacctctcaaatactgacatagaaaaattacccgaatcaacatgttcactctacaacttgctaatactgaagctaaatggttgtaaacatttgaaggagctgccctcaaatttgcataaactcactaatttgcatagccttgaattaataaatactggagtgagaaaggtaccagcacatttgggaaaactgaagtatcttcaggtatcaatgagtccgtttaaggttggcaaaagtagggagttcagtatccagcagctaggagaactcaatcttcatggaagtctatcaattcagaacctgcagaatgtggagaatccctcagatgcattagcggtggatttaaaaaataaaacacaccttgtcgaggtagagttagaatgggattttttctggaaccctgatgattcaacaaaagaaagggatgaaattgtaatcgagaatctacagccttccaaacacttggagaagttgaggatgaggaactatgggggtaaacaatttccaaggtggttattaaacaattcattattgaatgtggtatccttaaccttggagaactgtcaatcttgtcaacgtttgcctccccttggacttttgccattgctgaaggagctttcaattgaagggcttgatgggattgtgagtattaatgctgattttttcgggagtagctcttgttcatttacgtccttggaatctttgatgttccacagtatgaaggaatgggaagaatgggaatgtaaaggtgtgacaggtgcttttccacgtcttcaacgcctttctatagtgcgttgtcccaagctgaaaggtttgcctccccttggacttttgccatttctgaaggagcttttaattgaaaggcttgatgggattgtgagtattaatgctgattttttcgggagtagctcttgttcatttacatccttggaatctttgaagttcttcgatatgaaggaatgggaagaatgggaatgtaaaggtgtgacaggtgcttttccacgtcttcaacgtctttctatagaggattgtcccaagctgaaagggcacttgccagagcaactatgtcatttaaattatctaaagatttctggatgggactctctaacgaccattccgctagatatgttcccaatactcaaggagcttgatctctggaagtgtcctaatctacagaggatttcacaggggcaggctcataatcatctccagactctgaatgtcatagagtgcccccaattagaatcattgcctgaaggaatgcatgtcctccttccatctcttcatcatctggtcatatatgattgtccaaaagttgaaatgtttccagaaggaggtttgccatcaaatttaaaagaaatgggtctccatggtagttacaaacttatctacttattgaaaagtgccttgggaggcaatcactctctagaaaccttagatattggaagagtggatgttgagtgtcttcctgaggaaggtgtactgccacactctcttgttaatctatggataagggagtgtggagatctaaaaagactggactacaaaggtctctgccacctctcctctctcaagacattgcttctttgggactgccccaggctccaatgcttaccagaggagggtctgcccaaatccatttcaactttgacaattcggaggtgtcggttgctcaaacaacgttgccgggaacccgaaggcgaagactggccaaagattgctcacattgaagacgtgtattgtgaataa

SEQ ID NO: 95058 - DNA, 201 bp, Glycine max
  Peptide Sequence Number=SeqID_211836
atgccgcgacccactcagtcagtcactcaggcacagcgccacaaagatccactctctgccacgagcccgcaacccactcacaaacatagctcgccgtcgcgaccccgtgccactgcttttccgcgaccctacgccgccgcgaacgctcaccctccatctttcctcaccttgttcttagaccttagaattgtgagttggtga

SEQ ID NO: 95059 - DNA, 354 bp, Glycine max
  Peptide Sequence Number=SeqID_211837
atgtcatcactcaacaacttgtacgttgcattggcctttgcgttaagcttaaatttgttgattaatatgtctctatcttcagaaactcctcaaccgtcccagggtccttccaattcaaagccattgtctgcgtacgaaaaatatcttagtgattgtgcaagcaagttgaagccacactgtggtgaacaaatcttcttcagtgtgtttgttggaaatcaaacggttaccaaccgctgttgtctcagtctattgaatgacatgggaaaagcctgccacacagacgtcacaaaatatgcagtgacattgccattgttcaagcagaacctaactcaaattttaaagaggagtgagaag

SEQ ID NO: 95060 - DNA, 933 bp, Glycine max
  Peptide Sequence Number=SeqID_211838
atggcacatcaagaaagtgcacatgaagaaacaactcatggtcttggctatactccttcatattctcctcctgcaacaccaaatgaatccataacaacacctaaattagaagaaacaaccaataatttggaggggacaagtaggcttaaaagtgagatttcaaagcattttaaaaatatcaaagctaatggagaagacaaggcccaatgcaattattttttcaaactattgggaagaaaatcaaagaatggaacaaagcacctatggggccatacaaatatttgtattcagtacaagagtgccatgagaaggaataaaggacaaacatatcttgtgcctaaggtggtccaaggaaaacaagagttgggtacaggaacttatgatgcggataatgcaaggaaagagcttgcaaagacaattattatgcatgagtatccacttttaattgtggatcatgttggttttaagagatatttagtagctttacaacctgtctttcaagttccttgtggaaacacaatcaaaagagaaatcttcatgatttatcaagaagagagatcaacacctttgaagttattagatagtcttcaaggaagagttgccatcacatcagacatgtggactgggagcaatcaaaaaagggagtatatggttctcactgctcattatatagatagttcttggaccttaaaaagtcaaattttgaagttcatttatgttcctgctccttactcaagtgaaaaactttgtaatgttttagttgagtgtttgatggattggaacattgatacaaagttgtctactatcactctagataatagtagcacaaatgacaaaatggttgacaaaattaaagataagttgcacttaggaagtttactaagggatgagactttacttcacatgtgttgttgtgcacatgtgaaaacttaa

SEQ ID NO: 95061 - DNA, 171 bp, Glycine max
  Peptide Sequence Number=SeqID_211839
atggttgtattacctgagtcctatgtaccactcgtggtagacttggtggatcttgtgtctaaggatgaagaagaggatttggaggaggatacatctattgaggaggatccatctatgaataaagatgaccttgccattgagctggagctgatggaggaggactcttcatag

SEQ ID NO: 95062 - DNA, 186 bp, Glycine max
  Peptide Sequence Number=SeqID_211840
atgtcaatgaaaaacctcatcgagcacctaggagtacatgacaagacaaatcacacactaggagaccagtcagggtcaccctgttttgcgagaatgcttcaaccatgtgagatcgacacagacttaaaggagcagtcaaaccaggtgtatttacccccaaggcctacactccgaagagtatgttag

SEQ ID NO: 95063 - DNA, 432 bp, Glycine max
  Peptide Sequence Number=SeqID_211841
atggctccctgtaagataaaagccacagttacattgtcccaggccagttatgactcatccagatttgtatcaagggatgcgtgggaccgttacacagataacatcatcgatcagaacattcttttgaagaggaatgtgaagctatacattaatgagtttgatgacttcaaaagagaagtcgagagaaggaactggcacagggagctcactaatttttctgatggaagcatcgatgtggcaattgttaaagaattctatgcaaacctatatgtccctaaggacaaagaacaaaagcaagttagggttcaaaggcacctgattaagttcgatgcggactccctcaacactttcttgaagactccaatggttgaggccagaccctcaagagctggcaggccggttgtgtatcctaggaaggggatttgttcttaa

SEQ ID NO: 95064 - DNA, 411 bp, Glycine max
  Peptide Sequence Number=SeqID_211842
aaacgtctcgatcgggcatggaatgccgagcgggccgatgagctctccaatggagctttgccggagttcaaggatattgaggatattcaggacagtctgcgcgcattgaacccgaaggacgccgcgcaaggctctctccaaacacgcgcgcttgaagtcagcggcatgattgcagaagggctgcctgtcccatttctcatcgtgctgatttcatggctggcgcttttattcgcaacttttggcctacaggccccgctaaacagcactgtcatactgataataatcgtatgctcattgtccgttgccggcgcgattttcgtgatttcggatatggcgagtccctatgccggactgatccacatttccgaaactccacttcgcactgcactggatcgtctcggcgcaccataa

SEQ ID NO: 95065 - DNA, 942 bp, Glycine max
  Peptide Sequence Number=SeqID_211843
gaggtggccgagaccgttgcgagcggtcagacgccggtcctgtcggtgaagaacctcgtgacgcgttttcccatccggtccggcctgctggcgcgccagacgggtgcggttcacgccgttgaaaacgtctcttttgatctcttccagggtgaaacgctgtcgcttgtgggcgaatccggctgtggcaaatccactaccggccgctcgatcatgcggcttgttgagccatcgtccggcgatgtgtcactcgatggttatgacgtgatgcgtctcgatacggtcgggctccgcaacatgcgcaaatccgtgcagatgatctttcaggatccgttctcctcgctcaatccgcgcatgacggtgggtacggcaatttccgaacccttcatcaagcataaattgggcaccacgaaacaggcgaaggaaaagacggccgatcttctcgaaaaggtcgggctttcagccgacatggccaatcgctacccccatgaattttcgggcggccagcgccagcgtatcgccattgcccgtgcgctcgccctcgatccgaaggttatcgtcgccgatgagagtgtgtcggcgctcgacgtctcgatcaaggcgcaggtcatcaatctcatgctcgatcttcaacaaagtctcgatctagcgtttctgttcatctcacacgatatggccgtcgtcgagcgtgtaagccatcgtgtggccgtcatgtatctgggcgagatcgtagaaatcggaccgagatcggcggtatttgagaaccctcaacatgattatacacgcaagctgatggcggctgttccggttcctgatcctgaccgacgccgggtgaagctttcaagcgaaacgggagaactcaaaagcccaatccgtcccgcggatttcgttgtgcctttgcgcgaatatcgagaggtatcgccgcagcacttcgtggcgttgtag

SEQ ID NO: 95066 - DNA, 375 bp, Glycine max
  Peptide Sequence Number=SeqID_211844
atgggaatggatattctgttcaacactggtgacgataataaacccaaaaaaatcattattgcgctaagctgcaattttgcgcagaccggtttacaagagctttgccgttcactcccgggatgtgaagtgcaaacgatactgggtgcgccagaagcgatatcagatgagctcatgtttagttatgccgatttagtgattaccgacctgcctcgtgatgcggcaggtctggcagagttacttctcattcctgaatggttcaaaggcagcacgttgattttattggatgaagaagctaaggcgatgcgtcgcacactcctggatgcagacttcagtgatgtggtaatgaaaaaagaaaaattaacgacgctgcatcag

SEQ ID NO: 95067 - DNA, 261 bp, Glycine max
  Peptide Sequence Number=SeqID_211845
atgtcagacaacaacgatgctcctcaaataaaaacccaccgatgtagacatcagttgaggagttataaaaatgcatttaatgggcatggaagaacaaataagaccaaggtgaaagacatcgtcactatttttggtaagacacaaaagaaggatcatgctgacaagaacatttggaagaaaatgcaagacaaaagatggtctgaaatgtcgtcaggatttggtggagatgggtatacgacaacagttgcatccgtaggctaa

SEQ ID NO: 95068 - DNA, 351 bp, Glycine max
  Peptide Sequence Number=SeqID_211846
atggcttctcataagagaaaagccatagcttcaatgtctcaggctagttatgatagatcaagatttatatcacagaagacttgggaccattactcagataatgtgcttgccaggaacattctgctagaaagaaatgtcaagttgttttctagattgaggcctgatcctcaagagcttgcagctcgactgtgtatcctgggaggggatttgttcttaatgccgagggtctgccgtggaagctcttgtggaaagatcttaccactctggcccaaacctggagtgttctatcttattctaacttggccccgacatcccatacttctgatcttaatcttgatagggccaagttag

SEQ ID NO: 95069 - DNA, 258 bp, Glycine max
  Peptide Sequence Number=SeqID_211847
atgtttatgaagaggaaagacatgcattggcagtttggtactctgaacctgtcccacacttcttcctattttcccccatcttgtgctgaaggaatggcgattttaagttttgctctatctctgttcctgatcagggagagggggagctggcgcaagtaccatttttgctctggaaattgcttctgggatatcaaagatgtttgctcagaagaatgtcacgctgagcccggggaggcacaagatagtgatactggatga

SEQ ID NO: 95070 - DNA, 426 bp, Glycine max
  Peptide Sequence Number=SeqID_211848
atgcatctccatggtggaaaatcaccattaaaggacctcattgaagctcaaagatccagccttcatagaagctccacaagcaagcttccatcaaaagggggaaaatctagtgaagaaatatacccccaagaagaaggacaacctttaatggttaaggaggagtgtaaggaggtaagtgtctcctcgaagaggttagctaagaaggaaagacattttgaaataaagaaaaatattaaagaaatttcccctcttagacaacctccacattttctcctttgtaaaaatacacttgttagcattgtcacacctcttgggcttaagtatattcctcaagtaaaggagttgttggatgagggtttggttcgcaagagcttaaatccttgtgctttgttggtggccaaaatagtgatcaaggggttcccatga

SEQ ID NO: 95071 - DNA, 300 bp, Glycine max
  Peptide Sequence Number=SeqID_211849
aagttgcagctgatatcgggtgtgagagcatttttgagcgagcaacaagggcttattattaagtggaaaaaaagaggttcggtgagccttatcgtgcgctgttggaagccgttcgggcacggtgacgactccggtaatgccgccgccaccaaaagagaatgcaaggacgaccttctctggtttcgcgacatcgaaaagtttgccgccgacgatttctccatggctgtcgtccagaccaaccaggggatggtggaccctaagcaggttccgttggactacgttctcttccaacccaactag

SEQ ID NO: 95072 - DNA, 357 bp, Glycine max
  Peptide Sequence Number=SeqID_211850
atgtccgaagaagttgatatggatgtagaaaaagaagacgaacctggtgtgaaatcagaacatgttgattgttctgatgtgttcaatacttctaagatattaaaattaatttttgttgttaaagctcgagctgttacttatgaaattggttttgtggcagtgattatgaggtcaaacacaaatactggtatgagaggaagggtgccatttgtcttaattggttgtgaaaggagtagtcagtataggaccaggaagaaagattttgtaagaacagttactgatagtagaaaatatgggtgtccctttaagctatgtgggaaaccagtggttggaggcgaaggatggatggtgaagtga

SEQ ID NO: 95073 - DNA, 450 bp, Glycine max
  Peptide Sequence Number=SeqID_211851
atggaaaagagcggaggcaaacaaaataattttgggtcaatgaaagaaagggaatggaaaatcttcagaccagataaattctcggcaagattgccattctcgactggcgatatcccaccccacctgaacaaagaggaaaagaccgaaacacccagcttcctctccaaaaacactaccctcgagaaaatcctattgaagctaaaagttgacatcctgcccttcattctcggttacaaggaagattacccttggcacaagtatattgtttctctaagatatggtgctctggcgaatgatttgtttttctttacaaaaagcatgtttgcctttcaggtggaaaaacccagtggaccgttcggtcctgccaaccacttttattcggagacccatgaatgtcattgcctagcgctgttcatgtgccctccaccgtttgagtctggagccccgtga

SEQ ID NO: 95074 - DNA, 456 bp, Glycine max
  Peptide Sequence Number=SeqID_211852
atgactcttgcaactctttttggaaagcttcaggaacatgaaatagaacttatgagactaaatcaacatgaagaaaatgacaagaaaaagaaaggaactgcacttcaagcttcatcttctattcaagaagaaagtgacaaagaggacttgaatgaaatagaagaagatgagaaacaaaggaaattaaaggagatcaaacttcaatcaaagaagaaaggagaagattcctccttagttctgaaatgcaatgaatgcgatcaacccgggcacttgagatttaattgtcttgtctttaaaagaagaatggaaaaatccgacaagaaaaatttcaaagataagaaagaaaataaagcatacatcacttgggaagataatgacatggattcatcaagtgattcagaaaatgaaatcataaatctgggcctcatgaccaaagactatgaaagcgaagaagag

SEQ ID NO: 95075 - DNA, 771 bp, Glycine max
  Peptide Sequence Number=SeqID_211853
atggcctcagaatcagacgatgattctgaaacaaatctgcaaaaacaaatccaaaaagctaaacaaaccaaaactgtctgtaaccaaaaaccaagccaacagttgacccaacaagaatcaacaccacaacccagcaatagctatatttccaaaaacaaattcttcaatgtcttgcaaatggaaccagaatactgggacaagaatcctttcaaggcaaccgccaaaaataacactatgtataattttccaaattggttcctccaatggtggaactacttcggaccaattccgcaaatatttccagaagaagtccaacagggattccaacaattcagcaagctcttcaatagcaaggaatcaagaattccggcagatttaaaatatggaaaaaccgaaaacagcaaacagtacccaccattgcagagacatgcctttgtaaaatggtggtcacaattcgataccccaaaggctgctccagaacaagtcaagaactggtttcagagcaactctgagtttctcaagcctgctgatccagagacatctttgtttctgaatcaaaagtctcaacttgcagcgttcttagcaagctcaaaatctaaagagagtcttgctcagaatcttaaggaagttctccaactacttcaacaagaagaagaagaagaactccccaagaaagaagccgaatcatccgagaataatgatgaccaggaagatgatccattctaccaaaatgaagatgactgctttggtatatcgttagacgatgattag

SEQ ID NO: 95076 - DNA, 246 bp, Glycine max
  Peptide Sequence Number=SeqID_211854
atggcaagttcaacatgctttcaacaaatttcttcacaaataaccatcatgaaagagaaagaagtctacccaaacctgaaatttcgaggccccacacgtagagatgcgcttcacgactccgaaaatgccttcctttcgcgatttggagcagaaatgatgaccaaaggttggagctttgttggagcttcaatggtggaggaagaagaagagaatggcaacgtgagagagagaggaaaaggcttctga

SEQ ID NO: 95077 - DNA, 654 bp, Glycine max
  Peptide Sequence Number=SeqID_211855
gcagacacagttgtgtccgatggcaagcagagaccaagtttggtcattctgcacccaagatacgcggagataccttacggttatccgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaaacagaacgcttgatagcatgcagaggctgacacagtcttctgcaccttttgttcctccggggacaacaaagtcatttacatgtggaaatttcatggtcactcgcgactctcgtcagccgagaggagcgaaattagtgtcatacactgatttttggggacctttgcttgatgacatgcgaccattctttggtccttgtggg

SEQ ID NO: 95078 - DNA, 131 bp, Glycine max
  Peptide Sequence Number=SeqID_211856
gcttggctagggtcggcggtgctgggttatggccccgtgttaagtttcggattggtgggccccctcctcccccccgtgatcagttttgtacgcaggattttgccaattttggcttgcgccccgtcggttaa

SEQ ID NO: 95079 - DNA, 161 bp, Glycine max
  Peptide Sequence Number=SeqID_211857
tgctctgaatgtcaaagtgaagaaattcaaccaagcgcgggtaatcggcgggtgtaactatgactctcttaaagccaagggaacgggcttggcggaatcagcggggaaagaagaccctgttgagcttgactctagtccgacttggggaaatgacttgagag

SEQ ID NO: 95080 - DNA, 317 bp, Glycine max
  Peptide Sequence Number=SeqID_211858
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 95081 - DNA, 459 bp, Glycine max
  Peptide Sequence Number=SeqID_211859
atgcctctaatcatttggctttacccggatagaactcgcccgcgggctccagctatcctgagggaaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 95082 - DNA, 258 bp, Glycine max
  Peptide Sequence Number=SeqID_211860
atgctacaactacagtgcataataaaagcaaagggaagattagggacacctacctcgaacggaaatggcgtccaaccgaaagaagcagcacctgggctcgcggtgaaggagaaggctcgcggaagagcaatattgctgggtgcacctagcatatcccctgtgttcgagagagccactctggtccattccactaaggaaatttcactcaaggtctacaagctccacatggaactacatcatgtcttggtggggcattga

SEQ ID NO: 95083 - DNA, 318 bp, Glycine max
  Peptide Sequence Number=SeqID_211861
atggcaccagaggacatggagaagacgaatttcattactctatggggaatcttctgttacaaggtgatgttgtttgggttgaaaaatgctagggcaacatatcagcgggccatggtggcattgttccatgacatgatgcataaggagattgaggtctacgtagatgacatgattgaaaaatcaagaacggaggaggattacttagtcaatttgcggaagttgttcgagcaactatgtaaatacaagttgagactcaatcccatgaagtgcacgtttggggtaaaatctggaaagttgctcgattttgttgttagatag

SEQ ID NO: 95084 - DNA, 231 bp, Glycine max
  Peptide Sequence Number=SeqID_211862
atgggtgagaactttttgatcggcccctatgttcacttgaggctcatgcacggtgcccctcatggccccagtgagggaacctattgggtgagaacttctaattttcccctaggttcacttgaggctcatgcacgatgcccctcattgccccagtgtaaggctttgaggtaccaatttgttatctttcgtgatgaccttgtagctgggaacctactgggtgagaacttttga

SEQ ID NO: 95085 - DNA, 135 bp, Glycine max
  Peptide Sequence Number=SeqID_211863
atgacttatagaatccacaattgtacaggggatcgacgtcaagatccagcatatctacaggttttatcggtccctcagctacctgtttatcctacacagttaataaacattaagcgaatgacagtcaaaacttga

SEQ ID NO: 95086 - DNA, 282 bp, Glycine max
  Peptide Sequence Number=SeqID_211864
atgggatttcggggcttccgggacacccctgggttaacgtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatccgttcttcgttcttcaacgggtaa

SEQ ID NO: 95087 - DNA, 237 bp, Glycine max
  Peptide Sequence Number=SeqID_211865
atgtcaaaatattgtcttaatgtcaacatagttggaagatattgtcttaactctggaggtaatatagctgcatcttctaagatattgtctccacggtggtgtgttgttctttgcctctatgatggggatttccgtggtggtggtgctgttcttcgttgccgtgatggggctctcctcagtggtttttgtgttagtgtagcagaagtgcagaacagcaaaagccaagatcgaataaag

SEQ ID NO: 95088 - DNA, 1096 bp, Glycine max
  Peptide Sequence Number=SeqID_211866
atggggaaaggaagagcaccatgctgtgataagactcaagtgaagagaggtccttggagccctgcagaagaccttaaactcatagccttcatccagaaatatggccacgaaaactggcgtgctctcccaaaacaagcagggcttctgcgatgtgggaaaagttgtcgcttgagatggatcaattatctcaggcctgatgtgaagagaggcaattttacactagaggaagaggaaaacataataaggctacacaaagccttgggaaacaagtggtcgaagattgcatcacgtttgcctggtaggactgacaatgagatcaagaatgtgtggaacacccacttgaagaaaagattggctccaaaaaaaggttcagaatcaagtgctgatgaatccaagccagaatcatcaatcacttccgcctcttcctcatcatctgaatcgtttttctcttatgagagaccaaattcaccaaagaccacaacaccttgtaacaatgatcaatttaatgaccaagcagagaaattatcaattgaagataaaatggagcaggattcagaaaaacaagtgtccaatgaacttgctaacatcactgaggatccaaaagggtcatcagtttcattgtcttctgatgagtcaaacatagtaaacacaagccagattgttgaacacaaaccagaagaagaacaattggcctctccattaccctacttaggacattatgatgttggaagcatgttagaagaggtggataaaccaaaccaactgattgaaattccatgggagccagattatgatttttggaagttgttagatgatgataacagccttgaatcttttcaatcaaatgaagtccaattaggtgagttcccagccatccaaaacatcattcttggagaagagagtgttcatgatgctgaagccaagaagtggtcccaagactttgagaatgagtttggagtagttggtgagatgaaggagtcaaacaaggatcatttcctaccaaagaactatgcagttgagccagaaatggaccacactcaagcatttgattttgatgacattgacatggcaaggccagaatctgaattagacttgg

SEQ ID NO: 95089 - DNA, 375 bp, Glycine max
  Peptide Sequence Number=SeqID_211867
atgactaaaacacgtcaaaagggggtacggaaagtaaatgaaatgaaaataaaagtacgcgaaactagtggggaccaccaaggaccgaagaacaacggagaaggaacgaaggacggtggaaaatcttcacgaaatcacctaaggaaatgtctcggatgcgttacggaagcgcctcggcttggattttcttcacggaaacgatttttctcactaatttcaagtgatcctcagataccaggagggttgaacgtttttgttcttccctcctccccctatttattgggaaaaaagggagaagcttgccacccagcttgcccaggagagatcggttgcttcctccagaaggcaccgccttttggaggaacttcctggaag

SEQ ID NO: 95090 - DNA, 544 bp, Glycine max
  Peptide Sequence Number=SeqID_211868
atggcgaggcctgctgaattggagcttgatgacaaggaaggtatccctcctgaccagcagaggttgatttttgctggtaagcagctggaagatggtcgcactcttgctgattataacatacaaaaggaatcaacacttcacttggtcttgaggctaaggggaggtaccatgattaaagtgaagactttaactgggaaagaaattgaaattgacattgaaccaactgatacaatcgaccggatcaaggaacgtgtagaagaaaaagagggaattccacctgtgcagcagagactcatatatgccggtaagcagcttgctgatgacaaaacagctaaagagtacaacattgagggtggttctgtacttcacttggtgcttgcattgaggggtgacatcattgttcttatgtgcttggttgtaattgaggctgctattggtgggagcaccaatgttaaccttcaaacgcttctgtcagtgtcagagaagtttatcttctgtagccttgtttgtgggtgtcttccgcttgaaaagagggaaatggaag

SEQ ID NO: 95091 - DNA, 228 bp, Glycine max
  Peptide Sequence Number=SeqID_211869
atgggagtagagggcgcacaaggacaatggaattggagtggagggaggagggttcgaaggagaaggaaatggaggtttaggtgtgaagaaaaggaagaggggacaagcaaatgggaagtgggaagtgggaaggggaagggttgtggtataattgcatatgcgggtacccgtgggttcttggggcgagcacaaaccggtattttagctagtggggtgggtagcagttag

SEQ ID NO: 95092 - DNA, 687 bp, Glycine max
  Peptide Sequence Number=SeqID_211870
atgaccactatagcccagtctaacacttctagacttgtgttccctactctaatcgtcgcattatgtagagccagaggggttgtctctgatagcctcacttttgagcgcctaagcccggtcattaacttggcgtacatcaagaagaactgttggaaccccaaggatctaacagtttctattcgaggggctaggagggcgagggtaaggccagctgagcttccttctacttttgcagctcctactccagcatccacttcagcagctccttctgtcccagctcagacagattctcagcactttgcagccatgcttcaaagcattcatcagggacatatcattttattacagagtttacaggtggtggcacctccaggatctattccttcaactgagcagtttagggagatggtagcctggcccaggacccaaccttctcttcacaaggaagatgaaggtcccacaacccagccatttgttataggagaagaggcagaggagacacaagtgagacaggtagttgctgccacgcctgagcgatcccttaaggctacttcagagccttctgcacaaggggaggacataccttcacctcagcctacagtagacccctccactcctcttctagagatgccaaaggacccaactacaccgatcctagctatggacacttctcctccagctactcca

SEQ ID NO: 95093 - DNA, 1323 bp, Glycine max
  Peptide Sequence Number=SeqID_211871
atgcatgcttttgtattttgtttcttactcctatgttcacattctattgcatccttcgctgaagcctccaaaactctaagtggcttcagcatcaatcttattcaccgtgaatcaccattgtcacccttttacaacccttcactcaccccatcagagcgcatcaagaacactgtcttgcgctcctttgctcgctccaaacgtcgtcttcgcctatctcaaaacgatgatagatcacccggaaccattaccattccagacgaacccatcactgaatacctcatgaggttttacattggcacccctcctgtggaaaggtttgctattgcggacacaggaagtgatctaatttgggtgcaatgtgccccttgtgagaaatgtgtaccccaaaacgccccattatttgatccaagaaagtcttccacattcaagactgtgccatgtgactcacaaccttgcacactactccctccatcccaacgtgcctgtgttggaaagtcaggtcagtgctactaccaatatatatatggtgaccatacattagtctctggaatattgggttttgagtccattaattttggttccaagaacaatgctattaaatttcccaagcttacttttggatgcacattttccaataatgataccgtggacgagagcaagagaaacatgggtctagtgggtcttggagtagggccattgtcactaatttcacaactagggtatcaaattggtcgcaaattctcctattgtttccctcctttgagttcaaactccactagcaaaatgagattcgggaacgatgcaattgtaaaacaaataaaaggggttgtgtccactcccctcataatcaaatctattggaccaagctattactacctcaatcttgaaggcgtcagcattggaaacaagaaggtgaagacaagtgaaagtcaaacagatggcaacatattaatcgattcagggacctctttcacgattctcaagcaaagcttttacaataagtttgtggctttggtgaaggaagtgtatggtgttgaggcagtgaaaatccctccattggtatacaacttttgtttcgaaaataagggtaagaggaaacgtttccctgatgttgtgtttcttttcacgggtgctaaggttcgcgtggatgcttcaaacttgtttgaggccgaagacaacaacttgctttgcatggtcgcattacccacctctgatgaagatgattccatctttggaaatcatgcacaaattggttatcaagtggagtatgatcttcaaggggggatggtttcttttgctcctgctgattgtgccaaagactag

SEQ ID NO: 95094 - DNA, 153 bp, Glycine max
  Peptide Sequence Number=SeqID_211872
atgggtgtgtctggaaatgtaatagttttaggggactcatctttatcttcattgctcgatccaaacgcgcttgatccaagacgtttggatcaagaaatggagcacatggcagcatttcttaggcgctctgatgggcctttaatattcgcgtaa

SEQ ID NO: 95095 - DNA, 897 bp, Glycine max
  Peptide Sequence Number=SeqID_211873
atgtttgccactgcagacacagggagtgatctcatttggatgcaatgttccccttgtgagtgccagtactcttatgcatatggtgacaagacattcaccgttggaacattgggtgttgataaaattaattttggttcaaagggtgttgttcaatttcccaaattcactgttgggtgtgcatattacaatcaggataccccaaattcaaagggtcttggagaaggaccattatccctagtttcacaactaggtgatcaaataggttacaaattttcctattgtttgatcccctacggtttaaactacactagcaaattgaaatttggggacatagcattagcaacgataaaaggaaaaagggttgtgtccacacccctcatactcaaatcttctgaaccaagtttttactatgtcaattttgaaggcatcagcattggaaaaaggaaggtggagatgagtaaaagtgaaagtgatggcaacatgttcattggttcaggggccacgtacacgatgttgcagcaagatttttacaataagtttgtgactttggtgaaggaagtcgctggtgctgaggtggagaaaaatcctccagcaccattcgatttttgtttaagagataagggtactaagcacctttggttcaaggatagcagtgatgacgacgacgatggtgtgcctgatgttgtgtttcattttacggcaacggagatggatttaacatcttcgggaatgtgcaacaaatgggatttcaggtggagtatgatcttagagggggaaaggtttcgtttgctcctgctgattgtgccaaacattagtttgcgtaacctgtgttcggttaataatgattacacttgtgcttgtatacctagaaaatatgagaaagttgtatgtttgtaa

SEQ ID NO: 95096 - DNA, 219 bp, Glycine max
  Peptide Sequence Number=SeqID_211874
atggagcgcaaggcagcgtttgtgatgcgctctgatgggccccttaggctttcattggcttctccagaggatatagaagaaagtgagtataaggctaaagacaagaacaagagtggatgcatgttgatgaaatgtaaattcaaagaagtaaaggctaaagacaagaacctgaatgcacgagtggagcacgttgaagttgctctatttatagatttttaa

SEQ ID NO: 95097 - DNA, 1188 bp, Glycine max
  Peptide Sequence Number=SeqID_211875
atgcatccactcgtgttcttgtctttagctttatacttactttctactgtatcatctagagaagtcagtgaaggccaaaggggcttcagcattgatcttattcaccgtgactcaccattgtcacccttttacaaaccttcactcaccccatcagatcgcatcataaacactgccttgcgctccatttatcaattaaatcgagcttcccactctgatctaaatgaaaaaaaaacactcgaacgtgttaggattccaaaccacggagaatatctcatgaggttctacatcggtacccctcctgtggaaagacttgctatcgcagacacagcgagtgatcttatttgggtacaatgttccccttgtaatttatgcttatacacaaacacttatggtgacggatcatccaccaaaggagtattgtgcactgaatccattcattttgggtctcaaaccgtcacatttcctaagactattttcggatgtggatcaaacaacgacttcatgcatcaaattagcaacaaagtcacaggaatagtgggtcttggagctgggccattgtcgctagtatcacaactaggtgaccaaatcggtcacaaattctcatattgtttacttcctttcacttcaacctctacaatcaagctgaaatttgggaacgatacaacaataactggaaatggggttgtctcaactcccctcataatcgacccacattatccttcctattacttcctccatcttgtaggcatcactattggacaaaagatgctgcaagtgcgtacaaccgatcatactaatggcaacataatcattgatttggggacagtgttgacatatcttgaagtgaacttttaccacaattttgtaactttgttgcgagaagcccttgggatttcagagacaaaggatgatattccatacccatttgacttttgctttccaaatcaagctaatataacttttcctaaaattgtgtttcaatttactggagctaaggtttttctgagccctaagaacctatttttcaggttcgatgacttgaacatgatttgcttggcggtactacccgacttctatgcaaagggattttctgtctttggaaatttggcgcaggttgattttcaagtggagtatgatcgcaaagggaaaaaagtgtcttttgctcctgccgactgctccaaaaactag

SEQ ID NO: 95098 - DNA, 126 bp, Glycine max
  Peptide Sequence Number=SeqID_211876
atgacgttcttcaccactgcacctcatggcacatcaagcggtgaagtcattcctcaacacttcaagtgcaagcgaaagcgagggttgcagaaagtagggaaagggaaatttccaagaactacgtga

SEQ ID NO: 95099 - DNA, 1038 bp, Glycine max
  Peptide Sequence Number=SeqID_211877
atgagattttacatcggtacccctcccgtggagcgtcttgctgtggcaaacacagcgagtgatctcatttgggtacaatgttccccttgcctaagttgtttcccccaagacaccccattgtttgaacccctcaaatcttccacgttcaagggtgccacatgtgactcacaaccttgcacattactccatcctaacaaccgtcattgtggaaaagtaggtcagtgcatatattcatacgaatacggtggcaaatttgcagaatcattcaccgttggattagtaggcactgaaaccctaagttttggttccacgggtggtgcacaaaacgtttcatttcctaactctattttcgggtgtgggatgagcaatgaaatcaaatttcgttttagcaacaaagtcacgggtgtagtgggtcttggggcagggccactgtcactagtgtcacaactaggagctcaaattggtcacaaattctcctattgtttagttccttacgattcaacttcctctagcaaattgaaatttgggagtgaagcaatcataaccacaaatggggttgtgtccactcccctcataatcaaacccaatttgcctaccttctactttctcaacctcgaaaccgtcaccattggacaaaaggtgttgcaaacgggtcgaaccgatggcaacataatcattgactgcgggacacccttggtgcatcttgaagagaccttttacaacaattttatggcattggtgcaagaggcccttgatactgcgttagtgacacatcattcgataccactcaagtgttttggtagaactggccgtgaggttcttcctgatattgaacttcaatttaccggagctagtggtgcagtgagatctaagaacctttttcttccaataaccaacctgttttgcttggcggtggtacccagccaagtaagtggaatttccatctttggaaatattgcacaggttgattttcaagtggggtacgatctcgaagggaggaaagtttcttttgctcctactgattgttctaaattttaa

SEQ ID NO: 95100 - DNA, 696 bp, Glycine max
  Peptide Sequence Number=SeqID_211878
atggcactaagcacatacttcaactttgaaactcttcaaattcccaacttagaaacaaacactttccatgaagccatgccagaagaagtagcagcaccaaacctccaacagctttttccctattcagatgaaagcttctttctttcagacgcgctttttgagaactatattgacccaactggtggttttctctatcctccagacgtaaaccctccttatgatggggacattttcccaactcataaagattacaaacttctcccatgttcaaaacgccaaaagtgctgctatgaggaacaacaacgacaacaagaacacgtgtactcttcttcattgcaagagtttactacacccacactaccatccagtttcttagatggctttgttattccttatgataattgctgctccttgcaagcagaggaactgcaacagaaactcttctccgagacacaatatggtgatacttgtgttgatcttccatgtgagaagaaaggcaatgagagaaccatatctccacagagtgtagcggcgagagaaaggagaagaaagatcactaagaagactcaagagcttgggaagttggtccctggtggaccaaagatgaacacagctgagatgcttcatgcagctggaaagtatgttatgtaccttcaggcccaagttgggatgcttgaactcatgaacacactcgag

SEQ ID NO: 95101 - DNA, 1014 bp, Glycine max
  Peptide Sequence Number=SeqID_211879
atggcactaagcacgtactccaactgtgacactcttcaaatttccaacttagaaacaaacactttccatgaagccatgccagaagaagaagtagcagcaccaaacctccaacactttttttcctacttagatgaaagcttcttcctttcaaacacgcttcttgagaactacattgacccaactttcggttttctctatcctccagggatcaaccatccttatgatcccttcacttcactcactagtcgtgatgacattttcccgactcatgaagattacaatcttctcccatgcccaaaacgcaaaaaatgctgctacgaggaaaaacaacaacatcaagaacacgtgtactcttcactgcaagagattaccacaccaaccctactatccaatttaatagatggatttgttgtgccttatgaaaattgctcctccttccaagcagaggaactccaacaaccagtcttctacgaggttacacaatatggagacccttgtgtggatcttcagtgtgagaagagaggtaccaagagaccaatatctccgccgagagaaaggagaagaaagatcactgagaagactcaagagcttgggaagttggttcctggtggacccaagatgaacacagctgagatgcttcatgcagctgcaaagtatgttaagttccttcaagcccaagttgggatgcttgaactcatgaacatacttgagttcatatgtgacgatgcctcaatatttgctttaacaatccgaatgcatgtgctgggtcattgcatatttggtcatctagaagataaagctgaacctcctcctgaaaatatacacgctctagttgtttctccccttgttcaagagaagttgtacacggaggaaaggtgctttgttccaaacggaattgtcactactttgacaaatcacgaggatgttcactcaagacctaccatccttgaggatcttaaacagctgattgggacagacattgagaagaagcaaagcaagactaaatcttcataa

SEQ ID NO: 95102 - DNA, 405 bp, Glycine max
  Peptide Sequence Number=SeqID_211880
atgactagaagattatgcacatggttcatatcagtgccacaaagacaacatttttggagcctaaatggaaatgggtacctgaaaagggagaatgtttggggaaggaagaagaagaagaagattggaggtcactgcgctctccagacaggcgcctccactgtgcacgtgacacgtggcacagcaggtagcaccctgacgcgggcgcctttggtagcgcccaggggtcaggcactattggtggcgcccctgctgcaggcgctacggttagcgcaggcagccaggcgcctgccccccagcctcttcttctcacaccctccagtctcttctcacacccccagcctctcttcttctcacaccccccaccccaaaattttatattttttatattgtttatcaaaaatttaa

SEQ ID NO: 95103 - DNA, 252 bp, Glycine max
  Peptide Sequence Number=SeqID_211881
atgaagttagtaactgactccaaaattatctggaaagaagataaagctgaacctcctcctgaaaatctacacgctctggttgcttctccctttgttcaagagaagttgtacacggaggaaaggtgctttgttccaaaagaagttgtcactactttgacaaatcacaaggatgttcaatcgagacctaccattcttaaggatcttaaacagctgattgggacagacattgagaagaaagcaaagcaagaatga

SEQ ID NO: 95104 - DNA, 783 bp, Glycine max
  Peptide Sequence Number=SeqID_211882
atggcccatttatttcaatggaggataggccacatttctggcttttcctccttctatagatgccggttaccacatatgctgccatcagaggaagcttttgctgctgctgtttctgctcttggcattgagaacaaagatgatttggttgtttatgatggaaaagggttatttagtgcagctcgtgtttggtggatgttccgagtatttgggcatgacagagtttgggtattagatggtggcctgccgagatggcgtgcatcaggttatgatgttgaatccagtgcttcaagtgatgctattcttaaggccagtgctgctagtgaggctatagagaaagtatataagggacagacagttggcccactcacatttcagactaaatttcagccacatcttgtttggaacattgatcaggtaaagaaaaatatagaggacaaaactcaccaacacatagatgctcgatcaaagcctaggtttgatggagctgtacaagagcctcgaaagggaatcagaagtggtcatgtacctggtagcaaatgcatcccttttgcccagttgttagatagttcacagacattgttaccagcagatgagttgaagaagcgatttgaacaagaaggcatctctgtggaaagcccagctgtgacttcatgtggaacgggcgtaactgcttgcattcttgcattgggtcttcatcgtcttggaaagtctgatgttgcagtttatgatggatcttggactgaatggggagcacaatctgatacacttgttgacacttcatga

SEQ ID NO: 95105 - DNA, 327 bp, Glycine max
  Peptide Sequence Number=SeqID_211883
atggagcacccatttgcttctacacatgctagttctcgctacagattagatgactctagcaatactgctctccccttatcagatacatgtgccttccaaggtctttcttcaaagtatgctgcttcagaaaatcatgaagaatgtgaaaagatgataagtgttacacaacagaagcatgaaagaactagtgtctttttgcgcttgcccggtgcttcagatgcagttgttcagccaggtcattgcatgacagaactgctggaggaagctagtcagtggaagaagggaaaagagaaacgccattttcagaatggaaatatcactgcatag

SEQ ID NO: 95106 - DNA, 636 bp, Glycine max
  Peptide Sequence Number=SeqID_211884
atgatgttttatgaggatgatgttaagatagccatcgtagttattttgccatggttgtgtctgcagatcagcacttatgcattgtcgagtaacagtttattaaggcaaggggagacgtttgatcactcatctacactattctcaccaatgcatcagttctgtttgaaatttgctcctcttcagtttgaccctactcacacctacttagtcattcgtaacacacgaactcctaccggatatgctgattggattggcaacagaaatgactattggcaacaattctggggtgcttctgacattgaaaaattcagtggatctatgaagcatgcgatgtggcaaagctttgatcatccttcagatgttttgctacctggtatgaaactaggtgttaatcacaagacaaatcggtcatggtcggttgcgtcatcattttctaccaacaacccatcttcaggttcctttgcacttgaatgggagccaaggaaaggagaattgctcatgtatgagtacaaaattgtctcaaacaaggatgaggagtcttttagttatgcaagtcacaatgattactcacagttggtgctgtttagcaatggaaacttgcaggatacacaaattggagatatagctcaagcttaa

SEQ ID NO: 95107 - DNA, 2037 bp, Glycine max
  Peptide Sequence Number=SeqID_211885
atgcttaataactcaagcattttaacatcagcacaaaaaaaattctctctaaaattcgccacaattgaaatacccaacacctccctcaacacctacttggttatagaccgcgcaaacaccactggcaatgttgattggattggcaacagaaacgaccctcttgcgtacaattcttgtgcactaacactgaaccattctggtgctttgatcatcacacgccacaacggggactccattgtcctctattctcctgctgaggccaccaacagaaccattgccacacttttggattcagggaactttgttttaaaagaaattgatggcaatggttctactaagaatgtgctgtggcagagttttgaccaccctgaatttgttttgttgccaggaatgaagttaggtgtcaacaaaaaaagtggcatgtcttggcttgttaaggcatcaatttctagagccaagcctgcttcaggttcgtttactcttgaatgggaaccaagggaagggcaactggtcataaagaggcaagggcaggtatattgggcaagtgggttgctgagaaataagagatttgagcacattccagaggaagttcagctcatgtatgaatacaacattgtgtccaatgaggaagaagagtcattcagctacacaaccccaaatggtgtatcacaatgggtgttatttcacaatggtcagctaaaggacacaactaggggaagtgagattgctagagctgacacatgttatggctacaacaccgatggtggttgccagagatgggaacaacccacatgtaggaagaaatcagatcaaagagatatgaagaagtcgattcgtgttcattttgctgcagcagtagcgtcacttgtaattgtcattacctccattggcattttctacataatattaaggagaagaaaatctgcactgaaagataacacaaccagaactgaaaataaaatgctgaaattagtggctttggatagatatgctgttagtaaacatcattgtgaagtaaagaagaggagtgattcaagagtcttcagctatgcatcaatcattgccatgacaaacaggttctctgtagaaaacaagttaggagaagggggttttggactagtatacaagggaaaattgccaacaggagaagatgtggcaataaaaagactatcaaaaggttcaaggcaaggagttatagagttcaaaaatgagttaaacctcatatctcaactccaacacatgaatgttattcagatattgggttgttgcatccatggagaagagaggatgttaatctatgagtacatggctaacaagagcttggacttttttttatttgatcgaactagaaaaatgctactagattggaagagacgtttcaatataattgaaggaattgctcaaggattgctctatctccataagtattcaagattgaaagtagttcacagagatttgaaagctagtaacatacttcttgatgaaaacatgaatcctaaaatttcagattttggcacggcaagaattttcagccctcaagaatcagaaataaatactgaacgaattgttggaacatatggttacatgtcgcctgagtatgtcacgaggggaattttctcaatcaaatcagatgtctatagttttggagtcttaatacttgaaattgttagtggtggaagaaccaacagcttctacagtggtgaacgccaatgcaatctaataggacatgcttgggaactttggcaacaaggcaaaggactagaactagtggatccaactataagggattcatgcattgaagaccaagcattaaggtgcattcatgttggtcttctatgtgcagaagataatgcagttgataggccaaccatatcagacatcataaacatgttgacaagtgaatatgcaccttttcctcttcctagaagaccagcattttacagtagaagaatgcctaatgaggaatgcagatgtaccaaaggttctgaatgttattcagtgaatggtttgtctatttccaacgtagtagcaagataa

SEQ ID NO: 95108 - DNA, 786 bp, Glycine max
  Peptide Sequence Number=SeqID_211886
atggagaaacaaattttgacatgtgctgttttttcattgggtgtctgtatggttataaagtggagatgtccaaagcaaactatccctcccgatgataccggtttccaaaagaaactcctgtatctggaatcaatcggtattgactctttctcgcttattgaaaaccatccaacagtgatcacaacttctcttgctgacataaaatccaccgtggaatacattacctccttggatttcaccgcaattgagtttcggcgtatggttggcatgtgccctgatattctgaccacccaagtctcagacctcatacctgtcttcaccttccttcatcgcgaggttcatgtgcctggctcgcatattaagcgggtaataaatcgccgtcccaggttgcttgtctgcagtgttagtaagcgacttcgtcctaccctatacttcctccaaagtattggcatagaagaggtaaacaagcacactgacttgctatcatgtagtgttgaagaaaagttcatgcccaggattgattactttgagaatatcgggttttctcgccgtgatgcaacttcaatgttccgaagatttcctcagctgttttgttatagtattaaaaataacttggagcctaaatacagttactttgtggtggagatggggagagatctgaaggagctgaaagaattcccacagtatttctcatttagcctagagaataggattgagcctaggcataaacagtgtgtagaaatggggccattaggtgcttttggcctttcactatggaaaagttaa

SEQ ID NO: 95109 - DNA, 312 bp, Glycine max
  Peptide Sequence Number=SeqID_211887
atgggaagcgatagaaaatcgaaacgagcttcaccctcccaacgcgaagatgagaagagaagcaagaggcggagaacggtagaggatgaggaaaggaagcaacggaagagggaaaagaaggagaaaaggaaggacaaaaaatctcacgagcattccaaagaaaattctgagaaggggttgtcaatgttgggctttcaaggcagaataagagagataaaaaaggacatgatacatgcatatttaggtgctattgtctggattggacaaccaagttcaaccttggtgggactattagttttaaatcttgaatga

SEQ ID NO: 95110 - DNA, 924 bp, Glycine max
  Peptide Sequence Number=SeqID_211888
atgggggatagtcagtattcgttttctctcaccacatttagcccttctggaaagcttgttcagattgagcatgctttgacggctgtcgggtctggacaaacgtctttgggaattaaagtttacagtagtgttctgggatttccgattaagtttagtgggattgaggtggctgagggtgctgctgcaaatggagttgtcattgctaccgagaagaaattgccatctatattggttgatgaagcatcagtccagaaaattcagttattaacaccaaatataggtgtcgtatatagtggcatgggtcctgattttcgagttttggttcggaaaagcaggaaacaagccgagcagtatcaccgtttatataaagaaccaattcctgtcactcaacttgtcagggaagttgccgccgtaatgcaggaatttactcaatctggtggtgttaggccttttggagtgtccctgctagttgctgggtttgatgataacgggccacaattatatcaggtggatccatcaggttcatatttttcttggaaagcttctgctatggggaaaaatgtttctaatgcaaagacgtttcttgagaagagggcaagccttggcgcagtggtaaagttgtgccttagtgactggttggtcatgtttttgttccggaaacaacctctttgcatatacaagagtaaggttgtgtacaatgaccctcccccatatcgctgcatagtgaggagccttccggcactggggtacacagatgatatggagcttgatgatgcagtccacacagcaatattgactctgaaggaagggtttgagggacagatctcaggaaaaaacattgaaattggcataattggagctgataaaaagttcagggtattgacaccagctgaaattgacgactatttggctgaagtagaataa

SEQ ID NO: 95111 - DNA, 291 bp, Glycine max
  Peptide Sequence Number=SeqID_211889
atggggaatgacacgcttaatttggtagtgtctgacacatttaacaatttagttgagcttcaaaatgaagtgaacaatggcaatgctttaagaattttcagctacgcatcaatcattgcagctacgaacaagttctcaatagacaacaagttaggagaagggggcttcggaccagtatataagggattgttaccacagggagaagaaatagcaatcaaaagactttcggaaggttcagagcaaggagacattgaatttaaaaatgaattaactctcatatctgaactctaa

SEQ ID NO: 95112 - DNA, 1227 bp, Glycine max
  Peptide Sequence Number=SeqID_211890
atggccagcactgtggttagcctatcctcaatagtcttgctttgcacgataacagcagttcaagggaggaaaacacttcatcacctaaacaatgaatggctaacatcttattcagttattaatgacattgatggtatttgtaaaacaatggtagagacacaaggttacacatgtgaggaacatcaggttacaacagaggatggctacatcttgagcctgcagaggattccggtagggcggtccagtaacaacactgacaagccgccggtgctgttacaacatggtatcttttgtgatgctctaacatggctggtcaattctccagatgaatcattagggtttatcttagcagacaatggatatgatgtgtggcttgccaatactcgtgggacgaaatatagtaacaggcacatatcacttgatcctgatgacatggcttattgggattggtcatgggatgaattggctagttatgatcttcctgcctttgtccaatatgtgtacaaccatactggtcagagaatacactatgcaggtcattccttgggaactttaatggctttagcttctttctgtcaagggcaagtggtgaacatgttgagatcagctgcattacttagcccaattgctcatatgaatcaaattacatcactactaacaaaaattgctgctgacgcatttctagctaatgacatatactggttaggactccgggaatttgttccaaacggggatgttgcagcaaaatttgcaaaagacttatgccatattctaaacttcgactgctcaaacctaatgtcacttttcgcaggtccaaattgctgcataaattcgtccacaatagatgtctttcttgatcatgaaccaccgccaacagcaactaagaatttggtccatctatcccaaatgatcagaacaggaacaatagcacagtatgattatggcaatcaagaacaaaacatgcaacactatggacaaccacttcctcctctttatgacatgaccggaattctgaatgaattccctcttttcatcagctatggagggcaagatactctatctgatgtaaaggatgtgcaggttttgctcaatgacctcaaagatcatgattggaacaagctcgtggtattgttgaacgaagactatgctcatgttgattttgttatgggtgttaatgctaatcaaatgatctatgatcctatgatggatttcttcaaggttaattga

SEQ ID NO: 95113 - DNA, 339 bp, Glycine max
  Peptide Sequence Number=SeqID_211891
atgcttttttgtaccattaatgaatttccagcatatgggaatttgagcgggtacaatgttaagggccatcgtgcatgcctcatctgtgaagaacacataagctacatacaactgaaacataagaaaaatgtatgtgatagtgtcattgggatgctccttaacattcaaggcaagatgaaagatggtttgaatactcgtcaagatctagcagagatggcttgtcatactttgtcaggaaaggagaagatgagtttttgtcagtgtttacgccgtgtcaaagtcccacaaggatactcttcaaatattaagagccttgtgcagttgaaagatcttaatttg

SEQ ID NO: 95114 - DNA, 1152 bp, Glycine max
  Peptide Sequence Number=SeqID_211892
atgttatctgacaactttagtattgataaggaaacccttaggaaaaatttctattctccggagaatgaacctcaaaggagatggtttttccaacattacaagggtacaaacagaaaacaaatccaagacaagttctacgaatttgtcgaaagagtcaaaattaatgtccttttctttgattggtttcatgcttatgccatcagaaaggatatagactacccttggaaacaagacatcataggtaatccaacaacaaatgtcataacaaattggcaagtgaaggatggtgagttaatccagtcggaattacctcccacaacacaatatcaactaccaaatatcaaagacagtaacaacaaacctgtcatggcaattccattcaagacaaaagatgtcaacgaggaagtaacctctagagacattaaaagcctaatggaacaggcaaattataccaacaaatacttacaagctttaggagaaaccattaaaactaaggtagttcctaaacaaaaatcaattgaggaagcttcgccgagtgtccccattgaaaaacctttattcaaacctttcaaagttagtgataaggctaaacgaaaaattagggaacttagaaaaactaaatccttaattgaaggcgtaggtgacaatcatagcgaattactaaacaagattagtagtttgcttaaggtcattccagatactccccaagcttcggaaaatacttccaaaatggtaacaagaagtacctccaaattaattaatgttattaatgaagatagtgaccaaaacttagataacacaactgagataggatcagtgtcagaaaagaatataaatccattaaactccaaacactggaaaaccccctccaaattatattatcaacgtccaactgcccctgaccttctattagaagaaagaggtgaaaacaattttaaaagttttagtgcaaataacatctatgaatggaacatagatgcacaaacggagtataacatcatgaatacactccaacatatgaccatggtagccacggcttaccaaacctcccatgaatgttcggaagaaaccattatagatatcttagtggcaggattttccggacaactaaaaggatggtgggataattatctcactaatgaagagaaataa

SEQ ID NO: 95115 - DNA, 202 bp, Glycine max
  Peptide Sequence Number=SeqID_211893
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggtctccgcaaagtcgtaagaccatgtatgggggctgacgcctgcccagtgccggaaggtcaaggaa

SEQ ID NO: 95116 - DNA, 355 bp, Glycine max
  Peptide Sequence Number=SeqID_211894
atgaggatcaaaaggtcttttaaggttgtaatggggccaaggacaaggtatggagaaatatggaataagtggctaaatcccaaaggaatagaggagcaatggggaataagctttgggggggggaggtttcattcagcatgtccaacatttaaccaatatacaatgtacatcaagtatggcccaaaatacatcatgaagcatagccaacaaaacaagttgtcaaatgaaacaaaaaccccccacacttattcccaaaacaattccaaagctccaaaattccttaaggatatgtggggcttcaaaacaaggaaagggaaacaaggctcaaaagggctatcaaaggaattaattcaag

SEQ ID NO: 95117 - DNA, 621 bp, Glycine max
  Peptide Sequence Number=SeqID_211895
atggccttgccattcgataacctggtcatcgcctccggtaacaaaggcaaaatccgtgaaatcgcgcatgtgctggcacccttgaatatccagattgtgtcgcaatctgagttcaacgtgccggaatgtccagagccttacggtacttttattgaaaacgccctggccaaggcacgacatgccagtgagcatactggtttgcctgcgttggcggatgattccgggttatgtgtgaatgctttgcatggtgcgccgggtgtgatttcggcacgctatgccgggccgcaaccagccagcagtttgctcacgcaggatgaacgtaataacgataaattactcacagtgatgtcacgcgaaagtgaccgccgggcgtatttttacagtgtgctggtgctggtgcgttcgccgcaagacccgcaaccgattattgccgatggcatgtggcgtggtgaaattttgcgtgagttccgcgggtctgaagggtttggctatgacccattatttatggatctggcaacccgtaaaaccgtggccgaattgccgctggaaatcaaaagccaaatgagccatcgcggtcaggctttggtaaaattgttgcaggctttagagcaaaatcagtag

SEQ ID NO: 95118 - DNA, 1200 bp, Glycine max
  Peptide Sequence Number=SeqID_211896
atgcgaagctgcatcatcaacctctggatcgtggcggcactcgtcgtccccgtgctcctctctctcagaagccctcgaggcgaaacccaaacccaaaccacttcttctttctccgattcttctaccttttctttgaagcttgcaaatggatttggcttctatgctgtctctttccctttcaaccaaaggatacgtgatgggtccaatctcgaatacgatttctatagggacacgtgtccccaagcggagggtgttgttcgttcggcgctcactcgcatatacttcgaccacagggacgttgcacctgctctgcttcgtctcttcttccacgattgcttcatcgaggggtgtgatgcttctttgctgttggatgagaacaatggtgatagaaaccgttcggtggagaagcaggctgtgccaaatcagacattgagaggttttgacaaaattgagctgataaaagaagaggtggaacaagcatgtcccgggattgtgtcttgtgctgacatacttgctcttgcagcaagagattccattcttctggctggtggacctttctatccagttttaacaggaagaagggatagccatcaatcattttttgaggaagcaactgatcagattcccagacctgatgataacgttacacgcacactaaatctcttcaatctcagaggattcaatgcaagagaaacagtcagccttcttggaggacacaacattggcaaaatcggctgcgacttcattcagcaaaggctgtacaactttcaaggcacaggacaaccagaccccagcatccccctcgatttccttcgccagatgaggctaaactgcccagacagcaagaacagcagcaccagcatagacgagtttacgatctcaaagccagtgagcagtgatttccactccaaaatggggatgtcatacatgcaggcactgtcatcttcagtgtcatcaggagcatcatttgacactcactactaccagagcctgctaagaggaagagggcttcttttcgcggatcagcagctgatggccgagcagaaaaccgccagattggtctctgcttatgcttcagatgatggatcaacctttcgaatggactttgctagggtcatgttgaaaatgtctaaccttgatgttctaactggacttcaaggtcaggttcgagtcaattgctcactacctgtgtcttcttaa

SEQ ID NO: 95119 - DNA, 267 bp, Glycine max
  Peptide Sequence Number=SeqID_211897
atggtgtacttgagacataagatcatagactacaatctcagtgctgttgtgactgatgcttgcagactagaggagagtggcaaattgtcattaggtagtgataaacttccatccaaaactgttaatcacccaggcccttttgggccctccagaagattcctccagaaggcggttgcttctggaggaagcaaccctgctcgcctgggcgagctgagctcgcctgggcgagctgggcggcaaccacctcccctattttgctataaatag

SEQ ID NO: 95120 - DNA, 384 bp, Glycine max
  Peptide Sequence Number=SeqID_211898
atggggttatgggaggccttcggcaattggttacgcagcctctttttcaagcaagaaatggagttatctttggttggccttcaggatgctgggaaaacatcacttataaatgtaggatttattatgaaaaagctgatcatgacaatttatctgtctctaaatgaacttcatgacttgttgagcaaaccttctttaagtgggattcctatgcttattttgggtaataagattgacaaacctggggcattgtctaagcaagacctgacagagcagatgggactgaaatgcatcaatggtagagacgtttgttgcttcatgatctcctgtaaaaactccatcaacattgatacagttattgattggcttatgaacctagctgattga

SEQ ID NO: 95121 - DNA, 159 bp, Glycine max
  Peptide Sequence Number=SeqID_211899
atggggggggtttggttgtttgaagccactctcttatcctgggttatggagaattcgtccctaacagtcaaccacttaatccaaccctatttcaatttactaagcgaaaatcaacttagggttttcaatacgtgtttaggcaccacatacaccagttag

SEQ ID NO: 95122 - DNA, 254 bp, Glycine max
  Peptide Sequence Number=SeqID_211900
gacaatccaaaacaacagccagaatgggttaagaccctatcatctgagaaatcaggagaagcagcagctgaaagtatgaaatctgtggtttcaagatacaaaggagaactgattgcatgggatgcttcctgcccagccaaatatataaagatacttaaggagattctgtcatttccaggagtttctggaatgtcagcagcaatagggttgcaaggacattttgccagtggccaaccaaatcttgcttatatgag

SEQ ID NO: 95123 - DNA, 2691 bp, Glycine max
  Peptide Sequence Number=SeqID_211901
atgtcggactcggccaacaagttgcgattggtgcgttgcccaaagtgtcaaaatcttcttcccgaactcgctgattactctgtctatcaatgtggtggctgtggtgccgttcttcgagcgaagcataaaggttatgtgagtggtagcttgtcggatgaggggaaggttggacttggaggagattctggtaaatcagaaagttctttggagaaaggcttagttgatcgcagtgacgcttcagatgttgatgctaagtccagtagtgttccctctagggatgataatcaaagggctgtggataaagtagataacatcgacgaggggtttcagaaccaaccagaggatgctggtgagaaaggggtaattgatgatgatgttgatgtcggcaggaataaagatgaactgggtaaaacaataggaagagaacaggaggaacctcccaagtctcaaattggtcgtgagaatgggtccaaattctctaattggccgaatggagagagaaatgagatggaagggttttggagaaagccacgagctgatatggaaaatgtgagattttccacttcgaagtatcctgacgagggaccttcaaatggcttttctagtaattatatggaatcgtggaggagtcgtaaagaatcagatggtccaaacatggttcagcaccttgagcaggatcgagctgagcttctaaggaagctggatgagttaaaggttcacatcagtaagtcttctgaaatggttcacaaccccaaaggaaagattcttcccgaagaaaggatgattcctccggatcctcatccttatggtggtggctctgatccttggttttcagatggatcatcagggttgaacagaacttcaaggcaattttttggcactgataagcatgtggcaggttccaatcatttcaattatcatcatgatccatattcttatgcaagtggtcatgacatggctatgcccaacttccctctttcaatgcataatccaaatcgatacggggatcctcttgcatcccaaatgccgaggagaggtccacaccagttcccacaacagcctttgcatccctactatcctggacggtatgttgatactaatccagattcatatgaactatactcgcataatgcaatgcttcacccacctacttgctcttgtttccattgctatgatagcaaacaaagaggttcagtgccagcactgcctgcttcattcattaacagcagattccccgataccccaaatgatcctatgttataccatcatgagatcccaggggcatttggtccacatgttcataattctagaactaccattcctcctgtgacttatcgtcaaaaacaattacatgcaagatgggctagtgacttcaactctgagatgagtggttttgttcgaagccgtcctcgcaaagtaatgttagctagcagtagccagcgttgctatcctgcagctggtggttcgcccttcatctcatgtcataattgctttgagttgctgctactgcctaaaaaagcattggttctggtgaaaaatcaccagcaaaaggtgcaatgtggggcttgttcttcagaaatcagctttgctgtcatcaataagaagctggttatttctcctaatttagaaacaaagggagttccctcaagaggtgataatagctctaatgaggttgtgagtagccgtatgtcacattcccgaggtcacgtgagcaggactggtgctaacttttcatctgatgattattctggttatgattttcattcagtagacagagaacctatttctctggttgctttgaactctaacaagtcccgggagatgccgagttttcattcttcatctctcagtacctctgaagatgaaaatagtccggaagcaatgattgctccaagggaggccactaagtccattcaacggccaactacagactctctatctcctcctgctggctcccctctgcaggagtattttgattactctagtaataaccatgcagtaaatcggtttggaaagggaaaccaaagtagtcgctcagagcaggagaagacaaaagtggacaagatgtcagcacgtcaaaattctttgaaagagacagcacttgcaacagagatggatgtccatgattattctaacactggggtttcccaggattctggagatgctagccgagaacatgatcatcctagatccaacagaggtggtgaatcattttttgcaaacattatcaagaaaagcttccgagatttctcccggtctaatcatacagatgagcgtagcaaaatcagtgttactgtaaatgggcagcccttatcagatcgtgttgtcaagaaggctgaaaagctagccggaacaattcagcctggaaattattgtgaactaacagatttccccccatacaggtatgattttcgggctggattttggggtgtcatgggagggccttgtcttggaataattcctccatttatagaagagttcaatcatcccctcccagacaaatgttctggtgggagtactggtgttttagtaaatggtagggaacttcaccaaaaagacttagatttgctatctgggagaggactccccacagatatagatagatcttatatcattgaaatttctgggagagtcctggatgaagacacaggtgaagagctggacagcctaggcaaacttgcaccaacgtaa

SEQ ID NO: 95124 - DNA, 1746 bp, Glycine max
  Peptide Sequence Number=SeqID_211902
atgaaggttgctgcagaaggctgcaacttgctgttgttcattacctcttaccttttactgatctcagcagttaatacacaaacttatttgtgttgccattgctttgaaaacaagcagtgtttggcagaacctcggagagcacagtatggaggaggcattatagtaaatccaggatttgatcacaacatagagggttggacagcatttggaaatggagcaatcaaggaggtaatgtcgaatggaggcaatagattcattgttgctcacaacagaacacaaccattagatagtttctctcagaaggtccaacttaagaaaggaatgctgtacaccttttctgcttggcttcaggtcagtgaaggaagtgacactgtgtcggttatgtttaaaacaaaaagaaatgaaatggtacgaggtggccaagtgatagcaaagcatggatgctggacccttctaaaaggcggcatagctgcaaacttttcaagccctgttgaaattctttttgagagcaagaattcagctgaggaaatatgggcagacaatatctctttacaaccattcactaaaaagcagtggagatcactacaagacgccagcattgagagggtacgtaagaggagggtgagattccagataactcatgtaaacgaaacagcattgaaaggagctaaagtcatcaccagaccaataaagctgaacttcccatttggatgtggaatgaaccattatatcctcacaaacgaagattaccagagttggtttgtgtcaaggttcaaattcacaactttcaccaatgagatgaagtggtatagtacagagaaaaagcaaggcgaggaaaactacactattgccgacgccatgctgaaatttacccaagagaatggcatttctgtgagaggtcataacattttctgggatgatccaaaatatcagcctgattgggttaggaccctatcacctgcggatttaacgaaagcagcagcaaaaagaatgaaatctgtgctttcaagatacaaaggagaactgattgcatgggatgtgatgaatgagaacctccatttccacttttacgaggacaaattcggtgaaaatgcctctgcagtagcatatgcaacagcttatgagcttgatccagagccaaagttgttcctgaatgagtttaacaccattgaatatagtggggatgaggcttccaacccagccaaatatataaagaaacttaaggagattctgtcatttccaggagtttctggaatgtcagcagcaatagggttgcaaggccattttgctagtggccagccaaatcttgcatatatgaggtcaggtcttgatcttcttgctacaactggacttccaatatggctcacagaagcaagtgtggatccacaaccaagtcaggcagagtacttggaagaggtactaagagaggcttattctcatcctgctgttgaagggattataatgttttctggtccagcacaagctggtttcaacgccacgacgctagccgatgagactttcaaaaatactgctgctggagatgttgtggacaagctgattcaagagtggggaactgggcctaatattgccacagcagatagcagaggaattgtggatatttcactgcaccatggagattatgatgtaactgttacacatcctctaatccactcccctataacgctgaatctaagtgtaaagaaagatttttcactagaaaccattcatgtgaaaatgcatgcataa

SEQ ID NO: 95125 - DNA, 780 bp, Glycine max
  Peptide Sequence Number=SeqID_211903
atggtttatgttgtttttggaagggaggggggactgggagaaaaacatgataagccaatcttttctctttgttttgtgccattagctgtcagtatatgcaaactatttttctgggctgatgtagcggattcttgttcaatcccatgccttgaacatgatgaacggggtagtactgggcaggttggtcgaagcaatggtcaaagggaagctggtggaaaagtctttactcagagtaaagagaataatgaaagtcaaagtagagagcaaagagatgagaaatcaccggtgaaactggatgacagtttacagaaaagagatggtttcactgcaagaaaagatgatccacctactatgaggaaaagacgtgcatttagggagaagaagatccctgcggattcagcagatgctaatccagcttcgatagtggaagtaaagccaagccatactgaccatcctccggaaaggaatgaaaggaaggatgaaagaagcagcaatcctcatcatctggatagacctgagaagcaaaatgcagagggcagagcacccaataagattgaagctagaagggatggtttttcatcaagagcaaggtatgggggcagtggaggcaataacaattacaggggaagagataaatttaatggaaagcaaggttatcgtcctattaagacacgaatggagaagtggaaacatgatttgtatcaagaggttaacaaggatcctattcctaagaatgaggatgaccagattgcaaagttagaagcactattggcttcataa

SEQ ID NO: 95126 - DNA, 351 bp, Glycine max
  Peptide Sequence Number=SeqID_211904
atgaaggccgatatgttggccttgaaggatcaaatggcttccatgacggaagccatgttaagcattgtcgcaacatgcccttttgcgggtgagcgaggcgaggctcacgggtgcacattccaaaggaggaaagatgcgcggagtcgccaccaacgtttatttgtggaaaacgtcggaaaaaccaaaggaaaccggtcgacaaatgcggggctcttgctcctacgtaccctccatcaaagaggaaatcagacctacgtagttctctttaagggtgaatcaagcgattctttttacttggaaggtgatcattttaaggcgttggaccttaaaaatgatccatttacttggtaa

SEQ ID NO: 95127 - DNA, 357 bp, Glycine max
  Peptide Sequence Number=SeqID_211905
atggcaaagtggagtctcacggagatgatcaaagaggctgacacggatggggatggtgtaattagcttcactgagtttgctactatcatggcttgctctgattttgatttcttaggcctctcgagcccgcggaagaacaccttcttccgctacactacccaacgtccagttttacacgcgcggaagaagaacactaacttggatggcggaagaaacgctcacagaaagccaatggcgaagacgggaaccaaaatggagactgaaagccggcgagaacaaaggcctgtggaggagaacaagggaaccaaaatggagaagcaaagcttgcacggaggaagaacggaagaagaccaatga

SEQ ID NO: 95128 - DNA, 678 bp, Glycine max
  Peptide Sequence Number=SeqID_211906
atgttatatggtaagcacaacgagaggcctaagaaatcaaaatcagagcaagccatgatagtagcaaactcagtgaagctaattacaccatccccatccgtgtcagcctctttgatcatctccaacacgaggtctacgtcgtgtgttaggcagggtagaggcagagacattagtcaggatgtgcctgaggctgatgttcctcggcgtcgtaggcccactgcctcagcacgtaggcaacgggttacccagagagtcgaggatgttcctcagttgcctgaggatgtgcctcatgtgtctaatggtagcccagaaatgacaggcgccgccgatggtgttgagacagatcgagtggctagtgatgggagcttgggggcacttgctgatgatgaggggttccccggtgggccacgtgatccatctgttttgatagaatttgttgatcatgtggcacacaacatatggagtggacaggagcgacccgatctcaagttggtctcccatggtaggaaagtagataaatttgggagaccggatgctgagatcgaaggtgtgatagtggccaccggattggatccactgatcaggtgttctgtaatcaccattgatcctggacttatattcgcctttgttgagaggtggcatagggagacaagcagcttccacctcccagtagaggag

SEQ ID NO: 95129 - DNA, 278 bp, Glycine max
  Peptide Sequence Number=SeqID_211907
tgaaagttaagaatgcagatgcagatgcagggggtggagctattattgggagagattacctggcacttttggagaagcactggcctgaactgcagtgggataagaatagtggggagcattttttcttttacactgacgacaaggatatcaggcatgtggtattttatccatctttgaagtcaatttctttgcggttagaggaagctcgttcatggggatgtggcatctcgatctgggaaattggccaaggtctggattatttttttgaccttctgtga

SEQ ID NO: 95130 - DNA, 1089 bp, Glycine max
  Peptide Sequence Number=SeqID_211908
atggaagagagcaccaagaggaaatacactaatctgatccatgaactaatccaaggaaaggaactaacaaagcagctcagtgaccatctggtttcatcttctccatcatcccatgaaaccaatgaattgttggttgagaaaatacttttgtcctatgagaaagcactcaccatgttgaactgggggtctattgtgggagaagccaaaaccaccagtctcaacatcatggattcccgttgttcttttacaaatagtgaaagccccagaagtgaggtcgtggaccgtgaatttgagcacaaagctgtcttcaagaaaagaaagaccatgcccagatggaccgagcaagtgaagatttgctcaagaacaggacttgaagggtctttggatgatggatatagctggagaaaatatggccaaaaggatattctcggagctaagtttccaagaggatattacagatgcacacagagaaatgtacaagggtgtctagcaacaaaacaagttcaaaggtcagatgaagacccaacaacaattgaggtgacctacagaggaagacatacatgcacgcaagctaagcatttaaacaaggcattctcatcaaacataaagataggtttgggggaaaatcaattccaaaagaatcaaccacttctagagaaaacacaacaacagaaccctgaggggattttcacctttgaaacagagcttaaagtcaaaacagaggaattggaaaccaaggaggatatcttcccatggttttccttttcttcttcatcaattggatcagaaaatgaggataacatgttacccgacaccatgattgaaaaccatttcatggaaagcttttctcctgtattcatatcaccagcgacttcagaatcaaaccctttctgtttgtcagcatacgacttggacagcactggactattatgccgaaacatacaaacctcagaatctgatatcactgagatagtttcagccctaacttcagtcaccaactccccaatcctggatttggatatcttacttgataagggggattttgacacggatttccctttcaacattcctgaatttttctcttcataa

SEQ ID NO: 95131 - DNA, 1032 bp, Glycine max
  Peptide Sequence Number=SeqID_211909
atggatcctgttgagcaaatttctgaagagtggagttctcttagtggattctacacagctgaggaagctgactttatgagccagttgcttggtaactgttcactccctgagaacctgtgtggaaacttcaatttgggaattccatctgcaatatggcctggccatgaatcaacaatagtgagcgtgacaggaatcaatgaaagtccatattttcatgcaaatgctgataatagaagtagcttcactgctgatagtagcaatatttttcctactacaagtggtaataagtgtgatccagtagccaacattggctacatgtctgtgggttttcccttgggggatgccaagtttagcccatataatgttcaagggagtgacagccaacagataaatgaaaacactgatgaagagttaggtctagaggttattgctgacaagaaattgcaggatcaccaggaatgtgaagtactagtttctgaagctgcacaagaggatataaacaccaatctggagaagtcaggaaaaagatctaggggctcaatgcaggtacgaaagagcaagaaaaatgttaaatctatgaagaaaccaaaatctgattctataagtaactctgaggagggtagaagtcctgatcttcagggtttctgctcagaggatgatgactccaatgcttctcaggagctaaatggaggaggatcttcaagtttgagcctcgaggattctacatctcttaagttaaaggggaaaaaatcaacagctaatagaggttctgctactgatccacagagtgtatatgcaaggagaagaagagaaagaataaatgaaaggttgagaatcctacaacaccttgtccccaatggaaccaaggtcgatataagcaccatgctggaggaagctgtcaaatatgtgaagtttttgcaactccaaattaagcttctgagctcagatgatctctggatgtacgctcccattgcttacaatggaatgaacattggactagacctcaatattaccccaaccaaacaaccataa

SEQ ID NO: 95132 - DNA, 750 bp, Glycine max
  Peptide Sequence Number=SeqID_211910
atgtataaaaagttagatggatcctttaatgttaagctttcctaccgactgattttgcctagagttgttctggaagcatcaccagcagtgctgttgggaaaggaaaaacaaaggaacaaagccattaaccttatagtaacagagtgcaaggaaatgggatatgatggtattgttttggaatcttggtcaaggtgggcagcttatggtatcttgcatgatccaagcatgcggaatttggtgacagttaaaactatgaactctatttcggagaactcaactaatctctctcaggcattgcagtttgtaaaacagcttggagatgcactgcattctataagctcagagaaaattagtgggcagcagctgcagttggtctatgttataggttcaccttctgagaagttgcaagagcatgattttggtcctaaagatcttgagactttaagtgaagctgtggatggattctcgttaatgacatatgatttctctaatcctcataatcctggtcctaatgcacctttgaaatggattcaaattgttctacagctgcttctcggtacctctggcaatagagcccaaagccttgcccccaagatacttcttggtatcaacttctatggaaatgatttctccctttcaaggggtaattcctttgtttcttgtcttcgtaatcctttacatgtttggttggaggggaatgaaggaggttgggtaccaggacaatccctcctccttcatcctttgaactaa

SEQ ID NO: 95133 - DNA, 740 bp, Glycine max
  Peptide Sequence Number=SeqID_211911
atggaacctgttcaattggtttctgaagaatggggttctctttgtggatttcacacaactgaagaagccgacttcatggttcagttgtttggtggtaacacttcagtcactgaaaagcacagtggaaataccacttttggcttttggcctggccatgagtccacaatagtggccataactgacactaatagcaactcataccttcctccaaattttacagatactaattttttgtgtttctcacaagggagtagctccagcactgataatagtggtaataatatcttttccactacaagtagtggaacctactcctgtgatccagaaacaaactttgattctgtgcccatggttttgtgccttggagatgccaaatttagtccccatagttttcaatgtgatgactacttaagccaacagataaatgaaaacactgatgaagagtcaagtcttgacccatggaaattggctattgctgacaacaatttgcaggctaagagagagtatgaaatgatggtttctgaacctgtagaggaagatagaagcagaaacctggagaacctaccaaaaagactaaagagctcaatagagggaaagaccttattggtggagggcatttgtaatccctgcctggcttgtgaaaccatccaagcaatgacagaatttaaatttggaggagttttgtcagatatttgggagaacgaaaagcagcatcttctggaccaagatacggcttacag

SEQ ID NO: 95134 - DNA, 406 bp, Glycine max
  Peptide Sequence Number=SeqID_211912
tggtggattacttagacatccagctaattctccacaatggaagacaatcgatcatttgtatccaaattttgtagacgagccaagaaaccttaggcttggtcttgcttcggacagaatgaatcattttggtaacttaagcactaaccatatttcatggcctattttgctgatgatttacaacctctcccattggttatgcatcaagcaaaagtacactaagctttgtatgatgataacgggtcctagacagctaaggaatgacattgatgtgtatctcagtctgttgattgaagatttcagaaaattgtgggaagatggggttgatcgattgaagaaagcttttaatgggagtcaggaaaatgagagtgcgtcaaaaccattagctaggaaagaagtttatgatcag

SEQ ID NO: 95135 - DNA, 868 bp, Glycine max
  Peptide Sequence Number=SeqID_211913
atggatccaaacatcgatttagatgaagttttagatcaaatgatagatgaggaattggaagacaacactaatgaagaaatcattaggttgatacttgagagtcaacaacaactacatggcaacaccactgggtgtagccaaagaagaatagtggtacatcataatcatgaagaagacgcgctcaacaaccatgatgaatactttcaaatgagggtcgatgcactacgtcaaaaaggcttatctccattgcagaagtgcacaactgctattcatatattggcttatggatcacctgctgacaatgtggatgaatacgtccgaattggtgaaacaattgcagtggaatgcttggaacgatttgtatcaggcatctacaccatatttgggaatgaatacttgaggagaccaaataacgaagacaccgaacgactactacaaatgggagcggcacgcggatttccaggtggaagaaatctgagacctagaaccgcaggacctgaaagaaccaactcgcatgaacatcaaaaccgaggtgacaatcttcttgaccttaacagcaaccttcttcagcttcagcttaggcttttgtggctcaacaaaactgatggacttgaccatcttgtctttgccttgcagaccaagaagctcgtatctgtttctgcggctgaaggtgagggtggcgtttcgtacaagcgtgctcatggctgtaaaaaatggagattcacgcacacggacacaaaattgaactcaaacaccggaaagtttataataattcacgcatacccttcaatcaaccaacagactccttggaacacagtgatttgcaaagtgaaaacaaacgcaaacacagacacggcttttgatttag

SEQ ID NO: 95136 - DNA, 462 bp, Glycine max
  Peptide Sequence Number=SeqID_211914
atgatgatgcgccaaagcgggcaattttgtgaaagaagctggactcaattaaaatctcagtggaacaagatccatcatctagttcaaaagtttaacgggtgctacaaacaagtagataaatataagagaagtggaatttcagagaaggatgttttgactgatgctcatatgatttactcacagaaaagaacaaaggtttctacttctggaaattactcgtcttcttctaacccagagacacccgttgaagttgaaaaatatgttatgccttcgccaatgtctcgcccaattggacaaataggagcaaaaaggaagagcaaaggaaaagaatgttctaaccctctcgatttatctagcatagaaagtgtaatgaaggacaaaaatatgaacacctcaaaacttattcagttgaaagaggcacaggaaaggcgtatgcaagaacaggaatggtgtttggagtag

SEQ ID NO: 95137 - DNA, 882 bp, Glycine max
  Peptide Sequence Number=SeqID_211915
atgtgtgcctttagggtgctatgtgatgaatttttcattattcctatcacttccaagtttcttcaccattacaatgtaaaacaaaataggaagggtggttgggtctcccttatcggtattctcaacaaggctgttattggtccctccacctcttcttacaaggatttcaaaggctacttcttccgagtgcaccctgggattgagtcaaagtttttgagagggctttattgctcaaggctaaaggggctatggctaccaaggcataagttgagaaggccaagggcaaaaaaatatgaccatttcaaagacaactgggttcttcctcctccttctatcatcatgggtgtcgctaagagggtgaattcatctcaagatgaagggtcttccaaaaggcaaaaggtggagctagtgctaattgccactcttttcgtcgtcgagagccacctcattttcttatctatgaaggaagcagtttcttctctatgggataaggatttcaatccatgtgctcttatagtcaggctagaatatgctatggaagcttcccttctagcgttaatggattgcattcttactactactaaagacttggccaaggctctccaagatgagattgaatgccttaacaaggagtttgctctcttcaaggtgaatgctaaggagactgaggttaagcttaacagtgatctcaacaaggctgaggccgagatcctcaaaactcatgaagtcagcttctttaaggccactaaccaagccaagtacttatttaaggaggctgatctatacctttctaatagtgacaaggaaatgaatcaccagggggagttggttcttgaagctgaggcgcttgctaaaggcgccattgaagagcctattacttag

SEQ ID NO: 95138 - DNA, 1644 bp, Glycine max
  Peptide Sequence Number=SeqID_211916
atggttgagaacgacaacaacaccaacattgtaaaagggataccgattgtgggtgcctctggaaagaggaacccaacaaacgtggtgagtcccttacgtcaggagcttgatggaacaagggaggaaggaattcaagagaaccaaaacgcaaactcggttgtgatagcgaaaacccaccaaacatatctggctaagatagacacgactgatacaatgtggcgagaaggaacccattccgtcacaaaaccagtccacaaagcaacaagcactaacactcggttgcatcctttcatcgacaggattatggaagcccaacttccacctggatggaagttgctaagcatcagttgttacgatcgactctcagactcgaacgaacacggtgtaacactctatttttatactcaattgctgaaaaactccattgactcattcgcgacactaatcgtgtgttttagagcagagtatgcgatgagcataccacatcatctgacagttgtggcacttgccagctttaagcaagaacaagatgaatcgcttcacaaattcattctatgcaagaaaccgcctacaacattgggcaagttgagagcaagggttgtcgaattcattcaaatggaagagattactaggttcaaagagaaaatgtgtgaagaaacctcaagaaagctagtggacccagaggaagcttgcaataccaggttgatccaatcattggctaagaatcgacttccaccaatagttgaaaagtccaagtactatcaatatcatcaagtcactaatcacaacattgaagattgcactatccttaaggataaacgagatagaagccaagaacgtagcagcacttgcaaggcaaaagaaacacaccatcagggtgagaatcccctacccgaaacacaacttcgaggtgtaatcaacataatagctggaagattcgtgaggagaggaagttcaaacttggcacgcaagcactatgtctgtagccttgagtctcttaactcagttgcagtcgaaaagaaacccacaaggagcctacccctcattactttcatagatgaggatttcgagggaatagaccgatgtcacaatgatcccatggtggtcaaaatacagacaatgagcacaataggatatgtgcacttgctaactactttcaaagatgaaaaggggtcaaagtccatcatgatcaagtactttttagtcgacaccttgactttttacaatatattgataagatgtccttcacataacgagttaggggccatcatttcaactccgcatctagcgatgaagttcccaagtgaggatgggaaaattatcactatcagagttgatcaaatgagtggaatggaatgttatattgtaagcctcaagattgctaaagggaaaagggtagcaaagcccaaagtacaatcggtagcatgcacctccctcaatagtaacttgggagaaactgaactcgatttgagaaaagcaaagtcgagagtgaaacccactaaagaagtgaagtccttccaactcgacaaagatccttctcaatgcaccaagcttatatgtcagatgagtaaagaaatggaagaatccataacccaagctagactagtcacacaaagtaaaaggaaactcgatcctaaaaggtaa

SEQ ID NO: 95139 - DNA, 318 bp, Glycine max
  Peptide Sequence Number=SeqID_211917
atggcacataagaggaatgccactttcaacggctccttaggcgtgtgtgtgaatcatttggatattttcaagttatctcaagttacctttcctgttctagctagtccaggtttcttagacctagaagattgcagagaaggagcaaagggagatcaagaagtacttgagcaaaagtcgttaagggaggttaagggagatctcatgatttgtggaagtggaggaatctttagctcgtcaactaccaaagtaaaattgctgaaaattgcagaggtaactgcaattgtggtcacaatcccttacactgtcgtttcactttga

SEQ ID NO: 95140 - DNA, 312 bp, Glycine max
  Peptide Sequence Number=SeqID_211918
atgtggtcgagggagcacttggcagagaaagaattgaagcggcgtggtgccactcttcgagaaaagggaaagagctttgttccatggaggaaggaagaatcgtggatggagggagcagagagcgataaggaaagagaagaggacatgggtgcacgcaattggaaacaaaggtacgatacgaggaatgtggttttggttcctacggcgaggaagataggagtgcaggaagctactatccagtttcttgtggtaagcgggttcgggtatggtatggtattggagcttattgagtttatatgcacaacaaattga

SEQ ID NO: 95141 - DNA, 633 bp, Glycine max
  Peptide Sequence Number=SeqID_211919
atgtcgcaaggttctgctcttttctctttcctctcttacagttcgcgcctttttctttttctttccaaaaccctgattttcgtttgcccaatcacgcttgatttgttaactgggtatgtagatcggattggttttgtctattcagatcaaccgtgggctactaagttatattgcttcgtgcacaaagttcctgtctgtggggaatgtatctgcttcccggagcaccaaatctgcgtggtccggacttattccgaatgggttatagatggggagtatgattggcctccgaaatgctgccaatgccagtctgttttagaagagggggatggatctcaaacaactcgactgggttgtttgcatgttatccacacaaattgcttggtctcgcatatcaagagttttcctccacatactgccccagcaggatatgtgtgtccttcatgttctactacgatatggcctcctaaaagtgtgaaagattcaggatcacgtcttcattccaagttgaaggaagctatcatgcagcgacttcatggtcactgtggaagggatgatgctaagggttatgagctaccatctggaaaactcattcaagacatcatgtctgattctttattaaatggacagtactga

SEQ ID NO: 95142 - DNA, 105 bp, Glycine max
  Peptide Sequence Number=SeqID_211920
atgctagtggtagagaatttgcttatgaatgaggtggaactatcagcggtggggtctgaaaggtttggttacacttggcaggttatgtgccttgaattgacatga

SEQ ID NO: 95143 - DNA, 348 bp, Glycine max
  Peptide Sequence Number=SeqID_211921
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgaattgggttcaagctttccccagccccttctcatcaatggactcctga

SEQ ID NO: 95144 - DNA, 447 bp, Glycine max
  Peptide Sequence Number=SeqID_211922
atggggtacattcagaccgttcctccgccaccgtttcgtgattcgttgacagatcatgtggtgcctacaggggagctctgtgtagttcttgggcaggtggccccagactacatggagtggttttttcagattttgcacccttttgtgacgctgacggaggacactgctgagccgagacctgcgcctccccccccccccactcatgatgatgagttcgtcgagccacctgtccccgaggttccagtcgcgtcggatctccctacacattttgtggttgattgcacaggatgtgtaaggattgctgagcatttggagcgggccatcaacctcaggatggtgactaaagggactgacttatatgatatcatggatatttgtcagaggatagctagaggtaacgacccagatgacagtcttatgccgcgacagagacaccgcatatattaa

SEQ ID NO: 95145 - DNA, 231 bp, Glycine max
  Peptide Sequence Number=SeqID_211923
atggcgaacaaggccaaaggaaaaggcaaggaggtcgctggaaaaggttctgccggcaagcgcaagggcgccttcgacaatgacaagaccgatggcggctgcaagagaaacaagccttgttcgaatgaaccggtctctcatgttatttttttggattcgttgacgtgcagacatgaggcaggccacctttggagggccacctttagagagtctcaggcgatccccagataa

SEQ ID NO: 95146 - DNA, 528 bp, Glycine max
  Peptide Sequence Number=SeqID_211924
atgacctttcatcttccttttttttttcctttttttcttccctgccactccacatttttcttccttctccttcctccctctcccttcgctccacttcatgccctgtcctcgtccccttcccctcagcattcacggtctccctctcccctcccgtctgcagcctcgcggctcccccctccccttccccttccccttcgtggcctcaaggccccctcctccttccacctccgcgaccctccaccgcgatcacccccgaccaactccaatatatcaaagatcttcagggttcttatagaagaacccattatccaccctggagatctatggtgttccttttttgggagatccacacaaggtcagatcttgagctcaagatctggcgctaaagttgctcttaaacatcgtgcccatgttgtgcattttagcaagcctagcccacatacaaacatcagtgatgacgaagacatggaggagtttctctgtaggaagcacttggtcaaaggcgaggggagagggaaaagaaaataa

SEQ ID NO: 95147 - DNA, 198 bp, Glycine max
  Peptide Sequence Number=SeqID_211925
atggggtttatacattcgcaagggtggatattcgtcgatagtgggaatgaaatggagcatgaaacattccttgcaacttggttggcagagattgatttctctcccaatggcttgagattctcaaatttgcaaccacaccctaggttgatcaaccatgaaaaacctatgctatgtaggtggcaccggctaaatccatag

SEQ ID NO: 95148 - DNA, 144 bp, Glycine max
  Peptide Sequence Number=SeqID_211926
atgaacgaagaacaccgaatgaagaacgatgtagaaattgattacggccacaattcggaaatgagggggttttatggtcttgcagctcacccaggcgagctgatgcttcactctgaagtaaccttgctcacccagacgagctag

SEQ ID NO: 95149 - DNA, 353 bp, Glycine max
  Peptide Sequence Number=SeqID_211927
gtcctggtcaagcggctcggtctcctcaaaggaagaaatccatcacatcagccatatcaccgttttccttagcttcgtcttcatctcctggggcctctgacaggggtcctagcgctgttggtgcagggtatactggtagaagctctcgttcaaatgcacctggcccctatggttggccgcctgctggtcagccaaatgctacatgtagagttccaccctctgcatgtgaggtgagatggactccagagatggtggctgctgtagaggtggcggtggtgcgtctacagcgggctgctactgctggtcctaccccggctgctatgcctaccttggcatgcagtacttctcaatga

SEQ ID NO: 95150 - DNA, 171 bp, Glycine max
  Peptide Sequence Number=SeqID_211928
atggaggatgtagtccctatgaacgaagtaaaggattgtgatgttctagaggaagtcctaaaggagagtctaacaattaagaagactacaattttgcactttttgaagatccttggatggtggcggaccattacctcattgtctagagatggaggccgttctttcttatga

SEQ ID NO: 95151 - DNA, 546 bp, Glycine max
  Peptide Sequence Number=SeqID_211929
atggcatctgggttaaaagtgaacctccagaaatctagattcctcgcttcaaggaatgttgctagaaccaaagttgataaattttctagtatatgtggctttcacagcaccatgaagcttgatagatatctaggcttccctttacttagtgggagagtcaagaagtgtgacttcgattttatcctagaccatatccaggggaggcttgcaggctggaaaatgaacatgttgagttgtgctggtagaactaccttggccaagtccgttcttaactccatccctatttatcatatgcaaaacctttggcttcctacgggtgtttgtgatgaaattgatagagttacgcacactttcatttggggttataccaagaaccattgggtgaaatgggatgttataataaggcctagaaatcgtggaggtctaagtataaggacaactcgtgaagtcaatgtggccttacttgggaaatacatgtgggacttgttacatgagcccaacaaactcagggtttctttgttttcaactaggaaggcaactggttag

SEQ ID NO: 95152 - DNA, 174 bp, Glycine max
  Peptide Sequence Number=SeqID_211930
atggcggtacccttgttctccaaaaagatcgtgaaaagtgtgtcaagacgtttaagtgcccccaaagtgattggaagatctccgtcaagagatagggggagcaacatgaagactaagtcttggagcttgaagaagcttgaaaaagttttgtcttttacgttccaactctcttga

SEQ ID NO: 95153 - DNA, 489 bp, Glycine max
  Peptide Sequence Number=SeqID_211931
atgcaagctaaccgactcactcacgcatatttaattcacaacccatcactcaacaacaacgcgtgctcactcgaaaatcagaaattccaaaacattactcgtcagtacacactttatctcattcatgcaatcgattcagccaaacatgcctccaaaaagtgtcaattcaaccaaacccaaaacatatcattaattgttgtccacaatgcagaaaaagctactgtctcactaagtcgagaccgtgtgcttagcgagtatcatttgcttagtgaggcagcagctcgcttaacgagtaagaagaatcttgaagggaatctgtcatgcaagcacgcgctcagcgcgtcatcaactcgcccaacgagtcatctgtctcttttggcgcttagcgcgcctggttcgctcagccaaatatcacttactcgcgctaagtgcgaaaatggcgctaagcatgcctttgaggtcaaaaagccctttttaagcctaaaatga

SEQ ID NO: 95154 - DNA, 240 bp, Glycine max
  Peptide Sequence Number=SeqID_211932
atgaagttgaaggtaacagaaataaaggtaaaacaagatgatggtaaagcaggatcttacacgagcgaagagagtcacacacagtgggagttcaatagaagatggacaagacaaatggtgcagtgcaacaggagtcaggagcaccaaactgagtttcaagtttcaactttcaacagaggcagccagccacggaagccagagaagcagctgaaggagaaaaacaagaaaagaaaaaagtaa

SEQ ID NO: 95155 - DNA, 456 bp, Glycine max
  Peptide Sequence Number=SeqID_211933
atggggtaccactcccccctgaaggactatcggtgtctccagaaaggtgttcaacatctaagcgtcgaaccggatgagcttcccttgcactttgcattgcttgggcgagccgtcttctggtgcctcctccaaaaacttgtcatactgtgtgtaagccaactccatgttcctctccataaaaatgtttcaaagatgaatgttattctgatatcgatgccaagccacctccaatgtgaatctggtggagtcccatatgggttccaccccctgaggtctactggtggaagctcgacgtttcttagaggccatctgcaaaaagaaagacaacaagaactggtgctgagcaccactctagcaaaagcgaggagaggcttagcaagaggatacgcgcttagcccaaacattgcaaataagcgaacaaagagggttttgggcttagcacgattggcttgctaa

SEQ ID NO: 95156 - DNA, 489 bp, Glycine max
  Peptide Sequence Number=SeqID_211934
atggagaagcaagttaggaagattcgttctgatcagaggctgttgttctccaacattgatcaacttcagaggattatgaatgagttctttgcaaggttccttcgccttgaggagtggatccctaacaaggaaagacctatcttgatccctaaagttgctcttatgcagtatgagcctccaccaccaccaagagctaccaccccgccttcatcttcttcatcttcaaaaaactcatctcctaatatgcatgattggtttacaccttttgttcctcccttctattttttgcttgatgacaaagagggagaagtttatgagagattaacacgacacaatgaccatgtgggtgtcagagagcttgcagaggcaccacgtgaaaaagcggaagagtttgagaaccttgaccggggaggagccaaggcatgtgatgacaatattccatggcttaatatgggaaaggtagccaaagtagaggatgaaagcctatga

SEQ ID NO: 95157 - DNA, 534 bp, Glycine max
  Peptide Sequence Number=SeqID_211935
atgaatttttccttggtttttatcaaatgtgggaaaagattgaaggaggaagagaaggatgtttcctctctagttattgatgcctctatatcagagaaggagatctctgataagattgtagagcctactgctgaaaggaaggtggtcagcttactcaaaatgaagaagctaaagaccagaatgcagaagcttagggagatgaagcttacaatgaagacatccaccattctaagggtgtggagtgcaatacctcagacaaatcacacccaaatgagagaaatgcaaggttgtgtagactatcactttaaaactccacagttgagtgtgtttggattggagtggttatgggatgggtctcaaaagggttacttatggaggtttctaaccggtggagtcatcaagacatcaataatttggggcattacaaatggtatcaaagtaaacctctctcctaatacggttttatttgaggacgtggaagttggtgggaatgtaatacatcgagcgagtcgtactggtttcagagggatctag

SEQ ID NO: 95158 - DNA, 1074 bp, Glycine max
  Peptide Sequence Number=SeqID_211936
atggaataccatgttggctgcctagcacaaagtgcaagtcacgttcgttgctcaaccagttttgaagatgctgatatgtccttagaggcattgcatttgttctgtgacgtgcagttgtctcagataaagcctaatgaagttacacctgtggcattgattagtgcatgttctaatttaggtgcacttagtcagggtgatatgtattccaaatgtggctatcttaatcttgcatgccaattgtttgatgtgttgtctgacagggacactttttgctacaatgccatgattggggggtttgcagttcatggtcatgggaatcaggcacttgaaatgtatagaaagatgaaacttgagggcctagttcctgatggtgcaactattgtagttactatgtttgcctgctctcatggtggattggtagaggagggcctggaaatttttgagtccatgaaggggattcatgggatggagccaaaacttgagcattacagatgcctaattgatcttcttggtcgagccgggagattaaaggatgcagaggagaggctacatgatatgcccatgaaaccaaatgcaattttgtggaggtctttacttggtgcagcaaaacttcatggcaacttagagatgggggaagctgctctcaaacacttaatagagctagaacctgaaacaaggggaaactacgtgcttctgtctaatatgtatgctagcattgctaggtggaatgatgtgaagagagtgaggatgctgatgaaagatcgtggggttgacaagttgcctggttttagcttagtggagattaatggtgccatgcatgaatttctcacaggtgacaaagcgcatccattttcaaaagaaatacatttgaagattggggagataaatagaagactacaagaatatggtcacaagccaagaacgtcagaagttttgtttgatgtagaagaagataaggaagatttcctctcttaccacagtgaaaggctagctatagcgtttgcactaatagcttctccttcaaagatcgaaatcggtttcaccattttaaggatgggagttgttcttgtctag

SEQ ID NO: 95159 - DNA, 465 bp, Glycine max
  Peptide Sequence Number=SeqID_211937
atgaagaaaatcttccagcctggacagcaggttctactgttcaactcccggctcaagcttttccctagaaagctcaagtccagtgagcgtaactggatagtgaatggccaaaggttgaaagtctacaatggtggcgatattgataaattgaccaccatcatccacctccatgaccttgtgatgtctgctcaattttggatggtcaccttacgctcaaagcgtgctaagcacaagtgtgttattatgatagttgtgcttaatttaattatcacagaaggttgctttcaagattacttcaacaaacattcaaaggttaagcactgcttcaagactaatacaaggttgcttcaacaaacaagcattgcttcaagattaattcaagatcaagcttttgcctcaaaacaagtgtttccaagagatcaaggctctggtaatcgattaccaggcagtgtaatcgattactag

SEQ ID NO: 95160 - DNA, 708 bp, Glycine max
  Peptide Sequence Number=SeqID_211938
atggagtggaggaccatgttggagccatggatgcgaggcacaagccttgaagagggagggaaaagtgaagctattgggttgcagggtgttgtgggcaaatttggaggatgtgttaaggaggtgactgagaaaggtgttgaggttgtggcatttttgcaacttttggagaattgggtggttcaacatgaggctactagcttttggtctccatccaaatgtgtgaactacactgtcgacaacgaggactacacctcctcctccaccagcctcctcgtcgccatcactggcttcctcacctccccctccttccatgacaccaccaacactgtcctcccctcctccatccctacctcctcagctgcaacaattgcacactcttcttctctttcgcctccatcttcttcgtcttatttcataactccatcccaccactcagataggacagagccttatccagcgaaggaacagagaggtcctacacgctccgtcggaatctcagcagtagaggaggcatcccagagcctctattcagccgcagggattgctccagctccggtgccggcgctggagggaatcgcacttgttgacgagggagttggtgatgaggggaatgggaacggtggagaagccatagtgagtgggatcctcttggtcgcagaagagcttcttggcacagggcttgtcggaggagaaggaagacgacgatga

SEQ ID NO: 95161 - DNA, 1404 bp, Glycine max
  Peptide Sequence Number=SeqID_211939
atggggaatggtaatctagaaatgagtgtggaggaccaaaaggtgacattcaacttgtttaaagcgataaagaaccccaatgattgcaaaacctgcttcaagaccgatgaaacaaccgtagaggagactcaacccatccatgaaggaggaatggttcccaagaaaggcggtatgatagtgatatgtaatgagaagaatgatctcatccctacacggatagtcaccgagtggagaatgtgtatagactaccacaagcttaatgatgccacaagaaatgatcatttccttttgttgttcatggaccatatgttagagcggctagttggacaagctttttattgtttcttggattgccccttcaatgtctttgcttacagaaagatgccatttggattatataatgcccttgccaccttccaaagatgtatgctagccatttatgttgatcttgtagaaaaatgcattgaggggattgccttagcccacaatatctcatcccaagggattgaagtggacaaggcaaaaattgatgttattgagaagttgcctccacctgtgaatgtgaaaggcatccgaagttttctcgggcatgccaacttttatcgaaggttcataaaagaattctccaaaattgtcaagccattaagcaacctgctgaacaagggtgaaggacggatcacttggtacaggtcacgaaatcgaatgatgccactttcagagatggaagataagtcagggctttgggattctcatcagtcagcccctgtgattgtggccccaaattggagtcaagagtttgcgttgatttgtgatgctagtgactatgcattgaattatgccaccacagaaaaagagttgctagctattgtatatgcatttgagaagtttagatcatactttattggctccaaggtcatcattttcacagatcatgcggcaattaagtatcttctgacaaaggttgattccaagcctaggttggtgaatgaagaagtcactcaggaggagaaagagattcgtgatgagtttctagacgaatccccgttgtctgtgagtgagtggccttggtttgcaaacattcccaacttcaaagcaattggaatcatccctaatactcataattggcatcaacgagataagtttctccatgatacacattattatgtttgggataatcctcatttgttcaaacttggagcaaataacttgctaagaaggatgcctatgagcatgtgttgcattgtgatcagtgtcaataaactgaggaaggtcttggggcactacaatatcaggcataaggttgcttctccttatcatccccagacaaatggtcaagctgtgctatccaacagggaattaaagaagatccttgagaagactgttgcatcttcaaagaaggattag

SEQ ID NO: 95162 - DNA, 1929 bp, Glycine max
  Peptide Sequence Number=SeqID_211940
atgtctcactcaccttctccttcaccttcaccttcttcaaccacaacaacaactacttcaacttcaacatctacaacgacttcttcttctcgtcgattcccttcccctcttctctcgcattcctccaattcctctacgccgttagtcccgaagcgttcccaatcggtggaccgccgccgcccccgcccggcgacaccgcttcccgaggcggcgaagcttctcgtgacttccactcggagcctgtcggtttcctttcaaggagaggccttttcgctgcctgttagcaagaccaaggccgccgccgccaccccgccgccgcggaaggccgccacgccggagcgacggagggctaccccagtgaagggggagaattcgaggccggtggatcagcaccggtggccggcgaggacccggcgggtggatcatctctccaagagtgtggatgtcagtgataagaagaaggttattgggaatgggtttgggaaagtggtgagggctttgcagcaatcaatggtggtggagggtgagaagaggagagcttcttttgatgggttaggagggttgagtttggatttggggaaagctgagttgttgaagggtaatagtaatagtaatagtaatgctaataatcatagtaataatgatggtggtggtggtggtgggaatttggttaataagtcttcattggcttctgatctcactgcttctgatactgatagtgtttcctctgggagcacttcaggagcacatgagtcttctggggctgccaagggcactaaggagcctcgtggcattgttgtgtctgccaggttttggcaggaaactaatagccggctgcgccgccttcaggaccccggttcgcccttgtcaactagccctgcttctagaattggggtgccaaacaggaatgctcagttgaaaaggtataatagtgatggtcccatgttgtcgccgcgaaccatggcttctcctgtcagggggaatgtgaatgctcgacctgcttcgccgagtaagctttgggcgggatcatccccctctaggggggttagtcctgctagggtgaggagcacggttgccagttctatcaatagtggttcaagtaacacaccctcgattcttagcttctctgctgatgtgcgaagagggaagattggggaagatcggatatttgatgcgcatacattgaggcttctgtataaccggtatgtgcagtggcgtttcgtgaatgcaagggcagatgctacatttatggtgcagaaactgaatgctgagagacatttgtggaatgcatgggtaacaatctcagaactccggcattcagtcatacttaaaagaatcaagcttgtgttactgaggcaaaagttgaagttaacttccattctaaaaggacagatttcgtatttggaggaatgggcccttctagatagagatcactccagttctttgcttggagcaactgaagctttgaaggccagtaccctccgtcttccagttgttgaaaaagcaatagctgatgtaccaaatctaaaggatgctttggggtctgcagttgatgtgatgcaggcaatggcatcctcaatatactctctttcttcaaaggtggaagaaactaactgcttggtggcggaaatcctaaaggtgacatcaaaagaaaggcttttgcttgaacattgcaaggagtttttgtcctcgttagcagccatgcagcttaagaacgcatatgttacaactttctcgcgtgccaacttccagctgcctgacaacacgtgtgtagaactgatcttatttgacaactcactcttaatgctaacactactccaagccttttattttccacagggtggagatataacacagaagtatctctttgtgtctgaatatacaatttacaaaggaaaagaggtggcttttcactcactagttagctag

SEQ ID NO: 95163 - DNA, 840 bp, Glycine max
  Peptide Sequence Number=SeqID_211941
atggaaaaggaaatgcttgtcttcagctctaacaaagaggatattctgggaaggcatgatgcccctgttcgttgtgttgagtactcatatgccgcagggcaattgatcactggtagttgggacaagaccctgaaatgttgggaccctagaggtgcaagtggccaagagcgcacacttgttgggacatatccacaagccgagcgtgtctactctctctcactggttggacatcgtctggttgtagcaacagctggaagacatgttaatatctatgatttgagaaacatgtctcaacctgaacaaagaagagaatcttctttaaaatatcaaaccagatgtgtgcactgttaccctaatggaacaggatatgcacttagttctgttgagggccgggttgcaatggaattctttgacctctcagaggctagccaagcaaaaaaatatgctttcaagtgtcacaggaaatcagaagctggaagggacattgtctatcctgtaaatgcaattgcattccaccccatatatggtacatttgccacgggaggttgtgacgggtatgttaacgtatgggacggaaacaataagaagaggctataccaggttttattcctttttgctttgcataatttgagtgaccagaattttcgtaagtactcaaaatatccaactagcgttgcagcactttcgtttagcagagatggacgcctgttggctgttgcatcaagttacacattcgaagatggacctaaaagccaagaacaagatgctatctttgttcgtagtgtaaacgagattgaggtcaagccgaaacccaaagtctatcccaatccaccagtttga

SEQ ID NO: 95164 - DNA, 516 bp, Glycine max
  Peptide Sequence Number=SeqID_211942
atgagctgcaatggttgtcgagtcctcagaaagggttgcagtgacgactgcatgctacgacattgcctagtgtggatagagaacccacaagcccaagctcacgccaccctcttcgtcgccaagttcttcggccgtgccactctcatgtctttcctttcctccgtaccctccaaccaaagatctgctttgtttcagtcactgctttatgaagcagtggggcgtactataaatccagtgaatggagcagtggggctgttgtggactgggaactggcacctctgccaaatgggcgtggagaaagtgctccgaggtggtgctgcattgaccccactccctcaagtaataacaagtgtggagagagtgatggttggaggtgaaataataatgtgtcaccagcccaagaagcaacatgtggggacaccccctgaggaggaatccgagatctccacgttcggaagtagaccactggattctgcccctcaaagtcaaaccaacctccttacactattcttctaa

SEQ ID NO: 95165 - DNA, 228 bp, Glycine max
  Peptide Sequence Number=SeqID_211943
atgaatttggtagcagctgcatgcaggcacttcctctgcccgctcggcgaggaagtgggtttggtgaagttcaatgctaccgaagacaggttctttaaagcatcatggtggggaaggaggtctcctcccatgacactgagactgatcagtacgagcgggttttgttcgaatttgaatgctcaaatcatgttctttgcgccacacctactagggtttgtgttcttataa

SEQ ID NO: 95166 - DNA, 423 bp, Glycine max
  Peptide Sequence Number=SeqID_211944
atggcaggatatgggattgtcattttaggaccatcgctgcatttctggttcaattttgtgtcaaagcttttcccaaggagggatcttttttctacattgaagaaaatggtcatgggtcagacactttatggacctgccatgactgttattttcttctccttgaatgcacgtttgcagggaaatagggtaaacacttctctcttgtactccatcccttcccctccaaacgaaggttttgagccacttatcttttccctttctttttcttatcctcatatccgatcactcatacatggcataactgaagaagggaagagaagtttgacaaataagggaaggggaagtgaaggggctaaaatccctcccctcgctatttactcccttccaatatttgaggatttgggtggacggaaaaatacttaa

SEQ ID NO: 95167 - DNA, 1343 bp, Glycine max
  Peptide Sequence Number=SeqID_211945
aagaacattcttctggagaagttatcgaaagaagttcttccggtaacttctccggaagaaggttctttcggatgaacaatttgttctactggaagaaccttcttccgaagaagctactggaagaagaaccttcttctggaaactatccggaagaaccttcttccggaagaacaacaatttgttcttccggaaagcttccggaaaaaagttcttccggtagaacacaaattgttcttccggaagaagtgattgtgagaaggttcttgggcaaaatgacaatatccaaacacagcttttctcgaattgacacattggagctgaaagctctgattgttaggaaggttggtcatcaaagagctgacaagtactttgatcagcttcgaagattattgagttcaaagataagcaagtcagagtttgacaggatttgcactgtgataattgggagggaaaatatccctcttcacaatcgactcattagagcaattttgaagaatgcttgtctggctaaagtcccacctgtgagaggctctgcaagagttgggagtgccaccagtgtaaaagattcaaatgggtcgcagagaggctctgctcaatcgctgtttggggaagcatttcctccttccatgcggaggatcagctctttggctgctcgagactgtaggttcaagggacgccataatgcttttgggccgctgggcaagcctcattttggtcttgcgtctgaagaattggtatataagacactggagcagcagagtgcaacagaactgaattcccttggcagtagacctccgatttctgttgaagagggagaagaggttgaacagatggctggaagccccagcattcaaagtaggagcccagttacagctcctctcggtgtatccatgaattttggtcgtggtcgtagacttcattctaatgtatcattatgtagcaaagattatccagagacctgtcacagcaatggatatctccctgacactagatctttgaggaattgtttggagcaaaagttggagaaggagggtttaactgcaacagtggattgtgtaaatctattgaataatgcactggattcgtatctgaagaggttgattgagtcctttatggatttagctggatcaagatttggaaatgagcatctaagacagcaaaacagacagttggtaaccagttcaaatgtattgctacctggaagatgtatgcagacagcaacaagatctgccagtgcatctgttttagattttcgtcttgcaatggagttaaatccacaagttcttggaccagattggcccatacaactagagaagatttgcatacgtgcctctgaagagtga

SEQ ID NO: 95168 - DNA, 312 bp, Glycine max
  Peptide Sequence Number=SeqID_211946
atgggaaaacgaagaagctcgttgattggagaagttggtttaatggctaaagtttgttggccatattttgatcctgagtatgagaacttcaccaatagaatgaaccctccaagggtctctgtggacaatgctagtttccatgactgtacattgattaagatggatagtgttaacaaacctggaattctgctggaagttgtccaaatcttgacagaccttgacttcataattaccaaagcttacatatcttctgataggggtattgttagaatggcaagtgtaccaattcgcacaagtagtataaaacggtaa

SEQ ID NO: 95169 - DNA, 2427 bp, Glycine max
  Peptide Sequence Number=SeqID_211947
atgggtgatgcactaaatgaagtgcagcacatgggtggtgcacctgctgcttctcccaagagggacattacattgcttgagggagacaaagattttgagctgcacaatggcattgaatttgaatcccatgaagcagcatattcattttatcaggaatatgccaaatctatgggattcaccacttcaataaaaaacagcagacgctcaaagaaaacaaaagaatttattgatgccaagtttgcatgctctaggtatggagttacacctgagtctgacagtggcagcagtcgaagacctagtgtaaagaaaacagattgcaaagcttgcatgcatgtgaagagaaagccagatggaaagtggatcattcatgagtttataaaggaacataatcatgaacttgtaccagctctggcatatcattttcggattcatagaaatatgaaattagctgaaaagaataatattgatatcttgcatgctgttagtgaacgaaccagaaagatgtatgttgaaatgtctaggcaatctagcagctgtcaaaacattgggtctttcttgggtgacataaactatcagtttgacagaggccagtatttggctttggatgagggagatgcccaagttatgcttgagtattttaagcatgtacaaaaggagagtcccaacttcttctattctatagatttaaatgaagagcagcgcttaagaaatctattttggattgatgcaaaaagtatcaatgattatctcagctttaacgatgtagtttcatttgataccacttacataaagagcaatgacaagcttccatttgcaccttttgttggagtgaaccaccactctcaacctatattgcttggatgtgcattgcttgcagatgagactaaaccaacatttgtttggttaatgaagacatggcttagagctatgggtgggcaagctcccaaagttataatcactgatcaagacaaagccttgaagactgcaattgaagaagtctttccaaatgtccggcattgtttttctctttggcacatactggagagcatacctgaaaatctctcttttgtgataaaaaagcatcagaacttcttgccaaaatttaacaagtgcatttttaaatcatggacagatgaacagtttgacatgagatggtggaaaatggtcagtatatgtgaactgcaagatgatctatggtttcagtcactgtatgaggaccggaaaaaatgggtgccaacttacatgggggatgcctttttagctggaatgtctacacctcagcgctctgaaagtatgaactttttctttgacaaatatattcataagaaaattacccttaaagagtttgtgaaacaatatgggataattcttcagaataggtatgacgaggaagccattgcagattttgatacattgcacaaacagccagcacttaaatctccttcaccttgggaaaaacaaatgtcaacagtttatacacatgcaatatttaagaaatttcaagttgaagttttgggtgtagctggctgtcaatctaggatagaggctggagatggcactattgcaaaatttatagttcaagattacgagaaggatgaagagtttttggtaacttggaatgagttgagctcagaggtctcttgcttttgtcgattgtttgaatataaaggtttcctttgcaggcatgcattgagtgttctccaacgttgtggttgttcttgtgttccatcccattatatcttgaagaggtggaccaaagatgccaaaattaaggaattgatggcagataggacgagaaggacacaaactagggtacaacgttataatgacttgtgtaaacgagctattgatttgagtgaaaaaggatcgttatctgaagagagttacaatgttgtttttcgtacacttgtcgatgccttgaagaactgtgtacttgtgaataattctaataacaatggtgcagaaactagcagcaatgcctatggccttcgtgaagcagaagaaaatcaggttcctcttgctttgaaaccaaataaaaagaggaatgcagccaggaaaagaaagggacaattagagcaggatgttatacttgttgatgctcaagatagcctgcagcaaatggataatcttagcacagatgcaataacccttaatggatattatggtacccagcagaatgtgcaaggactggtacagttgaacttaatggagccacctcaggatggttactatgttaatcaacacagcatgcaaggcctgggtccattgaattctatgggtccaagccatgatgggttttttggaacacagcaaggcattcatgggctgggagggcagttggaatttcgtcgagcaactacttttggatatagccttcaggatgaacctgatccccagtttcatggcaacagttcgagaaatacttag

SEQ ID NO: 95170 - DNA, 366 bp, Glycine max
  Peptide Sequence Number=SeqID_211948
atgaagttcaatgctaattttaagctggcaacagttcagaaattcaatatattgaagtatgaggttgcccagaaatatgattctcattatgatgcgttcaacccagatgaatacggcactgttgagagccaaaggattgcttccttcttgttatacctatcaaatgtagaagcaggaggagaaacaatgttcccttatgaggtgaagccacgacagggcgatggacttttattttattcattgttaccaaacgggaaaattgataagacttctcttcatggaagttgtccagtgattaagggggagaaatgggtcgcaacgaagtggattgatgatagagagcaacaccacttgctttctttataa

SEQ ID NO: 95171 - DNA, 369 bp, Glycine max
  Peptide Sequence Number=SeqID_211949
atggagttgttcttaacaacgaggataatggtggatggggtgaggcagttcatgaccccccattccctagagaatgtgagcatagcaattgtagaggatacctcaaatcatccaaatgggtcaaaattccaacaaatttgttttagatgtggtgatggtgctgataaaattcaaaattgtccaaaagaacatacttcgcaagtgaaatataataggttggatgtttggcagaataatagaatggacaataaacataaaatggaagatgctaataaatttgaatctaattccttggcaaagctgttgtcaaatgtggaggctttctcaacgaggcaccagagagatggggggaggttgtctggttcatga

SEQ ID NO: 95172 - DNA, 278 bp, Glycine max
  Peptide Sequence Number=SeqID_211950
atggatcgaagttggatgaaagcatcacgcattagtgacgagtatgagaatggggttctagtgttgaaagatatgttgttgaagaagctattgagttttgttccgcagtacatagaaacagttcaatctattggacttcttgaaactcgtcatgatcagacacgaggaggtaagggtacacaaggggtcatgggaacaccgccaaggtccccttcatcttcagatggtcattcaaaggctacgtctaggaagagtagacaatccacacggctaagaag

SEQ ID NO: 95173 - DNA, 274 bp, Glycine max
  Peptide Sequence Number=SeqID_211951
gattcaacaagcgattctccctcaaatttcagccagcccgtatcaattagacttcacactttatgcttcggggtcatacaatgctcaatggaatgccccggggctcctccatgataagcacacattgcgttcgagtcgtatcctcagaaaaatggaggttgaggaaccttggttggggctttttgctgcaaaattcctttttgttggtgttttttggtttgtgctaaaggtggtcttcgtcattggaagtgcggtagacaagctttgtggttga

SEQ ID NO: 95174 - DNA, 735 bp, Glycine max
  Peptide Sequence Number=SeqID_211952
atgaaaagcttcgaagcaagagcaaaagaaacagaacaactccaccaacgtttcaagaagctggagcaagagtggcaagccttcaaggaatccaagccaacaccaccaacaacaaaagcttcacacaaacattcccttcaatattcaaacgaaaccatccagaagccacgcaaatattctccaagagaactcatgttcaaccttcaacaacaagagtctccctcaccggaagaagaaaaatcgaagaacgtaacgaggaccaaggatagggcagtgcaagagattcttcaagagcgtagggaggccattgagaggggaaaattgaagggtcgacgactttttcattcagaggaaaagggtgatgagagtaacagtcgtcatgaagtgagatcaatgtccttctatgaggaggaggatgatgaatctagtggaagcgaattaggggtgcatgattattgctcgcgcgagctttcatattcttcttcctctacatcgtcctgtctcattggtggcgacaatcataaccaaaataacgagacagtggcgcctttggtggcaatgataaccacggagatgggagttgctagtaatagtaggcgtgccaatagaagcacgaggtatgctgtattcttaggtggggttgctgctattatcttgcttgtgattgcaacgttaatgcgcttgggaaagagttttggtggagatgattgcgacaagattttcattccaacatga

SEQ ID NO: 95175 - DNA, 300 bp, Glycine max
  Peptide Sequence Number=SeqID_211953
atgtggggttggagcaaaatgaaaaggatgtgttggtgtggacacaatgtccctcgagaactttctcggctagcaatgcgtaagccttctaatgagggcttgccaactagatcaaacttgaggagaaggaatactaggcttgacaacatggacttctcatgtccattatgccatcaccaagaagaaacattagaacacttgtttttcttatgcccgatagcgtcaagtatatggagcaggtgctggaattggctaggtgtacaaatggttctacactacaaaccaatggagcacttttag

SEQ ID NO: 95176 - DNA, 678 bp, Glycine max
  Peptide Sequence Number=SeqID_211954
atggctgaagcaactcgacccaaaactagaatggaacacatagaagaagccatagccaagctagcctccaaccaactccatgtcaccaccaaactaggtgaactcattcaccgcattactgtgttggaagcccgtcagcaccactcacccacacctccatcttcttcctctgcgaaaacattcctaacacatattccaatatcgactttgtcgctgacttcgccgctacctccactattgaagccaacttcgccaccacaccccgcactcatgccgaaacaccccgcacccttatcggttccgtttcccatgcatgttcctcaccttgtcactaacagcaagcaccaagtggcctacgcatcgtcctccgtcttcaaccagctcgatcacgcctgtgccgttgcttcccttgacaacctcttaagtattgttgttcattatggtcgtgaagcggctccgcatgacaagcttttggaacatagagacatgacactatttgagaggggagttgcgccctatgggaatattatgaatcagcccaaggtggagcaatttagcacagaagatgaaatagcagcagacaaggtggagacaagcactaacctcaggaccaaaaggaaaatatgcaggccgcactacctgaaggattttgtgaccaatacaaatcctaaatgctaa

SEQ ID NO: 95177 - DNA, 474 bp, Glycine max
  Peptide Sequence Number=SeqID_211955
atggttcataaggtcaagttggaaaacggtctaatcaggctttctgttatcgcaaattcaatgatcagaatcttctatagtttggtctgtgagaaaggaatgggaaaaaatgaaaaaagagtgaatctcatatgctatgatgaagttgaggatgatgtgttggaacaccgtgacggagaaggggttgccgatgaggatgaagttaaggatgatgcgttgaaacattgcaacagagaagtggttgtcgacaaaaaagaacttaaagatgatgtgctgaagcactacatcgaagaagtgtctgtcgatggggaggataaagttgaagacgacacactcaaatccaatgctaagaagtttttagaacctttgttggtgtaccctgttttgattggggttggtgataagagtactgaagcacatggttatcctgcaacttggaacttggttttgccagctcccgtattatgtgtgtag

SEQ ID NO: 95178 - DNA, 927 bp, Glycine max
  Peptide Sequence Number=SeqID_211956
atggcaaaggagaaaaacccagaggaagaagcaacccaagagaaaaaaccggagcaagagtccaaagaggaagttgctgctgctgctgctgctccgccaccgccaccgccaccgccaccgcccgagattgtgctcaaagtgttcatgcattgcgagggttgcgcccgcaaggttcgtcgctccctcaaaggattcccaggtgtcgacgatgttgtcaccgattgcaaatctcacaaggtggtcgttaagggagagaaagcggatccgctcaaggttttggagagaatacagaggaagagtcacagacaggtcgagcttctttctccgatcccgaaacctcaagaggagaagaaggtccaagaggaagagaagcccaagcccaaccccgaagagaagaaagaagagcctcagattgtgacggttctgaaagttcacatgcattgcgaagcttgctctcaggaaatcaagagacgcatacagagaatgaagggagtggaatcagcagaacccgatctgaagaactcacaagtgagcgtgaagggggtgtacgatccagcaaagttggttgagtacgtttacaagagaaccgggaagcacgcagtgatagtgaagcaagagccagaaaagaaagagaaagtggaggaagcaaaagaggagaagaaagaggaagagaagaagagtggtggtgaaggagaagaaaacaaagagaagaaggaagaagaagccaaagtagaggaagcaacaacaccagcaactactgaagacaccaacaaggttgttccagaggttaagattaatgaatacttctataacccaccaaggtatggcatggaggtgtatgcatatcctgcacaccctgcgtatttccattcctaccctccccagatgttcagcgatgagaacccaaatgcctgcactgtcatgtag

SEQ ID NO: 95179 - DNA, 294 bp, Glycine max
  Peptide Sequence Number=SeqID_211957
atggtattaaaaactgtaaatgataataaactcccctcacctatcgtgagctctctgtcagttcctctttgcatcgctcagaggtctctcattcacgctccggcaagcaacgacggctcgtggtggccaccaatagtcgtgggtggtggagaagaaagtgttagggtttgggtgggtgggtgtttggagaggaggagagcgaagaatcatgtttttcacgttgaaaaacatatttataatctacagatcctacttagcgagctcgtctcactaagcggggtctacttttggtga

SEQ ID NO: 95180 - DNA, 390 bp, Glycine max
  Peptide Sequence Number=SeqID_211958
atggaatggaatgtgtccaaggataagctgaaacttgtggctttaggtgggctatcattcagtctcttagtgtgcaaggaaagttacaagggtagatatagtgccatctacatgttggaccaacgattagggctagcatgcattgaaattttaatctacaagcaagagtcactgtgtagtttcatccaaaagcttgcagttgagtaccaaaacaaggcactgattgttaaggttgatacagatgaggagtacgaatttgcacgcgacatgcaggttcgtgggttgcctactgtgttctttattagccctgatccgaacaaagaagctattcgaaccgaaggacttgtccctatacagatgatgagggatatcattgacaaggatatgtga

SEQ ID NO: 95181 - DNA, 341 bp, Glycine max
  Peptide Sequence Number=SeqID_211959
atggcgcgcagagacaaaaattggtcattctgcaccctttgtcatccagaggcggcgggcccgatgacatgcggagacaaaattggtcattccgcacccctttgccattcagacacagccgtgtccgatggcgcacagagacaaaaattggtcattctgcaccctttgtcatccagaggcggcgggcccgatgacatgcggagacaaaacttggtcattccgcacccctatgccattcagacacagccgtgtccgatggcgcgcagagacaaaaattggtcattctgcaccctttgtcatccagaggcggcgggcccgatgacatgcagagacaaaatttg

SEQ ID NO: 95182 - DNA, 429 bp, Glycine max
  Peptide Sequence Number=SeqID_211960
atgaaaaaagactatgacattgcccttgttggggcctttagaagggaaaaggacaaagacatggaattacaggcactaagagatgaaattcaagcgtccatgaagctggtgagacaaagagaagatgacatacaaagtttgaagatgagactacgttttcgagaagctggaataaaaagattacaaacagatgcttctgagaagatctcagctgagacacacttgctaaaagaaaaagaggagcacttgaaggaaattgaggtcttgcgggcccagaccttaggagattatatcagcacaatgatttcaagattatccatcagaatatggcatggaaggctggttgtggggataaaatcagattttggaaagataggtggttgggggaggaaagcactctgcaacagaaatactctcagctctttttga

SEQ ID NO: 95183 - DNA, 267 bp, Glycine max
  Peptide Sequence Number=SeqID_211961
atgtcatcgttgaatatgcgaaaaggatttgaaggccaaaggataaagagggaaatatccaccttgaagctgctgaagcatccgaacgtgaggaacttagatcaattggaagacttactcaacaaggttaaattgaagaccataaggactgaaccaccttctgcatctattgctggcacaagttggtgtatctttggtgtttctgtagattctgtagttgctgcgttacaatttgtggctccctctgcaaagggattctttttgtaa

SEQ ID NO: 95184 - DNA, 507 bp, Glycine max
  Peptide Sequence Number=SeqID_211962
atgggaaagttggatcatctagaggaaaggctcagggccattgaaggaggtgaagattatgcctttgctaacctaaaggagttgttcctagtacccaatatcatcacgcctcccaagttcaaggtgctggactttgacaagtacaaggggactacttgccctgagaaccatctgaagatgggggcatacgcaaaaggtgaggaacagctaatagatttcttccaagaaagtcttactggggtagctattacctggtacactaacttggaaccttcccgagtccaatcttggaaggacctcatggttgccttcgttaggcagtatcagtataattttgatatggttccggataggatgcaactacagaacatgtgcaaaaagggggcacgaatctttcaaaagaatacgcccaaaggtggagagacctggcagcttaagtggcacctcaatgacggaaaaaaaaatgataacaatgatagtagacacattaccagtattctactatga

SEQ ID NO: 95185 - DNA, 381 bp, Glycine max
  Peptide Sequence Number=SeqID_211963
atggtggaagaattcgaagaaattctaggatgtcctctagggggaaggaaacccatacctcttctccagggttctatcccttcattagctagaatttctaaaatattccaaatctttggcgaaggaattagaccaccaaaagcaagtcgaaaatggggtggtcgggataccgagaaaatgtttggaggcaaaagcaagaatcttggcaggcccgtctatccgctacaaggtcaccgctcgtgcgttgaaaaaggaaaggcgaattgggaccaactcttggctagcatggaggggcgtctgttaattggttccctcgctagaaggaaggaagaatcaggattgtatcttcatgcgaaggatgtccaaatgttccctagatga

SEQ ID NO: 95186 - DNA, 591 bp, Glycine max
  Peptide Sequence Number=SeqID_211964
atggcggttaagagattcccttttgatctggttcgggttaaggatcattcacgcagtgctaatgatagagtggctgctgagagaacacatgataatagggttgttgagttggaagatgaggcatcttgcagttcatgttcagcaccgcgtttgcttccctttgttgatagggaaaacgtgtatgatgctaaggggaagagagtcatgagtatgaaacgaaggtctggagttcggcgccggaggagggctagttatgattgtacgaaagtctcttcagctgttccttctgaaaatctgcaatctgatgttgtcctcactccttgttcgccttgtgatggcagtataattagagataaaaccagtgcaggcataagtcctacctcggggaaaggagttagtgtagatgatgccgaagttgatcaagctgaccatgatttggatgaaaagacctgtcatagttatgaatttagtggatcaatggttgatagtccaggacaggacaaatatttattgtcattggaacactacataaataatgtgtgtgaccatgtccaaattgttggtaatggagaggatcgtatcaagatgtag

SEQ ID NO: 95187 - DNA, 486 bp, Glycine max
  Peptide Sequence Number=SeqID_211965
atggctttcaaatggactattcggctagctcaagagctctctctccaaaacatcatttttgagactgattgccaagaattctctctagcttggaaggaaggaagtgtggatagatgtacgtactttgatgatattcttcaagattataagtatctcttgggatatagaagcaattcaacccttgtttatactagaaggacgagatacattgttgcaaaccatctagggaatatgttcatgtttacaaaccatactcgaaacttcacaagttcaagacttatcaaggtaatccttgtggcgtctaccctgacttatcttccttcattggaagtggcgtctatcctgacttatcttccttcaccggaagtggcgtctacccggaaactggccaaatacagtctaaaggcccaagtggagaaggacgaaggcccaagtggagaaggacaaagcccccgagtggagaaggatgaaggcccaagtggataa

SEQ ID NO: 95188 - DNA, 435 bp, Glycine max
  Peptide Sequence Number=SeqID_211966
attcaaaggagtaaccgcttgagaattctttgtcttaacacattggagggtacatcttttgtggtacaagtagagggtacatctacttgggttgttgtaactgagaacaagagagggtacatctcttatggatcagttcaagtggagggtacatccacttggttgttcaaagagaacaagggagggtacatcccttgtggatctttgcttgtaaaggtttttacaaggttcaaagaaatctcaaggaccgcaggttgcttggggactggatctgaatttgacattcctaaatcatccgatttaaggaccaagaaaaaaatacttcagaccgtaggagagcggtggagacagtttaagtcagatttgaccttgaaatgggctctggcacatggtaaggagggcaaggatgacaaagatggtcaaaagaaggcgtag

SEQ ID NO: 95189 - DNA, 432 bp, Glycine max
  Peptide Sequence Number=SeqID_211967
atgttcaattctagtaatgagctggttgaagatccattggcagttgagagagaaggagctatgatcaactgttggacattagaggagagaaatattttctctgagaaattggcagtctttgaaaaagattttcaaaaagttacttccttccttgaccacaagacaactgctgactgtgttgaactctactacaaagatcataagaccaattgtttcgagaaagataagaagatgatgggttgtaaaagtcggaagtcaaaaacatccataactaccatgaagggattggttaaccaaagaacgcgttcaggaagactccacttttggaggatatccgatgaaagtgagagggttgcagttgatgcattgattgatatgtgtgattctctttcacctgaggctacaaaacgttgtcatgccaacaacctgtaa

SEQ ID NO: 95190 - DNA, 114 bp, Glycine max
  Peptide Sequence Number=SeqID_211968
atgactggcgagtctggtctaaatgttgggaaaccgccagtcaaactggcgggttgggtgcaggctagggggtgcaggcctaaaggggagttgcagctgccactggcgatttga

SEQ ID NO: 95191 - DNA, 270 bp, Glycine max
  Peptide Sequence Number=SeqID_211969
acacctgatgagataaaggagcatagggagaagaaattgaacagtccttggagagacatgccaatttcagagtcattgaagctctttgaggatatgaaaaatggcagtatagaagaaggaaaagccacacttagaatgaagcaagacatgcagagtgataactacaatattttaccccacaccctcatgctggagacaaatggtgtatctatccaagttatgattatgcacattgcattgtggattctcaagagaatatcacacatttag

SEQ ID NO: 95192 - DNA, 351 bp, Glycine max
  Peptide Sequence Number=SeqID_211970
gaattactattagctggagctgatcctcatgcagtggatgatgaaggtgaatctgtcctgcatagagcagttgccaagaagtccattgaatgtgcccttgtcatactggaaaatgggggcagtagatcaatggccatcttgaattcaaagaatatgacggtggtttgtcttgctacgagttcaatggctggtgttggttcttcttcttacaaaggcaatgacaacattctcttctgctttcactgcaagtccaagacaacaaccttcattaacggatggcagcttcgaagtggcggtttagctctgctctgtcaaaactgcgggatgaagttcatcctgcaagcttattag

SEQ ID NO: 95193 - DNA, 132 bp, Glycine max
  Peptide Sequence Number=SeqID_211971
atgttgaaccctcctgaaaatccaagtcgaggcgcttccgtaacgcttccgtgggtgatttcgcaaagattttcaaccgttcttcgacgttcttcgttcgttcttcgtcgttcttcggtcttcaaccagtaa

SEQ ID NO: 95194 - DNA, 1578 bp, Glycine max
  Peptide Sequence Number=SeqID_211972
atggcattggaagtgcttgaagcgctggattcagcgcgcacgcaatggtaccacgtgaccgccattgtaatagcgggcatgggcttcttcactgacgcctacgaccttttctgtatctccacggtttcgaaacttttgggacgattgtactacttcgacccgagcaccccgaatctccccgggaagctcccgctgagcgtcaacaacatggttaccggcgtcgcgattgtcggaaccctcacaggccagctcatcttcggctggctcggagacaagcttggccggaaaaaagtgtatggtatcaccctcatcctgatggtgatctgcgccatttgctctggactatcgttcggggcaacgccgaagtccgtcatggggacgctctgcttcttccgcttctggctgggcttcggcatcggcggagactacccgctctccgccaccatcatgtcggagtacgccaacaagaggacacgtggcgcgttcatagcggccgtgttcgccatgcagggcgtgggaatcattttcgcaggtttggtctccatgaccctctcagcaatcttcaagcactactaccctgctccagcgtacatcaacgaccctgtcttgtccacgcaacccgagggtgaccttttgtggcggctggttctgatgatcggcgctgtgccagcgatgatgacttactactggcgaatgaagatgccggagacggggcgttacactgccatcatcgaagggaacgccaagcaagccgcggcggacatggcaaaagtcttggacatagagatccaggcggagcaggacaagttggctgagttcaatgctagcaataactacccactgtggtcgaacgagttcttccagcggcacgggcgccacttgataggaaccatgagttcatggtttttgttagatattgcgttctacagccagaacctgacgcagaaggatattttccctgcgattgggctcatagacaaagactatcaaatggacgctattaaggaagtgttcgagacatcacgtgcgatgttcgtgatcgcgttgctgggaacgttcccggggtactggttcaccgttttcttcatcgagaagatcggaagatacaagatccaactcatcgggttcttcatgatgtcgttcttcatgtttgtcattggggtgaagtacgattacctcaagaacgagggcaaaggctacttcgctcttttgtatgggttgacgttcttctttgctaactttggccccaacagcaccacgtttgtgctgcccgccgagcttttcccgacgcgcgtgaggagcacgtgccacgcactcagtgctgccgcgggaaaagccggggcccttgtgggagtgtttgggatacaatgtttaactgtgggcggcgaatcgtacaagattaagaaggtaatgattattctggcggtgacgaacttgttagggttcttctcttcgttcttggttactgagacgaagggacggtcgttggaagagatttctggggaggatgggagagagagtgaactcacaccgacgcccaataatagggttcagggatcaaggactgagacgatgtga

SEQ ID NO: 95195 - DNA, 153 bp, Glycine max
  Peptide Sequence Number=SeqID_211973
atggcttgtggcgcttccaggtatgatgatacaaatcctgaagcagaaaagaaagagtatattgatcatattgaagaaattgttcagtggatgggatggaaaccattcaagctttgtgataatattaatacttccaagaattgtatgaattag

SEQ ID NO: 95196 - DNA, 342 bp, Glycine max
  Peptide Sequence Number=SeqID_211974
atgccattgtatttgaactttctcaatatatcggcaatcatggtggttgtttcatcttgttacattctctggcaaaaggaggaggaagcgagggcgcagtcagctgatggcaaagtgtttaagattgttccatggcaccatctggagcatagcaccagcaactccctgagcatacaggccttaagccatgacttgactggtttagatagatcatattttcaaaagttgttcatgtcattgcatgcaatgtttgctttcacccaaaggggtggctttgatcaaattgacaaggatgattccaacctacctctggatacagctcctattaagcatgtcacgcag

SEQ ID NO: 95197 - DNA, 1140 bp, Glycine max
  Peptide Sequence Number=SeqID_211975
atgttggagggtgcaagaagaacagcacactttaggctagtgattgtggatgggaaattgtacgtggagaagtataagaaggctattcagacgagagatgtgtttactttgtggggcatattgcaactattgagaatgtaccctggtaaagtgcctgatttggaactattgtttgattgtgatgataggcccgttgtgtcaaaggagagatttaaaggcccaaatgctcccaccccacccttgtttaggtattgctcggatcagtggagcttggatattgtgttccctgattggtccttttggggatgggctgagataaatataaagccatggaaacatgtcctaaaagaaatcaaagaagggaacgaaaagaccaagtggaaggacagagtaccatacgcctattggaagggtaaccctcttgttagtccaactaggaaagaccttatgaagtgcaatgtcacagaaaaagatgactggaacactcacctatacatacaggattgggatcaagaatccagtaaagggtacaagaaatccaacttaggagaccaatgcacccataggtataaaatatacgtagaaggatgggcttggtccgtaagtgaaaagtacattttggcatgcgattctacgactctatatgttaggtctcggttccatgatttttttgtccgaggcatggtgccactagagcactattggccaattagagacaacagcaagtgcaaatctcttaagtttgcagtggaatggggcaacaacaacactgataaggcacaagcaataggggaagctggtagcaaattcattcatgaggacatggacatggactacgtatatgattacatgtttcatctacttaatgagtatgcaaaacttcaaaggttcaaaccaactatacctcaaaatgctgtggagtattgccccgaaacaatggcatgtggtgtagatggtatacaaaggaggttcatggaggactcaatggtgaagtctcctagtgattcaaatccatgcactcttcctcctccatatgagcctataaacctacaagactttctagagaagaaagctagttcaataaggcaggtagaaacttgggaagaccaatactgggagaaagaaaaagggggacaataa

SEQ ID NO: 95198 - DNA, 1161 bp, Glycine max
  Peptide Sequence Number=SeqID_211976
atgtccatggcgtcttcagtttcattttatgaggaaagtagttggggcaaaagggtatctgaaaaggttctttctttctacgcttctcttcccaaaaagggcaaacctcaaggccgtgaagtcaccgttttggccgctttccttctctcttctccttccaatgatttgaaggttgttgcaatgggaacggggacaaagtgcattggacgttctctcttgcgcacttgtggtgatgttgttcatgattcccatgctgaagtcattgctcgaagagccttgatgaggttcttctatacacagattcaacatcttactgaaagtagtagtaagcatgcacctggaaatggagggaaacggttcaaacttgatgaagatcacttgccatttgagtgggatccaggtggagatgcttcactgagctttcatgtctctcctttggaaactgtggttttaggagaaagtgattcaacttcacctttggataatggatcaaaacaaaaggggatggtccagaggaagccaggtcgtggtgatacaaccctgtcagttagttgctctgacaagatagctcgttggaatgttgttggtgttcaaggagctttgctttcctactttcttcaacctgtatatctttcttcaattactgttggtctgcccctaaacatccctgagaattttcgtttggaggataacttgaaaagagctttgtatgaacgtattccacccttattgaatgaactgacatctccgtttctagtgaaccagccgatatttcacgctgcaccagtacccccaaaggactttcagcaatctgagagtgctgctaacactttaacatgcggatattctataggttggaatgaatgtggcttgcatgacatcatcatgggaactactggaagaaagcaaggcacctctgcaaaaggggcactctacccatcgacacagtcatctttatgcaaaaagaggctgttggaggttttcttgtcactgagaccggaaaatttaatcagttctctgcccaatgggattacttatcgagaacttaaggatggagctgaagaatatcatttggcttccaaaatttttaaagggaagccaccttttaacaagtggttcttgaaacccttggattgtgaggccttccacatttcagaataa

SEQ ID NO: 95199 - DNA, 444 bp, Glycine max
  Peptide Sequence Number=SeqID_211977
atggcagagctccaaaccaaggttgaacctgttacggtcccggctccggctccggtggatcccgagccaccgctagctgaggctccgccgctcgagaagaaagcggtggcggtgccaccacctgttccggctgcggcagaggaaaccaaagctcttgttgttgtggagaaggagaatgagaagataccagaacctgtaaaaaagaacgcctcaggtggatcccttgatagagacattgctcttgcagaaatagagaaagagaaacgattgtctaatgtgaaggcttgggaagaaagtgaaaaatccaaagcagagaataaagcccaaaagcagctctctgctgttgctgcttgggaaaacagcaagaaagcagctcttgaagctcagctgagaaaaattgaggtattatttgttgctcagttattggttgatacaatgacatag

SEQ ID NO: 95200 - DNA, 1413 bp, Glycine max
  Peptide Sequence Number=SeqID_211978
atggacaattcatccaactttgatgacaattctgatgtggggtaccaaccttcaccttcttctgtggatcaaaatgatcattcaatcactgaaaacgttggatactcccctttattcagtggggaatccttcgcgtattgtcggtctaattcggaggtctcaaacttctctgagcctattgatgacaatagctttgcaagtgaaccttcaccttctctatggacaccaatgaaacatggagctagtcaagctgctctttcaaggttaggagtgaagcagcacagacactcagtggatgagaaatctgatgaccttgacctcttagagacagagcttgatatgatgagggaaagattttcaaagcttctattgggggaagacatgtctggtggtgggaaaggtgtctgcactgcagttacaatatcaaattcaattaccaatctctacgcaactgcttttggacaaaatttaaagttggagcctctgaagcctgagaagaaggctatgtggagaagagaaatgaattgtcttctatctgtgtgtgattacatagtagaattttccccaactgcacaatatttagaagatggcacaattgtggagatgatgacaagcaaaccaagatcagatatttacatcaacctcccagctttgcagaagcttgacacaatgctcatagaaatattggatagtttccaggatactgaattttggtatgcggagcaagggagcatatcagggaattcaactcggtcacggggaggctcatttcgaaggattgttcagaggaaagatgagaagtggtggctgccggttccttgtgttcacactgggggcctctctgataagtcaaggaagcacttgaatgagaaaagagattgtgctaatcaaattcataaagctgcaatggctataaatagcagtgctcttgcagagatggatatcccagaaacatatatgtctaatcttcccaagagtggaagaacaagtctgggggacacaatttaccgctgtatgtattctgcagacaagttctcacctgatcaccttcttgactgtctcaaaataagttctgaacatgaagcacttgagctggcagataaggttgagtcttcaatccactcaaaaacatcatggaacaaagttaaggatctcatggctgacactgaccgaagtgacaaaaactacatcttagctgagagagctgagactttgttgttttgcttgaagcaaagatatcctgaactttcacaaacatcattggacacatgcaaaattcaatacaaccaggatgtaggaaaagcgatattagaaagctactcaagagtattagaaggcttagcattcaacattgtagcttggattgaagatgttcttcttgctgataaatcaatgaggaaccaaaatgtatag

SEQ ID NO: 95201 - DNA, 399 bp, Glycine max
  Peptide Sequence Number=SeqID_211979
atggtgttggttctattggctagtcgcgctcatggtcacgctcattttgataaccttggttccaccgctttaaacttgagattggatagtctgcaatctccatttcgatctagaagtcgtagacaatcaactttagaagaagaggaggaggaggagtatccagatgcaagaagacctggtagaagacgaacagacaaatcaagaagagataatcatttgcggagcactaaaatggaaatccctacatttcaaggtaaaaatgatcctggactgtatttggagtgggagaaaaaggttgaacatgtgtttaattgccataattattttaaggagaaaaagctccatgttgagcttgtaggccttggatattcttcatcaatggagtcatttgcttcttga

SEQ ID NO: 95202 - DNA, 258 bp, Glycine max
  Peptide Sequence Number=SeqID_211980
atgaaggcgatcaattcaatttattttttacagaattctgagaataaaactgcttctgataaagaagggattgtggaggagaatgaagcaaatttagatttggatgctccagatgaaactgtcttagttgaagcaagagaagctagtggtggtggtggtgcacctgtagatgatttggaggttcctccaattgttgatgatgatgaaagtggaggagatgcaattaaagaggatgaagatcatcaggaggatgactga

SEQ ID NO: 95203 - DNA, 3139 bp, Glycine max
  Peptide Sequence Number=SeqID_211981
atggacctcactagggtttctgcaacatgtcatcatttaagatccttggctgcttcagtaatgccttatacgaagttaaatctgtttcctcatcagagggaagcagttgagtggatgttgcatcgtgagcaaaatgcggagcgtttgccacatcctttatttgtagttctctcaactgacgatggctttagtttccatgtaaatactgtaactggtgaaattgtcaccggggaagctcccaccatcaaggatttttgtggaggaatgttttgtgacgagcctggcttgggtaagactgtaacagctctctctcttattatgaagacacgaggtacattggcagacccgccaaatggggcacaagtagtctggtgtcaacataatggtaatcagaaatgtggctattacgagatcagtggtaataacatcactggtgttactactttgggtaagagggatgtgtgccaagataccagtagaactaatgataaccatgattactcctccaaaagagccagattgacatatcctgatcagcaaatatctaaacttcacgattcatgttccagggaagaaaacaaatcacctgtggatgcatgtttcaaggaatatatgcattcaaatcagttcactaagagtttgagtcgcataaagaaaagtctacatttcacatttgaagaggaagctatgattttcaaggaaagagaaattggtgaaggattaattaaagcaaagcatgcatcagatgttacatctcatgtatctcaaaacaagttgcctgggaagcctaaaggtgatcgttttgagtacagtgatacatggattcagtgtgatgcttgtcacaagtggcgaaagcttgtagacaatagtatggctaattctagtgcagcatggttttgtagtatgaatactgaccctctgtatcaaagttgcagtgtccctgaacaatattttcataatacctgtaagataacacacttgccagggtttcacataaaaggaacttgtggaggtgaggaacaaaatgtttcttttttcacaagcgtgcttaaggagcactactctttgataaattctcagacaaagaaggccctgatgtggttggctgaaatttcaactgacaaccttgcaggaatggaaacaaatggcatcaggggtcctattttaaacatctgtactgcatctagtagacatttccacaaaatatttcaagcatttggcctcttaaagagagtagagaaaggtgtgtgcaagtggtactaccctcaacatcttaacaatttgacttttgatgtgtctgcccttggcatggctcttcgtgagccattagattttgttaggttatacttgtcaagagctaccctggtagttgttccagcaaacttggttgatcattggaaaacacaaatagaaaagcatgtgaggcctggccaattgcgggtttatgtttggactgatcatcgaaagccatctgtgcattgtcttgcatgggattacgatgttgtcataactacttttagtcggttgagtgcagagtggggcccacgtaagaggagtgctttgatgcaagtgcattggtttaggataattttagatgaagggcacactcttgggtcaagcctgaatttaacaaacaagttgcaaatggctatttcattgatagcttcaaatcgatggattctaacaggaactccaacgccttacactcctaacagccaacttcatttacaaccattgttaaggttccttcatgaagaatcttatggactgaatcgaaagtcatgggatgctggtgtgcttaggccatttgaagcagagatggaggaaggaaggtctcgtctgttacatttacttcaaaaatgcatgattagtgctagaaagatagatttacaaagcattccaccatgcatgaagaaagttgtttatctagattttaatgaggagcatgctagaagttacaatgaattggtaatcactgtacggcgtaatatattgatggctgattggaatgatccttctcatattgagagtctactgaatccaaaacagtggaaatttcgtagtgcaactttaaaaaatgtgaggctttcatgctgtgttgctggacatattaaagttacacatgctggagaagatattcaagaaacaatggatatgttagtacaaagtgatctggaccctacttcaggagagtatacctccataagatataatctcttgtatggtggtcactgtgtcaggtgcaaggaatggtgccgccttctgctcattacaccgtgtcggcatctgttgtgcttagattgtgtttctatagacaatacaaagtgtacttatcctggctgcagtaaattgtatgagatgcagagtagagaggcccgacctgaaaatcctaaaccgaagtggcctgataattgggatcctgattggcaatctacatctagtagtaaagtctcgtatctcgtccagaggttgaaagctttgcgaggaaccaaatcagggacaaacttcaatacagaaaatatcattgatgagatgcatattgagaatagtctgcatagaagtgatgacaaatcatcaattcagacatgttttatgagcagcactaagaccaatttgaaccctgagaaagttctgatattttctcaatttcttgagcatatacatgtcattgaacagcagttgactattgctggtatcaaatatactggaatgtatagcccaatgcattccagcaacaagaagaagtcattggccatgttccagcatgattcaaattgtatggcacttctgatggatggaagtgctgcattgggtcttgatttgagttttgttacgcatgtatttctaatggagccaatttgggacagaagtatggaggagcaagtaattagtcgtgctcatcgaatgggtgcttctcgtcctattcatgtggaaacattagcaatgcgtggtacaattgaagagcaaatgctaggctttttacaggatgctgataactttagaagatcaccaattaaggatgttactgaatctgatgatgatagtgggggacgaggatatagatcattgcatgattttgctgaaagtagttatctactgaaacttagatctgtgtatactaatttggaacgtccagaag

SEQ ID NO: 95204 - DNA, 504 bp, Glycine max
  Peptide Sequence Number=SeqID_211982
atggaggccatgaaagaccaaatgaccactatgatggagtccatgatgagcatgaggaaaatgatggaggtcaaagcggctacaatcgccactggaagtgttgccactgcagtagacctgactcacccatttggtatgaatcaagtaagtcgtccagtcccggatatggtaggtcagggagtcgaagcattgggaagtataggtgacccctattttgtgcaagtccaaagcaagcatcctttcccatcgtatggcctaccttccaactatgcaccacccaatgttgtatatgtgcccaatgagaactttgaccattccgctcctataccccttgagagccaacatccccagtctgggcatgcacatgtcactcaacccatgggggagacacatgaagtaccccgagaccacactctggctgacttcgagccttacctcggatatgccactaaggggcaagcatttggtggcataccctatccaaacacccccgggaggccttaa

SEQ ID NO: 95205 - DNA, 159 bp, Glycine max
  Peptide Sequence Number=SeqID_211983
gttcaaaaggatcaccgaggtaaatgggccccaaactatgaaggactgtttatggtaaagaaggctttctcaagaggaatgttgttgctcatgaacatggatgatgaagagctaccttcgcctgtgaattctgatatcgtcaagcgatattacgcttaa

SEQ ID NO: 95206 - DNA, 333 bp, Glycine max
  Peptide Sequence Number=SeqID_211984
atgggctcaaaaatctaccctaaggtttatgagaaccctagggccttctttagtagctctagcccaagtctcttggagtcttctatccaatacccttggggggcctctgtggcacctacccccttgaaaattaggcctgtcccccgaccatgcgatagtggttctaaactactcatgagtaggccacgggtcttgccccgactattatgcctgccttggcatgcaatacttctcaatgaaggacttgttaattgggggtcggatgagctttttgggcatgaccagtaccccgtagaactggcagaggcatgtgatcaatgctggaaatcataa

SEQ ID NO: 95207 - DNA, 474 bp, Glycine max
  Peptide Sequence Number=SeqID_211985
atggagagcgtgaggttcttgaggggctctaggggtagggaatgcgtagttgtcactcgaggtttggtcccaactggcttcgatgtcgtcgtcttcgttaatccacgaggagcacttgttcttgggatgaacccaaatgacatgtatgggcgattgaggccgtgcgttgacaacaccactacagcaatggcgaggtcaaagacgtctaccatcgttctatcctcttcctcactccgtctgtttcgcccttcatcagctcgcccaagcgagctaaggcttactcctgaagtcatgagctcgcctaggcgagctggagctcacccaggcgagccaaatgctggcttgggcgagctggggcctagaaaatgcaaggaaaagacccttttgccctcctttcttggtatcttttgttttctagatcaaaacactgagtggttcatcgctttgcactgtaactggtgtccaatgtcgtaa

SEQ ID NO: 95208 - DNA, 1413 bp, Glycine max
  Peptide Sequence Number=SeqID_211986
ctcaagcaactcaacagaaagaagaatcgcattttggcatccatcaatggtaacagtgcctacgatgtgggcggaggatatccggaattggagcagaatcagaatggaaagttgcattcagacatgtcttctcaacgcgaagccctccttaaaggaggggaccaagtcatctctgttttggaggaaatgattacccttttggaagacatgaatatggacgaggaatctgagaaagtggcagtggagttggctgcgcaaggagttattggaaagagagttgatgagatggagtctgatttcatgatggcccttgactacatgatccagcttgccgagaatgaccaggatgataagcgcaagtcactgttggaagttatcaaagagacagtattatcacatctaaccaaaaaatgtccaccccaggttcaagtaattggtcttctatgtagaactccaaaaaaggaaagccgacatgaattgttgcgccgagttgcagctggtggcggtgtatttaaaggcgaaaatgagttgaagattcatatcccatcagcaaatctaaatgacatagctaaccaagcggatgatttgttggaggcaatggaaactcgtcctgttatcccagatcgaaaactacttgcaaggcttgttttgatcagagaagaagctcgtgatatgatgggagggggaattatggacgaaagaaaccatcgtggattctatactcttcctcagcctgaggtggacttcttagccaaattggtagctctaaaacctgggaaaaacgtgcttgatatgataagaaatgtaatgcaaggaaaagatgaaggtgcagacaaatctggcaatgacaatgaggatgacactaccaatggggagccagctgaatttcttggaaggccactagtaacgggagagaagacacttccagtgcgccctggcatgtttcttgagactgtctccaaggtcttgtctggtttatatgctggaacagattctggcatcactgcacaacatttggagtgggaagaggaattaagagaaattgtttgcttacaaaggagtggggatgtctcctccgcctctaggaacctcacaattgctcaaaaactcacaaatctccctaaaagctcaaaacttggctcctttactctattctgcgcttctgtgttcgcactcttcaagctctctttcaattatgttattccagacattaaaaagggctttctgatcttgatgtcatgcttagtgcgagtaagtgaactttggctcagcgccaatcttgcgctaagcctggaaggtgacaaacgaatcgctgagcgagctgataacgcgctgagcgcatgcttgcatggaagattgcctttcagattcctcttactcgctaagcgcgttgatgcctcacttagcggatga

SEQ ID NO: 95209 - DNA, 597 bp, Glycine max
  Peptide Sequence Number=SeqID_211987
atgtatctggatcaagctatctgtaattggacaaggcaatccgagaatgtggtgattgcagcagacctactgcatgtgtacgtaggcgtgaaaagacgtgtagttgtaaatgaggagcaagagatttacgaaggtcccaaaaatgttgcacttgaagatgttgtgtttggtggtggacctgaggacaaatcaggtcttacagaatatgttgatcatgtgggttgtgaacagtgggatgacttgaatcgtggagagttaaagctggtagcatatggaaggaagttgagtggtctgcctaacccccctaccccccctcccccaaataaggagatcatgagagtgatgcatgattcagggttacttccattgacagaatgtagttatgaaattggtgacaaaagacttttatctgcttttgctgagaggtggcatcttacccgcacacgtctaaagacgtgggtggctattgcattgttgatggagcttttggtagtggacaaggaggacacatttttggagactaaacaatgtagaggaggtcatgctcgcctatcttggttgcgaggattttatgtagataggtgtatggacgggtag

SEQ ID NO: 95210 - DNA, 390 bp, Glycine max
  Peptide Sequence Number=SeqID_211988
atgcacagcctgcaagagttggctcagaataggccaatcatacctctggagtattttattgagaaagtagcctggcctgaagctcaactcccattggtgagacccaatgaggctgctcctctggagcccgcaccggcacgggttgatccaatgtcagctgagccacaaactccagtggtgaatccacctccttcttcagagcttgatgtagttcccccatctccacctctagttgtcatctccaatgcatcatcagatgaagcggctggccctcctgattcaccagctggagaaacaactgacccccctgcttccctagttggaggaattgtcgatctttcttatttgtcatctggagaagttgttgctctcagtgattccccagtttag

SEQ ID NO: 95211 - DNA, 678 bp, Glycine max
  Peptide Sequence Number=SeqID_211989
atgtcagggttaaacataattgaccttgtgaggtggagagagcttggtcttactcaaacttacagaaagttgataaaagagtttaccatgcaggaaggatctattgagggtattgcatggcgagcaagcttgctaacctttgagaatgaaatatatccactcaatgagtcatgggttgtgtctggactgggccatgattatacaattgatactcaacccattaacactgcttcggtgctacactataatgggaaaatgaaaccttggcttgatctaggaattcctcagtataaaagctattggaagaagtttctgaacaaagaagatcagctcttaatgaataaggaacctggaaaattccatgcatttctggcaaaaggatcaagaagtcttagtagcctcacagttttcaagatagcgaacatatctaagctattggagcagttccctaagccatataagctcacacacagttgctaccatagcatgatattcaacttacacactacatctggcaactatttttgcttcttgctcctccatgaaatcaaatttcctcctataagaagacaatatccagaagtggatcatctatctaatgatccctgcccagtcaacattcgggtaacaagtgattttggaattgccttcatcttcatattgttctcctcatcctag

SEQ ID NO: 95212 - DNA, 318 bp, Glycine max
  Peptide Sequence Number=SeqID_211990
atgatattagaacctacttcctcaagtggtgacaaggccggtggtgaagcaattcctatgcttttgagatttcctcgtctttctgatccttggggtggctatgatatgattggatttagagatattctctttcttggcctcttcttcacatatctgaaactatatatgatgaacggtcatggacaacctgcattgttgtacctggttccatgtacactaggtaagcttgtcagatatccaattatggacaggagtatggacaacctgcattgttgtacctggttccatgactatggtattgggatgcaaaagaggtga

SEQ ID NO: 95213 - DNA, 162 bp, Glycine max
  Peptide Sequence Number=SeqID_211991
atggaggacaccttacaacacctcacgcaaagggatctgttgcttcatctgtacttagggtttaacgtgatccttgtcattatgggaaattatggaaaaatgccattgatatatgtagttgtaattgggattgctgtgtcagaaaatcctttatctttgtag

SEQ ID NO: 95214 - DNA, 369 bp, Glycine max
  Peptide Sequence Number=SeqID_211992
atgcagagataccttatggttatccgcaccttttgtcagctagaggcaagtgagcccgttgacacgcagagactaacatcgccatctgcacctttcctggagatgtcagtgtcttttagccgagactgcgaaaaagtctcgtttgcaatccatcagactcaagggtccagctgcaagtctgatgacatgcggagatgccttatggttatccgcaccttttgtcagctagaggcaagcgagcccgttgacacgcagagactaacatcgtcatttgcacctttcccggagatgtcagcgtcttccggccgagactgcgaaaaagtcttgtttgctatccgtcagactcaagggtttggtagcatgcagtga

SEQ ID NO: 95215 - DNA, 439 bp, Glycine max
  Peptide Sequence Number=SeqID_211993
atggctacacagtccaactcttcttcgcctcctcctcctactggtgcagcaacgcaatcgccttctacgttgaagtggactagaaaggcctcacacctaagatcatttgcgactagaccagttggggcagagagatccctggtccacgtggatcttgctactggcaaagcggacagtccccaaagcaagaagttaagaacatatttggggatcgttgcttgtgataaggctgaatttgatatccctgaagcatctgatgtaaggacaaaaaagaaaatacttcaaactgtgagggagcggtggagacagtttaagtctgatttgacatcaaaatgggcacttgcagccgacaaggacagtgtgaatgacgctgatgtgcgaaaaaaagcacaggccatccagaagcaaaacactgcccctcacatgttgtctcgtgggg

SEQ ID NO: 95216 - DNA, 177 bp, Glycine max
  Peptide Sequence Number=SeqID_211994
tggctaagcacaaggaagaatccagaagaagatgagctgtcaagttcgctaaacgcactgctccaggtcatcaagcgcaccgcttcagctcatctgctaagcgaaacaagcgtgcttagccaaaatccacttatgcgcgctaagcgatccagatctgcgctaagcgcacgagcatga

SEQ ID NO: 95217 - DNA, 264 bp, Glycine max
  Peptide Sequence Number=SeqID_211995
atggctcacagctttggaaacgagaccggcggcggcggagggaggccgtcggggaacttctccctgacgcggcaaccgttggtgcactcactgacgtttgacgagttcatgaacaacatgggaggttcgaggaaggatttcgggtccatgaacatggacgagttgctgaagaacatttggaccacggaagaggttcagacaatggggtcggcgagagtttgcactaatgatggcggtgtcggcgccagccatttgcagtggtag

SEQ ID NO: 95218 - DNA, 807 bp, Glycine max
  Peptide Sequence Number=SeqID_211996
cctacatccaacttgaagtgcctgtcactcggtgaaaaaggactggagatgatcaagcgtggagaatttcagagaaacttcatacacaagttacaagttcttactctgtgctttcataatgggtcggatgtattcccatatgaaattctacaactggcgcccaatatagagaagcttgtggtgtacaatgcttccttcaaggagattaatgtggattacactggactcctattacagctcaaagacctatgcttggagtcccttccagagcttgtttccattgggttagagaactcttccattcagcccttattgggaaatctagaaaccttggaagtaataggttgttctagtttaaaagacttggtaccatctacagtgtctttctccaatctgacatatttggaagtagaaagatgccattgcctgctatatttgttcacatcctccacagcaagaagtttgggtcaactcaaaagaatggagataaaatggtgtgattcaattgaagaggtagtagtctctaaggagggggatgaatcacatgaggagggaataatatttccgcagctcaattgtttgaaacttgaaagaataggaaagctgagaaggttctacagaggaagtttattaagtttcccatcattggaggaattgtcagtaatcaagtgcgagtggatggaaacattatgtccaggtaccctaaaagcagacaagttggttcaagttcaacttgaggagtcatcagatgctatcaaattggaaaatgacctgaactctaccatgcgggaggcatttaggaaaaag

SEQ ID NO: 95219 - DNA, 579 bp, Glycine max
  Peptide Sequence Number=SeqID_211997
atgcgtgtggagaaaaatctgtttgatagagtcattggtatgcttcttaacattcaaggcaagataaaggatggtttaaatactcatcaagatctagttgagatgagtatacgagaccagttacatcctaggtttgatgttgagagatacatgaagatcttaaaatggtatacaaagaatctacaccatccttttgttgaaaggtacattgtagaagaagctattaagttttgttcgaagtacattgaaaaggaaaaactttttggacttcctgtatctcaacatgatgaaagagtggaggtagattccatgccttactttggagtcattgaagaaatccaagagcttaattatgtaaaattcattgtctgtgttttcaagcataaatgggttggtagcaatatcggtgtgcaaaccgatgatttcggatttaccttggtagatctaaagaagctcgcttatcagaatgagcattttatcatagcagaacaagctaaacaagtgttttgtgttcaagatccttgtgatgaaaggcacttggctccaccacccaactcccctcctcctcctcctgagtaa

SEQ ID NO: 95220 - DNA, 1983 bp, Glycine max
  Peptide Sequence Number=SeqID_211998
atggacgagcatcttcaacatttggaaacagccttccagaaacaggtggaatacttaggccatttggtttccactaacggtgtggaaccactagccgagaaggttgaagttgtgcgtcaatggccatctccacgcaccaccaaagctttacgaagcttcctaggactggctgggttctatagacggttcatcaagggctgctttcgaccaactgaagcttgcactgtcctcggcaccagtcctggctcttctagatttttaggggtgggcatgggtgttgtgctttcacaaaagggtcacccaattgcgtatttcagtaaacctttcagtgccaaattactccggtcatcgacctatgtccgggagttgtttgctattacggcgactacgctggagcaatatatgtatctcgccagactgatgggctatgattacgagatacactatcattcaggagccaataatcaagcagttgatgccctttcctgcgttccagagcttgattcttccatcgctctcatgctttcacttgatcaccattcagactatgttcattgccgcaatgacattgtcacttatcccaccaaacaccctgggttcttcgttgttaacaatctcattctacaccaccaccgcatctggttgccaaaagatgccccaattattcccactctcctcactgaatttcatgctacccccactgggggccactccggtgtcgccaagaccattgctcgtgtttctgagaatttttattggcccaaccttcgcgatgatgttgctacttttgtggtcaattgccttgattgccagtccaccaaatatgaggcaaagaagcttgctggtctcctatgctcacttccatataagggtaacacagttatattggtgatagttgatcgtttttctaatggggtccatctagtaatgctttccactgcgcacactgccttcatggtggcaaccttgttcctggagatggtcgtcaaaatccatggagttccctggagtttggtcttcgacagggatcccttatttctcagcaagttttggcaagatcttttccggggtagtggcacccacctacgcatgagctctgcactccttccttgggctgagtggtctcataacacctccttgaattctgctaccggcaccactccttacgagatcacatttgaccgcaagccatttaatttcccagagtaccttgccgacgactctaacattgatgctattgataccatgttttgcgatcgcgaggatacttttctgatgattcgcaagaaattgctcaaggctcaggatgctatgaaggagaaagctgataaacaccatcgggatgtgacctttttgccttgtcaatgggtgttgctccgacttcgcccacattgccaggtctctgctagagagaacccacacatctcaggaaaattagcaaagcacttttatgggccattccaagtcatggaagtcattggcaaagtcgcttatcgtttgcaattgccacccgacgctaagatacatctcgtcttccattgctccatactgaaaccgtttcatggtgatcccggcgatcctgctatttctcccctgccctctcacttccatgatgctcaaccaatcattcgacctgcgacaattcttgactctcggcaatcctctgcttccacctgggaggtcctcgttcagtggcatgggctttctcctgatgaaacctctagggaagattggtcaaccttatgtcaagactatcaccttgaggacaaggtgctttcccaagggcctaggggtgatataggaggggatataacagaggcaagcaatgacacaggaagccacatagttgaggcaagcaatcaacatgatgagggtgggataggcattctgttagaacaattccagcacgtgggagacaatgctaacaaacttgattctaaatattccaagggtacacaaaagggtagcaattctgttaattga

SEQ ID NO: 95221 - DNA, 267 bp, Glycine max
  Peptide Sequence Number=SeqID_211999
atgtatttcatggataaatcaaattcaaattgcagaagcaataagctcattcacaaacaaattccttacattaacatcacattcaaaccacaatgtatggatggcgagatgtacatgtggcggtgcttttggacagagctgagaacggagagagaaaaagaaagatgcgcaagaggtagcaaggacacgagatgcaacgagaacggagaggaagagagcgcagctgagacagagagaggaagagagccaatacggaagagagtgtag

SEQ ID NO: 95222 - DNA, 1899 bp, Glycine max
  Peptide Sequence Number=SeqID_212000
atggtgatagcggcaatgagaatgacaatgaagacaacaatgatagagtgtggtggtggcggaggtgacagcaacgatggcgtggtggtgacaacgatgcaaaacgtcaatcagaataaagtcaaatataaatccaaaaactatcgtctagttgtccaaaatttagtggaaaaagacgctgaagacatgtctggtcactgggggattcttgtttcagatccatggcttcagaatcagttcacacaagtggagcttcgtagcttaaagtcccatttcatgagcatgaggagggaaagtgggaggcttgtgattgcggatttggcttcgaagatgtcaaggttgaaggtggtgggagagaatctgagtgaggaagagagagcttcttgcgtgaaggatgtgtatcagaacactgaagaggaggttgattttgaattgtttctcaaggtctacttgaaactccaaacatttgtgaattctagaaccggaagtagtccaaagaactcgtcagcgttcctcaaggcagctacaaccacattgcttcacacaataagtgaatcagagaaagcatcatatgtagcacatataaatcactatctagcacaagatgagttcctcaagaaatatcttcctattgacccttcaaccaatgagctctttgaaattgcaaaagatggtgttcttctttgcaagcttatcaatgtagcagttccagggaccatcgacgaacgggcgatcaatacaaaaagaatactcaatccatgggaaaggaatgaaaatcacacactttgcctcaactctgctaaagcaattggatgtacagtggtcaacattggcactcaggacttcattgaaggaaggcgtcatctggtgcttggggtgatttctcagattattaagatacaattattggcggacctcgatttgaagaaaactccacagctgcttgagctgcttgatgacagtaaggatatggaagagttcatgaatctacccccagaaaaaatcttgttgaggtggatgaatttccatttgaaaaaagcagggtacaagaagattgtcactaatttctcctctgatgtgaaggatgctgaggcttatgcacaccttctaaatgttcttgcacctgaacacactaatctctccacgttggcagttaaaaatccctttgaaagagcaaagttagttcttgaacatgctgataagatgggttgcaagcgatacttaactgcgagagacatagtggaaggatccccaaatcttaatcttgcctttgttgctcatattttccagcacagatatatacgcctactaactcaacttccctcttgtaggaatggactttcagcccagacaaaacaacagatgtctctccttgagacatttccagatgacaccctagactctagagaagaaagagcatttcgcctttggatgaatagctttggaaattcaacatatatcaacaatgtcttcgaggatctccgaaatgggtgggttcttctagagactcttgacaaggtgtcgccagggattgtcaattggaagattgctaataagcctccgattaagatgccatttagaaaagtggagaactgcaaccaagttgtgaaaatagggaaacagcttaaattttcgctggtaaatgttgctggaaatgacattgtgcagggaaataaaaaattaatactagcttatttgtggcaattgatgcgatacaatatcctacaacttctcaagaacttgagattttactctcgtggaaaggaaataaatgatgctgatattttagagtgggccaacagcaaggttagcagctccagaagccaaagccgcatggacagttttaaggtattgaaattgtacctttatagtcctttcactcaagcatctgctcattga

SEQ ID NO: 95223 - DNA, 843 bp, Glycine max
  Peptide Sequence Number=SeqID_212001
atggctgaaagacccactagcacctttggggccaatactgagatgaatctcaaagaggagtgcaaggtaattttcactaggagggaaagtgctgagaaggaaaagagaattgagaaggataccaagaccaaaagagaaataccaccagcctcatcaaaggaggcaccgtaccctctggtgccattaaggaaggacaaggaacgctacttcaagcagttccttcacatattccagcagctggagattactatcccttttggagagaccctacaacaaatgtcactttacataaagttcttaaaggacgtcctcataaaaaagggaaagcacatcaacaacaaaaccattgaggtgggaggcaattgcagtgcagtaatccaaaaactacctcccaagttcaaagatccgggaagcatcaccatcccatgctctattaggagtgtatccgtagggaacctcaagattgaccctacaagaatgacattacagctggtagaccgctccatcacaagaccattcagagtggtagaagatgtcctggcaaatgagcatcccagtaatagcaagacttgttttaaggtggaggaaaatgagcaaaatgctaaccttgttgggaggcacttgaattctgtgtttctaaaagaagatgaagccaagttagttgtgaatcctacgaactcttctagtgtcttcttggggccaaaacaggtcagggcccaagccactcaagatattccaccagatcctccatcagcggtccctcctccagacgtctctcctccacctaccggccattctttgctttttttctcaaccggagcaactcctctctatgctgcatag

SEQ ID NO: 95224 - DNA, 648 bp, Glycine max
  Peptide Sequence Number=SeqID_212002
atggctttgactctttcgaagttgatcctttttcaagtgcttggaagcattcagtcttatcaagtctgggagaaaatccatgaccattttcacaaacaaacacgagcaagagcttgccaattgcagaccgaactacatgtgatagtgcttgtggacaagcctatgcgtgaatttcttctcaaaatcaaggctataaagtttgaatctctttcggttgaagtgttgttattagctcatgaagctcatcttcaaaagtttcagaagcatggtttctctaactcattgacaatcaactacacacagactaatcttaacttttcgcttgcatatggatttgatggctataatgtgctaaacaaagcattgcaacctaattatgagaatttttcgtctaactctcgcggtggttttggtcacggaggtaatttcaatcacggtgatcagggtggtggtggtctcaaccacaaagaaagaattcaaaagaagatgatttcaagtgctttggaggaaaaattgatacaaaaacttggaaaaaaaggccttcaagaaaagttggaagaattggacaactcacttagcatgcattgcaggcttagcgtgtactccaggcttagcccacactactggcttagtgcgatgcaaacttag

SEQ ID NO: 95225 - DNA, 282 bp, Glycine max
  Peptide Sequence Number=SeqID_212003
atgcaatgtcgtagcaattcattctcactaggtgaaatcataggaagactagtcagggtcattctggtttgtgagaaaactctaaccatatggaatcaacataggcttcaaggaacaatcaaaccgagtgtatttacccctaaggcctacgctccgaagagttcgtcagggcctctccctcctgattcaggaaaaagagagcttcatgcgagggacattgctctcaccacaaacattatttcgcaaattccaacagtggggatgtgcaaaaatgatttttga

SEQ ID NO: 95226 - DNA, 888 bp, Glycine max
  Peptide Sequence Number=SeqID_212004
atgatgcatatcaaagactggttttcttcttccttgcagaaaccaattcccaatgataatggtgatttcttagtacattttatggatattgcacgagatgaactggctaaaaagcctgatgaagtctcagttgagaagctgcagtctcttctagaccttgcattgcgtactacagcagctgcagcagatccttttcacgaaggcttaacctgtgttgtggcaattactctgagaaattctggtgacaatgatctggaggagcctgttagcatcactagccttgaaacattttcactaagttacaaggtgcactggccactgtctatagtgttatcacgtaaagcccttacaaagtaccaattactttttcgatttcttttccactgcaaacatgttgaccgtcagttatgtggagcatggcaagttattgaacccaattggcatctgatgtataacagacttcagtcagcaaatagcatagatgaagttatacaacatcatgattttttccttgataagtgcttgagagagtgtttacttcttttacctgagctgctgaagaaggtggagaggcttaaatccatgtgcctacaatatgcagcagcaactcagtggcttatatcatcttctattgaattacataacccagaggaacctattgatgattcaaaaggcttgaataaagccaaatggaaatcaggccaggtcctgaagtcaaccaccagaaatatggcagtcactgattctgttctaaaatttgagaaagagtttaatactgagcttcagagtcttggatcaatcttgagtaataattcccaggcagagccatatctgtctcatcttgcacaatggcttcttggtgtcaaaagtgaaaagaatggtttatga

SEQ ID NO: 95227 - DNA, 540 bp, Glycine max
  Peptide Sequence Number=SeqID_212005
atggaggatgttgaaggaaggaaatggaaaggaagagaattggggtgggtggaggttaagttccgatcgtcgtcctccgccgccgtccgccgtcgcgccgccgccgtcatctccgacagatttttccggcgagaccaaggttcggatcgcctcgaaaagcgcgatccacccttggaacttgcgccgccgtcggacgccccacgcgccgcttctttgttgcgcgttttccggcgcgtgcagctcacgcgccgccgtcccggcgttggaagctgccccttccggtcttggcagcttcgtcgtcgcctcctgggtgcgtttcaggcctcacctccttctttcggcaagccgtttggtcagctcttatgtgttttcctctcttgtgtgttagggtttgctgtttggctcttaaatggcctcctctggacctggtttttcattctccgggaccccaaccatcaccactgcaaagctgaactggaaaaactacccttcgtggtctgcttccgtggagttgtggttccttggtcaaggacaccatga

SEQ ID NO: 95228 - DNA, 198 bp, Glycine max
  Peptide Sequence Number=SeqID_212006
atggggttccactgcttttggtgcatttccattcaacctttgctttcatcaatcattgacacagatgaaatgcctcacacgactctcttcaagctgcacattttccggtccaccacgtatttacacttgcttgcacatctctcaagcgcattattctcactagaaaaggattctagtcacactggtcctcgtgcttga

SEQ ID NO: 95229 - DNA, 300 bp, Glycine max
  Peptide Sequence Number=SeqID_212007
atgttaggaaggttggtcctagatagatgtcgtatcaagttgtgtgtgatcgataacaatgattctacaacgtttgtaatatttgagactgaggctacgaatttgttggagtttgcatgcttagatatgtgtaacaagcaagaaaggtcgagtgctttacctggcatgctacctaaggatatctttgatttgaaggacaaaagtttcattttcaaagtggataacaagaatgttgtccacaaaagctttgatcaatcattcaaagttaagaaaggttacactgaggtggaaatgacttag

SEQ ID NO: 95230 - DNA, 126 bp, Glycine max
  Peptide Sequence Number=SeqID_212008
atggttccacacttccacttgtcctctccatccgtccagactgcaagatcgcacatgggtaatgagtcatttggtaatggggagaaagtaggaactaggaattaccatgcttccggttatttataa

SEQ ID NO: 95231 - DNA, 411 bp, Glycine max
  Peptide Sequence Number=SeqID_212009
atgaaggcccaagtggagaaggatgaaagcccagaggcagagacactatcaagactattaattgttggtgaaggcccaggtaatccttgtggcgtctaccctgacttatcttccttcattggaagtggcgtctaccctgacttatcttccttcaccggaagtggcgtcatccaaaaactctacagcctgtatcaagtgatccgccccgtaagcaactgctttcacccttctttgtcctctgctcctctcattgttttcctcctctaccctaaggtctcttgtttgtgggtggatatctttcaactcaatgcatcatatgccagtgtacccaccagtgatttcccttactacaactatcagcattcaacttcctcgttgtttaacatacccccacaccacatggaattttag

SEQ ID NO: 95232 - DNA, 369 bp, Glycine max
  Peptide Sequence Number=SeqID_212010
gttttcgttacttgactttgttggtgtgagactaacggggatgacaatctttgttgcttttgtctatttggagggaggacatctaaataatgtggtatgggctctagaacgatttcaaggtctttttctaaagcgtgatgtcctccctggagttattgttaccggcagagacctaacattgatgaatgcagtgaaaactgtattctccgagtgtaccaacttgttgtgcaggtttcatattgacaagaatgtcaaggaaatatgtaaatccctggttggtcaaaaacatccatgggattatgtgatggatgcttgggagagtttggttgattgtccttccaaggatcagtttgatgattgtcttaagaa

SEQ ID NO: 95233 - DNA, 423 bp, Glycine max
  Peptide Sequence Number=SeqID_212011
atgactttaaaaatgctttacgacatcgatttttcccactctcatgctgacgtgacacgttttaattgggctagcttggacaaccctaaatctcagtttttcttctaccctcgctcattcttccattctcattgccgtcatagagagagaaagggagggagaagaaatgtcacaagagttggtcctcccagaaccagcaaaaccactagcattctcgctctcatgcacgagcttcttggaggaccaaattgcaaggaagctgttctcaaactaaacgcttccgatgataggtacgtttttatgatttgctccatggttgaactcactgttcaacaggtggagaagttgagggaaatgagtccactttatgaatttgtcaaggaaggtatcaacatcaaggacattcaatgggcacaacactga

SEQ ID NO: 95234 - DNA, 153 bp, Glycine max
  Peptide Sequence Number=SeqID_212012
atgcttgacgggacaggtgaggcaggctatgcttcagactgcttcagagtagcagtgcagggagtagcggtgcaggtaggagtaggatggtctcgccaacactgcttgcgagacgagcttatatccgccaatggtattggcgatatagtttga

SEQ ID NO: 95235 - DNA, 970 bp, Glycine max
  Peptide Sequence Number=SeqID_212013
gtttacccgtgtatggatccttagattcataggaggtgtcctatttgttgacaaaagcagcaacaaagtttccctaagcgccaccgattacaaaattaaatcaatcggaggtatgagcatcttaatccaaatgtgggcatgggaacgatgcacgactttgactccaaaaaggactcctcctgtaatagaagataaaccactcggacacagtggcacctacccgatagagtgttgcgacaagtgtccttcgcaaccactgaatatccatggcctaacgttgaaaggcaaacaagatgaaaattatttccaactgttggccccaatgattagtcaatggaacaatcgagctgagtttagggtcgacgtttatcctcgacaggagggcctattgagttttaactccgactacatgatctggtataggcgaaaaacgaatatgtttgtcgatccaaagaatgcaaacacaactacattgggtgaagttgcggagacattacagtatatggtgtcaccacaagggaggaacacatggacatttgatgatcacgtgccttatgtagagaagataacgattttatccgaagagcaagagaggatcactaagcctgtggcacatggtcatcacactgatatgtctgcaagcgaacattcgttcggtggtgttgcggaaacacatcctcattttttatggccgactatgatcccttcacagcaacatgatgccccaatggcaacacctaacgccccattagcttcacaatggaatgtaccccgagcaatacatgatatgggtgacttattaggtgttgatttgcatcacgagttttctgctgaggttgagcaagtagaagcggggagacatcacgcagaagcaatcctgatcgtcaagcgcgaagatgggatcgaccatgtggcacatcctcacgtcatcatagacatcataatgaatgattttcatgtctctatttaa

SEQ ID NO: 95236 - DNA, 705 bp, Glycine max
  Peptide Sequence Number=SeqID_212014
gatgtgctggaaaaggcacaggccatccagaaacagaacactgccccccacattttgtctcgtgaggctgagaagaccaagaagaagctggagcaagctgcacaatcaggaagcattgatggcgtcatcgaccctccatcccccgtcagatgccacgtgaagtggaagatggcccgcaccaagaaaacaggggagatgacgactgaggccgcaaaggaaatcgctgagaagatcgtgacacagggatctttcgtcccccgtggacgtcaacatgttctcaccgctgctattggacgtccagagcaccctggacgtatccgtgctgctggagctggtgtcaccatcaagcaatacttcggatcgactccacggacgtcccacaagggacttgcattacctcctgagcctctggttggtccctcaggtcctcgagtaagcacaaagaggagttgtgttgatccctcaggaaacgatcctgagacgggtgactcagataggtgcggcttgtacatcgaagcaaatcctgaccgcctggttgccctggggagagtttatgagggatccactattgttcacaacactcctttgttgcctggccaagtaaaggtgggtgtggaggaggttaaagatgcagatgctccagttcctgtacccactgatgaggtttccttagtggggcagacaattgacaccttccttgcttga

SEQ ID NO: 95237 - DNA, 264 bp, Glycine max
  Peptide Sequence Number=SeqID_212015
atgtttcatgtttctggcagcggcgatcatgacatgtgtgttccatacacggggagtcaagtgtggacgagatcagttggatacaagattgttgatgaatggaggccttggtcatccaatggtcaagttgctgggtatacacaaggatacgacaaaaatcttacttttctgaccgtaaagggatctgggcatactgttccggaatataaaccacgagaggcattggacttttacaaacgctttctcgctggattgccaatatga

SEQ ID NO: 95238 - DNA, 213 bp, Glycine max
  Peptide Sequence Number=SeqID_212016
atggctgagtggttgatagccccggtcttgaaaaccggtatagttcggaacaaagaactatcgagggatctcatgtctcaattaagaggagtcatggaaagaactggttcaaaatctcgatcaattcctttttcaaatcctgcggcagctgcgcgagctcttcccgcgtgccataaatggcctacaaataggaagaatcctagaacaaaatga

SEQ ID NO: 95239 - DNA, 495 bp, Glycine max
  Peptide Sequence Number=SeqID_212017
atggcgaattctagggtgcgtaagcgaaactccttatgcaccatggcatgttaccccactggcaatgacgacgccggtgacgagggtgagataggtgagctaggcctcgcgcttgaatgtcatgatgtaagcgaagacaacggtgaagaagggggtgctggcgtcaatggcctggttgaaagacaccagaagttagcggagggagacattgccaaaaacgacggagacacagaagacgagactgagggcagtgatcttgaggaactggaggcggtagcaaatggtctgcatggggaccatcttgagctaggcgatgacaacatagctaaagagggagcaggcgcatgttacctcgttggcaatgacgacgccggtcactttgacgaccatgaaggcgctggtggagtcgaggccggaggttggttcatcgaggaagcgcatgatggggtagtggatgatgtcggtgccgatggagatgcggcggtgaaattctga

SEQ ID NO: 95240 - DNA, 246 bp, Glycine max
  Peptide Sequence Number=SeqID_212018
atggcggacaaaattttccaacttctgggtgcaagcccaacaccatggtgctgcctaaggctaattgttttggccaaacggcctaagtgtatcactctagtcgttatgggaactacctacatgctccaacatggccctcattcacgtaccaagtggtttcataggccatttctcaccaaatcatgcgcaaatgccattgaggcatttcaccgagcacttggtgggcgcatgtttaggcacaaatag

SEQ ID NO: 95241 - DNA, 192 bp, Glycine max
  Peptide Sequence Number=SeqID_212019
atggctccaagctcgttgagtatcttcctactgattaaggaaaagtataatgacatcagcggaactgccccggtagatgaggaccttggacaccctaaagttcgttatgctgatggagaaaaccacgaggtcatcttggttgacgaggttgatgcccttgaagtccctgtccgtaaaggtgataggaggtag

SEQ ID NO: 95242 - DNA, 591 bp, Glycine max
  Peptide Sequence Number=SeqID_212020
atgaaattccttatactgacaggggagattgtaaccgttaaggttgcaccacattctcctatccgggagcctgccatgcctcaccccacaacagttgaaggcactcaagtcatgacagaggaagaagggtctcaaatccaaaccctgaccatctatgaatccaacctgggtagtgaatttgacatagtttcgcaagacgatacctctgaaagaggctcaaaacctatcgaagagcttccatctgacatgccggggatccttcttggcataatatgcatcttcccccaggccaaacctatatcacagaagaaaatgaagataggagaagagcgacgtaaagccgtcaaagaagaagtcgacaagcttctccatgcaaacttcattagagaggtcaggttttgtacttggcttgccaatgccgtcatggtcaaaaaggccaacggcaaatggcgaatgtgcaccgactacactaatctgaacagggcataccccaaagacgtgtaccctctccccagcatcaataggttggtcgatgaagcgtccgaattccaggtgctaaccttcttggatgcctacttcggatacaactag

SEQ ID NO: 95243 - DNA, 591 bp, Glycine max
  Peptide Sequence Number=SeqID_212021
atgattaagttcgatagcatgcggggacgtcttggccatccggggattgcttcaggtggaagcaaccctgctcgcctgggcgagctgggcttgcctgggcaagggaacctctacaccaataatgatgcgatcttatatcatgtcttccctacatcccttaagggggaagcattgacctggcatgatggactttcacttaggttcatagacagctttgacaccctcgtcaaacaattcagtgcgcagtacaccactagcaggtctcatcgcatgacctcggttgccttagctagtctacgacaagtagacgacgagacccttagaaaattcatggatagatttgggtgcaccatcatccagatccaaaaaccacccaatagcatggacgagctacgcgagcaagttaagggctatatccagatggaagaatgtcccgattctggaatgaagtttgtcaagctagacagaagcgagaagcacacaccaaggccaacttacgcatctcggataagaggcacaagcctgataatcgccaaccttgttaaagataatggaagcaccaacttggaacaacctaaggctaaaacttga

SEQ ID NO: 95244 - DNA, 666 bp, Glycine max
  Peptide Sequence Number=SeqID_212022
atggcctatgaaaccacttggtacgtgaatgagggccatgttggagcatgtaggcttaccgtttggccaaaacaattagccttaggcagcaccatggtgttgggcttgcacccagaagttggaaaattttgtccgccatgcactcgtagatgcagggacgcccctggagaaggctctagcgccatcatagagtttgacagtcgtcgattctggagtgctgagcaccagcagcgctttgaggccatcaagggatggtcgttccatagggagaggcatgtccaactcagggaggatgagtaccctgacttccaggaagagatagctcgcaggcgttgggaaccactagtgacccatatggctaaatttgacccgaagatagtcatagaattctatgccaatgcctggcccaatgaggagggagttcgggacatgcgctcgtgggtgagtggtcactggattccctttgatgcagatgccctcagccagttcttgggcaacccactgattttggagaaagaccagcagtgtgagttcagccagaggaggaaccaggtgaggatcatgcgcaccagcatgactaccttgacccatatatggatgatgctgctgttcaacaacgtcttgcctagcgaccacaactccgatctccctctgcctaagtgctag

SEQ ID NO: 95245 - DNA, 471 bp, Glycine max
  Peptide Sequence Number=SeqID_212023
atgactgagaacaagagagggtacatctcttgtggatcagttctagtggacggtacatccactagggtttcaaagagaataagggaggaggtggatgtcattggacctatctttggccaacaccgtccaaggtcagttctgacaaccaggagacacatctttacagccgatgtcaccgaacacatgatgcaacatagtcttcctttggtccttccaccagtagctttcagttttttgtttggatcacaaaaaattattcctgttcagagaggctatggcaaacgtcaacaatggaaaatcaccatgcacgatggtgtcccatctgttgcccagccatggttccaatatctctctaaaattaatttaatgcctggagatgaggtaatattcttcttcagatttgacgaacatgtatgggaagttgtatttagaaaggaagttataagggaagatgaggacctttcccgctga

SEQ ID NO: 95246 - DNA, 522 bp, Glycine max
  Peptide Sequence Number=SeqID_212024
atggaaaaccatagatttataagcaagtctgattcaacaaaagccaagagcaacagaaagcatattagacaacaaaaagtccaccttgatgttcagcatagtgtccatgcaagtctcaatccagcttcatcccacactgaagatgattataaccaaccaaagacaccacctcatagtgttcatgcaactgccgatcgggctccacacgatgctgaagatcattttaatatctgcgattcatctgagaatgagacttctggatcagcaaaagctggaattgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 95247 - DNA, 1285 bp, Glycine max
  Peptide Sequence Number=SeqID_212025
aggactacacgtcctcaccttcagagggcagcacgccctcaccttcagaggaccaaacatcctcatctttagaggactacacgtcctcaccttcatagtgctacacgcccttgccttaagagggctgcacgcccttgccttcagaggactacacgtcctcaccgtcagagtactatatgtcctcaccttcagaggactacacgtcctcaccttaagagggctgcacaccctcgccttcagagggctacacgccctcagaggactacacgtcctcgccttcagaggacttcacatcctcaccttcagagggctatacgccttcgccttcgtaggactaggcgtcctcaaattcagaggactgcacgtcctcgccatcagaggactgcacgtcctcgcctttaaagggctatatgccctcgccttcataggactacacgtccccaccttaagagggctgcacgccctagcctttagagggctacacgccctcaccgtcagaggactacacgtcctcgccttcagaggacttcatgtcctcaccttcagagggctacacgccttcgccttcgtaggactaggcatcctcaaattcagaggactgcacgtcctcgcctttaaagggctatatgtccttgccttcagagggctacatgaccttgccttaagagggctacacgtcctcgccttcagaggacttcacatcctcaccttcagagggctacacgccttctccttcgacttggcgtcctcaaaatttagaggactgcacgttctcgctataagaggattgcacgttctcgctatcagaggactgcacgtcctcgcctttaaagggctatatgcccttgccttcagaggactacacgtcctcaccttaagagggttgcacgccctcgccttcagaggggtacactccctcaccgttggaggactacacgtcctcgccttcagaggacttcacgtcctcactttcagagggctgcatgccttcgccttcgaaggactaggcgtcctcaaattcagaggactgcatgtcctccccatcagaggacttcacgtcctcgcctttaaagggctatatgccctcgccttcagagggcttcacgtcctcgccttaagagggctgcacgccctcgccttcagaggactacacgtcctcgccatcagaggactatacgtcctcaccttcagaggactacacatcctcaacttgagaggactacacgtcctcgccttcagagggctacacactctcgccttcagtggactccacgtccgcacctga

SEQ ID NO: 95248 - DNA, 399 bp, Glycine max
  Peptide Sequence Number=SeqID_212026
atgaaactggacaaatacaggctaaaggtccaagtggagaaggacgaaggcttaagtggagaaggacaaagcccccgagtggagaaggatgaaggcccaagtaatccttgtggcgtctaccctgacttatcttccttcaccggaagtggcgtctaccctgacttatcttccttcaccgaaagtggcgtcatccaaaaaccctacagcctgtatcaaacgatccgccccagtgtgaacaagctagggatgctgtgggccgttggtgctttggattgggtcctgctagagtgtggaacggataaccaggacctcgctaatattctgaacgagtggagggatgaggattatcgcctgcaccaggatagagagttagagacaacctctaggatgctagaatga

SEQ ID NO: 95249 - DNA, 186 bp, Glycine max
  Peptide Sequence Number=SeqID_212027
atgtcagtgaaaaacttcgtcgggcgcctaggagtacatgacaagataaaccacacactaggagaccagtcaggatcacgttgttttgtgagaatgctccaatcacgtgggatcggtacaaacttaaaggagtactcaaaccgggtgtatttaccaccaaggcctacacttcgaagagtccgttag

SEQ ID NO: 95250 - DNA, 2766 bp, Glycine max
  Peptide Sequence Number=SeqID_212028
atgccttcatggtggggaaaatcatcatcaaccaagaagaaagcaaataaggaaagttttattgatgcatttcaccgaaaatttaaaatcccatccgaaggtaaaccaagcggtagatctggaggatctcgtagacattgcgatgattcaatttcagagaaaggggctcagtctcctcctgaatcaagatctccttctccttccaaggtgggaaggtgtcaaagctttgttgaaaggcctcatgctcagccactaccacttcctggcttgcacccatcaaatataagccgagcagattccgaaattagtataccatcatctagaagaagacatggaaagggctccaaatcatcgttgtttcttccactaccaaaaccagcgtgcatgcgtggtaggttgaaccctgctgagttggatggagatttggtcacggcttcagtctctagtgagagctctgctgatagtgatgaaccagtggactctcacaatcgtagtcctctggcaactgactgtgaaactgggactagaactgctgcaggcagtccctccagcttgatgcagaaggatcaatcatctactgtttcccaaataaactcaagggaagccaaaaaaccggcaaatattctgggtaatcatatgtcttctacttcaccaaaacgtaggcccttaagcaaccatgttacaaatctgcagattcctcctcatggtgccttcttcagtgcgcctgacagttcaagatcaagtccatcaagaagtccattgagagcatttggtaccgaacaggtgttgaactctgctttttgggccgggaagccatatccagaggtcaattttggtggatctggccactgctcaagtcctggttctggtcacaattctgggcataattcaatgggaggggacatgtcaggacagttattttggcaacctagcaggggtagcccagaatattcccccgtacctagtcccagaatgactagccctggtccaagctctagaattcagagtggagctgttacacctattcatccaagagctgggggaacacccaatgaatcacagacaggaaggattgatgatgtaaaaccacagagtcatcgtttgccccttcctcccttagcagttacaaatactttgcctttctctcattcaaattctgcagcaacttctccatctatgccaagaagtccaggaagagcagataatccaattagccctggatcacgttggaaaaaaggaaagctgcttggcagaggcacatttggacatgtctatgttggctttaataaggaaagtggtgaaatgtgtgctatgaaagaggtaactcttttttcagatgatgccaaatctaaagagagtgctaagcaattaatgcaggaaattaccttgttgagccggttacgacatccaaatattgtgcagtattatggttctgaaacaatacttgtttacagtatttgtcttttcagtctactcatagaaactgccaaatcatcccttaaacaggtaggcgacaagctttacatatatctggagtatgttgctggaggctccatatataaacttcttcaagaatatggacaatttggtgaactagctattcgtagttatactcaacaaattttgtcaggacttgcttatttacatgctaaaaatactgtccacagggacatcaaaggagcaaatatactggtagatactaatggccgggttaagttggcagactttggcatggcaaagcatataacagggcaatcatgtccattatcattcaagggaagcccttattggatggctcctgaggttgttataaaaaactctaatggttgcaacctagctgttgatatatggagccttggatgcacagttttggaaatggctacaactaaacctccttggagtcagtatgaaggggttgctgccatgtttaagattggtaatagcaaggaactcccaacaatcccagatcatctctccagtgaaggaaaggattttgttaggaaatgcctacaacgtaatccacacaatcgcccttcagccagtgaattattggaccacccttttgtaaaatgtgctgcacctttagaaagacctattctgggtcctgagtctccttcagacccagcaccagcagtatcggggatcacacaaggagcgacagcttcgggcattgggcaaggaaggaatccgtccaagttggattcagatcgactttctcttcattcttctaggtttttgaaaactaatccccatgcaagtgaaatccatattccaaggaatatatcttgccctgtttcacccattggaagcccacttttgaggccaagatcaccacaacacatgaatgggcgaatgtctccctctcctatatctagccctcggactgcttctggtgcatccacgcctcttaatggtggtagcggtgccattccatttagtaatcacttagtttacattcaagagggtcttggaaacttgccaaaatcttcaaatggtgtctacgttagtggccctgctcatcatgacttgaatgttgacatttttcgaggaatgcaacagacatctcacattacatcagaactggttccaagtgaaagtgatgttctggggaagcagtttgcacggactcctcataatgagccgtatgatgttcaatcagtcttggctgaccgtgtttgccggcagctgctgggggataatgtgaaaattaaccaatgccttgatctaagtcccaactctttgctcagccgggctaatggtttatga

SEQ ID NO: 95251 - DNA, 230 bp, Glycine max
  Peptide Sequence Number=SeqID_212029
gtttagtcaaaattgtaaggctatttggcgtcgagaagatactgggacttatggcgaaaaatgtgcagcaaggagcatcaacaacatgttatgtagccttgcacccccaagtgagtggaatcaacggcaaacattttgctgataataatcttgcggaagtatactcacatggaagggacgtggatttagccaagaagttgtgggattttagcataaatttgaccaagtaa

SEQ ID NO: 95252 - DNA, 261 bp, Glycine max
  Peptide Sequence Number=SeqID_212030
atggcaacaaagttctctgttaatattcctccatatggtcttggtgctgagactgctcgtgttcttgctttgcgtgatgtccatgtgattatgggggtgatagatatgattggtgcaaaaactgttaaggaagcaatacttaaggaggttcccacagctaaagttgatgtcatggagctagatcttagttctatgacatctatccggaattttgcttcaaagttcaattcatatggtctttcattgaatattttgatgtaa

SEQ ID NO: 95253 - DNA, 390 bp, Glycine max
  Peptide Sequence Number=SeqID_212031
atggtttacggcaaatcttgtcatttaccagtagaattggagcataaagcatattgggctttgaagtttttgaattttgatgagactgcatcaggggaacaaaggaaaacacagttgttggtgttggaggaaatgagatggaatgcttatgagtctttcagattgtacaaagataaaataaaggcctaccatgataagaagatgctcaagaaggaattcagaccaggacaacaagtattgatgtttaactccatattgaagttatttacgggaaaactcaaatctaaatggtcaggaccttcactatcaaagagaacccatgaaagagctatgcgtcaagctaatgacgttaaaagagcgcttactgggaggcaacccagccctttttaa

SEQ ID NO: 95254 - DNA, 1335 bp, Glycine max
  Peptide Sequence Number=SeqID_212032
atggaacatggaagaatattcatgctggaccaccatgactatctcattccatatttgaacagaataaatgcaaatggggtatgtgcttatgcatccaggactcttctattcttaaggagtgatggcatgcttaaaccattgacaatagaacttagcttgccaggccaatatcctcaccttgaaatccatagagtttttcttccagccaagcagggaacacaagcagcactttggcagctagctaaagctcatgttttagctaatgatgttgtttaccatcaactaattagccattggttatacacccatgcagttattgaaccatttatcattgccaccaaaagaaggctaagtgttatgcatccaatccatcggttgttgaatccacatttcaaagacaccatgcacataaatgcattggcaagactgatacttataaactcaggaggaattttcgagagaatattatttcctggtgagatctgtatgcagatatcatgtgacctctataaagagtggagatttaaggaacaaggacttcctgccgatctactcaaaaggagcatggctgtaaaagattcagacataaataaccccactgggattcaacttctattgctggactatccctatgccactgatggacttgaaatatgggtagtcatcaaagaatgggtcaaagacttctgctcattcttctacaaagacaatgaggccattgagggtgatgttgaactccaagcctggtggtcagagattagaacaaatggccatggtgacaaacacaacgacacatggtggtaccaactgacaacactctcaaaccttgtggaggcactaacaaccctcatatggattgcttctgccaagcatgcatctctaaactatggccaacatgcatacaatggttaccctccaaaccgccccacgctatgccgaaagtttgtgcctctagaaggcagagtggagtttggtgagttccttaaggacccagataagttcttccttgggatgctacctaataggtttgagatgagtcttgcagtggcattggtggatgtgctctcacgacacactagtgatgaggtctacttggggtgccagcaatcaccaggttggatagacaatgaagtgattcaaaataggtttgctgagttcaagcaagaaataaaggagattcagtcaaggatcatgcaaaggaatagggaccttaagcttaagaatagacgtggtcctgcaaacattgagtacactcttttgtaccctgacacctctagttctgcctcaacaagtggaatcactggaagggggatacctaatagcatatcaatttga

SEQ ID NO: 95255 - DNA, 1197 bp, Glycine max
  Peptide Sequence Number=SeqID_212033
atgaatatcaatggaatgccaaaaaaggcttcaagtagtgtgcccaaatggcagtactcttcttccgtcacaaccaaaatgttgaataacttgaatcctatatgccaagctacccaacaattaactctcaaggggaagtttgtgatcacgcacaatcatagcaaatcaatacctggaaaattaatttctgttcagatttatagtgggacagaggtggatcctgagactggtaaagggaagttgagtgaaaaagcatgtttcaaacagtgtgagagcatgaaacatagccatgatgcacaaaccatgatatataaaatcaagattcatattgactcacattttggaactccaagagcttttctgattcaaaacaagcacaagaagaaattcttccttcaatctgcatctattgagactaatgaccacatcattcactttgattgcaattcctggatatatccaatcaagaagaccaaatctgatagactcttcttctcaaatagatgctgtcttccaagtcacacaccaagagcactagtggaactaagaaaggaagagcttgatagattgaggggaaatggaatgggagaaagaaaggaatgggatagaatttatgactatgactgctataatgaccttggtgatcctgacaaaggtccagagcaccttagacctgtccttggtggctcaaggttatttccatatcctcgtagaggaagaacaggtcgaaaacatagtacagcaggtccatcgtgtgagagccgaccacaaccaatgaactttgacatatatgttccatcagatgagagatttggccccaataaattgaaggagttgaaatcaaattgtgtccatgctatggtacattttttatcaccaaaggcagaattcttaccacgacgaatttctgctgactttcattcattcgaagagttgcttgacatgttttctagcaataggaaccaaacaatagagggatggatgagagacaacttgaagaaactgatacctgttgagcacttaaaggaaatcaatcatgcaatgaaagaaaaccatgggcaattacctatccctcaaatcatatctgaaaatgaatgggcttggaaagatgatatggagtttggacgacaaatgattgcaggaactcaccccaccagaatccagtgcttaacggtacttcatacacttatgacctag

SEQ ID NO: 95256 - DNA, 996 bp, Glycine max
  Peptide Sequence Number=SeqID_212034
atgattacagccttctcctccttctgtgtgctctgttccgtccttaatttctggagtttgaagaagactggccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcgtcttcaggttttagaccttgcaaaaaataatttgtctggcaatatacccagctgtttccgtaacttgagtgccatgacactagtgaaccggagtacatatccccgtatctattctcaagcaccaaataatacacgatactcttcggtatcaggtatagttagtgtgctactatggctaaaaggaagaggagatgagtatcgaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacagtgtattgatttttcgaggaatcaactttctggtgaaatccctccaaccatttctaatttgagctttttgagcatgctagacgtgtcttataatcatttgaagggaaatattccaacaggaactcaattgcaaacctttgatgcctccagctttatcggcaacaatctatgtggtccaccactgcccataaactgcagctccaatgggaaaactcatagttatgaaggaagtcatgggcatggagtgaattggttttttgttagtgcgacaattggatttgttgtgggactttggatagtgattgctcctttgctgatttgtagatcatggcggcatgcctattttcatttccttgatcatgtgtggttcaaacttcaatctttttcctcgtatagtatcactgtttag

SEQ ID NO: 95257 - DNA, 939 bp, Glycine max
  Peptide Sequence Number=SeqID_212035
atgacgcttggagtcaagtcgatgcatgagtatctgtcgcagatcacagccatttatgattcccttgcttcagtaggaagtccaattatgcttcaggagcatatcgattctatccttgaaggtctctcttcagattatcactcgatcattgtgatcattgagagtaagtttgaacctcagcctatcatacaggttgaagtgcttcttctcactcatgaaacttgtttgaacaagttcaaacaatctctctctgaatctccctctatcaactacacgcaagctcaaacagtcccaaacaaacaggaacctgaaagtttttctaatttccatggaggatctagtcacggtggtggttttggtggcggtttcaactccagtggtgaaaaaaaaggaaaccccatgccacttttcatgcggtctttgggcttggaaatgagaatgggaatgggctgcccagttgatttggctggttcatccaacaggatggaccagatatacagttcaaaagggcacatacaaagcccacagcatgaaaaagaggctgcccatgccacttggcaggggtatcaacagaatatgcatccaagaggaatgaatagtgaatttgattatgctacaaagttcgtcattgatcttattccactcggggagattagcaactacaacaaaattgggcttcatggtgaggccagaaaaaaacgacccacacagccacacatggctgacaatgcagtgaggaggaagtcacagcctagatgcacatataagcatgtcacagcccaaatggccacgaaactcccagggacaacaatgttgatcctagtgatgatgtccagaaaactcattgaaaaagtggtcagagcagggaatagtgctaaacatctgaacaggagaaaaagggcagctggaatgaggcacatggccaggaacgaagactga

SEQ ID NO: 95258 - DNA, 255 bp, Glycine max
  Peptide Sequence Number=SeqID_212036
atgaagcaagacaaagaaattaatggtgcagatggcgtcaacaaattccaatcaggggaagaagaggaagataaggaacagtgcagtccagtatctgttttagacccacccttcgatgacgatgatgatgggcatgatgatgaccatgaaggggatggttttgatttggactgtagctatgccaatgtacaaacattttatgttgtgtggtcgtcttccatcaacatgccatcgtacacgcttcttcaaagttga

SEQ ID NO: 95259 - DNA, 3376 bp, Glycine max
  Peptide Sequence Number=SeqID_212037
atggccgattctcattcccacgacgcatccccgcgttccctggaggacattctcctccgcctcggggacaccatgacctccgtgacccttaagcttgatgaaatccttcatcgtttatctccaacatcccctttcccaactccacaaccaacccccattccgcctccacctaaccctgtacctgcaacaatccacaaaatgaaattggaagttccgcaattcgatggcacggagcctcttgggtggatattcaaaattaatcaatattttgaatatcatggcaccccggaacgcgatcgtctcacaatcgcttcgttttacatggagggacgagcacttgcatggttccaatggatgaccagcaatgctcagttcacctcttggccgggctttctacaggctttgcaaacccgctttgcgccgtcccaatacgaagatcctacaggtgcgcttttcaagttaactcagaagggttcagtagggcaatacctgtccgagttcgaggatttggccaatcgtataatcggcctaccccctcccttcattctgagctgcttcatctccggcctttccccggaaatacgccgtgaggtccaagccttacaaccgctcacactggtgcaagccgcagggctagcgcggctgcaggaggagaaattggctgatatccgtccttcccctcgaccaagacccccacctccaccacaaattatccctcacacgaaccctaattcccaaccctcttgcgccgcctccctcccacccttattaccagcgccaccacgtcagcctccccctgtgatgaaacgcttgtcaccggaggagataacctcacgccgcgagcgtgggttatgcttcaactgtgacgagcgttaccaccggggccaccgctgcgcttctcgtgtcttcctactcatcactgaggaagaggaaccccccttggctaatatagaccctaataacccacaacccgaacctataaccgacccacctgacttacccgacccgtacccggcccatataagtctccactccttatcgggccatcttgctccagaaacgctgcgttttgaagggactatacgagctcatcctctggtgctcctcgttgatggagggagcacccataacttcgtgcagcagccactggtctctcaattgggacttccttgccgccccacaccgccactgcgcgtcttggtaggcaacggtcatcacttggaatgcactacagtctgtgaagctgttcctatttccattcagaacattgaatttttggtggatctctatgtccttcccatcgccggtgccaacatcgtgttgggtgtccaatggctcaaaacattgggccccattctcacggactataattccttaagtatgcaatttttctatcagcaccgcttggtccaattaaaaggggaaagtgcagctcaattgggccttttgaaccatcatcagcttcgtcgtcttcatcagacacacgaaccagtcacttattttcatattgccgtcctcactgaaccctcttctcccacgagccccaccccactacccccacccatacaacacttattagcccagttctccaccttgttccaagatcctcagggtcttcccccagctcgagagaccgatcatcacattcacttactaccccaatcagacccagtgaatgtgcgtccgtaccgatatccccattatcagaaaaatgaaatcgaacaccaggtccaccttatgctccaaaagggcttgatccaacccagtaccagccctttctcatcacccgtcctcctcgtaaagaaacatgatggaagctggaggttctgtgtcgactacagagccctcaatgctgtcacggttcgagaccgatttccaattcccacaatagatgagctcttagatgaactcggaggcgcccaatatttctccaaactcgacctattgcaaggttatcaccagatacagatgcatggtccagatattccgaaaacggcattcagaacccaccacggtcattacgaattcaaagtaatgtcgtttggtctttgtaacgccccatcgtcgtttcaagcaacaatgaatagcatcttccggcaccatctccgtcacttcatcatagtgttcttcgatgacatattaatttacagcaatacatttgaggcccatatccaacacctaaccacagcgttccagctgcaggttgaatatttgggccatatggtttcgaagaggggggtagaaccagtagcttcgaaggtagaggccgttctgcattggcccacacctcactcttccagggccgttcgtggttttttgggccttgctggattctatcggcgtttcataaggggctacgctaccatcgctgctcccttagtaaagctcaccaccaaagacccctttcagtggactcctcatgcccaatcagcttttgaagacctcaaagcagccttatcctcagctccggtactcactcttccaaattttcagatgccattcacggtggagacagacgcatccggtgtcggaatgggtgccgtactttctcagggaggccacccgattgcatatttcagtaaacccttcagtcccaagcttctcagggcctccgcttacattcgtgagctgtttgctatcaccgccgcaattaagaaatggcggcaatatctcctcggtcaacgtttcacgattttgactgatcatcacagcctcaaggaactcctcacgcaggtgatacaaacaccggaacagcacatgtatttagctcgccttatgggctacgattacacaattcaataccgggccggtaagcacaaccaagctgcagatgcattgtcacgactaccagaacaagggccttcactcctgctgattctttccgtgccttcattaacatttctcgaggagcttcgtcgacaactccataaccacccagaatacatacagcgccgacaagaactccagcagaatccatctaattttcccaccttcacgatctcacaagacttaattctgcagaagggccgcatatggctgcctcgggaattacccatcacctccacactccttttggaatatcacaacacaccagcagggggccacgctggaatcgcgaaaacactagcaaggatatcggagaacttcacctggtccggccttcgtgaggatgtcagaagggttgtttctaattgcttggattgtcagatgaccaagtacgaagcccgaaaggcagctgggttgctgtgtcctcttccgattccttgccggccatgggaggacctctcccttgattttattgtcggattaccaccatgccagggccacaccaccattctcgtcgtggtggatcgtttctcaaagggcatacacttgg

SEQ ID NO: 95260 - DNA, 212 bp, Glycine max
  Peptide Sequence Number=SeqID_212038
aggaaacactgggtccaacaaagataggagaaaatcactcaatgtgtatcaatctcacacagtgcgtggtgagaaagtcgctagcgcacaggattttgtcggcaatcaaagggagaggaccactttaggtcgtgggcaaggattaacattctcaccctgggtcaaggtttatgataagttgggattttggctcaaggcttgtagaacggctg

SEQ ID NO: 95261 - DNA, 567 bp, Glycine max
  Peptide Sequence Number=SeqID_212039
atggtcattccgcacccttttgtcattcagaggcgtcgggtccgatggcacgcggagacaaattatggtcattctgcacccttttgtcatccagaggcgacgggcccgatgacatgcggagacaaattatggtcattccgcacaccttttgccattgagacgcagtcgtgtccgatggcatgcggagacaattatggtcattccgcacaccttttgccattcagacaaagtcgtgaccgaaggcacgcagagacaaattatggtcattctgcgcccttttgtcatccagaggcggcgggcccgatgacatgcggagacaaattatggtcattccgcacaccttttgccattcagacacagtcgcgtccgatggcacacaaagacaaattatggtcattctgcgcccttttgtcatccagaggcggcgggcccgatgacatgcggagacaaattatggtcattccgcacaccttttgccattcagacacagtcgtgtccgatggcacgcagagacaaattatggtcattctgcgcccttttgtcatccagaggcggcgggcccgatga

SEQ ID NO: 95262 - DNA, 333 bp, Glycine max
  Peptide Sequence Number=SeqID_212040
atggtggcatgttcgggcaacgcatgtgcgagtcgtggttgtgtgcagaggcgcgttggtcgccgatctcccctaggtgaacactcggaaggcgttgccgcttcggagctagcaccagaggagcggcgatctcggcacttggttatgacgtcgttgccagaaccagagatgcagttttctccgcagcatccggtgcggaggggattggagtggttgttgtggagtgtgcgggataagggagatggagagttttctggtgcagtagggtgcaatttgaagcttattctgaatttgaagctttttctgaagagagaaaggagaatttgggtttaa

SEQ ID NO: 95263 - DNA, 487 bp, Glycine max
  Peptide Sequence Number=SeqID_212041
tggcttcttgctaagtggtgttgggctttgttcaatgactttggttccttatggaaacaaatcattgattcatagtatggagggtggaagggtctgtgcgagatgggtggataaatatgcttctttgtggtggagggatgtgaggaaagtttgtgatgatgagagtgtggataggtggttccaaaagatgagagagtggaagatcagtgatgggcatttaactaggttttgggaggatagttggttcgaggaggataagttggcctctacattccctaggttgtataataattttttacaacaaggggagtgtatagggctgatggggagttggtcgatggaagagtgggagtgggtgtttaattggggaagaggctggtcggcatatgcggctcttcatgatatgaggtttggaactgaagaggatgatctcttgagtaaggtttgggatttggagatcctaccaaaggctaaattcatgatttag

SEQ ID NO: 95264 - DNA, 336 bp, Glycine max
  Peptide Sequence Number=SeqID_212042
atggtggaacttgatcaaattttacacccagaaggcactgttatggtgaaggatacccctaaagtaattgagaaagtagcacgggttgcacatgcagtgagtgacatgagaggcaataattttactgacaccatacctgacaacattggaaactgtacaaatttgcaatcttgtattttggaactttggaagcttaaacatttgtttgaattcgttagtggtgttaacttgcttcaattattgtcatccaagaatcttgccaataatcatcttgaaggatctattccacttaacattagctcatgcactaccttgaataagttgtcaggtttctaa

SEQ ID NO: 95265 - DNA, 225 bp, Glycine max
  Peptide Sequence Number=SeqID_212043
atgccacattgtttctcaatgccccacaaagaaaaccatgatcatgaggagtcaagcatctatagtagtcaagaggaggctacttcttctccttcctcaagtggaaatgagggtgaatccaagggtgatgagcatattgaaaaggtttacccttatgaagaaggtgatcttctaatggggaattacattagtgatatcaaagcagttcgtcctatgaagactggg

SEQ ID NO: 95266 - DNA, 645 bp, Glycine max
  Peptide Sequence Number=SeqID_212044
atgcaagagagacacattatttttaattcaggtgcagagggaagagtaaatgaaagaaattccataccattcaaactaccagtgagagttagagagagcatactctggaactcaaaattcattagaactgcagacttcgtggataccttggcatggtcaagctgtacccgtgtaactaccattgcaggaagcctatatttaatttggcacatatcaggatcgacagcaagagacaaaaagcaacgcagattaaaccttgtcttggtgatgcaattgctattaattatgtggctgctaaatccacagcttttgccacaaaatcagagccctatattgatgcataagaaaaagcactcaattttgatacataaagcagtaactattgctgcaaaaaattccaaagagcttaaaaggaggaaaaagaaacagaaagttgtcatggttacaggttcatctactggcacatccctgatatccattttagagaaaggaaaactcttgaactctgagagaggaaaggaagatgaagtggaggtagataaagaaggcctcaaattgggagaggagcatgagctagcctctaggctcatttgcatggccatgtccctccttgaaagagcaggagatacattggtgactgcataa

SEQ ID NO: 95267 - DNA, 252 bp, Glycine max
  Peptide Sequence Number=SeqID_212045
atggagtgtttaatatatgatcttggaaagaaggtttggacatcaaagggagaagaaaaagaagctgccaagaaggagttcatagaggcccttaaattgttggaggaacagctgggagataagacttattttggaggagacaatattggcactcattatttatttagcaagcatcagttttttatttttgcaaaccctccttctgtcaatactcagtacgaagttaacaaattgatcacaatcctcttgtag

SEQ ID NO: 95268 - DNA, 321 bp, Glycine max
  Peptide Sequence Number=SeqID_212046
atggggttgaaccaagcacattcttttaagaaaagggtttcatcaagtcaaggaagtgcaagagcagatgaaggccgacatggaggccatgaaagagcaaatggccacaatgatggaagccatgatgagtatgaaaaaatgttggaggtcaacacgactacagtcattgctgcgagtaccgccattgagggaggcgaagcgttaggaagtacgggtggccctcattttgtgcagtttcagaacaagcattcctttccaccatatggcttgcctcccaacatacaccacccaatgttgcacacactcccaatgggaatatag

SEQ ID NO: 95269 - DNA, 909 bp, Glycine max
  Peptide Sequence Number=SeqID_212047
atgccaactgttgttgtcttctcggttatacttcctcaaatagaggcacgtgaattcgccactgagcaagggggtttgtcagtggatgtgattaaaaaggcgttcagtgccacagaggaggaattcttgcatttggtgaagctatccatgcccattagtccccagattgcttccgtcggatcctgttgcctttttggtgcaatttctaataatgtgttgtatgttgcaaaccttggagactcgagagctgttcttggcaggagggatacagagagaaagaacagtccggtggtggcacagcgtttgtcaactgatcataatgtagctgatgaggaggtgagaaaagaagttgaagctctccatcccgatgactcacacattgtggtttatagccgtggagtttggaggattaagggcattatacaggtgtcaagatctattggtgatgtgtatttgaagaaaccagatttctaccgtgacctgggttttcagcagtttggaaatcctattcctttgaagcgttctgtaatgacagctgaaccatcaatcattattagggagcttgagtcagaggatttattcttgatatttgcatcagatggcctctgggaacaattaagtgatgaggctgcggttcagatcgttttcaaacatccaagagctggaattgccaagagactggtgagagctgctcttcatgaagctgcaaagaagagagagatgagatacgatgacataaagaaaattgacaaaggaataagacgacacttccatgatgatatcactgtggttgtaatctatcttgatcaccatgcaggctcctctaagcaaactgctgttggctatacaactgccccagttgatattttttccctaaatgcggatgggatgcttggtacagttgcctaa

SEQ ID NO: 95270 - DNA, 2043 bp, Glycine max
  Peptide Sequence Number=SeqID_212048
ggtttggggtttaacaacaaattcgacctcgctttgtccctcttcgacttcatccgtacccgaaacgaccgcgtttcgctcctgaacggttccgtgatcgccgtgatcgtctccattctcgggaaaacgggtagggtttcccgcgcggcgtcgctgctgcacaatctagaagccgatgggtttgaggtagatgtgtatggctacacctctctcataactgcttatgctaataataaaaaatacagagatgcactcaaggtgtttgggaaaatgaaagaagtggggtgtgaacctactttgattacttacaatgcaattttgaatgtttatggtaagatgggcatgccctgggctaagatcattgctcttgttcaggacatgaagtgccatggccttgcccctgatttgtgcacttataatactctcataagttgttgtagggctggttctttgtatgaagaagctcttgatctttttgaggagatcaaggtggctggatttaggcctgacgcggttacgtataacgcgttgctggatgtttatggtaagtcccggcggcccaaggaagccatggaggttctgaaacagatggagagtaacagctttcggcctagtgttgtcacttacaactcgttggtgtcggcttatgttagaggcggtttgttggaggatgccttggtgcttaaaaggaaaatggtggataaagggataaagcctgatgtttacacctacactacacttttgtcagggtttgtgaatgctgggaaggaagagcttgcaatggaagtttttgaggaaatgagaaaggtaggttgcaagcctaatatatgcaccttcaatgcgctcattaagatgtatggtgatcgaggaaagtttgaggaaatggtgaaagttttcaaggagatcaaggtgtgcaagtgttctcctgatattgttacttggaatacacttttggcagtgtttggacaaaatggaatggactctgaagtatcgggagtatttgaagaaatgaagaggtccaggtttgcacctgagagggacactttcaacactctgataagtgcgtatggcaggtgtggttcctttgaccaagcaatggctgcttataagagaatgctggaggctggagtgagtcctgatctttctacttacaatgctgttttggcaacattggctcgaggagggctttgggaacaatctgagaaagtccttgctgaaatgaaagatggtggatgtaaacctaatgaggtaacgtattcttctttgctccatgcttatgccaatggtagagaggtcgaaaggatgaatgctcttgctgaggaaatatactctggcacaattaaaacacatgctgttcttttgaagacacttgttttagtaaatagcaaggttgatctcctagtagaaactgaacgtgcatttttggagtttaggaagagaggaatctcgccagatgtaactacttcgaatgcaatgctttcaatttatgggaggaagaagatggtacctaaagccaatgagattttaaacttcatgtatgagagtggattgactctgagtttgacttcttataacagcttgatgtatatgtacagccgcacagaaaatttccacaaatcagagcaaatcttcagggaaattctggacaaaggtatcgagccagatgttatctcatacaacatagttatttatgcatattgcagaaatgacatgatggacgaggctaaaaggataattgaagaaatgaaagttcctgcacctgttccggatgttgtaacttacaatacatttatagcagcctatgctgctgactcaatgtttgtggaggctattgatgtaattcggtatatgatcaagcaaggatgtaagccaaaccataatacttacaactccatcgttgattggtactgtaagctcaaattgcgagatgaggcatgcagttttgttcaaaaccttggcgaccttgatccacaaatttctgaggatgaaaagagcaggttactagagcgcatagcaaagaaatggtctcaagttgatccatga

SEQ ID NO: 95271 - DNA, 627 bp, Glycine max
  Peptide Sequence Number=SeqID_212049
atggccatccatttaatgagtagactgtcaaagggccacaagattttgttgggatgtactaaagtccaccattttgaagcaacattggatgttcacaaaaactacatccaagttccattaaactaccacatcaattggtatcccaaatacccgacttatgtggtcctcaaagttaacggcgacaacagttattttgtcagagttcgaaggttttctgccgcagacaaaaataccactttccatgtctccttctcaactcctgcctatagacaactatcggcaacgtcacccgcaacaacccaacgccatgtttttaccgtggatgttgatgaagatatgctacaacagaaaaagccattggtgctgccaccggaggcttcatttcagtttcacaacattaaccactgttatcgttctaatgtggaacgtagtagtcggaggtgttgcctgtggaagattaacgtggaaaacgacgtccgtactcttgctgacccatggttccagtacttggcggacaatgatttcatgtccggagatgaggtgctattttactacacattcaagaaacatggatgggacgtcctgtatagaaagcagctgatatgggatgacgaccaatccgattaa

SEQ ID NO: 95272 - DNA, 711 bp, Glycine max
  Peptide Sequence Number=SeqID_212050
atgacgacgaccgatgccccgaccgcgtccactctcgtaagtccttcgatcatttcaaacagaccatttcggtcaaacttcctaattacgtcgcattttcgatttcagtcacctcgcagtttgtcgcggtgcacacccgtatactcctttcaggcagtattccatgttgataggaactacattgaggtccccagatcttatcataagcaatgggctccacattaccctgcttatgtgaagatagaatacaatggagcgctgcacatcattaaggttaggaaaaatggtcagcaatactacctggccgatggactgaaacaatttagaagaaacttcaacataaatgaaggtgtattgccaacttgtggaaggcctcccacaacccctaggaattatgtgtttacagtcgatgtaaccgatgatatcatctccaaacctacaccattgttgttgcctaccgcggctgtccattttgttgatgcttcaacaccatttatgaccgtgcaacatagcagtggcgttcgtgacatatggaccatctccatgcataatggtgaacaacatgtcgatgaccattggaacagattgttaacggacaatgacttgatgggtggagacgaggtcatcttctattaccggcctaacgaacatgtgtgggagataatctttaggaaggagccgatatgggatgaagatgacgactccacttga

SEQ ID NO: 95273 - DNA, 1587 bp, Glycine max
  Peptide Sequence Number=SeqID_212051
atggtcatcgacatcgaatccttggaagacaggagacatgatgttttgcctaattcttctattttgtcaagccttttcaaggctgaggtcaaaaagtccaaccatgagccgtgtagcatggagattttaattgatgacctaaaggatgttgatattgctccacttcttgacttgtgcatgaacttagatacttctgaaatagaggctgttgatgtacgtaatgaatcatcatctgtattaaatggagaatatgcattatcattgatgcgtgctattaatcaaaagcttcgagtagtccatctacaggattcatcatttggaaaagacttcttacgggatatttcacaacgaggtttggcatgccaagttttgacattgaggtgttcacgtttccggaagctgaacttaatgggggagttcatgcatatacacaccctaaatcttgatttcagttcttcccttaccagtttccaggaagactgttttaattgtatgcccaacctaatgcgcctctcaatgtgtgatacacagattacaaatctttggacgactgttgcagctctctctaagcttccatctttgattgaattaaggtttcaatatttgcagtattgcaatgatgctgtgacatcttttatcccatccagtgggaagtctgatgacactgctgattttagcccgcttgatagtgttccttttattggtgaaccacacactgatacaacagaactgacagatcctaactttaatgctgaagatcctctaagaaatttttattcctttgatgaagaagttataaatcctgatgttcaaagcatggttgaggattcttcagatgatagtgaagttggctttactagtcgtcatcataaatactggtttgcagatgtttttcctgggtggagttcagaagtgcctcttcagaatgagaatgaagatggagaagagtcattgcaaggtgcttttacagaccgtattgctgatgtttctatgaagtatatgtcttgtcatgcatcaccaatatgctatgagaagcattacagagagttcatgatagcttcattgccgaatctaaaaaatttagataatatgccaatcagaaagattgacaaggaaagggctaccagaatattttctcaatactttgaatatcttccatataaatggaagcacaaagagagtgttgtaagtatcttacagaagagagaaataaaatcaggccacaataaggtgcaatcttctaagcataggccatcatatccttctggaaagtcccaatatttttatactaggtctctttctgctgctaaattggggtcttcaacttggcctattttgcatcccctttctttagtaggatgtgaattggacaagggctttcatccaaggcagtttgagtaccatccatctgactctagtttgatggtctttggaactttagatggtgaagtagttgtcatcaaccatgagactgaacatattgtgagttatatcccatcacttggagcaatgaatagtgttttgggtctctgttggctcaaaaaatatccctctaagattatacttggtagttggtatggttattaa

SEQ ID NO: 95274 - DNA, 228 bp, Glycine max
  Peptide Sequence Number=SeqID_212052
atggacatcaatattggtggtttgtgtgtggtggatgacaacaatgctcgatggatgaggatgggtcacgtcacgatggtgaaggatgagggtggggctgtgcgtagttgtggtggactagggtggggttgggtgtggtggtggtggacaggggttgggtcacaggagggtgggggtgacaattttagatctgaggagaagggaaagaggtggggtttaaatccctga

SEQ ID NO: 95275 - DNA, 462 bp, Glycine max
  Peptide Sequence Number=SeqID_212053
atgcatcgtgggcatattaatgtagtcaagtttgctaatcattcccagtcaatttttgccacttcatcatttgatcacgatgtcaagatgtgggacttgagacaaaaaccaatacacccttgcttcactgtttcaagctccagaggaaatgtgatggtttgcttttctccagatgatcaatatattcttgcatcggcggttgataatgaggtggttagacaatatcaggctgttgatggtaggcttcacttagtttttgatatagctcccactgaaagttctcaaaattacacccgttcttattacatgaatgggagggactacatcataagtgggagttgcgatgaacatatccgtatttgctgtgctcaaacagggaggcgcctgagagatatatcccttgagggaagaaacttaggaaattccatttttattcaatctttgaggggggatccttaccgc

SEQ ID NO: 95276 - DNA, 372 bp, Glycine max
  Peptide Sequence Number=SeqID_212054
atgggatccaaaaaaattgtatccaaagcattgttgttgattgaagataatgcgcaaaggaggagaatcacagacattataagtgacatcatgtgtaagagaaaggagcattttacgatggagaggtatctattaggccacttgctgaactacaatgatgaaaaaggacaaatgctaagcgatgaccaaattgctgataatgtaattggggtcctatttgaagctcaggatattacagcaagtgttctaacctggattcacaagtatcttcaggatgaccacaaacttcttgaagcaataaaagtagagaaaatgggagtatatgaagctaatgaaggagggaacatgccattgacatggggtcagacctga

SEQ ID NO: 95277 - DNA, 453 bp, Glycine max
  Peptide Sequence Number=SeqID_212055
atggagtatcaatcttttggaagagtcccaacagcaaaaggggctaacataatgcaggcattgaaggtcaagcactcaacaaacaatacagagaactatagcgatcaaaccaagcttgatgaaggacatggagttcttttgttgggggaaaaaaagatgccatcacggttagatgaaatggcttttcctgactcaggaaatgcagattttgcagcagaagctaaagagtcaagtaatggtaggaatgatgagtctgatggagccaaggaagataaggctcaacaagagttattgaggcagaaatatagaaaaatgtgcagaaaaaggctacacacagcccaaacaatagagctaggccaagaggccgaagctggaacaataatacccccaaccacacttgcttataaacctaaagtatatgcttacatctttggtgcaatctacaatccatag

SEQ ID NO: 95278 - DNA, 150 bp, Glycine max
  Peptide Sequence Number=SeqID_212056
gatttcaatatgagcgtgttagcagcttacatgcagccaggctccaagtctaaaattgtcaagataaacttactagcatctagtagccatgccaacaaggatgattctgatgatttgcgaccttgccggttccacagtatgggaggttga

SEQ ID NO: 95279 - DNA, 270 bp, Glycine max
  Peptide Sequence Number=SeqID_212057
atgggaacatcaatgtcatctggtatatcgaatcgtcatcaggttccaacctacgtacaggcttcgccagtccctatggcatgcgagcatcaacatctcgaacttcctcaacaccgaccttcacatgatcattgcccaaaggaatgtggtgcacggttgtggacccctcacaaacttttccaaaggaaactaggcgagcagaatgagaaacctcaggctcaagaggagatgtgtgggagcctgctgaagccggtccaaagtattgtctga

SEQ ID NO: 95280 - DNA, 309 bp, Glycine max
  Peptide Sequence Number=SeqID_212058
atgtcgaacgcgatgatggaggatgttgagcaagatagggcatgggatttatcactaaaggaggaacctatggaggaacacgttgaggaaaaggaatcaaagttaaacaaattttgtatcatgtctagaggtacaattgtacaaacatcggatgatgaatttgctcaatggtgtgctccttggaaggggtcattggtggtccatgtttggggcacacaaggatggttgttggatcatgctatggcttctattcctgatttgcatttgcatgctaaggtgatgcattacacaacattggagagcctctag

SEQ ID NO: 95281 - DNA, 180 bp, Glycine max
  Peptide Sequence Number=SeqID_212059
atgaaagttgtaagaggtgaagagatgagaggaggagggtgcaaggagggatatcagagggagagaatggattttatgagagccgtgatgcgtgcaagtgagttacgagcctacgacggtgctttaaattttgaactaagaactatttcatctaggaatcccttggagaatcctaggtaa

SEQ ID NO: 95282 - DNA, 477 bp, Glycine max
  Peptide Sequence Number=SeqID_212060
atggagttcaatggtgttgtgtttaagatggtgcaatttgatgttgcaagtgtggttgaggaggctatgaggtgggttgttggtgttgtgggagtgtctaagagattaggattgcatgagaataattgggtgaaggccaattcggatggatcggtccaattgggtgagatgggatttcagaggctcgtgattgagtgtgatgctcaagtggttgttcaattcctaaaccatggtgtggatgcggatcatctttatgttgctcttgctgcaataatttgtgaatcgttaagcaatgattgggaagttcgagttaatcatgtctatagggaggcaaatgttgtaggtgatttccttgctagtctaactcataaccaagagttgggggtgcatgttttgtctaacccacctactgggttttctatgtttcttctgtcagatgttgttagggctccgttaacccgttttgttcgtgtgtag

SEQ ID NO: 95283 - DNA, 321 bp, Glycine max
  Peptide Sequence Number=SeqID_212061
atggcactccttcatgggtgccacaatgagccttgcatgcaattgtacgtgtttgtctccttcatggagtctacttgtacctcctcatgcaggcttcagataaaggatttttgttgtttcttcaaagtggaaaccccccaaaagcaacatctatgcgtgcatggatttggagaaggtgagaacgtggaatgttgcattgtaggagggtggcgaggttggtggggtctgcaaggaacacgaagacggagagtgaagaagagcaacaatgggtttgaacttgaacttttgggtggtgggaacgacaatctgatgagacagtga

SEQ ID NO: 95284 - DNA, 1848 bp, Glycine max
  Peptide Sequence Number=SeqID_212062
atggataagggtaagatccaagaggtgatcgagaaccaagtcctgacggtggcgcaagccgtcgaggacaagatcgacgatgagatcgccgccctggaacgcctcgatgccgacgacatcgaagccctccgcgagcgccgcctccagcagatgaagaagatggcggagaagcgctcccgctggatctccctcggccactccgaatattccgagattccctccgagaaagacttcttctccgtcgtcaaggccagcgaacgcgtcgtctgccacttcttccgcgaaaactggccctgcaaggttatggacaaacacttaaatattttggcaaagcagcatatcgagactcggtttgtgaaactcaacgctgagaagagtccttttctcgctgagaagctcaagatcattgttcttccaacccttgccctcatcaaaaacgccaaagtcgatgattatgtggtggggtttgatgagcttggtgggactgatgagtttagcacagaggagctggaagaaagattggctaaagctcaagtcatcttttatgagggaagaaaaggaaaacgtcctacgttttcaattggtgaaggaggcatctatcgtgtcccccgtcacggagagagaagggaaggaagagtgggtgttggtggttgtcctcctccctcctcatgggtatggcaaccctctcctcctctcttcctcttttccatcgctaccctaaccctaaccctaatccttcgctctttcgcccctccctttccctctccttctccttctctcgcactaaaccccgtcgtgccccctttctcgttctcgcttcctcttcccacgatttcacctccaactccaaggtaccctttcctctataattctcttattctccgtcttatactagaattcgttagtatagcttcgcttcataaatcagtgctcactgagttgatacaagagatagaacctctggatgttagccacatccagaaagatgttccgccaactacaacagatgccatgaaaaggactatatctggtatgctgggcttgcttccatctgatcagtttcacgttgtcattgaggccttgtgggaacccctttccaagttactaatttcttcaatgatgactgggtatacgctgcacaatgttgaatatagactttgtcttgagaaaaaccttgatatgtttgaaggagatatagagaagccaaaggcagaaagtacgaaagtggacttacaagggttgatgcatgacagtgtaaatgtaattgactttggtagagataagagcttgtcttctaaagttgaaaagcttcatgaggacgctgacattcaagaacttggtgacatatctgcagaagctctgcaatatatttttaatctgcaatctcgcttgtcttccatgaaaaaggagctgcatgaagtaaagaggaaaagtgctgctcttcaaatgcaacagtttgttggagaggaaaagaacgatttattggattacttgagatctcttcaacctgaacaggtagctcagctttccgaatttacatcccctgagcttaaggacaccatcctctttgttgtccatggtctccttgctaccctttctcctaagatgcattctaaaccttccaccatctcagaaaatacaacagttggagcaacaaatgttgggaatgaggattgtgctgaggttgttgagaactctgctcatcaatttcagcctactcaagtaccaatcacttctgctaaggagttatctttgcttactgaagaatattgcattcctgccatgtaccaattctcggtctcttccagtgttagagcgtcggtaggatcgaagatggttggcatgtag

SEQ ID NO: 95285 - DNA, 324 bp, Glycine max
  Peptide Sequence Number=SeqID_212063
atgaagttattttcatttccgaatcttcttcacaacttccgaaacaacgaccacaacaacataacaatttcacgtaaatatttaagcagttggctccgaccgaggaaagaaccaaagcccttgagtcgagagagattgaaagaagaatatgaaatacgagatggaaggtttaaagaggagaaagcaaagcaagtcggagaaaccagagacggtgaaaacgagaaggaaatgaagtggtgcgaaagaggaacttacggtgtgggtgtgagtaactccgcagcgaatgggaaagggagtgcgaggagggagaagggttcgatctga

SEQ ID NO: 95286 - DNA, 120 bp, Glycine max
  Peptide Sequence Number=SeqID_212064
atggttgcacaggttgcacttgagagggactgggaggttgtattgatcccaccccatgaaaatttaccagtttcagaggatattgttaacaacaaattcaaattgagttacaagaactaa

SEQ ID NO: 95287 - DNA, 597 bp, Glycine max
  Peptide Sequence Number=SeqID_212065
atgggagatcacttagaggaaatgattcgtgatcttggacaagagtcttttcagcaagcacatgatcttatgtatgatacattgcaaaatgatttgaagaagcctttgtatccagggtgcaagaagtctttgacgttgttgtcagcaatgctatgcctggataatgtcaaggccagatatgggtggaatgataaaaggtttacttcactgcttcaggtagtgcaggatatgcttctagaggaaaacacgttgccaaaaggttactatcaagcaaagaagatactatgtatgatgggtatgaagtatcagaagattcatgcatgccctaatgattgcatactatacagacatgagtttgaagaaatgcagacgtgccctaggtgtggggtaacacggtacaaagtgaaggatgatgacgagtgtagcagtgatgaaagtaccaagaaaggccccctagtgaagatgggagaaattgcaatggaatgctccaccatccggctgattcctctttacactaattttcggttaactttgaattccattgccatgaagagttccttgttttggttcttccaagctctctcttcctctctctag

SEQ ID NO: 95288 - DNA, 333 bp, Glycine max
  misc_feature (55)..(55): n is a, c, g, or t
  Peptide Sequence Number=SeqID_212066
atgctaaggtcgttaggaagcagtggcagagctttgcggtcaagaacaaaagaanaacccaaggaacctgaaccaactagtaatttggttgatggtaatagtaatgatggagttaagaggaaaagtggtaggaagaagaaaaagagaagagaagagggaataactgatcagttttctagaatcagatctcacttaagatatttattaaatcgaataagctatgaaaacagcttgattgatgcttattctggtgagggctggaaaggatacaggataagatgccctgtaacttaccttttacaggctacaactccttttgttgcatttggataa

SEQ ID NO: 95289 - DNA, 576 bp, Glycine max
  Peptide Sequence Number=SeqID_212067
atgatgatcacagaagatgaaacaactcttacaacaggcaaagaacaacaaagtgaagtgatgaacggagacaaggacaatcatggaagcgaagatggcaaccccaaagagtggttgaacctgagcataggtggaacttcttcactatcaacatctggagacactgattcacaagcaagaccaccagccactgccaaagttttttcatgcaacttctgcatgaggaagttctttagctcacaagcactaggaggccatcagaacgcgcacaagagggaaaggggagctgccagaagataccaatctcagagatcgatggcaataatgggattctccatgaacacaccaactatgtttcgatcacttggtgttcagccccattcacttgtgcacaagccacgcagaggtggtggtaccatggtgacaccgggctttcatgatgcaaatgcacatgcaagacttgggatggcatggacacctttctcgaccgaggatcaagcagatatggtgtggccaggcagctttcgcttggttccacgggagccactcaagcttgatttaggcctaagactctga

SEQ ID NO: 95290 - DNA, 273 bp, Glycine max
  Peptide Sequence Number=SeqID_212068
atggtggagttgcgtagcggatttctgaaaaaacgccaccgaatagcggtggtgtggcgggttaaagatggtggccgacatatccatggcggccatggcggatgtggcgtcgaggcggaatttggcggaatttttttttttttgtctgcggtaggagttaggctgacccgacccaaccctacccgctgcaacccctcaaagctccaacacacagcgcgacctcggaacccagctacgacccctgcaactagccacgacagcagccacgcatga

SEQ ID NO: 95291 - DNA, 852 bp, Glycine max
  Peptide Sequence Number=SeqID_212069
atggaattggaagttgacgagaacgacttgaaagccgccggcgctgaactcttcgccgaaggtggccggcgaggcattcgtatcaatggctggttgatcgagactcggaggcactccatactgaactcttccacattccaagagtgggaacagaaactcgatacgtctcatttaccagaaatggtttttggggaaaacactttgattctaaaacacttgagcagtggaaccaacattcattttaatgcatttgatgctctacgtggctggaaacaggaagccttgccgccagttgaagttcctgcggcggctaaatggaaatttagaagcaagccctctcagcaagtaatactagattacgactatacatttacaacaccttattgtggaagtggcactattgagattgataaagatctgaatgagggagagacttctaaggaaaccagtgatatccattgggaagactgcaaggatcaaattgatgtagttgcacttgcatccaaggagcccatacttttctatgatgaggtgggtaaaagagctcaagtgaaagaaagttctttaccattgtgctcctttttaagaattgatcatgctgttaatctgcaaaggtgtaatagtttagtgaaatctgcaaaggtggtgttatatgaggatgaactcgctgataatggagtatcacttcttactataaaagtgcttagagttgatggagtgttgattagactgagagaaacacgtatgcattgtgtatttggtggaagtacaaatcccattatacttcgagagagttgctggagagaatctacatttcaagctttgtctgcaatcatggatgaagtgctatag

SEQ ID NO: 95292 - DNA, 2703 bp, Glycine max
  Peptide Sequence Number=SeqID_212070
gtggttgggaccgctctaggtctgcatagtgatgctgcgagactggccgctacagggatggcacgtgggccaaaaggagagtgggtgaaagatggagaacgggttatggtgcgcaacaccccacaaaagtactggtggaagccaagtttaacgaatgacgagcctcctccaaggccattgaaggttacttttgctgagcctgcaactcactggaccgatgccatccccattggtaatggccgtcttggtgccatggtttggggtgccgtaccctcagaagctctccagctcaatgatatattctttaaattcattgagtttgtgattaacaatgtgaacgacaccggacctgtagatgttgttcttaattccttcaagatctttgttaggatccaattgtacggtatgagacttgagtcccaattagaagtatgggattctgaggacacactttggactgggattcctggagactacaccaacaaaagtgctcaacaggcactggctgaagtcagaaagctggttgatgatagaaaattctctgaagctacggcagcagcggtcaagttgtcaggagatccttctgatgtataccaacttctcggagatatcaagttagagtttcatgattcccatcttaattattcaaaagagtcatattatagggagctggatttggatactgcaacagcaaaaataaaatactctgtgggtgatgtagaatttaccagagaacattttgcttctaatccggaccaagtgatagtgacaaggttatctacaagcaaacctgggtcattatcatttacagtgtattttgatagcaaaatgcatcatgattcaagggtaagtggccaaaatcagataataatcgaagggagatgtcctggcagtaggatccgaccaatagtgaattcaattgacaatccacagggaattcagttttctgcagttcttgatatgcagattagtaaagataaaggggttatacatgttttggatgacaagaagttaagggttgaaggttcagattgggctattttgcttttgacagcttcttcttcctttgatggcccatttactaagcccgaagactctaagaaggatcctgcttctgagtccctaagtagaatggtgtctgtgaaaaaaatttcatatggtgatctttatgcacgccacttggctgactatcaaaatctatttcaccgtgtctcattgcaactctctaaaagctccaagactgtttcaggaaaatctgttttggacagaaggaaattggtttcctcccaaactaacatctctcaaatgggaggggatgataccattccaacttcagcaagagtcaaatcttttcaaactgatgaagatccttcctttgtggagcttttgtttcaatatggtcgatatcttctaatctcttgttcgcgtcctggaactcaggtggcaaacctacagggtatctggaacaaagatgttgagcctgcatgggagtttgtcttcccttctcttttcatccctcttctagctatagtttttactggtgctcctcacttgaacattaatcttcaaatgaattattggccatcccttgcttgcaacctacacgagtgtcaagagcccttatttgatttcatttcctctttgtcagtcattggtaaaaaaactgcaaaggtgaactatgaagcaaatggctgggttgtacatcaagtttctgacatatggggtaaaacatcaccagatcgaggtgaggctgtttgggctttatggccaatgggtggagcttggctttgtacccatttatgggagcattatacttatacaatggacaaaggccgtggtggattattggaaactaacccatcaacttcaccagagcacatgttcactgcaccagacggaaaaactgctagtgtgagctactcatcaaccatggacatttcaatcataaaagaagttttctctatgatcatttctgctgctgaggttttaggaaggcataatgatactattatcaaaagagtcaccgagtatcagtctaaacttcctccgacaaaagttgctagagatggttccattatggaatgggcagaagattttgtggaccccgatgtacatcatcgacatgtttcgcatctgtttggactgtttccaggacacacaattagtgtcgagaaaactccagacctctgtaaagctgtggaagagaggatggtccagggtggtcaacaacttggaaagcttcactttgggcacatcttcacaatacctgatcatgaaagggatttcgaaggaggactttacagcaacctgttcacagcacatccccctttccagattgatgcaaactttggcttggctgagaaaaaagcattgtttggtgtcagtttttcaggagcagttgcagaaatgcttgttcaaagcacaatgaaggacctgtacttgcttcccgcattgccacacgataaatgggcgaatggttgtgtgaaaggattaaaagctcgtggtggggtgacagtcaacatttgctggaaagaaggagatctgcttgaatttgggctttggacagaaaaccagaattccaaagtgagactacattatagaggaaatgtggtctcagcaagtttatcacccggcagagtttattcatatgataaccagttgaagtgtgcgaagacatactcccttagtgaagtgaatccttga

SEQ ID NO: 95293 - DNA, 345 bp, Glycine max
  Peptide Sequence Number=SeqID_212071
atggcttttcgttcaggttctctgtctcgctccttaatgtctacagctagggcatcactccgaccggcggcgccgtcgtcaacccttccccgcctccgtccgccaccactcgccgcccctcgcgtccagtcccgccgcttttccatgcctgcttccagctgtcccatggtaccttccgtcgttcttgtcaagatcgctagtagtctcgttgtgagtcttgctgccttcttcgacgttgcttccttgctagacacaactggttcagtcttgacggggccagggtgggggtggcgtggtgcaacggcttgggatgggaggcgtatgaggaaagggaagggtgtgtag

SEQ ID NO: 95294 - DNA, 1602 bp, Glycine max
  Peptide Sequence Number=SeqID_212072
atggaaaagttaaagcctgagaaggagcttcagcgggctaagtctgaaattcttcgacgcaaattgaaaattagggatctatttcgaaatttggattcattgtgtgctgaaggaaagtttccagaatctttgtttgattccgcaggagagattgacagtgaggatatattttgtgcaaaatgccagtccaaagagttgagcactaataatgatataattctttgtgatggtgtttgtgatcgtggatttcaccagctctgtttggatcctccgttgttaactgaagacattccacctggcgatgagggttggttatgcccaggatgtgattgcaaagatgactgcatggaccttgttaacgactcctttggaacaagtctttctattagtgacacctgggagagagtctttcctgaagcagcatcatttgctggaaataatatggataacaacttgggacttccttctgatgattctgatgatgatgattataatcctaatggttcagatgatgtgaaaattgaaggggatgagtcaagttctgatgaatccgagtatgcttctgcttctgagaaattggagggtggttcacatgaggatcaatacttgggccttccatctgaagattctgatgatggtgattatgatcctgatgctccagatgttgactgtaaggtcaatgaagaaagttcaagctctgatttcacatctgattccgaggatcttgctgctgcatttgaggataacacatcccctggacaggatggtggcatcaattctagcaagaaaaagggtaaagttggtaagctatctatggctgatgaactgtcatctttactagagccagattctggtcaagggggtcccactcctgtttctgggaaaagacatgtggaaaggttggactacaaaaagctgtatgaggagacgtaccacagtgatactagtgatgatgaagattggaatgacgcagctgctccaagtagaaaaaagaaactcactggcaatgtgactccagtgtcaccaaatgcaaatgcttcaaataattctatacatactcttaagagaaatgctcatcagaataaagttgaaaatacaaatagttcacccactaaatcccttgatggccgttcgaaatctggttccagggataaaaggtctggatcttcagcacacaaaagactaggagaagccgtagttcagagacttcacaaatcttttaaagaaaatcagtatccagatagaagcacaaaagaaagcctggcacaagaacttggacttacttatcagcaggttgccaaatggttcgacaatacacgttggagcttccggcattcatcacaaatggaaaccaattctggtagaaatgcttcaccggaagctaccgatggcagggctgaaaatgagggggagaagcaatgtgaatcaatgtctccggaggtcagtggaaaaaactctaaaaccacaagctctagaaaacggaagcatttgtcagaacccctatctgaagcacagctggatatcaatggcttagcaacaagttcaccaaatgttcatcaaacgcaagtaggcaataaaatgaagacaaggaaaaggaaatga

SEQ ID NO: 95295 - DNA, 264 bp, Glycine max
  Peptide Sequence Number=SeqID_212073
atggataagagcttgaaggtagaagaagatgaatggagggagaaggagagaaggagcaccaaattttgtgcctcaaatgagtggcagttggaggagagcttccctagggaggagtcgggtagctcattgaggaaagtagtaaggaggattataaggaagatcccaaagaggatatgtgggatgtttcctcatgggagtctcgctgttaaggaccttttaaactaccaacgtatttcacccttcttgtatacagttcttccctag

SEQ ID NO: 95296 - DNA, 489 bp, Glycine max
  Peptide Sequence Number=SeqID_212074
atggtttgtagagttagaggtaccaatttagttgaggtagaatcatgtagttttgaggaaagggattgtaaagttagccaagacaagatgaagaaaattgggctcgtgagttcttgtaaagccttgggatttttcagcagcatgccaaccaatatgacttgttgggttgagaaggagtatgacccatgggaagatcaacagaggaaattgatggacttcatggatcaggacaagaaagatgtggccctcatgaagttagaattggctaagaaagaggcaacatttgttgctctatctgagaaatatgagcaacctttggcagcaaaggcgattgccgagaaagacttggatgatgccaaatctcaattgaccttgctagaaggtgagaaaacaaagttggagaagcacttgaaggatttgagtatatttgaattacaagctaaaggatttggtgaggaagtgaaggcttttaaggccaagttagggtaa

SEQ ID NO: 95297 - DNA, 831 bp, Glycine max
  Peptide Sequence Number=SeqID_212075
atggaggccaagaaggaatatgaagtggaccatctgaccacactcacagggaccagtttctctcagttactattcggagatgacgacgacgattatgatgaaagtgcattgggactcgctgtggaccagtcttacacccgttcacctcttttctccattcacaaggcaccccaaatgctttgttttgccaaccatcaaaaccaaggtgacgttttgcttcctgaaaccaacgtaacccctcagaaatctgtcatcacttctagtgactcctcttctgctagcgcttcctcctgcaaccacaccaacaccgccttcaattccttacctaagtctaatagtttgcagaaaaagcgaaatgggatggggcaagaatcagtgaccaaggttggtgttggaagccagagacaaactaagaagaacaaagcagagaaccccacctcaaccggacatgcaaagaggaaggagaagctcggggaacgaattgcagcgttacaacagcttgtttctccctttagcaagacggatacagcatctgtgcttcacgaggcaatgggttatataagatttcttcatgaccaagttcaggtcctatgctctccttacttgcaaagtttgccttcctcgtaccatcaaaatcagcatggggacggagttatcaatgaagaggaagtgaacaaggatttgaggagtaggggtctttgcttgatccctgtgggatgcaccgtacacgtggcaggtagcaatggtgctgatttctggtcatctgccgcaatagggaacaatgttaatttcaccatcagccaagcagtgaaacgaaaccaagatcaatga

SEQ ID NO: 95298 - DNA, 135 bp, Glycine max
  Peptide Sequence Number=SeqID_212076
atgtcagcgtcttgcgggcgacactgcaataaagtctcatttgctatccagatgtcagcgtcttccggccgagactgcgaaaaagtctcatttgctatccgtcagactccaagtccggtagcatgcagtgactaa

SEQ ID NO: 95299 - DNA, 555 bp, Glycine max
  Peptide Sequence Number=SeqID_212077
atggctaagaaagtggtggcttctttgttttgttttgttacgtttcagattcaaacgaaggatggtttcctgctaggtcttcagcgcgtctcttcttcttctcttgggcttgggtacgatggagaacgaggccctccggttctgcttctgcttctgcatggcttattcatggacttagccatgtatgatcttgcagaaatgatcaattacattaattcagtaacaaacgcaaagctattagtcctcgggcatccacagggtaaaatgtctttcgctgccttcactcaaccggagatagcagaaaaggctgattggaagataaaaactgctgtcaagacacccaccagtgctgttactgcaagggcaactgtaggcagtggagttgggactccgaagttctgcaaatcaaagtacaggaatactgcacaaggaagaaaaggagggaagagtgtgcagaaagagaagcacgatacacctcaagataccaacaagcaggatcctcttcagaacttggtaattaaccacaaggcagaaggaagagaagagagggagtga

SEQ ID NO: 95300 - DNA, 201 bp, Glycine max
  Peptide Sequence Number=SeqID_212078
atgtcttcctctagtcttccatggagaaaggaagttttgacatcgagttgctctaactccatgtctagagttgccacctggggcaacaaaacacatatgaaggttgcttcagatggttttgactcgtgcagccagtcccctcaactggtgttgaattctaatgttgagggtgcatttgaagatcctgatcaatctcattag

SEQ ID NO: 95301 - DNA, 411 bp, Glycine max
  Peptide Sequence Number=SeqID_212079
atggaaaccaacacactcccaaaccaacagacaccaaaaaccaaaaggcaaatcttcatactctcaggtcaaagcaacatggccggtcaggggggggggggtatcagggatgctaacaaccgtaagcggtgggacggcgtggttccgccggagagccgccccgatccatccatcctccgcctctctgccaccctccaatgggaactcgcgaacgagcccctccacgtcgacagacaaatcatttgtgttataattcagctaaaaatagacaaatcggaggaactcgtcaaaatgacagaagagaatataaaagactcaggttgggattcatgcgccactttcccaagtcgaataactccggaagtgggagagagacaaagagtgaattttctctggattccaagtgagtga

SEQ ID NO: 95302 - DNA, 345 bp, Glycine max
  Peptide Sequence Number=SeqID_212080
atggagatgcatggagtggtaatgaagaatgaagagaaccgtatattgggagcaggggtaaccggaggggataatgagctcttcacacaaatcatattgttttgggtggtgaaagctctgagcaacagcaacaagaagaagagtgtttcccaacaaaatggagacagtaatcattcccatccctcgatcaacaacactacatcctctgcctttgctgcctctttacatataatgcttgggggatggactcgccacgcgcctctcacaccgcgtcgatcctacgtcttcacagggaaagatcaccacacctcacaactgttagctaatagtaattcaggactgtga

SEQ ID NO: 95303 - DNA, 1302 bp, Glycine max
  Peptide Sequence Number=SeqID_212081
atggcattgctatttctaataggatatgcagtcatcatatttgaagaatatctagggatcaataaaagtggagtgggactgttgatggctgtaggcttgtgggtgatacggagtatttgggctccatcaactgatatagctgtttcagagctaactcatgcatctgcagaagtcagtgaaatagtgtttttcttgcttggtgcaatgaccattgttgagatagttgacactcatggaggatttaagctggttacagacaatataacaacccaaaacccacgccttctcctatgggtgattggatttattacattctttctcagttcagttctagacagtctggcatccaccatagtcatgatttctctgttgcagaaattagtacctctgtcagagtatcagaagatattgggaggtgttgttgtaatagcagcaaatgctggtggtgcatggagtcctattggtgctgttaccactactatgctgtggataaatggccaagtatctgcagtgcaaacaatgaagggtttgtttttaccttcagtcatttctctagttgttcctctggttctgatgtccttgactagtggagttaatgggaaggaacaaaggtctctggatgtctttgcctctgaaccgattgctcctcgagggcaacttgttttctcagtgagtttaggagctttgatttttgtcccagtgttcaggtccctcacaggtttacctccgtacatcggaatgctgctcggacttggcatgctttggattttcgttgatgctatccattatggtgaatctgaaaggcagaagctaaaagtgccacatgctctgtcaaggatagacactcaaggagcactatttttcttgggaattctattatccgttagcagcctggaggtagcagggattcttcgggaaatagcaaattactttgatgcacatgtcccaagatgtgaactgattgcaagtgctattggactaatatctgcagtaatagacaatgttccattggttgctgccacaatgggaatgtatgatgtctcttctttccctcaagattctgagttctggcaaatgattgcattatgtgctagtactggcggatccatattaattattggctcagctgctggagttgcgttcatggggatggaaaaggtggacttcttttggtacttacggaaggttagtggctttgccttagcaggttatgctgctggtattgcggcctatttagcgcttcataatctcaacatcttccaaccaacacttgcagaggttcatttcctttctggttcttaa

SEQ ID NO: 95304 - DNA, 294 bp, Glycine max
  Peptide Sequence Number=SeqID_212082
atgaacgcagtccaacaccatgagctagcggttttaaataaacaaaacgaggacactgctcaggatcactggacttaccaatggtttctcaatctaaggaattttgcaacttgcaagaaaagaaaagtttctttcagtgtgattgggaaaactcatgcaacagaaaacaaaaaaattgaatggtcttcccaaactgctgataacaggaccctactagaagcaatggttccagagtggaaaccaagaagagaatcagtttgtgaaaagcctctatccgtcttgtggagtgtgtga

SEQ ID NO: 95305 - DNA, 531 bp, Glycine max
  Peptide Sequence Number=SeqID_212083
atggcacttgttgaagcctatgcttctctttcaatctcttctggtggttcaatttctaactctcagttgaagtgtgtcgcagttgctcgtcttttcactccaccaaaatgctctcccaccgctcactttcctcatcggaattttgttgcaactcgaccatcattcatcgttggttccccactcttgattcaaagaaatcatggaaggaaagctgcatgcaaagcaatccctgttccaataagatgtgagcaaagtacccaacaagggaatggtctggatgtgtggctaggcagactagccatggttggctttgcagtagcgatcactgttgaaatttctactggaaagggactcctagaggtatatgatactattgtacgtgtgaatgttgggaatttcaaaattcagtgtgtttccaagggaacattagctagaagaatttttgcatatccatttaccattgctcatattagagctagagaaggaaatggactgcataagaagatttgggcctatacttcaaatcattga

SEQ ID NO: 95306 - DNA, 354 bp, Glycine max
  Peptide Sequence Number=SeqID_212084
atggaagaaggaagaaagaggagaaacatacctgtgctgtacttgcatcctattccagtggatttatgcaatgacattgctatagcactgcaaagcttatggttctatcagactgcctttgttctctatggcccagtgatgccaagtggttgtaagcttagggaaaacagtgtcacgtgtgattctattgatagcgaggtttggggcgaattgcttgctaacattcagctctttgttgcggttcttgtggtccttgtgggaactgtggcatcatatggctttgctgcttcaagatatgggaattctgaagttaagaacttgcatgcaattcaggctgaattagatcaagactga

SEQ ID NO: 95307 - DNA, 762 bp, Glycine max
  Peptide Sequence Number=SeqID_212085
atgaagtttgacaagatcctcaagaggctgatcgagcagacactgccccattggcgtgacaaattcttgtgctacaaaatcttgaagaaacagttgaacgttatgtgtcccgaagatggccaagctctgccccagttgaatgccaaagaattggaccacttccttaacctcttgcagctagagattgctaagttcaacaatttctttgttgacaaggaagaagaatatgtcatcaaattgaaggagtttcaagacagagttgtcgaagccgttgattcaaatgtagacttgatgtcattagggagggaaatagtagattttcatggggagatggttttgttagagaactacagtgctctcaactacacaggcatgttatgtttagtgaagataataaagaaacacgataagaaaactggtgctctacttcgctcaccttttatccaatctgtggtgaaccagcccttctacgaaattgatgttcttaacaagcttgtaaaggagtgtgaggtgatactaagcattcttttcaccaatggtccgagctcatcgataagccaggattttatgcaaaatggttttggctccatgagtggtaatgaaaataaagagactgtaatgcaggttcctgaagaactttctgaaataaaaaatatgaagaacatgtatatccaactaactctatcagcacttcataccttggaacaaatcaggggtagaagctcaactgtaagcatgttcccatcttctccaaacaactag

SEQ ID NO: 95308 - DNA, 564 bp, Glycine max
  Peptide Sequence Number=SeqID_212086
atgaagatactggagtgtccaggaaccaagttcatgaatagatggggagatgaacttgatgatcacattgggtactccttgtggggatcctattgggctaagactgctagacgctatgaaacactattgagcaaggcaaaaatcttccagcagatagtcaacaagactgctagacgctatgaaacactattgagcaaggcaaaaatcttccagcagatagtcaacaagacgggaagatcagttggacgcaatctggaaaagacaactgaagaagaaagggtggacgtagaagaagacgctactcaagctaagcagaggaggaaaaaaaggatggatgcacctccgtccaaggctgcacctactcaaaagcatcaacctcctactctagttgctcccaaggaaacaggtgtaatggaaaatgtctccaagaggtctgcacctaagaagcaacaaaaaccttctccttcaaccaaaggaaaaggtcaaaagccacaacaaaagtctctgtccactacccatcacctaagggatctcactgagactaagagtgaggatgatacttag

SEQ ID NO: 95309 - DNA, 378 bp, Glycine max
  Peptide Sequence Number=SeqID_212087
atgcctaactctgttatgtttacaagtgctttatggaagattggtagggtgatggatattgttctgagtgtttttcttatatgcttcaaactctggttccaacagtatcggcaaatgagacgcaaggaacaagatcgtcttgccaggatggaagtcgactaccagaaaaggaaagagctggcagaatttaatttgagaagagaggaaagactaaaagcggctgaggaacggacggcaaagaagcgagcaaaacgtcaaaagaagaagcaaaggaaaaaggagaaaaagaccaaattaaatgctggagaacagctgcaagagaaagaagattcctcaggtgatgaagactctgataacgatgaggaggcagcaccttga

SEQ ID NO: 95310 - DNA, 246 bp, Glycine max
  Peptide Sequence Number=SeqID_212088
atgagggatggaggagaacaagtttatcttggtgattccaagactactgcagttctaggaaaaggaaaagttcttattgaactcatatatgggaagacactagctttgagtgatatgctacatgttcccaccattagagttaacttggtttcgatagcactattgatgaagggctccatagtatatggagggtactctagtaatgtaggatttttcagccctcgtgttttaggacacctagactag

SEQ ID NO: 95311 - DNA, 882 bp, Glycine max
  Peptide Sequence Number=SeqID_212089
atgatggcacatcacataagcatccagagggtgaacaatcctccatttaagatgatgttgttgttgacccctctctatttgatgttcaaccagttcgccaggagacttcaactgttcaatagtttgaaagaagcctatgaagaactgagacaatactccttaagaaaaaaaagcgaactgagtccaatcttgacatggacaatgaatgaagcaaaactccaacctaagattgattggacgcagttccctcttgaagttgaagaagaggaagttacttgtcccccgtccaagcaccaagaaccttatgtcacatctaaggcttttgagaaggatccaccaacaggtattgaagttcttcctccaccaaagtggaagcaacttcatcccaaggtattcaagccttcatctttaacagcacaacgcaaggatgtctacaaaatttcttctggagcctacatacaaaaggttagctacgacaaggacaccatttgttggttttgtaagaatgtcgcacaaaaaattgatccatcttctaatgatttcttgcctccttttctgcgtccacaacatgtcaactcttcaatccaatgtctaaccctctccttgactaaggataatgatgcaacttgtactcatatgtgtcgcaatgtgcccttcgcgggcgagcgagggcgaggctcacgggtgcgctttccaaaggaggaaagaggcacggagtcgccaccaacgtttatttgtgggaaacgtcggaaaaaccgaaggaaaccggtcaaaaataaaattctaagttcgggatttgtatttacgcttgaggaaggtcgacaaaagcggggcttttgctcctacgtaccctcctttggagaggaaatcagacctacgtag

SEQ ID NO: 95312 - DNA, 303 bp, Glycine max
  Peptide Sequence Number=SeqID_212090
atgtcgacgggcaaacccagaggcggtgattttcagatggtcccggcgccgggaacgtcaaagcctccccttccgccggcagcagcatcgaatgcgatagtggaatatactccggtctctctcaaagaggaagaggaggatctggaagtcaagctccgacggattatcgacaatgttcctgtccgtgttagcaatacttccggtagttccgccggttcaggctccggcgacttccaccagatgttagatcactggttcactgcagttgtgatgaggaacgtaatgatggcaacgaggggataa

SEQ ID NO: 95313 - DNA, 258 bp, Glycine max
  Peptide Sequence Number=SeqID_212091
atgcagagaactccttcaagagagttgcatgggcggaaacatgttgaaggttatgattctcggacatggttctccttcaacgtcgttttgtacctgtgtagtcaggtggacgataaagtaaaccctcaaggaggagtggttgaggacttgattgtggaggatgacgcaacggtggtagcgacagtggcaattggtggggagcttccccaagaggatcctggtggctcaatgtggaaagtagtaaggaggattctctga

SEQ ID NO: 95314 - DNA, 238 bp, Glycine max
  Peptide Sequence Number=SeqID_212092
atggccgaagtagacgaggtgcaagagaggataaaggctgacttggaggccatgaaagagaaaatggtcacaatgatggaggccatgatgagcatgaagaagataatggaggtcaatgcggctacagttgctgctaccagtgccgttgctgaggtggacccgactcccccatcaagcctcaaccaaataaatcatgccatcttggatatggtagggcagagaggcaaagaattgggaa

SEQ ID NO: 95315 - DNA, 1458 bp, Glycine max
  Peptide Sequence Number=SeqID_212093
atggcaattatgaccaaaaaacgcaaaacatctaagaagccaacctttccaccaggccctagaggccttccctttattggcaatctttatcaactcgatggttctactctttgtttgaaactctatgaactctcaaaaaaatatggtcccatcttttcccttcaactaggttcaaggccagccctcgttgtttcctcaccaaaactggccaaggaggtaatgaaaacccatgaccttgagttctgtgggcgaccctccctcataagcacaatgaagttttcatataatgggctagacatggcattttcaccctatagagattattggagacacactagaaaaatttccatcatccatttccttagcctcaagcgtgtcttaatgttttcctcaataagaaaatacgaggttacccaattggtcaaaaagataacggaacatgcttcttgttccaaggttaccaacttgcatgagttgctcacgtgtcttacgagcgctgtagtgtgtagaactgctttgggtagaaggtacgaagaggaagggatcgagagaagcatgttccatggcttgcttaaagaagctcaagaattgacagcttccaccttctacacagattatattcctcttgttggaggagtggttgataaactcactgggttgatgggtcgtcttgagaaaatgttcaaggtgttggatgggttttatcagaatgctattgatgaacaccttgatcctgaaaggaagaaactcactgatgaacaggatataatcgatgccttgcttcaattgaagaatgatcgttcgttctcaatggatctcactcccgctcacatcaaacccttgatgatgaatataattttggcagggacagatacaagtgcagctgcagtagtttgggcaatgacggcactaatgaagagcccgatagtaatgaagaaagcccaagaagagattagaaacatttttggcgggaaagattttatagaggaagatgatattcaaaagcttccttatgttcaggcagttataaaagaaacaatgagaatctacccaccattgcccttgcttttacaaagggaaacgattaaaaagtgtagcattgcagggtacgaaattccagagaagacattggtgtatgtgaatgcttgggcagtgcatagagacccagaaacttgggaggagccagaagagttttatcctgagagattcctagacagcaaaattgattttaggggttatgatttcgagttgattccatttggcgcaggccgaaggatttgcccgggcataaatatgggaattatcacagtggaacttgtgcttgctaatcttctgtattcatttgattgggaaatgcctcaagggatgaaaagggaagacatagacactgatatgcttccaggacttatccaacacaagaaaaatcctctctgcctagttgctaagaagcaagggtga

SEQ ID NO: 95316 - DNA, 501 bp, Glycine max
  Peptide Sequence Number=SeqID_212094
atggcgccattgctatggggtaggacacagaagattgcgtgccacgtgtttgtgatgggtaaagtcgatgtttaccccggaacaacttgcatgttctatgacatagctaatggccacaaacaaatcaatccacgccatgatgtgaaagtatattcatttagaaatgggaatatggctttgaatttgggacaagtgtcattgcctcatgataggtttgggacagatgtcacttctagaaagtctacctacaaaggcttcttacttgtgaagaattatgaccattcttatgatcggcttatgcttttggggatcaaatatggaagaagcatgatttcaggaggtatgttggtgattgtggctgggtatagggcagaggaagcagggagtagagtgcagccaacagaggaccttttctttacttcatccaacagtgttcgtacaaatggaaccagaatcaatttgaagattctccatggatgcttcatctcagttgacgcttga

SEQ ID NO: 95317 - DNA, 240 bp, Glycine max
  Peptide Sequence Number=SeqID_212095
atggatagaaaagtgaagcctttcattcttagtgctcttcttctacttttattccttcatcttcagttgctttctggcgtcgaagctcggccactcgaggttaggaagttagatagcactaccctgagaatgtgggcaatgctgcattcagggccaagccctggtgggaaaggccataaatccgagactgaggatgccccaattccaagagagcttaaacaatctgttccaagccctggc

SEQ ID NO: 95318 - DNA, 234 bp, Glycine max
  Peptide Sequence Number=SeqID_212096
atggctgctcaggtagtgcccctaatgatggaaagggaggtgatagcaatgatagtagacacattgccggtgtcctactatgagaagatggtgggttacatgccttcaagctttgccgatttagtgtttgccggcgaaaggatcaaaatgggtctgagaagaggcaaatttgattgtctcgcattgacaagtaaaaagcctggggcaaatagagagaatgagaagggggaatga

SEQ ID NO: 95319 - DNA, 267 bp, Glycine max
  Peptide Sequence Number=SeqID_212097
atggacacaagactcaagtctgtctccttgctcactcttgttcttcttgcttccttgtttacccctttgcttcctgtatcagaagcacgaccactgtttagttcttcaccaagtaagaattgtatcagtattattagagaggtgaatggagtcttcagaacattgaagagctctggtccaagccctggtgttgggcacagacttaaaaatcttcaaaatcttggagggatgaaagactctggtcctagtccaggtcaaggacactag

SEQ ID NO: 95320 - DNA, 114 bp, Glycine max
  Peptide Sequence Number=SeqID_212098
atgggttctccacctttcagcaatggaatttattctattccttcaaattttactcaaagccagagcgctaaagcgccgaagcatcaatgcatgctagctccaccagaacagtga

SEQ ID NO: 95321 - DNA, 423 bp, Glycine max
  Peptide Sequence Number=SeqID_212099
atggggattcctaagtataaaaaaggaagagataaaattctacaattcaagtatctaacatatctctctaccacctcctcctccaccttaatccctccgaatctacttttgagggaatttaccttcaacccggatgcaatttcaaaacatctcaataagctcttgattgccacaacattgttgatattgatatctcccacaaagattgggtcatacgtatattgcaatagactcacttccacttatttttcacccactttgaagtcaaagaacaagttctctgaggtagtttatctcatcaagccactaagtccctctgccacaatgttgattaggaaagaagctaaagggtctcgagtcttcttgttaaagtcatctttgcaatatgaactccatagaaggactaccattgataaggattga

SEQ ID NO: 95322 - DNA, 320 bp, Glycine max
  Peptide Sequence Number=SeqID_212100
atgattgcttcccgtcgaccgatccgcctttccttcaccgccgcgcgcaaccagtcgggcatgagcctgctggagatcatcatcgtcatcgtgctgatcggcgcagtgctgaccctggtcgccagccgcgtgctgggtggcgccgaccgcggcaaggccaacatcgccaaggcacaggtgcagaccgtcgcatccaaggtcgacaactaccagatcgataccggcaagctgcccggctcactcaatgatctggtgactgcaccggctggcgccggtggctggttgggcccgtatgccaagccggccgatctgaacgatcc

SEQ ID NO: 95323 - DNA, 315 bp, Glycine max
  Peptide Sequence Number=SeqID_212101
atggctgctggaaaactccaatcctttgcattcattgttattattctgtcgttctcttcttgggtgaagatccaacatgggatggcacggccacttaacactttagtgctacatagagatgctgatcaagaaccaattaggagagccattttggagtcatcacacacagttgtgagaagctcgaagattaatgtgggtgatatcgatgcacagaagaataccattcggaaactagttgttgacaacagcggtccaagccctgacggaccagggcataaagggctactcacatcatactctcaactcaacaactag

SEQ ID NO: 95324 - DNA, 270 bp, Glycine max
  Peptide Sequence Number=SeqID_212102
atggctcgaaaattccaatgctttgccttctttcttatttttctctctttctcttggctgtgcattcaacaagggatgccgcggccactggacacttttgttctgcacaaagatgctaatgaaaaaccaaagagtacctttctcaaggcatcacacgtagacgcagttgttgtgaaaggctcgattgtggaaggttatgcaaagaagaatatcaacagtagtggtcctagcccctgcggaccagggcattgccctaaactcaacaattag

SEQ ID NO: 95325 - DNA, 252 bp, Glycine max
  Peptide Sequence Number=SeqID_212103
atgcaaggaccaatggacaatgaccatgacagtttggtaagggaaagctatcatatacctgccaaaacacaacaggcgttgggacaaagtggaggcattgtagaagcccaactcattgacaatctggaaagggctaaggttaatgtcaataatagttttaatattaatcgggatgttgggacaccacctgcagagtctcatcgtaactatatcaacaatgtggtggacataggcacctccatatgcaactga

SEQ ID NO: 95326 - DNA, 276 bp, Glycine max
  Peptide Sequence Number=SeqID_212104
atgctcaagctttggatagctctaagactcggtgtgtctttcccttctgcttcctcctccttatatagggtccagggcttcactgtgggctttcttcgcgctaagcttggagtgggagcgaagcctggagtgcgagctaagcctgaagtatgcgctaagcctagagtgcacgctaagcctagagtatgcgctaagcttgaagtgtgcgctaagcctggagtgcacgctaagcgagctgtccaattcttccaacttttcttcaaggttttttcttga

SEQ ID NO: 95327 - DNA, 756 bp, Glycine max
  Peptide Sequence Number=SeqID_212105
atgctaatcaagattgtgaagagtttcaatgtggaagttcatagacagaaaggtaacattcaaatactagacagtggtctcagtcttagtggatcaaggcattcgcaactcaagaaggataacattcaaatactagacagtggtccaagtcccgacggatcagggcatcctcaactcaagaaaggtaacattcaaatactagatagtggtcctagtcctagtggatcagggcatctgcaactcaagaagaataatattcaaatactagatagtggtccaagccccaatggatcaagacatcctcaactcaagaagggtaacattcaagtactagaaagtggttcgaggcatggtggattagggcatccacaactcaagaagggtaacattcaaatactagataatgcttctagtcctggtggatcagggcatcctcaacaacagaaaggttgcattcgtatactagacagtggaactagtctcggtggatcggggcatcctaaacaacagaagtgtaacattcaagtactagaaagtggtcctagtcccagtggatcagggcatccacaactcaagaaaggtaacattcaaatactagacaacggtcttagtcctggtggattagggcatcctcaacaacagaaggataacattcaaatactagacaatagtcctagtcctcatggatcatggcatcctcaactcaagcagggtagcattcaaatactaaaaaatggttccaatgtcagtgaataa

SEQ ID NO: 95328 - DNA, 417 bp, Glycine max
  Peptide Sequence Number=SeqID_212106
atggcttcttcaccagcctcacctcctcctcctcctcctgacgcatcagcttcaccgtctggcgtgaagcggacacggaaagcctcacgtctacgatccttgtctactagaccagctggtgctgagagaccagtggtccatgttgattctgctaccggtaaggccgacggtccccacaggaagaaattaagaacatatttggggattgtggcacgtgataaggtggacgtgatgtacgagaactggaagaaggcggaatttgaaatcccagaggctcttgacaataggacgaaaaaaagttacttaagactatcggcgagagatggaggcagtttaaatcagacctcacgaggaaatgggcccttgcagccgatcaggacggtgtggacgacactgtctgtgagaaatatgacataa

SEQ ID NO: 95329 - DNA, 156 bp, Glycine max
  Peptide Sequence Number=SeqID_212107
atgtggacaaagaagatcgcgagggggaatgagcgagggaaacaaacctttcaaatggtgaggcaaagtgaagtgactatgagggtgagggcatgcgacgatgacgacgacggtacgcgtgagcttcggcggaaacactctttagggtgggattaa

SEQ ID NO: 95330 - DNA, 315 bp, Glycine max
  Peptide Sequence Number=SeqID_212108
atggtattccttctgccatgttatggattcaatccagtgctgtcttcaccgcttactacagctacttccacaaactgttttgaggaactagagcatgattacataaactatcttacaaagtttgtgcccacaaggaccattggtcctttgttcaagaccccaatagcaacaggcacaagtgaaatccgaggtgattttatgaagagtgatgattgcatagagtggcttaactcgagggccccagcatctgtggtatatatatcttttgggagtattgtgtatctgcctcaagaacagctggaaaggccttgttga

SEQ ID NO: 95331 - DNA, 732 bp, Glycine max
  Peptide Sequence Number=SeqID_212109
atggaagcaacaaacatggcatacagatccatcaaccagtatgtgctagcaaatgcaccttgctcggtcgaaattctagtggataaaggcttaagtggctctaaccatctagcgggaaatcaagtatctcatcatgtagcagtgttgttctttggaggaccagatgatagagaggcattgtgctatggatggagaatggtggaacatcacgggattagccttaccataatgcgttttgtccaaagtgatcaagtacaagtagagccattgaggcaacaacatggtggtattgatttggaagaaccaagggtgctgacagtgcaaacagatagggatattcagaagcagcatgatgagaagcttatacatgagtttaggatgaggtgtggggatgatgatgcggttgattatgttgagaaggtggtcagcaatggtgaggacacagtgacaacaataagaacaatggatgacattcatgaccttttcatagttgggagaggtcaaggggtgatatcaccactcactgcaggactcactgattggagtgagtgtcctgagacaggggcaattggggatatgctagcatcttcagattttgcagccactacttcagtgttggtggtgcaacaatatgttggggatggttcacaatatgaaggattagaaacaccatatggtgaagaatccacaccactaccaccaggacataaaatgttcacttcagaacactag

SEQ ID NO: 95332 - DNA, 135 bp, Glycine max
  Peptide Sequence Number=SeqID_212110
atggagaacaaggtggatttcaaggataacaagtcagtagacccagagaaatacactttcagcctaacaggaaggaagcctattagtttggaagagaaaaggaagcttggtgaagggtatattccactgctataa

SEQ ID NO: 95333 - DNA, 252 bp, Glycine max
  Peptide Sequence Number=SeqID_212111
atggagttcgtctttgtcgagttcgtctctgccacttatcgattgagctcgaagaaaactaggaaaggaaaaagtctcgaaaagggtgggaatcgattttggaagtccattgggcttggctttaagactgccagggaagccatcgaaggtttcaagtatcttccaaccatccttttgtgtgaagactcggtgccattgatggtagaagccaaagacactaattgtttgtcctgctgctcccagtttaggtag

SEQ ID NO: 95334 - DNA, 852 bp, Glycine max
  Peptide Sequence Number=SeqID_212112
atgtatcctacagtagatgaacatgaagaggtatatgcagctcatcatagacatccagggtatgttctaccagttgtggtgccaccaaattatggccctcctcaaattccatcctatgctcctccatacatcaacaacagtgttagtgtaaggggtcctgtgattaggacacaacgatggtcaactggtttgtgccgtagtactgatgatcctggaaactgtttggtcacttgcttctacccctgtgttacatttggattgatagctgagatagtagataaaggcaatacaacttgcacttgtgctggggctatttatgggaccctactagctctgagtgggcttgcatgcttgtgttcttactattataggtccaaattgagggtacaatatgacttaccagaggctccatgtatggactgtttagttcatttttgctgtgaaacatgtgctctatgtcaggagtatagggagcttaaaaaccatggatttgacttgagcatagttgaaagctctaacctctgctacaaatcagaaatcaagcaaaccttagatcaacacattgaaagtggttcactttcatcagaaatcaataacagtgcttctcaagtggattcaccccaacctattattactagtcctggtaatgctaatgcattagctgttgctgctctagaaaataaggatctagaattcctagtcgctcaacttggttcagattcacaccaaagcaacaacaagaacaatagtgatggtcatgacaatagtcagatttcattcaggaaagtagcagaaaatatgtcgcagctttcatgtgcttatattgcaagcaggctaggaaaaggtgattag

SEQ ID NO: 95335 - DNA, 156 bp, Glycine max
  Peptide Sequence Number=SeqID_212113
atgggtggcatttatggtgtgggttatgtggatgtggatggtaagaattgttgcttcaacgagtcacgtgtggagttttatcttgagcaagaacctcacccatcatcctccaaaaacttgaaacaccttttccagagtatgcttcattatctttga

SEQ ID NO: 95336 - DNA, 453 bp, Glycine max
  Peptide Sequence Number=SeqID_212114
atggcacttgttgaagcctctgcttctctttcaatctcttctggtgttgctcgtcttttcactccaccaaaatgctctcccaccgctcactttcctcatcggaattttgttgcaactcgaccatcattcatcgctgggggtggaactaaagaattgtttgaattgtctctagtgattcggagaaatcatggaaggaaagctgcatgcaaagcaatgcctgttacaataagatgtgagcaaagtacccaggaagggaacagtttggatgtgtggctaggtcggctagccatggttggctttgcagtagcaatcactgttgaaattgctactgggaagggactcctagagaactttggactcacaagtccactgcctacagttgcccttgcagtaacagcacttgtgggtgtcttgacggcagtttttatcttccagtcagcgtcaaaaaattga

SEQ ID NO: 95337 - DNA, 1104 bp, Glycine max
  Peptide Sequence Number=SeqID_212115
atgtattggcacgtgccgaagataaggccagagaccctacaccttcttcctttcagcctcaacaaagctcacagcaacagtttcagtcagttaaagtgtgcactgtgcatcatggaaaagtgcacattagtatgttacaaggttatagaagctgcttcttatatgttaatgctcacactgctcttcactttgaaaatgtttgaagacagctaccagcccaagactgatttcctcaaagctgttgcaatattagcagcagctgcaactggagcactgacaattaaccattcatgggtggccactaatcaggatcttgctatggcattgctatttgtaataggatatgcaggcatcatatttgaagaatctccagccttcaataaaagtggagtgggactgttgatgactgctccatcaactgatatagctgtttcagagcttacacatgcatctgtggaagtcagtgaaatagtgtttttcttgcttggtgcaatgaccattgttgagattgttgatgctcatcaaggatttaaggtggttactggcaatataacaacccaaaacccacgccttctctggatgttcatcattatcattattgctcctcgaggacagcttgttttctctgtgggtttaggagctttgatttttgtcccagtattcaaggctctcgcaggtttgcctccatacatggggatgctgcttggactctgtgtgctttggatccttacagatgctatccattacggtgaatctgaaagcctggaggcagctgggattcttcgggaaatagcaaactaccttgatgcacacgtgccaagtagtgaactgattgccagtagtattggactcatatctgcactaatagacaatgttccattggttgctgatgggaatttgattgcattttgtgctggtactggtggatccatgttaattattggctcagctgctggagttgcgttcatggaggatggaaaaggtggacttcttttggtacttacgaaaggttatgctgctggtattgttccatatttagcgcttcataacctcaacatctctctaccaactctagcggaggttcctttcctttctggttcataa

SEQ ID NO: 95338 - DNA, 606 bp, Glycine max
  Peptide Sequence Number=SeqID_212116
atggatggtcgaacccgcaagcattatatgattggtgtggtgcgtgttgcatcagaggtggacgcaattcagaataacaataaagggtggatgaggatccagaggttcttggccacactggccataactgtctccatactcttgggaaatggaaaccccgttcagtgcttcgacggcggtagccaccaaaaacagcaacacagtttgtgtgaagagctcattatcccctacggttacccctgctccgagcatacgattcaaacgaaggatggtttcttgttaggtcttcaacgtgtctcttcttcttcttctcttcggcttcggaacgatggagaacgaggccctccggttctgcttctgcatggcttattcatggaattagccctgtatgatgttgcagaaatgatcaattacattaattcagtaacaaactcaaagatatttgtagttgggcattcacaggggacaattatatcttttgctgccttcactcaaccggagatagtagaaaaggttgaggctgcagcccttctttctccaatatcatacttggatcatatcagtgcacctcttgtacttagaatggttaagatgcacattgatcag

SEQ ID NO: 95339 - DNA, 126 bp, Glycine max
  Peptide Sequence Number=SeqID_212117
atggctctaggggcgacggtgattgcgtggaagaaggatcgcgatggtggaagaaggaaggttctagtgggaaagtgggagaagcaacatgtggggaagggggaaggttctagagaagtggagtag

SEQ ID NO: 95340 - DNA, 435 bp, Glycine max
  Peptide Sequence Number=SeqID_212118
atggataaagcttttgctaggttcttctcgggaggcaatgacactaatattaatgaaccaatcccagtcatcactctcgatcaagcctatagtagtggcgtggagagtgttggcgaccatggtaagactacaataggtgatgaggttggccttggtgacaactctcacattgtagaatttcttgatggtgatgtggtgggtaaaggatgtagcgatggaaagggtacgaacaacggtggcggcttcaccagcaaagtcagaggtgaggtaggtgatgtgaggcatagagggaaaggggaggtcgtggatgacagcactatagtcacgtgctcaacgaaagtcatgaatctaggatggagtggtcgcaagacttgtggtgatggcgatcctagtttgcggtggttacgaggtgagtggtggtgttgtggtggttag

SEQ ID NO: 95341 - DNA, 333 bp, Glycine max
  Peptide Sequence Number=SeqID_212119
atggagggagggattgtgcccgagaaggaattggatcgaagggttaaggtttggaggtttgagagtaaagagattgaagaggggattgggccaaagaagttgttatcagcgaggtcaagtgtggtgaggccgcagatgaaggaggttcggcgagggagtgagcatgggtcggttgtgaagttccatgaggcgaggcatgaccagggagtgatggaggagggtttgattgaggccttgaaggctttgagtgctgcaatgtctgagggtgaggtttgtgcttggactaggatgcagtggaagtggatgagagtgagggaaatgatggttaggtag

SEQ ID NO: 95342 - DNA, 471 bp, Glycine max
  Peptide Sequence Number=SeqID_212120
atggtagaggagcctacaaaagttgtgattgaagcttttattgatgagccaagtgattcttctgctgtagtaattgatgacagtgaccaaggaggagtaaggaaatcacagagagctagacaaccctctagcaggttacatgattcaacaataggggaggaaggtgagctagtacacttagctctatttgctgaatctgaatcagtaagcttggaggaagcaatgaatgacacaaagtggactgatgctatgaaagaagagctgaaagctattgaaaagaataatgcatggcaacttgtgcctctgcctgctaagaaaaaacctattgcagtaaagtgggtttataaggtaaaaaagaatctgaaaggagagatttccaagtataaggccaggctagtggcaaagggattcttgcaaaaggctggcattgattttaaggagatgtttgcacctgttgcaagaatggagaca

SEQ ID NO: 95343 - DNA, 192 bp, Glycine max
  Peptide Sequence Number=SeqID_212121
atggttacccaaaacaatgagagtaacaagtttttgctctgggaccgtgaatgtgctgaattgattggtgaaacagctgatgatgcgaatagggtcaagattgaacaactagtgaatttgtgctgtttctggcacgatggcgatcttgatttgaaagcttcccctcaagcacttgacaaattgttggctcat

SEQ ID NO: 95344 - DNA, 141 bp, Glycine max
  Peptide Sequence Number=SeqID_212122
atgactggagttgtgattatgataatgattaggatgctcgtcatattgcggccaacagagcaggttcctgcgtgcaaagatgtcaaaacaaataatattttgttacaaaaatgtttagaaaaagagtgtcaagagaaataa

SEQ ID NO: 95345 - DNA, 147 bp, Glycine max
  Peptide Sequence Number=SeqID_212123
atggcttctgtacaggaatggtaccaatacggctttattctattcttcatggtgtacggatctgttcttgtgctcatgatggatgaggggttttatgctttttgggaggactcgtacgtacagtcacttactatacattttctgtaa

SEQ ID NO: 95346 - DNA, 879 bp, Glycine max
  Peptide Sequence Number=SeqID_212124
atggctcttaatcttctaaatctttcaatcttgttctttttactctttattgtgaatccatttccctttgtcgagccaagagccttacaattacctgtgttcaccaaaactctccaaaacctcaggggcgttcacaagggacaaaaggcgaacggtgtgggagaactcagaagctacctccaacattttggctacctaacaaacggtgattcttcgaacgacaacttcgacaataatgtcgagtctgctctcaaacactaccaagagttcaatcacttacgttccactggtgtggtagatgacgaaactatcaaaagaatgagcctcccacgttgtggaatgcctgatattgtcacccaacctaacgctaaccagttgttggtggcccctaacaactacagcttcttcccggggcaacctaaatggagaaaatttgcactaacctatggacacatgtcaagtgttgtcttgtccaataacttcttcagctctgtgagggcagcaaaattgagagccttgcaaacatgggctagagtcaccaacttcacgtttacagaaagggccccaccagctgacatagtctatgggttccatcgtggggaccacggtgatggctacccatttgacgggccgtatggggtgctagcccatgcttttgcgccacaaaatgggaggtgccactatgatgcagatgaaccatgggattttaatgggcaaaacattgattttgaaacagtagctttgcatgaatgtggtcaccttttagggcttggacatagtaatactcggggttcggttatggaagccacttatgcagggcaaaggaggagtttaacgcaggatgatattgatggcatacgagctctatatcagttctag

SEQ ID NO: 95347 - DNA, 870 bp, Glycine max
  Peptide Sequence Number=SeqID_212125
atggtttatctggacaataatgatgatagcaattcagcaactgaacaccacacagaccacattgcagaagctactaataggccaagaagagtgacagtagcattagagtcgcgttattcgtatcaattggtccgacctgcccttctctaccgctcttcattggcagatgccgaacatgccccttctctcatcgccaacctggctcgcctcgacacctccatggccaacctcgtcgtagcccaaacttccatggattccgatctccatgcatctcatcttcgtttagacgcgctccaagcctccatgctctccaaactcgatttcattatcctcaaactagataccatgatctcccgccaaggctccctgtttccttcttcggtacaaccaccaccgccgccgccgccactgttttctccttcagcgcaaccaccaccgtcaccgccagctcctccgtcgtacgcttcttcttaccaccccagccaataccctcctccgcctcgctatcacgtgcctcctcccatggctggacaacgagataatcctgctattggaatcgattccagcaccatcgacttccccgtcagcgtgtggcagcaccatcgtgccgacatcaatagccaattccagtccatccagttgtggcctctatcgctccgcaccaacccccattgttaccgcaagatcccttatgacaatggcatcttcctgctcggggatgatgtcgtcgcgcaccggattcgtccgtgttggatttggattctcttcgctactgagattttgctttgctccgttcgtcatcggcgtcaacgaccgccaccacatacaccaccacctctgaagccaccgcatccaccatcatctccgtaa

SEQ ID NO: 95348 - DNA, 324 bp, Glycine max
  Peptide Sequence Number=SeqID_212126
atgggccctgcgccacaccagggtctggcagccttggctcagactcatgggccgctcatgcacctccggttgggcttcgtggacgtggtggtcgcgtcttcagcctccgttgcggagcagttcttgaagatccacgacgccaatttctgcagccggccatgtaactccagaaccacatacttgacctataaccaacaagacctcgtttttgctccctatggcccacggtggcggttccttcggaaactaagtaccgttcacatgttctctgccaaggccatggatgattttagagaactgcgacagaatttcactgagatttga

SEQ ID NO: 95349 - DNA, 219 bp, Glycine max
  Peptide Sequence Number=SeqID_212127
atggatgagtttgatgcgcaggtggcctggctaggagcccatccttctccttctagaggggatgcacacatggctcaggaggaggggacttccatagatcagatacctgagccatctcctgcacctgttcctgaggagacccagccatctacaccagtcacggaggcagagcagcttatccaggattcatcagcagcttcagcactggataagaattga

SEQ ID NO: 95350 - DNA, 564 bp, Glycine max
  Peptide Sequence Number=SeqID_212128
atgcacgtggctcaattgatttctgatgccatccactatttgcagggatcgcgcccacaagacacccagtggacccggaggagtctaacagggctctggggtttccagctctggttatgggcctctgttagtcctacagggtgcgcgtccccccagcaagggatcgcgcccgcaagacacccagtggacccggaggaatccaacagggtcctggggtttccagctctgattacaagactttgtcagttctacggagtgcccgtcgcccccaagaagttcatcaggccccctattaaccgggttttcatcaagaagtactgcgccccccaggtaggcgtagggcgagacaccacaacagcctggggatggccggcagcgggcaatagacgcaccgctgccacctccagagccgctcagctcatctaccaaggctggagcattgcctatgacctgtggctgactagcaggcaaccaagtccaaagccaaaggtaagaaaaagtactaggtccgtgaccgacgagtcatcacgcgtccagctcaagacgttaaagaagcgctactag

SEQ ID NO: 95351 - DNA, 178 bp, Glycine max
  Peptide Sequence Number=SeqID_212129
gggcataatcgtcttaggcaatagtcagaggtcgagacaaggtcaaaggcagaaaccaatcaaggtacttagggacgaacgcaaggagaggctaggatcacgaccgataggtcatcatcctttgcttagcctgggacaaacggaaagcgtcgctgcgaagcagcccaatatcctttaa

SEQ ID NO: 95352 - DNA, 231 bp, Glycine max
  Peptide Sequence Number=SeqID_212130
atgacggcctggagaaaaatcaccatgacgaccgcgctgtgccagctgttaaaactgcagtatccgctgattcaggcaccgatggccggtgtcgctacgccgcagctggccgcagcggtatccaatgccggggcgctgggatcgattagcgtcggcgcggtgacgccgcagcaggcggcagacatgattgcccacactaaggaactgacgcgtggcccgatcaacgtcaac

SEQ ID NO: 95353 - DNA, 385 bp, Glycine max
  Peptide Sequence Number=SeqID_212131
atggccggttacgcccagggtctcgacgtacagcggcagaaacggcatcaccaggctgaaggcggcgccggtgagaaagcaccctacccaggcgacgaaaaggttgcgtttccagttaacgggttctgctgccgaagccataaatgtccattgccgaaaggtgacgcgttttgccggcggcaaaaagatgaagggcaaaacgtgaaagccggccagcgcctcgaaaccggcggcggtggtggtggcgctaaagtcagtgatctcgtagtgggccacggcgttaaacggatcttcggccaggatggcgtccagccgcgcacgctcaatgcccttggccaggatcacgccgcctgtgcggggattcttgcggccggaggcgatgaag

SEQ ID NO: 95354 - DNA, 852 bp, Glycine max
  Peptide Sequence Number=SeqID_212132
atgtggtccggtctgctgttcagcattaccttcctgttttccgctatcgccgcgccgttctggggcgccctggccgaccgacgcggccgtaaactgatgctgctgcgctccgccctgggcatggcgatcgtcatggtgctgatgggcatggcgcaaacggtctggcagtttctcgcgctgcgtgcggtgctggggttgctcggcgggttcattcccaacgccaacgcgctgatcgccacccaggtgccgcgcaaccgcagcggctgggcgctcggcaccctgtctaccggcggcgtcggcggtgcgctggtcggcccgttgatcggcggcctgctggccgatctgtacggcctgcgtccggtgttttatatcaccgccgcggtgctgttcgtctgcttcgtgctgacgctgctgtatgtcaaagagcaattcaccccggtgcaaaagcgcgacatgttgcacgcaaaacaggtgttcgcctcgctgaagaacccgaagctggtgctcagcctgttcgtcaccaccatgatcatccagatcgccaccggctcaattgccccgatcctgacgctgtatgtgcgcgatctggccggcgcgacccataatctggcgtttatcagcgggctgatcgcctcggtgcccggcgtcgcggcattgatgagcgccccacggctgggcaagctgggcgatcgcatcggcccggaacgcattctggtctttatgctgatcgtctcggtgctgctgctgatcccgatggcgttcgtgcaaacgccgtggcagctcggcgtactgcgctttctgctggggggcggccgacggcgcgctgctgccggcggtacagacgctgtttga

SEQ ID NO: 95355 - DNA, 213 bp, Glycine max
  Peptide Sequence Number=SeqID_212133
atgtacaattatcatgagaaaggaaaagctcctaatcttgaaagtgtattggcagacttcatgacatatcaagctagctctaaaggtgattgctattcaatgcaacagcagggaactcagtttgaaagggactattcttttgcagattatcaatgggagtcagaatggcaaccttattattgtggtgtccctaaattaatgactggtttacta

SEQ ID NO: 95356 - DNA, 240 bp, Glycine max
  Peptide Sequence Number=SeqID_212134
aacgacgttcctaaaggaaaactctacaaggtttcagaatttcaacaaacattatcgacaataacgaaacaaaagaggaaacataaaagagaatatgaatctgtggatcccacggtcatgtggctccgcatgccaccggactcttgggtcacggtaacaaaaggtagggtggtcgacaaaagcagggtttttgctactacgtatcctcaatttcgtgatgaggaactcagatctacgtag

SEQ ID NO: 95357 - DNA, 249 bp, Glycine max
  Peptide Sequence Number=SeqID_212135
atgtacacttatgtactagggacctccagtaaacttttcgagtcgatccaacggttaacgaattggaacgaagagaatgttactgggcttggaggggttgatggggacccgatgctgagaggaacgaggataagggctacgtgggggtacgtgagcttagttgaaggtgggcaactggggatggtgggttcatgtttgatttgtgaatgtgggagagttgatttgcaccatcgcccaatcgccacctag

SEQ ID NO: 95358 - DNA, 1221 bp, Glycine max
  Peptide Sequence Number=SeqID_212136
atggataacgcgcgcaagcgcgagttctatcaattgctgttgcagtgtggttttaaagaaattgaagtggctttcccttcggcgtcgcaaacggatttcgattttgtgcgcacgctgattgacgagcagctgatcccggacgacgtcacgattcaggtgctgacgcagtcgcgcgacgatctgatcgaccgcaccttcgaggcgctgcagggggcgccacgggctatcgtgcatctgtacaacgccacggcgccgatgtttcgcgacatcgtgttccgccaggataaggccgccaccgtggcgctggcggtgaacggcgcgcggcgcattcgccggcagtgcgaggcacagcccgataccgcctggtgcttcgagtattcgccggaaaccttctgttttactgaattggagttcgcgctggagatctgcgaagcggtggcggcggtgtggcaaccggggccgcagcggccgatgatcatcaatctgccggcgacggtggaagtgagcacgcccaacgtgtatgccgatcagattgaatggttttgtcgccacttcagccgccgcgccgatgtaacgatcagcgtgcatccgcataacgatcgcggcaccggcgtggcctgcgcggagctggcgctgttggccggcgccgatcgggtcgaaggctgcctgttcggcaacggagagcgcaccggcaacgtcgatctggttacgctggcgttgaatctctatacccagggcgtggcaccgggcctggacttcagccgcctgaagcaggtggtggaggtggtggagctgtgcaatcagctgccggtgcaccctcgccatccttatgccggcgagttggtgtttaccgccttctccggttcgcatcaggatgcgattaaaaaaggcttcgccgcccagcgccaggatggctggtggcaggtgccttacctgccgctcgatcccgccgatgtcggctgcagctatgaggcggtgatccgggtcaacagccagtccggcaaaagcggagccgcctggctgttggaacaaaatcacgggctggcgttgccgcgcgcgcgcgaccgacggcagcggcaaggaaatgagcggcgcgcagctgtggcgcttattccgcgacacctatgggctggtggagcaaccgcgcttgcagctgctgagctaccagacggaaagccacggcgtagaggcctacagcttcaatgcgcgggttgcctgtga

SEQ ID NO: 95359 - DNA, 306 bp, Glycine max
  Peptide Sequence Number=SeqID_212137
atgactgacagaaagcgaaagtcgacatgtatagttaagaagtataaatcattcgtaaagagcaaacgtatcttctgggaacaatggactgacgctcagagtctagtttctggaataactgagataagaatggatgaattcattgaactgatgaaagaacataacttggaaacgtcggccatgactaattttgcacgttgttttcaaatcatcattgtcacgcgtgccttatggaataatatggaagttcggcccgaaatcgacaccttgacacccaaatgtgtaacaccccagataccaagatag

SEQ ID NO: 95360 - DNA, 600 bp, Glycine max
  Peptide Sequence Number=SeqID_212138
atggcagaaccatcgaaaaagcgcaaaggaacttcgagtcgtagtcagcggcattctgggtcacacgaagctccaattcctccctccattccctctgggtcattattctcatcagaggaacagcgtacacagtacacaaacctcttttcctctcgttccattgcagacccaaaattcatagatatggagttcttctctaatgagaattttgaatgcttccaagcatttgaaaactccaatcttattccattcatgtctctgaaattacctgtctattctgagttagttaaagctttttattcaaatttagaaattcatgaagatgttctaatgtctgaaatctatgggattaagatggtcattgaccaatccctattctatgatttaacaaaattgcctagtgaaggtgtgccttttgagggtgcactgattgatgaatggaaatttgatttctctatgcatgatgcccgccggttggtttgcaccaaccaagcggatatgaccggaagacttcttgccggttcattggcttttgaaagccgcatcctccattaccttatagttcgcattttgcttcctagatcttcaaaccttgcccaa

SEQ ID NO: 95361 - DNA, 429 bp, Glycine max
  Peptide Sequence Number=SeqID_212139
atggggtctattgatttaaatgaattgttctttgtgcaacaagaatttgatgctataacaaaacatttgaaagaggttgacatagctggcatgattactatcaaaaataaacttcgtgaaattacacttcctaatatgacttctatgtgtccacatgttgacaaggtcaaaactaaagatgatgacaaaggtgatgacaaaaagctcaaaggtcaatcaaagaatgagttcaagatattcaagatagaatcaagaacacttcaagattcaagaggaaagttgatttcaagaatcaagaatcaagattcaagagatcaagatttcaagaatcaagattcaagagatcaagattcaagactcaagattcaagaatcaagagaaggcttaatcaagataagtatgaaaaggtttttctcaaaaattgagtag

SEQ ID NO: 95362 - DNA, 168 bp, Glycine max
  Peptide Sequence Number=SeqID_212140
atgtctccacgaaatttcgttcggggccatctatatgcgatggaggcaacttctctccgtagaagaggcaaaggaagttgtgtcattcaagaatgtgatgttggaggtaatatctcttttgctccttatgtgactagtttatttctatatgaagttatgttgatgtga

SEQ ID NO: 95363 - DNA, 303 bp, Glycine max
  Peptide Sequence Number=SeqID_212141
atgacgataacacttaatgatgtggcattgttgcttgacattcccattattgaccctttttacaattgtgaacatatagataaggaagcaacaattctcgtgcttgttgagttacttggagttgaatataaggatgcctttgatgagacaaagaaaataagaggggaacaatgcaacctatgtggagggatgctacaagtattcatagaggcatctgccttgacatatctttatgagcatcttactagtgttagttttgctggcacaaaacagattggtggctatgccactttaggttattag

SEQ ID NO: 95364 - DNA, 468 bp, Glycine max
  Peptide Sequence Number=SeqID_212142
atgtctatgagaggaatcggaggaccccttttgtgcatcggagatctcctgaacgacgtcggagaagaagaacaacaacacggacaaggacactctctccttcgcgaaacctttccttcttcttccaatttcaactacaacgatccaccccctgacctcaccaaactcttccaggttccgtttcttttcattccccattcattcatttccttcgaatttgaacactacgaccacttgaattccgcactctctggcaccgaccactcctggacctctctcaccttgaagttatgcactgcactagaaacttcaaatcagctggttcaatctaccaacacaaatgttgcatccttgtcaaagaaggttgaggaccttcagaaaattgttaagagaggggattctgcgatagcagcagcgaaggcactttattatgttaccccagacaatcacagtagtgcctcaaagtga

SEQ ID NO: 95365 - DNA, 1896 bp, Glycine max
  Peptide Sequence Number=SeqID_212143
atggcggagtacaatactagatcgcaagatttcagaaaatttgaagattcaatcaaagaaacattgaaggagatgagccaaaatatcaagaaaattgtagatcatgttgatggacaagaaactcacatttcaactcttaatcatcaaaatacagtgtttatggagaggatgaaccaggaggcgcatcatggtggtagttcgcatggatcaggttcgttccatagagatcgcagttacatggctgctcgtcaattctttgaaattgatggaacacctgtggaaatgaagatgaagttggcatctatcaacttggaaggacgtgctttatcttggcatcagaattttgttagatttcaacctaaagctgagcaattaggtaaagtttctgactactattaccaatttgattactgggttggcagggttcaaatatttggagaaattgctttaggaatcttcttgaatggctttaagcctccaattcagcatcatcttaggagttttatgcctgcatctgttaatcaagcatatacattagcactcttgcaagaaacctctttgagaactttgcaacaagaatttagttcgaattgtaggagacctcctttattacctactcctagaacccaacacatgaattcatcttctacctggaaacctacacctaaaccatttgttgattccaagggcaaagttgttattgactttgatgatagaagatcgaaagggttatgcttttggtgtgatgaaaattatgtaaagggccacaagtgcaagaagaaagagttgtttgtgattgaggtcactgaattgaatgacgtggagggagatcaagagggttttgtggaagaaacagaagaaaaggaggaagatgaaggaaatccacaaatctcagtgtatgcaattaatggtgttgctacaaaaagttaccaaactatgagggtaactatgactgtgaacaaaaaaccactgcatattctcaacgactcaggtagcactcataatttcttggatgtgagggtagcaaagaagttaggttgcaaagtggaagagatgggtccaatgaaagtggatgtggcaaatgggggaaatctgaagtgtatggctatatgcaagggcctgacatggactttacagggcaccaagattcctttaaaggaaggagtgtctacaatcaatgtgaagccctatagatactctatagtgcagaaagatgtgattaagctgatgactaaagaattattggatgttgggttggtgcagcctaataacagcccattttcatctccaattgtactcgtgaagaagaaaaatggatcttggagaatgtgtatagattatagggatctaaacaaaagcactatcaaagacaaatatcctatacttgttatagaggagctacttgatgaactacatggtagtggatggttttccaagattgatctccgatctggatatcatcagattcgaatgtaccttacggatgttccaaaaacagcttttagaactcacaatggccattatgagttcttggttatgccatttggcctgaccaattcccctgccacatttcaaagcctcatgaatgacatgttcaagccattcttaaggaagttcattttggtgttctttgatgatatcttaatttatagcagaagtttgaaggaacatgtgcaacacctgaaatgcacatttgagctgttgaggaacaatcatttattagaaaagaagagcaaatgtgattttgcttgtcgttatgtggaattctgcattaaagcattgaaaattgctatggtcactccaccaactcttgctttgccagattttcaagaggaatttttcattgaaacagatgcttctaacaagggaattggagctgtatttgtaacaccctga

SEQ ID NO: 95366 - DNA, 264 bp, Glycine max
  Peptide Sequence Number=SeqID_212144
atggcttctacaagtacaaatgttactccaccatctccaaaaactgcaaggctcggggcggagatgattaaacttggtgagcaaatgagaagaatgagttatgaagatgaagaaaggatggagagtatgagaaaggagaatgaggagagtttgggaagaatacacaggagtagtgaagctttaagtgcgaggattgaaaatatagagcgaagaagagaggacatgatgagaattctaaaactgcctaaatacagggacatatga

SEQ ID NO: 95367 - DNA, 177 bp, Glycine max
  Peptide Sequence Number=SeqID_212145
atgggtatgaggatgaggcagatcggcgctttgcggttttggcgtgtgcgcggcgagaatcagcacgatgagcgcggacaacgccagcagcgcggcgacgaaatagagtccccaggtgtagctgccggtttgctggcggatcacgccaatcatcatcgggccgacaaaaccgccgag

SEQ ID NO: 95368 - DNA, 945 bp, Glycine max
  Peptide Sequence Number=SeqID_212146
atggatattgtctggcaactgcagcagcagtcggcgcgttttgatgcgcaggaatcaaagctggcgcgatttattctggataacctgcacgccagcgcgcaggccaccatggagagtctggcggcgcaggcgggtgtcagcccggctgtactccagcgctttgctgcctcggcgggctaccgcgatctggatgattttctgcaccaggtgcgccaggccggccagcaggaaagtgcgtttatgacggtgattcgtcagcggcaggcttccctcagccagcaggagcagcgggtggcgcgcgccatcctgcgtgacgccgcgttcgcggcctcggccaccattgaacagctggccagccgggcggaagtcagtgcggcgaccattacccgctttgcccgttcggtcggctgcgacgatattcgtgatctgcgtatgcggctggcacgcgccagcgccgagccagccagcgccagccacggtgcggtgccgcagctggtgagtctgcatcaggcgctgacccagcagtggcagcagctggatgacagccgctggcagcaggcggcgcaggcgctgcgtcaggcacgcagcgtgttgctgatcggtgccgccggccagcacacgccgctggtggcggaagtgcagcagcggctgagtgaggccgggctggcgctggcgtggatccaggacgacaacctgctgcgcctgacgctcagccgtttgcagccggacgatctgctgctgatcctcgcgccggacaccatcaacagcagcgtgctcagcgcggtgcatcacgctcacatccagcagaccccagtgatggcgctgtgcccggcggcgctggatctcgccagccaggccaactactggctgccgctgccggatgcagcaccggcgcggcgttatggcatcctgctggcgctggaccggctggcggcggcgctgtaa

SEQ ID NO: 95369 - DNA, 917 bp, Glycine max
  Peptide Sequence Number=SeqID_212147
atgctgctgctggtgcaggccggtgctgcgcgcagcgccgctctcagcgccctgcggctggcgcgcgccggccagtttgatgcggcacagcaacagctggcggcggcgcgggaaaacgtgagcagcgcgcatcagcagcagacggcgctgattagcctggacgaaggcagcggccggttgccggttaccctgattctggagaaaacgatgcttaagatagcaatcattggcggcggcagcagctattcgccggagctggtggagggaatcatcaaccgttatgcgcagctgccggtaaccgaactggcgctggtggatgtggcggcaggacgcgaaaaggtgcagatcatcgccgatctcacgcaccgtatgctgcaaaagaacgggctggagcaggttaaggtcagcgtgcatttcgcgctggatgaggcgattcgcggcgcgcgctttgtgctgacacagctgcgcgtcggccagctggcggcacgcgccgccgatgaacggctgggcctgaagtatggccgtctcggtcaggaaaccaccggcgtcggcggcttcgccaaagcgctgcgcaccattccggtgatgctggagattgcgcgcaaagtggaacagctggcacccgacgcgttcatcatcaactttaccaatccggcgggcatcgttaccgaagccgtggcgcgctacagcaacgcgaagatcatcggcctgtgtaacgtgccggtgaatatgcaccatatgatcgccggcatgttacaggcgccgtttgacgaggtggcgctgcgctttgccgggctgaatcatctggtgtgggtgcatcaggtgctgtgccgcggcgaggacgtgaccgccggggtgatcgaacagctgtgcgaaggccaggcgctgaccatgaataacatcaaagagatgccgtg

SEQ ID NO: 95370 - DNA, 1089 bp, Glycine max
  Peptide Sequence Number=SeqID_212148
atgcgtaactacaaaattgccgcgattccggcagacggtattggcccggaagtgatttcggctggcattgaggtgctgcaggcgctgacgcggcacgatgaacagctgacgtttgacgtgcagacctttgactggggctcggactactacaaacagcacggcgtgatgatgccggaagatggcctgcagacgctgaagcagtttgatgccatctactttggtgcggtgggcgcgccggacgtgccggatcacatcacgctgtgggggctgcgcctgccgatttgtcagggcttcgatcagtacgccaacgtgcggcccaccaaaattctgccgggcgtgacctcgccgctgcgcaaccgtggaccgggcgatcttgactgggtcatcgtgcgcgagaactcggaaggggaatactccggcaacggcggccgtgcgcatcgcggcctgccagaagaggtgggcactgaagtggcgattttcacccgcgtcggcgtgacgcgcatcatgcgctacgcctttaaactggcgcagtcgcgaccgcgcaaactgctgacggtggtgaccaaatccaatgctcagcggcacggcatggtgatgtgggatgaaattgcggcggaagtggcgcaggagtttccggatgtgcagtgggacaagatgctggtggatgccatgacgcaccgcatgacgctccacccgcaatcgctggacaccattgtcgccactaacctgcatgcggatattctctccgacctcgccggcgcgctggccggcagtctcggcgtcgcgccaaccgccaatatcgatccggagcggcgctttccgtcgatgttcgaaccgattcacggctcggcgtttgatatcaccggtaaaggcatcgctaacccgatcgccaccttctggaccgcggtacagatgctggagcatctgggcgagcgcaacgcggccgcgctgattatgcagggcattgagcacgtgtgcgcggcgggcattctgacgccggacgtcggcggcagcgccaccaccgctgacgtgacgcgcgcgctggtgcagtttattgaagccaaatctcaggttgcggcaaccgcctga

SEQ ID NO: 95371 - DNA, 345 bp, Glycine max
  Peptide Sequence Number=SeqID_212149
atgcttagcatacctctgggcgctcagtgccattccctctctattggaattgggcttagcgcatctctgggcgctcagcgcctttcccactctgttggaattgggcttagcgcgccattagcgcttaccgagaggctaaatgttgttattttcaaaatcccaacaggtgttacacaatgcatcactataagaggaaaactcaagatgaggcttcattgtcatcaagtgagtcggagacccatcatgaccacagatcgacctccactccttatggctcacatagacccgggtatagggcctagtatctcaatgtgtgtgcaaggtgtaggtgtcatgtgtttgtag

SEQ ID NO: 95372 - DNA, 876 bp, Glycine max
  Peptide Sequence Number=SeqID_212150
atggccagggctccaattttctgtaatagttctatcatggaaggcttatttttcatcttgcattacaaacataacacagcagagccattcaattttcactgggattctgtacctgaaggtctgccttgggttgacgttgaaaacctagacaaatccattaacatttcacctgaaaaccaatggagcagtacacctggtatattgcagaaagagatgccagcttcaaagtctgtttctagcaactcagaatcaaaggattgcctggatatagaggcaccactggccaaggtcttggactcatttgagcagtgcaacagagatgatggcatgtgtgagcagtcatcatcacttgaggaattcatactgaaggatcttgagatggtaattggacagttcaccgagaggacccgtatttgcttccgagatgctctgtaccgtcttgctagaaacactgaagaacaacatgtaatgctggaccagaatgaagatcttaacatacagaaggcaataccacatacagatcacaatgaaacaatgaggtctcaggacaagaaaccaatggaatcagcaaccaacaatattgacagaataattgcaaatctcatgttcaagagcatggagttcaacatacatcactctccaattacatcatcgacaaactccattcaacaagttattgaaagtaataatggtctacatggaaacagctcaaaagccatgaatatggaagaaaagttttgctattcccatccccaaaaattactagtagatgccgaaattccaaggtttggactaagtaatcaaccaagggacacaggttcaaacatcacatgtgaaggtcccataaagacatctttcatgatagggtttgattag

SEQ ID NO: 95373 - DNA, 2169 bp, Glycine max
  Peptide Sequence Number=SeqID_212151
atggcggatgcgactcgctctaaggtgccatcagatcgtctggaagatgcaattgtgaaactcacaacttctcaactcgccatgaattcaaaaattgacgatcttcttcatcgcatgtcgcaactagaagcgaaccagcaaccaccgcaaacactgccgtcttcgtcggcaggacagacgctgccgtcgtacagtctagtgcatcgtatgaagctcgacgtaccaagattcgacggttctaatccaactggttggaccttcaaaatcacacaattcttcgaatttcattctactccagatcaggaacgtttaacgatagcttccttttacatggaaggaccagtgcttgcgtggtttcaatggatgcatcgcaatgcgcaattatcgtcatggtcagccttcctccacactcttcactcgtgttttgctacgactacatatgaggaccctacagggttgctttgcaaactacaacaacgcttgtcggtaacgacgtatctgtctgagtttgaatcactggcaaatcggatagtaggcctaccagcgccatttgaattgagttgtttcatctccgggttgagcccatctattcgcagggaagtgcaggtattacattcgatctcgttagctcaggtagtttcgtatgcacgactacaggaagaaaagctcttcgacgctcaccggccttcgtcgtatcgcacaccagcacctacggcgggagctactaccacacgttctccatcaaccaacactacaccatctctgttaccaacaccagtacggacatcgacatcgattccctttaaacgattaacaccagaagaattggtcattcgccgggaaaagggactatggttccactgtgacgagaaattctctcgaggtcacaagtgtatgtcttccttggttttactggtcatggaggatgatgaatccgcgatagatgcagatcaactaagggctccttcaccaactccaaagttgttaccggaatctccgccagcgcaactgagcttgcatgcgttatccggccacctggcacctaaaacattacgcttgaaaggctttatcaataatcatcctatcagtattctgatagataagggtagtatacataatttcctccataatcgtgtggtattaaacttggggttggaaccaacagaaacaacactgcttcgcatcacgatggggaacaacaaggagatccactgccatcaattatgcacagtcattaaggtccacattcaacaacactccttcaccattgacttccacgtattacctctatgtggggccgatgtggtgctaggggtgcaatggcttaaaacccttgggccggttttaacggactatggcgcgttgacgatgaagttcattgctggtggcaaattaattgagttgcacagagatcgcgagaaagaagtagagcaagtgtcaccctctcagttacgtcgattcgtacacacaaaccctgctagtacttttttccacattcgtgttgaaccaacatccaatcatactcctcaaccaggtcattccttacttgaaatcactaccttaattgccaaatacgcttccttattccaacctctcgcgaaccttccaccatcacgaccgatagaccataccatcaacctcttaccaaattcagctccggtgaatgtcagaccttatagggctctcaattccataacggtgcatgatggtttccctattcccatggtggatgaattgttagacgaacttggaggtgcacagtggttctctaaactggatttgatgcagggatatcatcagatattgatgaacacaactgatatcagtaagacggcgtttcgtatgcaccaagggcactacaagtttcgggtgatgccctttgggttgtgcaatgctccatcttcctttcaagctatgatgaaccaattgttgcagccatacttaaggaaatatatcattgtcttttttgatgatattctaatatatagcaggaccattcacgatcatcttcttcatttggaaacagctttcaaggtcctgatggcgggccaattctctcttaagctctccaaatgcacattcacgcaacaaaaattagaatatctcgggcatgtggtctccggtaacaaagtcacgccagtgccaaacaaagtgcaggctatacagtag

SEQ ID NO: 95374 - DNA, 1128 bp, Glycine max
  Peptide Sequence Number=SeqID_212152
atgtggcagatggcaaggaaagcaaggacctatgtagacgaggatggaaaggctggaagagatgagaaaaagagtagaaagtctcacagacttccttcttcttctgaatctgtctatacttctcttgatttgtttccatattatacttttctcaaaacctttggatgtgcttctttccctttacgtagaccctacaacaatcacaaggtagactttagatctgctgaatgccttttcttgggttattctacctctcataaagggtataaatgtatgtcttcttcaggcagaatttatatctccaaggatgtcattttcaatgagtccaagtttccctatgctgacttgtttgagacttctacttctctcagtcagtccacttcctcctccattccttttcagtttccttccattcctatcattcagtctccaaatctttcacatcctacttctaattcccctcaaactcatacctccttgtttccggtcatctcaattctcctaatgttggacagtctgcatctgtttctgcacagtcctcttctaatcatcagccagttcagtctgacactgacatacctattccagcttctagttcagcatctagtccagttcagtcccctagtactgaacccacggatcagtctcttcctgctactgttactttttgttccagctatcagttcagaagcaacatcctcctctattaaccctacatctcctcacagaccactaaacacctaccctatgcaatccagatctaagtctggtattcatttacccagaatcaatcctacactaatgctagctcattgtgaaccaaaatctgtcaaacaagctttgacagatcctaattggctttcagccatgcagcaggagtatgaagctttaatgaaaaatcatacttgggatctagttcctctgcctccacacagaaaaccaattgtctgtaagtgggtgtttagagtgaaagaaaatgcagatggctcaatcaacaagtacaaagctaggcttgtggcaaaaggtttaaatcaagttgctggctttgacttttctgagactttctcccctggggtaaaacctgttaccgtcagacttatttcaacattggctatcactaatcagtga

SEQ ID NO: 95375 - DNA, 114 bp, Glycine max
  Peptide Sequence Number=SeqID_212153
atggcactgcgaagcaaagtgttccaacaagagagtcaaaccaacggaaaatgccaattagcgattgtcgttcaagcaaactgtgatttgaacggtcaagatagcgccatttaa

SEQ ID NO: 95376 - DNA, 471 bp, Glycine max
  Peptide Sequence Number=SeqID_212154
atggtaatattggggacaagacaaccaggaaatgacattgatgtttatctaagtcccttgattgaagacttgagaaagttatggggtgagagggttgacgtgtttgatgggagtcaaaatgaggcattcaagttgtgtgcaatggtattttgtaccattaatgactttctagcatatgggaatttgagtggatacagtgttaagggccatcatgcatgccctatctgtgaagaaaacataagctatgcacaactgaaacatagaacaaaagcagtatatactcggcatcaacgttttctgaaaccttatcactcttatcgacgattgaaaaaagattttaatggaagtcaagagcatgaaattgcaccgatacccttaactggtcaacaggttcttgagtgggttgaggacatcattactatatttggaaagacccaaaagaagctgacaattcaaacttgcatacggtag

SEQ ID NO: 95377 - DNA, 213 bp, Glycine max
  Peptide Sequence Number=SeqID_212155
atgaccataatttgtctctgcgtgccatcggacacgactgtgtctggatggcgaaaagatggtgaaaaggtgtgcggaatggccataatttgtctccgcatgtcatcgggctcgcctcctctggatgacaaaagggcacaaaatgaccataattttcctctgcgtgccatcggacacgactgtgtctggatggcgaaaaggtgtgccgaatga

SEQ ID NO: 95378 - DNA, 792 bp, Glycine max
  Peptide Sequence Number=SeqID_212156
atggttgagaagacaaagaaaagactaaaagaagctgccaagtctggaagcattgagggcatcattgaccttccatctcccatcagacgccacgtgaagtggaagatggctcgcacgaaaaaaactggacagatgacgtttgagactgcaaaggaaataactgacaggattgaaagcgtcacaaggattgttcgtcctccatggacatcaggatatcctgactgctgtcattgggcgaccagagcacctggttgtgttcgtgctgttggtgccggtgtcaccataaagcaatactttggatcggaacttgcactacctccaaagccagaggttggtctctcagatccttgtgtcagcacaaaggagagttgtgttgctccctcagggaacgatccagggacgggtgactcagacaaatgtgggctatacattgaagaaaatccttcccgcttggtttccctaggaagaatttatgagggatccacaacagttcacaacatccctttgttgcatggccaagtcaagattggtgttgaggaggttaaagttgcagaggctctcgttcctttacccactgacgaggttaccttagtggggcagatacttaacaccttccttgcttggccaacacatcttgtgaagcgtttatcagaacaaacaattgtgtcaccagcaaaacctccagaaatcccggatgaagaggtcgatgatcccctgtacctgatgacattgaccatcccacaactgtttttgaagcctctccaggttatgtgggatgctaccatatacggg

SEQ ID NO: 95379 - DNA, 288 bp, Glycine max
  Peptide Sequence Number=SeqID_212157
atgggtggaagtggagctttatttggagaaggccattgttttgacaatgaaattgatacgactggtgtttttctcaatgaggttcaggatatggccattcaacaacatggacctgatgtgtgggaatggactgctgaccctacagggatagtgaggatgatgcaattttcattctttggacctggcttaagaactttgagaaaggcttcacaaaacattttaatcactggtgcagtagtattagacaagcttttctgtactagtagaggatacaattttggctactag

SEQ ID NO: 95380 - DNA, 1098 bp, Glycine max
  Peptide Sequence Number=SeqID_212158
atgggttcagcatttggatggtacggtcctctcatagacctctccacaacctcttctcgcatcggcgatttcgttcagcttctcgtcttcgttcaccgttccttccccgttcagtgcaaatcgtggaaacgtggacgcgacctaacccgaaccgacattgaagtcggcgacgatacgatgccgttttttgtggtttctctttggcagaagcaaatggggtccatggtatcagccggagatgtcgtcttgttacagaatctcaagattgcgaagtatggaaacgccgttgaggccagaaccgttcagtggtcttcgctgctttgcttggttcacccttaccaatcacttctctcaaaggctgttgaagagttggtaacaggttgccgtgtggggacaacaacaaaggacaagcttaggagggtcataaaatgggtgcagcagtctcggtcaaccatttgcaacattaagttgcagtccaatcaaacacagaaaatagagcatctgcctagaaactggacggtgcttgaagaggaaaagcctagggactgcttttcacttatggaagtctctcagctaacaacatcctgcaaggctatagtatgtgcatcgattggtgaaattgttccactacatacctccaggactcttggtgataccaagaaagagaagctatatgtctgggacgaatcagattacatgccaattcttgttaagaacagggccgcagaaatcttgtttgggaacatcaaggctggaaaagtatattcagcttataaagagcaaatgaataaccaaaatcttggtccaagaaacgataaagatgccattggaagacttgctattgacccgagactttctggggaaggacttccgagtaccagtacattagaggtgggtaagagcttgcaattgcaggaaaaacatcttcctgataagttaaactattaccgtgtatggttaattcttctgaaaatgttgctgaaacaaggaaagaacggccctctgaaattagagatcattgttgatcccagcttagatattgaaaatggaaaatttgaactggtttctgcaacaatgccttgctttggaaccaaatga

SEQ ID NO: 95381 - DNA, 431 bp, Glycine max
  Peptide Sequence Number=SeqID_212159
ttgaaggtttgactgtggagtggcttgagacaacatccactttggtgcttagcatgtctactagtaagtgtgcatttaggaggggctgccctaacaagtggagggcatttgaagaagttgcattgcttacttgtccatataacctggattttaccatggataattctaaccagagtgaagtaatgaaagtggatgatagtataactgccatggacagggaggagcccatttcaagatcagacttatcggaaactgaaattgaccctgcatttttcccactcacagtgtgtcttctttcaacaattccagtagcacttcatgctgttggtgatccggtttgcaaccaaagatttttatgtgatgaatctgttgattctcttaatggaatgcactcggctccattgtggaaaatagtgtatagttcgacatag

SEQ ID NO: 95382 - DNA, 1378 bp, Glycine max
  Peptide Sequence Number=SeqID_212160
tgatccttcaactgccactgatctggatgatgcactgtcaattgaggagttgcctaatggaaattatagagtaggtgtccacattgctgatgtgtcatattttgttctccctgacacacccttggatagcgaggctcagtttaggtcaacaagtgtctatatgttgcaaagaaagttacctatgctgcctgcattattgtcagagaatattggttcacttagtcctggaggggatcgacttgcagtttccatgctcctggatataaatcttgcaggagatgttgtagaccgttggattggtcgtactgtcatacattcttgttgtaagctttcatatgaacatgctcaggacatcattgacaaggcttttgattttgagggttcaaatttcagtgaagatggctatcctagagtgtatggccattttgaatggcctgatgttattaagtctttgaagagtctttatgaaatttcaaatgtcttgaaacagaagaggtttactgatggggctctacggcttgaaaaccccaaagttgttatcttgtttgatgaaaatggagttccttacgatagtatgctttctgaaaggaaagaatcaaattttcttgttgaggaatatatgcttttggccaataggattgcagcggaagtcatatgtagagcttatcctgatggtgcattgttgaggaggcatcctgaacctaatatgcggaagctgagagagtttatggcattttgtcagaaacatggtttagaattgaacacatcttcatctggtcagttccattggtcattagagcagatcagggaaaagctcaagggtgatcctgtgctttacaatatacttatttcttttgctacaaggccaatgcaattggcatcttacttctgtagtggagatttaaaggacagtgaaaatgaatggggtcattatgctttggctgtcccattttacactcatttcacatcacctctgcgtcggtatccggatattattgttcaccggacactacttgctactatagaggctgaggaattatatatgaagcatcagaaggctttgcagggttacaaggaagtgaaagtgcaaaaaagatgtttcacagacattagttttgataaaattgctgcagaatccatggaaggtagggaagcactatcagccgcagctgtgaagcatagtgttccatgtgcagaaacacttgcagatattgctgcttattgcaatgagagaaagctagctagtagaaacgttaaggatgcctgtgataaactttacatatggtttctcctgaagaaaaaggaggttttattgtcagaagcaagaatactgggactaggcccaagattcatgtcaatttatattcaaaagctagct

SEQ ID NO: 95383 - DNA, 1539 bp, Glycine max
  Peptide Sequence Number=SeqID_212161
atgagagccactgttgaaggatccatgaccgagaggtttgacgacggtgaaaaggagaagaagaagaagcgccgatccaatcgtcgatccaagcaaaatcctccatcatcttcagcgtctgaagttaatgaggcccagggggtgtcaccagaatcagggaaaattggaacacctactcatgcttctccatcctttggcagttcattgaagcaggtcaatgtgtgttctcctaatgagcaaggattatccaaatcatcaaatgtcgcttttaattcgatgcctcccatgcatatcaatgagcaagtggaacctggtgatttgcgaattgtgccaatgtatgatggaggaattgattcaaaatcattttctgagcccactggttgcagagggtcatctgtaattaataaaaacaaggactcagtcccttgcggtcaaattgggctttctgggcagaaaaattattttagtccacactggtctgtagaggctgttgagaaggcattggagaagggtgatatttttaaagctctccttcatgtcaatgctcacaatagacttgaggcatactgcaaaattgatggaatgtcaacggatgttttcattggtgggattccagcccagaatagagctgtgcaaggtgatattgttgcagtcaagtttgatcccttgccattgtggacaaaaatgaaaggaccaaatgggtcttgtaacaacactgcaacactggaaggttgcaaccttcttacagaagataaagaagtgggtggtaatatttgtaatgggaaagctaaagtaggtgctgagtatgagtctgctcattgcagaagctatcctggtcaaaacaaggaggatgctgatcaaaactcctcatatagaagttatcctttgcctgaaaaaacaatggtttatgatgatattacctctcagggttctactaaccatttagatctgcatggaatggccagccatgacagcattaatggtcatcactgtgctgctcctgattccataaagaacaattcttgtagtgggcagagcaatgcattagaaaagatgtgtttgttggttaactctttcccgtctaaaagaccaactggcagggtggttgctattatggagagatctccacgtcgagagggtattgttggtcacattaatgtgaagcagtgggtttctttcagggacacaggcaaaaaggatttgaagaagaataagaatttgatttctgagcatgaatacatccaactgacaccaactgatccaaagtttccaaatatgatgcttcttgttagaaagttgccaaactgcattaagaaaaggatgaaaagtggtgatgtgacaatcgaaatggatctggtagctgcacaaattgatgactgggttgaagaaagtccttttcccgaggctcacattttgcgtgtttttggacgaggtggtgaagttcagacccaattagatgcaattttgtttcagaatgcaatctgtttgtctgagtttctacctgaagctctgtcctgtctgccatgtgttccttgggag

SEQ ID NO: 95384 - DNA, 231 bp, Glycine max
  Peptide Sequence Number=SeqID_212162
atgtgcccggtggtcggttttggcccgtggctaggtcttggcaagccgttggttgaaattttgccccccggtcaacttcgtggtttttgcccgttgttggcttggctagggtcggcggtgctgggttatggccccgatgctaagtttcggattggttggccccctcctcccccccgtgatcagttttgttgccaggattttgccaactttggcttgcgccccgttggctaa

SEQ ID NO: 95385 - DNA, 804 bp, Glycine max
  Peptide Sequence Number=SeqID_212163
atgtcctccacttcagaggactacatgtcctccacatcaaaggactacacgttctcccctttggaggactacatgtccttgccttacgagggctacacggcttcaccttttgaggactacacgccctcaccatcagaggattacacaggactgcacgttctcacctttaatcggctacaagccctcgccttcagaggactacacgtcctcaccttcaaagggctacacgtcctcgccttcagtgggctacaagctctcgccttcgtagggctacacgcccccaccttaaaaggactactcatcctcaccttcagaggactacacgtcctcaccttcagtggactgcacgccctcgccttaacaggactgcatgttctcacctacagaggactacacaacctcgcctttcgagggctagacgccctcgccttcagaggagtacacatcctccccttgagagggctacacgccctcaccttcgtagggttacatacccttaccttcaaaggagtacacatactcaacttcagaggactatacatcgtcgccatcagagggctacacatcctcgcctttagagggctacacgtcctccccttcagaggacaacatgacctcccctttagaggaatgcaagccctcgccttaacaggactgcatgttctcatatttagaggactacacaacctcgccttccgagggctagacgccctcgccatcagaggagtacacatcctccccctgagagggctacacgccctcgccttcgtagggttagacacccttaccttcaaaggagtacac

SEQ ID NO: 95386 - DNA, 501 bp, Glycine max
  Peptide Sequence Number=SeqID_212164
atgatgagcctgacgccacatcccctattctacattgatgctatcaagaccatgttgaagcataatgatgcgctccatgtggatcgcttctccgggttcctatgttgtcagcgtatgccaaatgtaccaggtgccaggattcatatcattgacttttgctttgtgtggacccaacctatgccaccttattatcatttcgtgatgcccgtacctatggttttcattctgttagagtcacattctttgtctgctaacgttgaaatgtgttcttttggattttactcctcacttaaggatattgttgctacttgtccttctctgatgtctccttgttcgatattgctagagacttgggtaccactcgggatggagatggtgaatcgtatgtcagaggatgagggagaggatctaaaggaggaaacgctgcacatggatgatctatctatggacaaaaagtaccccttgacggagtcagagatcatggaggaagattcctcatag

SEQ ID NO: 95387 - DNA, 570 bp, Glycine max
  Peptide Sequence Number=SeqID_212165
atgagtacttgggaagatctggatgacacttcgtctgatgaagattatgaagaagccaacatatgcctgatggtagatatagcttttgacgaatttgaattagatcaagaagatgggattttaaagaatcaagaatttaagggtcaacctcaagatgttgtcaaacttcatgaggaaattagaaccttaaaaactactttagccaaatttgttaatggaacagataatcttaacaaactgttaggatactatagaagttcctcagaaaaatctagaaatggatatgatgggaaggtatatgttcatgataaggacaccattgtttgttatttctgtgagatcaacctaagaagggtacaacctacctttatggctaacataaaaggactgaaaaagatttgggtatcaaagaaaaagattattcttgttgcaaatgtccttgattgtaggaagcggatgcctatcatggtacctagactatggctgctcaccacacatgacgagagaaagatgtatgttccaatgcctgactctgtttcatggtggaacaattacttttggaggaaataa

SEQ ID NO: 95388 - DNA, 270 bp, Glycine max
  Peptide Sequence Number=SeqID_212166
atgtatcagggattaggtaggggagtatatcacaacaaataccgtcccactatttctcaacctcaacaacttcaccatatgcgtccacgacaaccttcacgacacaaacgactccctaatcctgttgaacagcgcaacggaaacggacaccggggagtcaaagtggaagcaatcaacgtggacgaactggccgagctggaggcaatggaaaaggaggacctaggtggacaggttggagctggcaaggcgaggacgataccaatgtcctag

SEQ ID NO: 95389 - DNA, 423 bp, Glycine max
  Peptide Sequence Number=SeqID_212167
atggacaaaggagacaaaactcaaattgttgctcaactccaaggctcagaatgtgatgttgtgtgctttatcaaaagaggagtacaccaagttaaagaggaacaaactcaatctcctcactcgttcatgaacaagaacttcaacaagacgaaggacctaaaagcaaaaagtcttaggctcttagcagtcagaagaacaagaaggcatcatcatctagagaataagtctcgagaagtttgtccaaagctcttaaagttgaggattcatctaatgatggttctaaggaagactcctatggagaggggctctccttcatttcgcaaaagattcacaaaatatggagaagcaaaggtgactgcaagtggaaaaattcctcaagaagaatgcccaaagaaaagaaagataaagacaaaagcttcataa

SEQ ID NO: 95390 - DNA, 429 bp, Glycine max
  Peptide Sequence Number=SeqID_212168
atgtacgggagtaaagctagtcaacttgtgaaagaatttgcaagtggagaaaaaggtccatatttacatttcccaaacatttctaccattttcatacatctccccattctgaaggaaaggaaaggaaacctagcagccctgattatagtcagaacttattttggtctatcagaactcctgatattccagtttgttacatcaccatccttggatggtgaaaatgacttgattcgagaagtagttgcagagtgtactcaacatcaccttgattttcagtccttgataaggaagttccacattgcctgtctcaattcttgggatgtagcttatatatctgttgggcaatatcacaaaggatcaattggttttaagatgaaatctaacatgctatcagagcctatagtccgtcttggttctcgcctattctag

SEQ ID NO: 95391 - DNA, 156 bp, Glycine max
  Peptide Sequence Number=SeqID_212169
atgactaacatcgtctcctgcacctttcccggagatgtcagcgtctttcggccgagacagcgaaaaagtctcatttgctatctgtcagactccaagtccggtgatgtcagtgtcttccggccgagattgcaaaaatgtctcatttgctatccgtaa

SEQ ID NO: 95392 - DNA, 155 bp, Glycine max
  Peptide Sequence Number=SeqID_212170
atgctgcctacccctacaaaagaacggtgggcgagcaagcgaagccccaggaagagcgctatcctagtcaagaagagaagttctcgagatatctatggtgaaccgatgttgcttagggcgggtgaccatcttatgattgaagataagcaccgaaa

SEQ ID NO: 95393 - DNA, 249 bp, Glycine max
  Peptide Sequence Number=SeqID_212171
atgaccaggccttgcttaaagggaatagaagagaagactgccaagttgaaaggaagtgagaaggctctagttgcacggcatgaagctagtcatgctgtagtaggtactgcagtagcaaaccttcttgctggacagccacatgttgaggtgtggactttggaatatcttattttagaatttattgatcttgttttatggtgggaaattaaagaaaagtataaatctgttatgtgtgatattcaacgataa

SEQ ID NO: 95394 - DNA, 405 bp, Glycine max
  Peptide Sequence Number=SeqID_212172
atgaggttaaagcttcggaagaaagtgataagccttggaacgagaaaccaagaaggcccgaaagaaagaacacgtgccagcaaaggttttgaggggctttatagggcagcaatagtaagctcaagctccgaagaggtgaaagggaatcatccacgggtcaaaggcatgatcttgaaggacgagctaaaggcttcccttaggtcgaaaagaagtttgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggactga

SEQ ID NO: 95395 - DNA, 246 bp, Glycine max
  Peptide Sequence Number=SeqID_212173
atggcacatccctccaaaccatcttcacatctgctggctttaatgcttgcaagttttaaatcaagcttaaaaactttggtaatgacagggagttgtgcctgttcttatgtccctttattgacagtttttatgtttgagggacagatctcaggaaaaaacattgaaattggcataatcggtgctgataaaaatttcagggtattgacaccagccgaaattgatgattatttggctgaagtagaataa

SEQ ID NO: 95396 - DNA, 1692 bp, Glycine max
  Peptide Sequence Number=SeqID_212174
atggccaattatgatggtgctgcttttggtgttaatataattgaaaacagtaatctggccaatggcaccaatggatggtttcctctgggtaattgtactttgagcgttggaactggttcaccgcgtataattccaccaatagcaagagactctcttgggcctcatgaatccttaagtggacgccacatccttgtaaccaatcgtacacaaacatggatgggtcctgctcagatgatcactgagaaattgaaactttttttaacttatcaagtatctgcttgggtccgaattggttctagatcaacagggcctcagaatgtgaatgttgccctcagtgttgataaccagtgggtcaatggaggacaagttgaggttgctgatgacaggtggcatgaaattggtgggtcttttagaattgaaaagcaaccatctaaggttatggtttatattcaaggtcctgcttctggtttagacttgatggttgctggacttcagatttttgctgttgatagacatgcaaggtttaaatatttaaggagacagacagacaagtatttctcacttgctcctatgcagatccgtaagcgggaaatcatcctgaaattctctgggctggactcaattggaaatcttggaaccttggtgagagtcaaacaagtacaaaacgatttccccattggatcgtgcattagtagaagcaacattgacaacgaagattttgttgacttctttgtgaaacattttaactgggctgttttcgggaatgagttgaagtggtattggactgagccacaacaagggaatctgaattacaaggatgccgatgaaatgttagacttatgtcagaagaacaagatagacacccggggtcattgcatcttctgggatgtggacggcaccgttcagcaatggatcaaatcactgaataaaaatgatttgatgacagctgtccaaaaccgcttaaatggcttattaactcgctacataggcaagttcaagcactatgatgttaacaatgaaatgttgcatggtacgttttatcaagatagactaggtaaggatataagggcaaacatgttcaagattgcacaccaattagatccatctgctaccctttttgtgaatgattatcatgttgaagatggatgtgacactagatcatcaccagaaaagtacattcaacatgttcttgatttgcaagagcaaggtgccccagttggaggaataggaattcaaggtcacatagatagtcctgtggggcctattgtttgttctgcccttgataaaatgggaactcttggcataccaatatggttcactgagcttgatgtgtcttccactaatgaatatgtgagagctgatgatcttgaagttatgctgcgggaagctttggcacaccctgctatagatggtgttatgctatggggattttgggagttgtttatgagcagggaaaattcgcacttagtgaatgcagaaggggaactcaacgaagctgggaaaagataccttgctctcaaacaagagtggttgtctcatagccatggttatgttgatgagcaagggcaattcagcttcagaggcttcagtggaacatacaacgttgaagttgtgaccttagcaaagaaagttaccaagaccttcgttgttgacaagggtgactcatcactggtggtatcaatcgatttataa

SEQ ID NO: 95397 - DNA, 294 bp, Glycine max
  Peptide Sequence Number=SeqID_212175
atggcactccagaacttcgttgatttttctacaaactctgcgaatccatactatctgcatccgaatgagaatccagctctagttcttgtttctccttctttaacggccaagaactaccacacttggtcccattcgatgcacatcgcgttaatttcgaagaacaaagacaagttcatcgatggatctcttcccaaacctcccgtttccgatccgttatatgcaccgtggatccgctgcaacactatggttctcgcttggattcaccgatcaatttctgattccatcgcaaaatcg

SEQ ID NO: 95398 - DNA, 313 bp, Glycine max
  Peptide Sequence Number=SeqID_212176
tgaccgtgaggctttggttaatgatccttccttgatatctgccattcctactagcttatttcagttgagcagtcgtgctaagcggaacctatgggctcagctcgcatctatcactaacctcaactacaacatgcttagcgtgatgagagaatctggaagagcacaagaatcgaggccatgcgcaaagcaagacattcgtctcttaccaggctcaacgcacaactggcaccaagcccaaatccacttactcgcgctaagcgcgatggtggcgctaagcgtgatatcgcgatttcagagaccatttaaagcctga

SEQ ID NO: 95399 - DNA, 354 bp, Glycine max
  Peptide Sequence Number=SeqID_212177
atgaatagcacaagttttcaaggtttagaaaaccagaaaactttagaaaggttttggtacaaagaagaagaagaagaacttcaaagagatttcaaggcttgtaaaggattgattggaaaagcaaaagctttcttcttgagtcttgaattcttcttgattcttgaacttgaaaggttttggtacaaagaagaagaagaagaacttcaaagagatttcaaggcttgtaaaggattgattggaaaagcaaaagtattcaagattgttgttagaaagattgatttagaatacaaaacaaagccttgcttttatagactcttcatgtctggtcaagaaggccattcagaagagttataa

SEQ ID NO: 95400 - DNA, 465 bp, Glycine max
  Peptide Sequence Number=SeqID_212178
atggctgataaagtgacactgtcacatttggaaactagtagatgtttgtttcctgaattttctggacaagactctggatcatttgaggccttgaggcttgatgaggagcctgcagcagtgcctaaggaggaaaaaggtcgtggttctccaccaacatggcatgttactggaactgaactagattccttatacatgagaggcaggcttacactagagaaggtgaatgcagcaatcaatgatatggtgtcttatgctgaagcaaatgctctacttatagttgtccccaaaaagaagttggcggaaaatctttgggaaaaagccctggaaataagagatattgcatccatggaagggattaagggaaaacactctttccttgaagctgacataaagggaccatcacttaaacttgacaacactggaaaagcaatactgattgtgagtattcttgtctcaaacatgtga

SEQ ID NO: 95401 - DNA, 420 bp, Glycine max
  Peptide Sequence Number=SeqID_212179
atggctacaggaaaacaaacagttccaggtgcaggggctttaaatccatcaaaaggtgatagatgtgggggctttgggtactatcaattggacacaaatgtgggggctttaggtaccatcaacagggtgaattcctgggaactgtggatgatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 95402 - DNA, 212 bp, Glycine max
  Peptide Sequence Number=SeqID_212180
atgacattagaagaggggaaggtgaagatcgagaagttcgatgacaaagatttcagctttttgaagatgcaaatagagaattatctatatcaaaagaagttgtatcaacccttatcaggggttaagccatatgacatgaagcaagaagaatggaacttcctagatcaacagactattggcgtgatcagattgacattagccaagaacgtcac

SEQ ID NO: 95403 - DNA, 654 bp, Glycine max
  Peptide Sequence Number=SeqID_212181
atggaggaatacaccaataatcacctgagccaaaacacaagtccaagggcaaatttgttgtattctttggctggtggttcaagcgtaggaaaccgccaccaccaactaattccatttaacacctttcatcttcaaacgggtagatcggatcactgttttcaaccggatcaagcaccacaccctagtgtgaaaaccgagtccaacaattcccatcttcactatcctctaatgagatcaaatcttcaccacatgctgcatcctcagcaaggagggagccagagctctaacgaacttgaagccataaaagccaaaatcattgaccatcctcactactcaaatcttttacaagtttacatggattgccaaaaggtaggagctccgccagaagtggcggcgcgttttgctacggttaaagagaattttgaggcacggcagcgatctttggttaggtcaatggaaacttgcaaggacccagaacttgatcaattcatggaagcttactatgacatgctagtgaagtatcgagaggaattaacgaggcctatagaagaggctaaggatttcatgcagaggatagaatctcagctgaacacgctttgcaatggaaccgtgcggatcttctctggtattttatctttctatttgtgggagtag

SEQ ID NO: 95404 - DNA, 367 bp, Glycine max
  Peptide Sequence Number=SeqID_212182
caagtggcttttgagttcacggtcttccgcttggggatcaatctcgatcaattctgtttctcgaccactgttgtctttatcctcttccgatgatgaaccaatgttttcccacttatcatctgctcaacaacacatgtctaggatcaaattcgaagtaggaaagttcgatggaactggagattttggattgtggtggcatagagatgagttgcaagagaggattgtggcaaccatatgcttgtgtttggcagacgagatcctctgtcacgtgatggatggagttgacatctgtagaatgcctatgaaagaaattagagctaacgaaatatctgaaacagaaactgcatggagctcaagtagcagctag

SEQ ID NO: 95405 - DNA, 756 bp, Glycine max
  Peptide Sequence Number=SeqID_212183
atggtagctgtcttggcagatttatttgacacatttgaccgaaggtgcgagaagagtagcacacggatcatctgttgcttgcccgctctctgtgtttggttggtttcgcacctgttcctgcaagacactaggcatccatgtctgctccaaagccatcgctcgtgtgctgaaaagagaagaatagattgggaccaacttttggctagtgtaggaggtagaacaatcaattggttcccccgatggaaggaaggaaaggagggagtccttttctcatgtaaagggtacccaaacattccgctaataggaacgaggggttgtattaactacaatcctgcgctcgccataagacaactagggtaccccatgaggggagcaccgatggaagaaagcatgtctcctttccttgtaagggatttcggcgcacaaaatttcaaggctatacaaagaatccataaagcatgggaaaccccgttaaggaaagatcaagaacttaggggcattcgtaacggcatcattggtggttatcatgaatggctgaaagttcatatacgaggtttagattggctcgccaagttaaaagtcgtcagcgaagacagtttcgaagcaccggaagaagacgaagaagtccaagctctcaaaaacgagttaggaaaggcgaaacttgccaaggagaagttcaagttagccgctacacacatctggaaaggagtgtgccggattacgggaaaagaatgcaactaccgcaaaagcccttga

SEQ ID NO: 95406 - DNA, 363 bp, Glycine max
  Peptide Sequence Number=SeqID_212184
atggtgttgacagtatatatgatattatatattattgttcttgtattaatgacaaaactgaaacaaaccgaagtggagcgtgagttactgaaaaagtgctgtgaaactctaactgaggagaacaagatgctggaaaaagagttgcaagagctcaaatcgacgaaaacatcgatgggacccttttatatgcagcttccagtggaaagccttagaatatgcccttcgtgtgagagaataagcggtggcaacaatggctcctctcccacaacggctttgcttgaagccccaaaggcccataaagatcagcccttctataaaaataactacacattcacccaatcatccgcagcttttgctagctag

SEQ ID NO: 95407 - DNA, 165 bp, Glycine max
  Peptide Sequence Number=SeqID_212185
atggcggaaattagcagagaacccgagaatttcggaacaaaagaggatgatgttgggaggggaccaaggagagggaacaaattcgaggagagaaaaaagcacacacacgtcattctgggttgttcccttttgggtccatgggggactgtgaaaagcaccaaataa

SEQ ID NO: 95408 - DNA, 1062 bp, Glycine max
  Peptide Sequence Number=SeqID_212186
atgaagagagggaaggatgatgagaaggtgatggggccaatgttccctagactacatgtcaatgatacagagaagggaggcccaagagcaccacctaggaataagatggccctctacgagcagtttagtattccttctcaaaggttcaattcaggtgttctgccactcaacccaaatatttcaagtaatacagttccccctgcatcctcaagtctgaggactgtccctgagagaaattgtgtctaccctgttcatttgccaccacaaagacctattcatcgagctgaaaaatgtaactcacgccaatcagaagggacaaatttgagtgcttctcttgaacagagaaagaaggtagatgaagacgactttagggttcctgtatactttcactccaggactggtcaatgtaatgataagagtgttgagagtttcaatgggaaaaaactcactcctacaggctctaggtattttggtggttccatatcagggcaaagtgattgtgaaagagatccaaagcagtttggctcctcagttgtcaatatgagaaaagatgtcagaagtgagattgatgtgcttccacaagtaagtacaagtaaggagcaggcatcaatgtctgtcagaagcatatcgactagagaaaatatccacaccttactaaggcaagccaaggtgactccgaatcgggagtttcaagattgtcatgtatcaaagtttaacagattacaacaaggtgagacttgcttacagctggagtgtggagtggagtcccgatccaatgacattggagataatggttgtcttgttgaatctgcaagggagacagacaagggaaatgcccctacagcaaaccaaactagtccagctgatgcaatcaatgacactgaacatcatgataccaggatgggcagtccgatacagaggggaaacttaaatgaaagtgacaatgcttccaagatctccatggtagaaaatttgtcgacagtgagaatttcgccagatgatgttgttggaataataggtcaaaaacatttctggaaagcaagaagagcaattgccaagtaa

SEQ ID NO: 95409 - DNA, 378 bp, Glycine max
  Peptide Sequence Number=SeqID_212187
gccgtttccgcaatacagtatcggttttttgacgcgaacttatatcacggtaagacctgtgatttggtcattacgcaacccttaggtcagccaccgacaaacgtcattgcacaggccggagatgctgatctgtgcgccgtcgctatcgatgcggtaaagcaggcgatagatgccaacacctttcccatgcggcctgcgtatctgaaagaaaagataccggcagaggcaaaagggtgcctgaaaggcgccgtcgctggcggcgtggcaggtcatctggttcatcatggcattgccggagcggcagctggctgcgcggtgggccaccacatggccgccaaaaaacaaaaagaggcggaacaaaagcaacagcaacagtaa

SEQ ID NO: 95410 - DNA, 348 bp, Glycine max
  Peptide Sequence Number=SeqID_212188
tggttgagagcccacgtgcaaggtttggattggctcctaagtttgagaaccgctaaaagggaggaagttgaggcaccagaggaagatgaagaggtgcaggcccttagggcagagctcgagcaagcccaaacaatcaaagaaaggctcaaatcagcagctctgaatatccgaaaggagaatgccgaactgagagatacaaatatagctaccaccaaggccttggaacgagagaccaagagggctcgtaacaagttccgaggggctctatggggcagtaacagcgagcttaagctccagagagagggaaagggaccaatcgcgagtagacagtttgatcttgaaggatga

SEQ ID NO: 95411 - DNA, 279 bp, Glycine max
  Peptide Sequence Number=SeqID_212189
atggaaagcaagaaagaggacaggagatcttcggaccaaataaattttcggcgaggaaatcatgtgcaaaataaagtcatggtgcagttatggtttgggattagggtgaaaaaacccggtggaccattcggtcctgccaacaaatcttattcggagccccatgaattgattgtcattcatgcatcctccaccatcgagtctagagccccaggaattgattgcctagcgctgttcgtctatcctccaccctcaaatcttattcggagacccatgaattga

SEQ ID NO: 95412 - DNA, 375 bp, Glycine max
  Peptide Sequence Number=SeqID_212190
acttatcaaggtaatccttgtggcgtctacccagacttatcttccttcaccggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaaataacgagagtgatgagcaaaatgacggcgacaacgacgaagtctatttcgttgaagcctttgggaagagatggcaccgtcaggcgccatttggtggaggagattctaattgtggtgcctaggtacgccgtcaagcatatggtgacggtggcattggaaagcacggaccaaaggtga

SEQ ID NO: 95413 - DNA, 112 bp, Glycine max
  Peptide Sequence Number=SeqID_212191
atggtgacaatgatggctatgacttcgccggagatatgtttggatgtgacggtcgtgtcatcaagagaagaagggggtttctgcccaaagcggtcaagagaagcagctctga

SEQ ID NO: 95414 - DNA, 153 bp, Glycine max
  Peptide Sequence Number=SeqID_212192
atggggaaaactaaggttgcaatcttgttgctttgggtcttgcttgccttgtgtatcagattgcagttaactgttgaagcaagagcatcatcacctttagaaagacaaatcgaagccaaattgaagcaacccactaagattttaccttactaa

SEQ ID NO: 95415 - DNA, 183 bp, Glycine max
  Peptide Sequence Number=SeqID_212193
atggcttcctctcaagtcgtaatcatgacagcaatggcggtccttctcgccgtcgtctccgccgctcacgccgccgatgcgccggcacctagcccctcctctcccgcctccgtcatctctccgtccttcgccgtcggttttctcaccgccgctgttgctctcgtcttcgagatcgaggcttga

SEQ ID NO: 95416 - DNA, 264 bp, Glycine max
  Peptide Sequence Number=SeqID_212194
atgcctgttgtagtggatggccctgatgatggaatagtctttactctttacagagacttatcaacaaaagactacaaattattactaaccgacaaattgagtctcattaccagagaagaaactcgtgttttgcttgttagtcctggcgcatggttgtgcgatcttaccttggaacgatacgaggttagggagaagaagatatccaaaaagcagagaccaagaggtttgaaagcaatgggaaacatggactcagactctgaatag

SEQ ID NO: 95417 - DNA, 450 bp, Glycine max
  Peptide Sequence Number=SeqID_212195
atgtctagtgttagagagaaaaacggaggggatgggtcgttgttgttgagggcgagttccgatagcgctaggcaagcaacgacgtcgaatttggtgttgcagtgggggaatcggaagcggctgaggtgcatgaaggtgcaggttaaggacgattcttccggtccggttcagaggacaacggttcgggtggatcgccgggtcgttagaaccgacaaggattctttaaataaggccacgttcggtgtcaattataataatcatcatcatcagagtaacgggtatccgaatctccgtgaacgtccatcttcgccgcaaccacgaatcctcagcaaaagaaaagatagtgttttcttctttgctcttatcagcgatgatataaaattcgctgttgttattaattccaagcaagcagcacatggggtttgtgtcaaatatctgataaagagttga

SEQ ID NO: 95418 - DNA, 818 bp, Glycine max
  Peptide Sequence Number=SeqID_212196
atggaccgttttccgatcctctttctcctcgccaccctcatcaccctcgcctccggtgcccgccacgatattctccggttaccctccgaagcatccacttttttcaaagcacccggtggcgatcaaaacgatgagggcacgaggtgggccgttttaattgccggttccaatggctactggaattacaggcaccagatgactgatgagcctttgtcatttcatcagtctgatgtttgccatgcgtatcaactactgaggaaaggtggtctcaaagaagaaaatattgttgtatttatgtatgatgacattgctttcaacgaagagaacccgcgacctggagtcattattaacagtccacatggaaatgatgtttacaagggagtccctaaggattacattggtgaagatgtaactgttggcaacttttttgctgctatacttggaaataagtcagctcttactggtggcagtgggaaggttgtggatagtggtcccaatgatcatatatttatatattactctgatcatggcggtcctggagtgctagggatgcctactaatccatacatgtatgcatctgatctgattgaagtcttgaagaagaagcatgcttctggaagttataaaagcctagcatgtgaatctgggagtatctttgaaggtcttcttcctgaaggtctgaatatctatgcaacaacagcttcaaatgcagaagaaagcagttggggaacatattgtcctggggagtatcctagtcctccctctgaatatgaaacctgcctgggtgacctgtacagtgttgcttggatggaagacag

SEQ ID NO: 95419 - DNA, 498 bp, Glycine max
  Peptide Sequence Number=SeqID_212197
atgggaggttgtggtcctttggcttcgcaagcagagtctccatccaaccttcactcccactgtaagaaaattgtcttcatcaagagtgttctcttaacaacaaacaagggatgcgtttccactgaagaagaaagcatcataataaacccccagtttgatgatggcctgaataattggtctggaagaggctgcaagattgcattacatgattctatgggagaagggaaaattcttccaaagactggtaaagtctttgcatctgcaacagaacgtacgcaaagctggaacggtattcagcaggagatcaccggaagagtgcagcgcaagcttgcctacgaggttactgctgtagttcggatatttgggaacaatattacaacttctgatgtaagggctactttgtatgttcaagcaccagattgtcgggagcagtatataggcattgccaagttagtgtcaatgagcctatctcatttccttattactgcttttcattaa

SEQ ID NO: 95420 - DNA, 417 bp, Glycine max
  Peptide Sequence Number=SeqID_212198
atggaggacggggataacattctggatgccatatacgaggaggacaacttagatgatgatgttgacatggttgatgttgaagaaggagagttggtggagcctgatgcccaaaatgttttgggacaaagcagtgccggagatatcaatgaagcaaatcaagaacctctcagtaagaaccaaaaacgtagagctaataagaagaagaataagaagaagaggaagggttcaggatctaatgccatggacataaacagatttgtgttagatacgtgtcgacggctcaaagagaaaaagtcatacatggtatacactgctgtgggttgccttggtgtctctgcattaagcgatctcgtcaatgagtgtttaataactggtatgataattactgtctacccagaggatctaccaacccaatga

SEQ ID NO: 95421 - DNA, 303 bp, Glycine max
  Peptide Sequence Number=SeqID_212199
atgaagtggtttggccaggaacatcgaagctcaagcagagggttggaaggagcaaacaagcatcttgaagaaaaatctgcaaggttagggacaaaattgcacacatcagagaatatggatagccgtatggtgcttgagagagtggataaccagctcaagggtcacccaaatcttaaccgcaaagcacgttccaatgggaaatcaacagagaaggccattaagccagtgactgaagccaagattgggagtattcagaaagtagccataggaccatgtaaacccaacaacatttgtaagaattaa

SEQ ID NO: 95422 - DNA, 1167 bp, Glycine max
  Peptide Sequence Number=SeqID_212200
gtgcgttatgagaaaatccctgtccgttaccttccgtgtgcctgctgaattaagcgaggcttttattggcgctgtgaatgctgctgatggagataaaaccgcctggctggtcgatgccatccggcagaaactgagcctgccagagagtaatccggacgctcgcatgatggctctggtagagcgaatggagttggctgccgcagctctgattggcgggaagcaaggcatcccacctttgccatacaatgaggaagcagtgatccgcattgcttcggaaaccatccgtcagggttttgataatggtcgtatcattgcagaacgccttaatgaagccggatatcagactaaagcgggaaaagcttgggataaagatatctatagtgcatggaaacgtcaggcagaccataaagcgaaaggagcttgctcacaccatggcggcgtaggaagcggaggagggatatcgcttattagtgccttggctctggctggctatagcttttacagattagacaaagcggaagcccatgaaaaatgcatgatctatgaatcatcgaagcaaaatgtatggtttgagttttctctaacatctgcaccctttaatccacaagaacactattcaattaagggaaacgccctctcatatacttacctttccagtatcaactctaagcccgaatgcttaactgtggccatcagcgatgcagaatctaccaaaatcgagaaattggcacgtacattagcatcgcatagcaatgctccgaatatgccggtcctcgatggtctggacgtttcgttaactattaatatcggtgatacggcaacttttcatgcacagcaggcggtgacgctctttggccagcagggcttgcgctacgtcggtgcggatagtttctcacccttcctttttacagtgaacgctcaggcattctttatgcgaaatgctgctggtggcatcgaattcttcacgtacaccactgatcatctgtcaggttctgataaaaatgagccagcctcagttgtcatggctaacccagcatcggtttattgtcaaaaggttggtggggcgttagaaatagtcaaaaacgaaactggcgagagcgcgatcattgtggctggtattgccctcttaatttggttcatagctagcggagcctacgctcctggcgg

SEQ ID NO: 95423 - DNA, 483 bp, Glycine max
  Peptide Sequence Number=SeqID_212201
atgagaggacaacacgtccttgccttcagagggctacacgtcctcacctttagaggactacacgtcctcacctccaaagggctagcgccctcaccttcagaggactacatgccctcaccttcagagaactacacatcctcacctttagaggactacacaacctcgccttcacagagctacacaccgtcaccttcagaggactacacgtcttcacctccagagggctacaggccctcaccttcagaggactacacgtcctcgccttcagagggctacacgtcattgccttcagagggctacacgccctcaccttcagaggactacacgtcctcgccttcagagggttacacgtccttgccttcagagggctacacgccctcatcttcagaggacgacacgtgctcgccttcaaaggactacagggcttaccttcagagggctacatgccctcaccttaaaaggactacaggtcctcgcctttag

SEQ ID NO: 95424 - DNA, 255 bp, Glycine max
  Peptide Sequence Number=SeqID_212202
atggggggggggggggtgcaaatagcaattttgaaatttggccatccagagtattttcgaagctggattgcttctccaggaagcaacccagctcgcctgggcgagctgggcgacaacctcctccccctctttcctataaataggctgaagggggttgttctaagggtcccggatccccctggtgatgtatttcagctgttttgggtgaaaaaaattgtttccgtgaagaaaatccaagccgaggtgcttccgtaa

SEQ ID NO: 95425 - DNA, 279 bp, Glycine max
  Peptide Sequence Number=SeqID_212203
atggagcaactcaggattgttgtgccaaatccaattgatactgaggacccggacgttgactttgagtggctagtaaatcaagccgaggaggaagaaaatgaggattggggacttcccccgaatttgaggagaatggtggaacaagaagaaagggagatgaagccgcatcaagaggagacagaggttgtgaatttgggcaccggtgaagagaaaaaggaggtcaagattggcacttgtgtgtccgcgaacgaccgagataagttagtggctctattgtga

SEQ ID NO: 95426 - DNA, 252 bp, Glycine max
  Peptide Sequence Number=SeqID_212204
atggaagggaaaagcaagttctttggattaaacaagtatctaaaccatgtatggagttgttgtaaaaaccatgatggggggtttaaggggttggaaggttcagcacttgagagaattgagagggaagaagaagaaaaagagaaagaagaagaagaaagaagaggaaacgaagctgaggcgctaccgaatcgtgagcgtgatcattccctacgtcgtttcttgttctgtgttcttcgtgcgatagtcggttag

SEQ ID NO: 95427 - DNA, 270 bp, Glycine max
  Peptide Sequence Number=SeqID_212205
atgtgggacaaaggaactaagaccacaaactctaacaaaggattgacacgagatgctaccctttacattgcatgggcaatcccattctctttggtgtacgggatggaagctgaggcacgctttgaccaattaaatcttattgagggaaaaaaattggctgccatgagccatgggcgactataccagagcagagtgaaaaatgcttttgacaaaagagtgtgctcgtgtaagttcagtgagagggaccttgttctgaagaaagtatcgtag

SEQ ID NO: 95428 - DNA, 570 bp, Glycine max
  Peptide Sequence Number=SeqID_212206
atggcggacatgtactcggcccccgaggaagttcatgggctcctcgattattgtgcaagaacaaatgaaggtcgatatggaggcagatcctacccatccctctgccataaaccaagcaaaccaacccaccccgaacatggtgggataaggaggggaggtgttgggcagtaccggtggtccacacatgggcaaccccaacctgtaggaggcgcccatgaagaacctctgaagcgtgctcaaggggacttcgacccatgtcccactttcaccgccgagggatcgacatgcaatgctatgcctcaacccaataccgtgggggttcctcaaccccgccctttgcaaccgctgtatttctcaataggggggtcgcctctggtagaggaagggagagagaaacttgatctcattgtagagagattaagggctatcgaagggtttagggattaccctttcaccgacatgataaaattgtgtttggtacctaatgttgtcatccctccaaagttcaagggacaacaatctgctgatgcatttcttccaagaaagcttggccggggcggcagtcatctg

SEQ ID NO: 95429 - DNA, 273 bp, Glycine max
  Peptide Sequence Number=SeqID_212207
atggtggctgacttgttggctgttgggggtgacttttggttgccacaatttcaggttagtgggtcattactaaaatctgatgtaaaacttctatataagctaaaccattttatcaataaacacaagttgagttttaatcagaaaattagagtttatctcttttatcttagtgagagtgattctcctaaattctggggggggattcaagaacaccctggctatatcaaaggactttcacaacctttgtgtgttgccctcgccgaaaaagagtga

SEQ ID NO: 95430 - DNA, 405 bp, Glycine max
  Peptide Sequence Number=SeqID_212208
atgaagagagctgttgaagaagaacccgccgtcgagaataaggcgccgttgaagatggcttgcaaaaccatcaacgaggaagaagaaccacgtcgatgcagaacagaatcactttgcagctttgttttcagttgtcacccgtattggagtcgtattgaagccgtgtctagccttaggaagccatatctaagccgtatcccagcctatcggtatcggatacgggtgcgacaccgacacttttccatttttcacgtattcgggcttcacagacggttaggttgggtgaaggtgaaggtgcattctggtgtttggtgttgcggtgatcgtcagtggcatacggcatatgagatcaagttgcctgttacggatcaagttgattcgcaagacttttgcggatcaacttga

SEQ ID NO: 95431 - DNA, 414 bp, Glycine max
  Peptide Sequence Number=SeqID_212209
atgtcttggtccaaaaggataggaagaaagaagatagggtttggagtatttttgtatgatgttgatgatgacgatgatggtggtggtattgtcggcaacaacaacattggtagaattgctagtggtgatggtgacaatagtggtagcggcgacattggtgatggtagtaatgccggtagtaatggtgataatagtagtaataatgacgatggtagtgataatgacagtgataatggtggtgataacgatactagtggtgctggtgacgatggtggtaatatcagtgtttgtggtgacaatgacgatggtggaggtgacattggtggtgatggtgatgctggtggtgatagtggtggtagtaaggatagtaatggtggcaataatgttggtgatggcggtgttggtagccaatga

SEQ ID NO: 95432 - DNA, 2127 bp, Glycine max
  Peptide Sequence Number=SeqID_212210
atgtctcgtataacagaaatgtttgcatcttcagaatatcaagatgaccatgctccactgtggtcatttgttacaataaaggaaaagataggagatgggggtggtaataggttgtggagttgtaatttttgtgaaaaagttgtcaaaagttcatactctagggttaaagcacatttgctcagaatttgtggtagtggaattgatacttgtccgaaagttactgatgcatatttggtttatttgaggagggtttgtgaagaggctgaaagcatattaaagtctaagaatgttcctttacctactgacaaaaggactccaacaccaccaacattaccaccaaaaagaagaaaatcaagcaatatagagagtgcatttaatattgaggataggaatcatcttagagcagagatagcaaggatgttttattctgccagcttgtcattccatcttgctagaaatccatattttgttagttcttattcatttgctgctaactgtaatctaagtgggtttcttcctcctagttataacgcattgagaactagtcttttacagcaagagaggtcttatattgaaaggttgcttcaacctatcaaatctttgtggagtttaaaaggagttacattggttgtagatggttggacagatgctcaaataagacctttgataaacttcatggctatatctgaagaaggacctatgtttttaaaggccattgatgggtccaaggagtacaaggacaaacattacatgtttgacttattaaaggatgtaatcaaggaggtagggccacaaagtgtagtccaagtcataactgataatgcttatgtttgtaaggcagctgggttattgatagaagttgaatttcctcatattttttggaccccttgtgtggttcatactttgaatcttggagtgaaaaacatttgtgctgcaaagaatgttgatggtaatgagaatgtcttcaatgaaggtgggtggattgctgaagtaattggcgatgcttcttttatcaaggttttcatcatgactcattcaatgagattagcaatttttaatgagttttcatctcttaaattgctttcaattgctgaaactcgttttgcctctatgatagtcatgttaaaaagattaaaattgttgaaacgttgtttgcaaaatatggtcattagtgatcaatggaatagttatagagaagatgatgtcagaaaagctgcacatgtaaaagagttgattttgaatgatatatggtgggataaagttgattacatcctttctttcatggatcctatatatagcatgattagaatatgtgacaccaatgcttctaatcttcacttagtgtatgaaatgtgggattctatgatagaaaaggtgaagacaaccatctataggcatgatgaagtgctagaaaatgaagtttctactttctttgaagttattcatgaaatacttaattctaggtggagtaagagttgtaatccacttcattgcttagctcattctctaaatccaaggtactatagtgataattggcttaatgaggttccaaatagggttcctcctcatagagatgatgaactttctagccaaaggaataaatgtcttaagagatattttccaaatgttaatgttaggacaaaagtttatgaagaattctctaaattctcatcttgtgcgggtgactttggttcatttgatataattgaggatagatgggcattagattcaaaaacttggtgggtgatgcatggatcctctacacctatactccaaaaggttgctttaaagcttctagtgcaaccatgttcttcctcatgctgtgagaggaattggagtacatactcttttattcattctttgaagagaaacaaaatggatccaaagaaggctaaagatttggtttttgtgcactctaatcttaggcttttgtctagaaaagaggaagggtataaaaaaggagagacaagattgtgggacattaatggagatgtacatgatccacttgatgatagtgctggagttcttgaaatgacagatttatctcttgatgagccagatttagaagctatgcttttcttagatgatggcaatggaggagaagaaaatgaaacaattagagtttga

SEQ ID NO: 95433 - DNA, 726 bp, Glycine max
  Peptide Sequence Number=SeqID_212211
atggcggaactctggaaggccaaaattctcccatataaacaggccattgcagcctatggcactgccatagtgggcctcccttcacaaattgcctatggtgtggatccaaatgaggggtgtagagtactagagagttcttcttggggagagttgggtatctgtgaagatcatgctattcaggaaccatatgaaggcatggaatttgaatctgaagatgctgctaagctattctatgatgaatatgcccggcgattaggatttgtcatgcgtgtgatgtcttgtcgacgctcagaaagggatggtaggattcttgcccgcagacttggatgtaataaagagggttattgtgtcagcatccgaggtaaatttgcgtcagttcgtaaacctagggcaagcacaagggaaggttgtaaggcaatgattcatatcaaatatgataagtctggaaaatgggtgataacaaagtttgtgaaggatcataatcatccattagtagtctctccacgtgaagcacgccaaacaatggatgagaaggataagaaaattcaggaattaacagcagagcttcggcttaaaaaacggttgtgtgcaacatatcaagaacagttgacttcttttatgaaaattgttgaagagcacaatgagaagctatctgccaaaattcatcatgtagttaataatcttaaagaatttgaatccatagaagagcttttgcaccagacataa

SEQ ID NO: 95434 - DNA, 249 bp, Glycine max
  Peptide Sequence Number=SeqID_212212
atggggatcagcacacttgataaacccgcttgcattgcagggtcgcacatggcaccatcttctctctctgatattctgtgcttaacttttgtgatcgtgcgtacgagctgtggaaaacacgagcagattccatttgaagctttgttgatccttgatttcccaatacccattgaaatgagccatgtgatgtgggtcccactcccgtgctgcatcgaacatgtcaatttcaaaggggtcaccctcacttaa

SEQ ID NO: 95435 - DNA, 414 bp, Glycine max
  Peptide Sequence Number=SeqID_212213
atgacacaaactaccttggatttttctccaacctttcaactacatcacacaacagcaacattaatcatcatgccctactcctccatgccactctctctgacccttcatcaccatcattattattaccccctcattgctaccaactctaattcctttatcataaacatcatcatcatcatccaccatccccttattgcacttgatgatcataatcaccttcaccaacacaacaaggagctaccttcacacactaaacaaggtcacaagcaagcacaaggggaagttgatgacaaagtgaaaagggtctttgttggttttgctgcaagatccaacaactcctcctggggaatcaagcatcttggtccgatccgtttcagttttggctatgactatgagtatattccgtgttactaa

SEQ ID NO: 95436 - DNA, 1095 bp, Glycine max
  Peptide Sequence Number=SeqID_212214
atggatcctcatcttcctaagaatggaacccaacaacaccatggtaccccaacaccttccccagcttcagttgcaaataatattataataccacatcctgaattccggataccttcctttaaagaacatcacaaaaatgttcctcaactcgcgatgattgtcatggcatgcatggttggcgtcatcatgtttctctgcgccgtgtccgtactcataaggtacttctactcaagaagatatagccgcaataaccaaaacagaagagtcgacgcccccatattgttcgatttgaacggagattctcctccgagttcggataacgatgatgacgtggaggagttggcggttgtccacccgatatggtacatccgtacggtgggtctccaacagtccctcatagactccatcacggtattcaaatacaagaaaggcgaaggcatcatagacggcaccgagtgttcggtttgcctcggagagttcgaacacgacgagagtctgaggttgttgcccaagtgcagccacgccttccacatcccttgcattgacacgtggctcaggtctcacaaaaattgccccttgtgtcgtgcacctgtgctacgcgacgaaactgacggcgcgcatgtgatcagagccgttgatcagagtaatcagacggtttcaaacgtttctggtcatcaagaggcccgcgtggagagttctgatcatgagagggttgaagatgatgatgtgtcttcggccgcagtggaagtggtagaggcaacacagcctctgagaagatcggtttcgatggattcttcttctgctaattcaatggtgttatttggtgatgtggtggtggatttagatacccatcattgtggtgaaaaagtgaattattcaagtaataaggatatgagtgttgttgttaatgagaagcatggtagtgggagctcaacttcaacaactattattaataacaagttggcttcaattggacgtgcgttgcaaaagaggccgatctccgtctcaatgagaatgagaagatctttttcacataacaccaagtttttgttctccagacactgtaggagtcagagttcaactcttccattgtaa

SEQ ID NO: 95437 - DNA, 1512 bp, Glycine max
  Peptide Sequence Number=SeqID_212215
atggtgattttcccaatacagcagtgtgcgagaatgcattccaatgcacaagttcccaagttagaggtaggaggtttctatgtgaggggaaggataagttatatgaaggcttggctagacaaatacatggtagagaaaaggcagtatattgtgagtggcactcctccactcaatacaagcggatacaaatctgatttcatgttggctagtcccattagaaaagtgaaattcagtttcaaggttgataaaatgagggctgtaatatccggagaaggagatctgctatctcatcctaacaactataacagtccaagacaactagacaaactggcagaagaaccaattaaaatcagacagcaacttgatacatttgcttttggaacagtctctgatgagataaatcctactatcaatggcttctttgctgatagaaatgaatatgatctggattgtcctacacaagggttttcttctatcccagatgccattgcagatattcgtcagggaaagttaattattgttgttgatgatgaagatagagaaaacgagggagatttaataatggcagcttcaatggtgacaccaaaagcaattgcatttattgtcaagtatggaactgggatagtgtgtgtaagcatgaaagaagaagacttagagaggctgcaactcccactgatggtgacacagaaggacaatggagaaaaactttgcactgcattcacagtgacagtggatgcaaagcaaggcactacaacaggagtgtctgctcaagatagagcaacgacaatcctgaaacttgcatcaagaaattcgaggcctgatgatttcaatcgcccaggtcatatatttcccctgaagtacagagaaggaggggttcttaaaagaccaggacacacagaagcttcagttgaccttgctgtgttggctggcttggaacctgctacagttttatgtgagatagtagatgatgatggttcaatggctaggttaccaaagcttcggcaaatggcaaagaaggaaaacttgaaaatcatatccattgctgatttaataagatacaggagaaagagggagaagttggtagagtgtgcttcagctgcactgataccgatcatgtggggacctttcaaagcttattgctatcggtcatgtctggatgggattgagcatattgcgatggttaaaggtgagataggtgatgggcaggacgtacttgtgagagtacattcagaatgtctcattggtgacatttttggggcaacatgtcaatgtggaaaccaattagaacttgcattgaagcaaattgaagcagcaagtaggggtgtcttagtgtatctccgaggacatgaaggtagaggtattggcttaggccacatggtccgtggttacccctcggaagatgacaagtatgaggaattgcagttaccagttgattctaggaagttcggtattggagctcaggtgcagaaagtgcatcctagttggggtaggcaatgtgacacttcacgatag

SEQ ID NO: 95438 - DNA, 1540 bp, Glycine max
  Peptide Sequence Number=SeqID_212216
atgaatgaaaacataagggatattctttgtattgataagacaggctcccttacaatgaatcatgcaatcatggttaatcatcttgactgcaggggtttaccccaagaaaaaattttacgctatgccttcctcaactcttactttaagagtgaccagaagtatcctctggatgatgctatcctagcatttgtatattcaaatggattcaggtttcagccatctaagtggaggaagatagatgagattccttttgacttcataagaagaagagtatctgtcatcttagaaacagaaggcggacactcacaattctttggcaggttcctgttaacaaaaggagcactgttagaagtattgagagtttgttctttcattgagaatttcgataaagatgaaatttctcccttctcttcaaatgattatcagcggattttaaatctctcagaagatttgagcaatgaggggttaagggtaatagcagtagctataaggaagctggaaatgccccaaatatgcgaaacaagtaatggaagcaagagagaagaggaggatattgaaagagacatggtgttcatcggcctcataacgtttttcgacccaccaaaggactcagcaaagcaagcactgtggcgtttgtccgagaagggagtgaaggctaaggttttaactggtgactccctctccttgacaacaagggtatgcagggaagttggcataagtaccactcatgtaataacaggtcctgaactagaacaacttgaccaaaacactttccatgagacagttcaaagagccacagtactcgctcgtctcaccccaattcagaaacaacgagtggtgcaatccttgcaaacaattggaaaccatgtcgttgggttcttaggagatggagtgaatgattcactagctttagatgctgccaatgtaagcatttctgtggactcaggtgtagccattgccaaagacatggctgatattatcttacttgagaaagacctcaacgtgcttgttgcaggagtggagcatggtagacttagttttggcaacacaatgaagtatcttaagatgtcagtgatagctaacttgggaagtgtcatttcactcctcatagcaacactgttattcaagtatgagcccttaacttctagacagcttcttactcagaatttcatctacagtgtgggacagattgcccttgcttgggacaagatggatgaagagtatgttaagacacctcacaagtcctcagagagaggcttgtccatgttcatgttgtggaatgcaccagtgtgcaccctttgtgatgtggcaacacttttgtttctttggttttattacaaggcttacactgatgtgactcagaagtttttccattcagcttggttcattgaaggtctcctattgcagaccctcatcatccacttgataaggacagagaaaatccctttcatacaggatgttgcatcttggcctgtgattttcctccactgttgtgacatctgcaattggaattgcacttccattcacaccccttgggaag

SEQ ID NO: 95439 - DNA, 738 bp, Glycine max
  Peptide Sequence Number=SeqID_212217
gtgagggtgagaggccatttggtgaagtttgatgaggacacgctgaatacattcttgaagacccctgtaatcatcgaggagggggaaacattatcagcttactctagatttgcactcttgagacttgatcctcaagagttagctgctaagctctgcatcccagggaggggatttgagctgaatcttgatggtcagcctcgaaagattttaaggaagaagatgaccacactcgctcagacttggagtgttctttattgctccaacttggtccctaccttccacacttctgacatcacactggagcgggccaagtttatttatggcattatcatgaagatggacatgaatctgggctacctcatctcccaccagatttctatcattgcccagcatgactcctctaggcttggatttctagccttaatcacagctttgtgtaaaactagaggagtcacaccgaattccagatctttggagagtcttagccctgccactaacttggcatatataaagaagaaatgttggaatctagatgatccaacagtgtcattcagagggccaaggaaggccaaggggaagagatctgagattcccccttctacagctccttatcttctaatattcctcctataccagcttcaactcccactcccttaccagctccatcagttccagctcctcctacaggaccctccttattcacttcaaagacattatttgtcatgctgcagagcatga

SEQ ID NO: 95440 - DNA, 471 bp, Glycine max
  Peptide Sequence Number=SeqID_212218
atggagactcaaaaaccgaggaagaggagaaagtctactcttggttatacaccttggcccagtcagacaaaaacttggttttcgagtacgttaggtccactgagagaggcaagcttaagtttcacagaagccgataggagactgagggaaaatgggccaaatgttccacttgagtattcctttccaagatggtggcatcttctatggaactctcttttccatcctttcattatcattctgattgttttgtcagttctgtcattcattacctgcgacagtccaaatggatttatcatgctcatattggttttcatcagtgtcacccttcgtttctatcaggaatacagcagctcaaaagcagcaatgaagctttcagaatttgtaaaatgtccaataaaagttcaaagatgcgctggtagagttgttcagaaagaacttgtagttcaagttgatcagagggatgtagtccag

SEQ ID NO: 95441 - DNA, 822 bp, Glycine max
  Peptide Sequence Number=SeqID_212219
atgaaggagaaattgatgttcgagcttgctacactgccatttctagattcttattggaaccaggttgcaagtgttttgaacattttggatgatgagctgatcaagaatgttggagactacattttaagctgtcaaacatatgagggtggcattgcaggtgaacctggttctgaggctcatggtgggtacaccttttgtggattagctacaatgattctgattggtgaggaatgggcggtattccggcaaggtaaggaatgtggattccaggggagaacaaataaattggtggatggatgctattccttttggcagggaggtgccgttgctctattgcaaagattatcttccattatcaataaacaaatggaagaggcatcacagacttttacgatatctgatgtatctgaagcaaaagaaagtttggatgggacctctagtcatgcaacatgccatggcactagtcagtcctgttcagctgattataaaagtatcggttataactttattaatgagtggagagcacaagaaccactttttcacagcattgctttacagcaatatattctcttatgtgcacaggagcaagcgggtggactgagagacaaaccgggtaaacgtagagatcactatcacacatgttactgtttaagtggactctcattgtgccagtatagctggtcaaagcacccagattctccaccgctgcctaacctagtattgggcccctactctaatctcttagaaccaatccatcccctctttaatgttgtcttggaacgatatcgtgaagctcatgtattcttctttactgagtcctga

SEQ ID NO: 95442 - DNA, 960 bp, Glycine max
  Peptide Sequence Number=SeqID_212220
atgacaaaactcaccaatctaattgggatcatcaaggacaaagcatcgcagagcaaggcggcgttgttatccaaacgcaccacgctctccctcctacgcgccaccagccacgactcctccacgccccccacgcgcaagcacctggccacgctcctctcctcgggcgacggctcacgcgccaccgcttctgccgccgtggaggtcctgatggaccgccttcaggggaccaacaacgctgccgtggccctgaagtgcctgatcgccgtccaccacatcatccaccacggcagcttcatcctccaggaccagctctccgtgtacccctccgcagggggcagaaactacctcaacctctccaacttccgacacaacaccgaccccacatcatgggaactctcgtcctgggtcagatggttcgcgcagcacatcgagcagctcttatgcacttccaggatcctgggattcttcctcggaacctcgaccgacagcgaggacagggtgtcgggtgtcgccaacgcggacttgttgaccgagtttaactccctggtggctttggtggaagggatttgcaagaggcccgagcccaacgggaacaggttagtggaggagattgtgaaactggcgcgtgaggattggggagtggcgcaagttgaggtgggcgtgagggtgagtgagtttaaggagaggttgggagggttgaagtttggggaagcggtggaattggtttgttgtttgaagaggttggagcagtgccaagagatgatggatggggcaagacaacttagattctgggatttggttagagaggttaaggacaaagcagggattcagctctgtagagaagaggctaagttgagaagggaaactctcaaattaaggctgagtcaatcggatcgcttttcttctcgccttctcaattctcctcactttctccgctttccctccgggaggttcatgtag

SEQ ID NO: 95443 - DNA, 678 bp, Glycine max
  Peptide Sequence Number=SeqID_212221
atgaagttaggcatgtcaggcacttggctaatgaccgttcttgtttgcggtgtgtgggggttgactgaaaatattgatcatatatttcggttatgcccaattacaagagttgtgtggtaccttctcttgcctgcgtctaagcaccaggattttttcaatcaagatactaagacgtggatgcttctgaattttagggataccgcaatggttaatggtagaagttggctcctcattttcgttgttgctttagatatcatttggcaaaacagaagcaacttcatatttcaaggtctcacatctcaacctgctgacattgtcaagcacattttgtctaaggtggagtttgcaaactttaatccaaacatgcactcagttagcttggatgagaggaaaactgcagccagtggtgtcattggaaaccactttggagctgttatttttgcctttgctgcattgggttcggttctgtgctacatggagagttatgggcaatatatattgggattggcattgcttggaaccgaggccacaagaattcttttagtagagtctgattctcagcttgcaattaacttgctgagacacggatgtgcatcttatcacacttgtttagcctggtgcagagtattctctccttcattcaagcgggaggatgattggagtgggctaatgttatga

SEQ ID NO: 95444 - DNA, 318 bp, Glycine max
  Peptide Sequence Number=SeqID_212222
atggcggaggagtcgccaagaaaatcctacagcttcgacagcgacgacacgtggcccacactctgcaacgaagattcaatgaaactcacatcgttgtggttcagattctactcaaacacaaggctttatcaacaacgccaagccagcgatgcggagtcagtcgaggcagagctcggcgtcacgctttcgggcctcttcgcgcttgggttgctccatcgtcgccacaaaccttctctctattccatcgctctcgagggagaatgttgggacctctgtgtcctcccattcttgattgctagcaacttactaccactatag

SEQ ID NO: 95445 - DNA, 1176 bp, Glycine max
  Peptide Sequence Number=SeqID_212223
atgtggtggatgatgggcgagactggaggcaattactgttgtaagaagagcgatgatttgtgcaccaatgtttgtggtcaggaatcaagtcaagtatcaggtatgtcacgaattcgctgcattctgcggggtttggatgtgaaaacctacatattcatgtttgctgttatcccaatgtgtgtctttggattctatatacatgggcagaagatctcctactttctgcggccactatgggaaaaagcacccaagcctttcaatgtcatccctcattactataacgaaaatgtcaccatggagaatctctgcaggcttcatggatggggagtccgggagtaccctcgacgtgtttatgatgctgtgttgtttagtaatgagctggaaatactaaccttgcgctggaaagaattgtacccttacataactgaatttgttgtccttgagtcaaattctaccttcaccggattgcctaaggctctggttttcaatagcaatagggagcagttcaaatttgttgagccgcggttaacttatgggaccattggtgggagatttaagaaaggagaaaacccatttgttgaagaggcgtatcagcgtgtagcattggaccagctcctgaagatagctggtattactgatgatgacttgttgattatgtctgatgtggatgagataccaagtgctcacactattaacctcctgaggtggtgtgatgaagtaccctcaatccttcatctgcagctgaaaaattatctctattcatttgaatttcgtgtggatgataagagctggagggcttcaattcacaggtatgagactgggaagacgaggtatgcacattatcgccagtctgatgacatattggcagatgctggatggcattgtagcttttgcttccgccgaatcagcgatttcattttcaagatgaaagcctacagccattatgatagagtcaggttctctcactatttaaatcctgaaagaattcagaaggtaatctgcaaagggaccgatttatttgatatgctgccggaggagtacactttcagggatatcattggtaaaatgggaccaataccccattcctattctgcagttcatcttcctgcttttcttctggaaaattctgacaagtataaatttcttttacctggaaattgcaagagagagagatga

SEQ ID NO: 95446 - DNA, 387 bp, Glycine max
  Peptide Sequence Number=SeqID_212224
atgaaaaccagagagccgttctgttccgtttgccaaacccgctacgacgaggagctgcgggtcccacttcttctccaatgcggccacggcttctgccgggactgtctttccagaatgttctccgcctcaaccgacaccacgctgacgtgtccccgctgccgccacgtgtcctccgtcggaaactccgtccacgcgcttccgaaaaacttccccgtcctcgcgctcctccgctcgccgtcttcttctaacgccgtcaggtccgttctcgacttcgatttcgattacaccgatgatgaagacgaagatccagatcaagaccaagactatcggagctacctaaaagacgatgaagtactgtggcggaacggtggtggaggattgaggctg

SEQ ID NO: 95447 - DNA, 330 bp, Glycine max
  Peptide Sequence Number=SeqID_212225
atggaaggaaaccaagggttcttgcgagcaagagttagacctagggcatgttattgtactttgctccttagatattgtggtcttcataatgaatcattgtttcaattgaatggtgtaccatggtgggaactgaattgtccaaaaagagttgtattatggtatcgatgtggtggggaggtcttgagtgttggtttgaaagagtttaaggatgacaaaggtgctttagagatgatgttgatgatccacttggtgatcacattgcaagtgatcacaatgaagataatcagggggagttattttgtagaatgtggaagtgaaccagcaatttga

SEQ ID NO: 95448 - DNA, 1020 bp, Glycine max
  Peptide Sequence Number=SeqID_212226
atggaaaacataacgcatctttctttggagtacactgccataagtaaattaccaaattcaattagagaacttgtccgacttcaaagtttagaactgcacaactgtggaatggttcagttaccgagtagcattgtcacattgcgagaacttgaggtgttgagtatttgccaatgtgaagggttgcgattttcaaaacaggacgaagatgtgaaaaataagagcttactgatgccctcttcatatttgaaacaagtcaatttatggtcctgcagtatatctgatgaattcattgatacaggactcgcttgggggattccacccaatttagaaacattatctgcaattcggtgcacatccttgaaagatttagaccttgcagttcctcttgaatccaccaaagaaggttgctgtttgagacaacttattttggatgattgtgagaatcttcaagaaattagagggattccaccaagcatagagtttttgtctgcaacaaactgcagatccttgactgcctcatgtaggagaatgctactgaaacaggagttgcatgaggctggaaataagagatattctttgccaggaacaaggattccagaatggtttgagcactgcagcaggggacaatcaatttccttttggtttcgtaacaagttcccagtaatatctctctgtcttgctggactcatgcataagcacccttttggacttaaacctattgtgtccattaatggcaataaaatgaagaccgagtttcaaaggagatggttttatttcgagttcccagtattaactgatcatatacttatatttggtgaaaggcagattaaatttgaagataatgtggatgaagtagtttcagaaaatgattggaatcatgtagtggtctctgttgatgttgatttcaaatggaacccaacagagccgcttgttgtgcggactggactccatgtaatcaaaccaaaaagtagcgtggaagatattcgattcattgatccttataaacccaccttcttataa

SEQ ID NO: 95449 - DNA, 133 bp, Glycine max
  Peptide Sequence Number=SeqID_212227
atggaggaaaaactgaagagatctagaggaatgcctctaagtggagtgaaagtactgcaagagctggctagtctaggtgggaagttcaaagaaatatcagctgagtttattaagattttgatgacgggtatag

SEQ ID NO: 95450 - DNA, 594 bp, Glycine max
  Peptide Sequence Number=SeqID_212228
atgacaatgtttcctcttaccaccgaggtgggccctcctcctcaaccgcgacctctcttttgccaagatcactactccgcgctgggcgttgggcccagcaagacaatctcggacgatcagtcgtggttgagatccaagttcatgcttagaagggcagcaggaggagggattagctgtcagaactgcgggaaccaagccaagaaagattgccctcacatgtggtgcaggacgtgctgcaagagccgcggcttcgattgccaaacccacgtcaagagcacttgggtccccgcatcacgcctccgcgaacgactacaacaactctttgctttgcaacaaaccctcgaaccacctttttctggaggaggcaaaaccctaaccctaagaggaaggagagaaaagggattactaacatatctgagggccagggctgccgtcgccggtgagagagtcgaagtcagtgccaaagaggcgagtgttgcggttggcgtcagtgtcctagtggaacccgcggcccttggtcttcttcagtcaccgcagtttcatccttgtttttgctcattgttcgaggtcgaggggtgtcgtgcgtgtggataa

SEQ ID NO: 95451 - DNA, 150 bp, Glycine max
  Peptide Sequence Number=SeqID_212229
atgaatgagggttgggttgggaagagacgaaacgaaatgaatgcaaagcgatcggtcaaagtcaggtggatcatggatggtgattgggtgagttgtgcggtgagcgaggttgggaattgggacgcgcacgtggttgaagaagtcaactga

SEQ ID NO: 95452 - DNA, 684 bp, Glycine max
  Peptide Sequence Number=SeqID_212230
atgattctgagatttgcagcagctgcagcttctgcttctgcttctgtctcacgcatatcaaaaccccataacccaccattcctttcacttccacaccccaacactctcaaattccataaccaaccttctcataatccacgcaacaacgttcttctgccacttccctcacggtctcaacgctgctacattcgagccataagtgacgcaactgtggaacctgaaatttctaagaaagaacaaaacgagtcacctaaagattggaagattaaaatgctctatgacggagattgccccctctgcatgcgcgaggtgaatatgctaagagagaggaataagagttacggcacaatcaagttcgttgatataggttctgatgattactctcccgaggagaatcaaggccttgactacgaaactgttatgggaagaattcatgctattctctcagatggatctgtggttacagatgttgaagcatttaggagattatacgaacatgttggtcttggttgggtttatgccattacaaaatatgaaccaattgcaaaaattgctgattccatatatggtgtttgggctaaataccgtcttcaaattacaggacggcctcctatagaagaaatattggaaactcgaaagaagaagggtgaagtatgcaaagacagcaatgcttgcaagatgtaa

SEQ ID NO: 95453 - DNA, 471 bp, Glycine max
  Peptide Sequence Number=SeqID_212231
atggcgttcttgtggaacaaaactagtatcgcttcccattttcgatctcactctcagaagactgagggtttggcttcttttccgcgccgtcgattccacgtcgaacccggggctcgtgaaaaagctctcttggcagaagatgcaacgctgaaaccgttcaaatcatataagaagagtgtcaaacagctcagaaaaattgggaatgctctgacagttgttgttgttgcaggattgaaattgcttgttaatgagctgaaaggtttatgtttgtttgagcggactttgttcttacagtttatgtttgttgttaacaagctgaaagatttcagactgctgatgaagcagtctaaagtttgtagtctggtagttgccagaacattacttaattggaaatggtctgagccagatttgatgtttgacttaggtaaagcccttggtgatttggaaatccagtatgcctctgcagtttga

SEQ ID NO: 95454 - DNA, 618 bp, Glycine max
  Peptide Sequence Number=SeqID_212232
atggctcaaggcaaaggaaaatccttttgttacctctcccatattgcacaatttcggaatttattggtgggtgatctcatagaccaacaatatcacaaacggaagattgtgataaggcaaaggaaatatggaaggcaacaaacttttggcatcatattcagccgagactcgacacaacagaaggctttaatcagctgcaatctcacgaacaacatcaacttgcagtcatcctttggattatttggagaaatagaaacaacaagatctggaacaatgcagaacccaatgccaacatatctgtctcgcagggacttcaattctccgtcgaatggctctcggttcgtgctaaccaacatcaacaaattcatcattcttctcatcaaatcacctcttggattccccctgcagctggtttctttaaatgcaattttgacgttgccatattcaaggaggaaaacacttttggtattggcttatgccttcggggtgctgacggaaccttcgtcaaagcttactcagaatttcaccaaggaattccaagacccgaggaagcagaagccttcgctctgcacaaagctctccagtgggctgctcaccaatatcaatggtagaatataa

SEQ ID NO: 95455 - DNA, 1977 bp, Glycine max
  Peptide Sequence Number=SeqID_212233
atggatactaaggcaagcttttcacaggttgttcttcctgtatttaatggagaaaactacaacctttgggtggaggctatagaagaggattatggtgttcttcaactaccagacaatcctacagtcgcccagatgaaaaatcacaaggagagaaaaaacagaaaagccaaggcaaaggcttgtctgtttgctggagtctcaaaaagaattttcataagaatcatgaaactaaaaactgcaagtgccatctggaattatttgaaggagaagatgaaagagtttgagacaatcaaagacttctcaggcagactgtttgacattgctaacaaggaaggatctatagaggatgcatttcaagtcaagttgcaaaccaacaataatggcaaaagccttagcaacagacctgaagtttttgcaaacaataaaaatcaaaacaacaatactcagttaaggcatgttgaaagaatatgcaaatttcaacaacaacaagaagaagtcaaggttcctgaggaccaatcacaagagagcagtggttgtacaaaccacatgacctatgatcgtgagctctttacagaacttgatgaagctattttttctaaagtcaagatcgaaaatggagcatatattgaagtaaaaggcaaaggaattgtggcaattgaaggccacacgggtttgaaactaatttccgatgtgttatatgtcccggaaattagtcaaaaccttttgagtgttcctcagttgctcgaaaaaggttataagggctacagaaaggctgaaattgatacacacagaaaggctgaaatatggatttgctttatgaagtttaaatctgaagttgttgacatcttttggaagttcaaagcttggatggaaactcaaagcaagtgcaaactacagttgacaacaccttattctcctcaacaaaatggtaccgcagaaaggaagaataagacgattatagagatggctaggtgcttgcttcatgaaaaagaattgccaaagaaattatgggcgaaagccgcaaatactgcaattttcttgcttaatagactactaacaaaagctttgaaaaagaagacactatttgaagcatggtatgactataaatctgagttgctcaatctaaagatatttggttgtttgtgcttttcttacattcctcaggttaagagggaaaaactagacaagaaagtagaacctggaatctttgtaggctatagcttaatttcaaaggcttacaggatctatttgccacatcatgacaaagtaattgttagcaggaatgtgggattcttggagctggataattggaactgggaagatgacaagaagattttatttcagaaggagaatgggaacgtagacgaagaacatgttagaggaacaatatcactttttgatatctatcaaaggttgttgttcgtgcttgctgcacaaaatggttgggctatacatcagatggatgtcaagtccacctttttgaatgggtacttggaggaagaaatctttgttgaacaaccagaaggtttgttgtccaaggataggagaagaaggaagttcaacatggaagaatgcaaaccaactagaactccaatgaatcaagaggaaaagttttgcaaaatagatgaagctaaaagggttgatgaaaggttgtacaaaagcttaatagggtgcttgatgtatttgataacaactaggccagatattatgtatgttgtgagtttactatcaagtcaagttagaagtttcaatcttcttggttattctgatagtgattggacaagatgtgttgatgatatgaggaacacttcaagttattgttttactttaggttctgttcagaaggatggaaaagtgaagcttgttcattgtagaaaagaatatcagaatgttgacattctaacaaaggcgcttcctaaaaacaaatttgagttcttgaggaaaagacttggaatatgcagcttcagtgtcaagtag

SEQ ID NO: 95456 - DNA, 459 bp, Glycine max
  Peptide Sequence Number=SeqID_212234
atgttaaaaaccggatcaaactttggagatcatggtatggagtcaatccttagtcatagtggatttgattgggatgacaccaaatacataattactattgatgatgaaaatgcatggactgagtatgttagttcacataaaagggctaaaaatttccgattcaaggaaattccaaattgggattatataatggacttgtgtgctaaagatagagtcattagtcgtggagctaaaaatattatggatgttgatgaagtcatgagcacgggagtaaacgaagtggaatttatgggtttagaggatgtcaatacttctatagatttagaggaattgggatttggtttgaaaagaatgggacaatcttcaagttcaactagtgtacaaccccaaaggaggaagactagagaaaaaaatggaataactgctttgataaaacaagtggttgaatcttttgattga

SEQ ID NO: 95457 - DNA, 210 bp, Glycine max
  Peptide Sequence Number=SeqID_212235
atgaaagctaaaaatgaatcgctttttttggacgatggagacctcagccggcctacggtgaatgggagaactgccaggaaaccacattacaagcgaaacctcaaagagagttgggcttcgtcctcaaaaggaaacaacaccagaaaatctggccttccatggattcaaacagaaaacgcaattgaaacattaaagcagaaacgtaaatga

SEQ ID NO: 95458 - DNA, 387 bp, Glycine max
  Peptide Sequence Number=SeqID_212236
atgactagaggcaatccatctgacttacaaccctttgatcctgagatagataggacatttcatatattagttaggcatcattttataccttttgagctttccgttattggtgagtctgagcattttgtgattggtaattttgaacatcctggttttgagcattatggttttgaacattctgattttgaacattctgagaacatggcacaacctccaccccgtgagaggactctaagggaaatggctgcacctgatttcacctacgaaaactcgtgcatccaataccatgatgaggatgtcccatatgttcttataactggactgatccatttgcttccaaagtttcatggccttgcaggtgaagacccacacaaacatctgaaataa

SEQ ID NO: 95459 - DNA, 600 bp, Glycine max
  Peptide Sequence Number=SeqID_212237
atggatcagaataatttagataagatcatagaaagggctcttgacatcagagagaaataccaccgtcttgaaaagcagcagaacggtagtgaatggaccctggaacaggatgcacttgcctaccttaccgatgccggcattgtcggacgggatattatgtcacatgagaaaacatggattaaaaaagatgcctctgcagaattggaacataaactagcggaaaatatctggtggttgattatcttagcagatcggacagccatagaaaagatgcagcctgaaagcagaaaggcattacaccaaaaatatcatgactatcattatggattccctattcatgatgataatgaattatttggacgcttggtaatggaaatcaatcaggcaggattaagctgggaaaccattctgaaaaaagaagaaagcttcagaaatgcatatgatcagtttaatattcagaaagtagccgcatatactgaagaagatcgtgaaaggttattaaatgatagtggcatcatcagaaataaacttaaggtgaatgctgccattgaaaatgccaaaacaatcattgagctgcaaaaaagaattcggatcatttga

SEQ ID NO: 95460 - DNA, 405 bp, Glycine max
  Peptide Sequence Number=SeqID_212238
atggaaaaaggggaaggaattgaccttgccaaaaaatataatgtaaaagcgttccctacttacttgttcattaatgcaaacggtgaagaagtacacagaacgttgggatatgtagaagaaaatgatttcgttcagtttgctaaagatgcggaagacccgaataaaagactgactgcattaaagcaaaaattcgaaaacggagaaaaagatcctgaattcttaaagaatcttgccggacttaccatttataatgactcggaatttgcgggtaaagtcctggatcgttatttccagggaaaatccagtctgaatcaggaagatgttcagatattacttgccggaattcaaagtacagaaagtcctttgtacaaaatttttaaagataaaaaagcggacattgtgaag

SEQ ID NO: 95461 - DNA, 189 bp, Glycine max
  Peptide Sequence Number=SeqID_212239
atgaaaatacaaaaaggtgatcaaggggttcccatgaaccctaagagaataaaggtcattcctgagtggcccactccaccaagtgttgaggaaaaaagcatggagtttcaagaaccccgagatttgaggccaaatccttttcatgggggagggaatgatgcaatcctaccccgcaagggcattggatag

SEQ ID NO: 95462 - DNA, 189 bp, Glycine max
  Peptide Sequence Number=SeqID_212240
atgggggaaaatcacattgcttctctgtccctcacaccacatgtgggtaacattgaaaacaaagatcagctggcagcctctgagatactttgtaaagagggttgccaaaatcttgtcttagctgtggcaccattattagttggtgctgtaatccttggtcgagctctttcgggtttggtaattacctga

SEQ ID NO: 95463 - DNA, 357 bp, Glycine max
  Peptide Sequence Number=SeqID_212241
atgtacaattacctatggagacaatcaacaaaggatgaacatagtcaccatatcccttatgcacataagggaaaggcagtggcgaacaatgaaggagtgattaagcatagcagccacaagtgggaaatgagactacttcctgctactagattgagtttgcaaggattcaggtccgaaccccagtatggagttcatatgcttgagcataaaattcaagatcaacaaaaggatatgaaactgtcgcaacctacctcacgacgagacgacgaaggcaaaataaataagtcaaaagcgttcgtctccaagggagaaaatgagcaaagtcgccaccaacgtttattcgaggaaaaacgttag

SEQ ID NO: 95464 - DNA, 1947 bp, Glycine max
  Peptide Sequence Number=SeqID_212242
atgggggaggttcgtaagttggagaacgggccaaggagacaatctacgaatgagtgtgaagaagttaaaattgccttttatggagatgcaagggggggcccttgtgatcacaaagaggtcttacaagcaatggggctgaacatagtggatattacgacatttaaaaggaaggggcagagactgctaagcaactccttatctaggaatcaaattaaggagtgtagtaggatgttgcttattaaaaatgaccaagaggaggtgatgaggttatgggagcttggtaagaaattaagggtcattttttcatgtgaggatgaagatatagtgaagagaattatggaagtggagcggagagataaaagagaggaacatcaagaagaggggcataaaaggcgtggtttcaaaggaaagggcgaagttggtatgcctacaagaaatcaagatggaggaggtaatggaggcaacgtgcagagctataagctttggaggtggaagaggtttgtatggggcatggtttttgggtttgaagggaatgtggaaggagggttggatgaaaggcgggatccaaggaataatttgatgggaggaagagaattagaggagtttgatgagttcatctatgatatggagctagaggagatggtggagaagtggtgggcttcatatgaagtcaatggatgggtggcctatgtcattaatgagaaactaaaatacctcaaaagagatttgagaaaatggcacgaagaatgctttggtgatgtgcaacaaaaaactaatgatgtggtgcaaaagattaatgacttggatatcaaagatgaggaagagggcatggaggtgaagaaggtcaagggttgggaggccattcctagatgggtggagtttgagagtattggagattcggaaaatcaagacttatgtgctacttttaatgaagatgaagtaaaagaggtggtgtgggagtgtggcagggacaaaagtctaggtttcaacgggttcaactttcacttcatcaagaaatgttggggctttaagaagggggactttatgaatatggtgggagaattttgggagcatggaaaaattccaagcagtggcaatccttcttttatcaccttaattccaaaaaaggaaaatgcccaaaggcttggcctaacgagattagtgagacaagcggtgaacttaaattcttttcaagggtatcatgtgatcaacaatttagtggaggtgctaatattgcaatttgttgatgacactttatttgtggccaaggcattgtctacaaatattatgtgtttgaagactatattgagatgttttgatcttgggtccaaccccaaagtgaattttttcaagagtaagttgattggcattgaggtggataataactctttgcttcagtttgccagagaacatgaagatttcttggtgcaaatgggaagatgtgtgtctaatggaggtggtggcttatgtcagattaaggctggttatgggaaaaagtgcttatgtctaagtataggagttatccaactccgatggaaaaggtatggttgtaaaattgtggcacgatgtgtgggtggggggagaatgcctagccaaaaagtttggaagactattctcaaacttattacaaaaggacagtatggtgggggaggttggggaatggatcgagggttgatgggaattgaggctccaatggaggagggagcggttatgcaacatgttgtgatggaccaattttctgaagacaaggtgctttggaagggatctctttctgggaccttctcaatcaaggaggcttatatacttatttcaactgtaagttcatcagatcagggcattttggctaaggtgtggcaagttcattgttataagcagaagttatgctctatgaatcctagcgctcgaggtctaggtgcctctagaaaaacaagtgctaacacggaatag

SEQ ID NO: 95465 - DNA, 465 bp, Glycine max
  Peptide Sequence Number=SeqID_212243
atgggaaattgccaagccatcgatgcagcaacattagtgattcagcacccgaatgggaaagtagacaagttctatgcacctttgagtgccacacatgtcatgaaaaccaaccctggtcactatgttgctcttctcatctccaccacattgtgtccaaccaaggacattcaaaattgccccaacaagagtgacatcaaaaacaaaaacgccaacaacccagttcgcataactcgaatcaagcttctcaagcccactgacacgcttgttcttggccaagtttatagactcatcaaaactcaagaggtcatgaagggtctgaaggaaaagcaaaaggcaaagatgaggcaaaacgtgccagagtcagctcacaagccagatttggagaaggagaaagtagcaaggaggtctgaaatggaggacaataaggaattagccaccataatcggtctagtagtcaagatttag

SEQ ID NO: 95466 - DNA, 381 bp, Glycine max
  Peptide Sequence Number=SeqID_212244
atgggttttgcagtaacacaaaggtcacgcataggagattgggggtttgagacccttgtgcgaaagccgtggtggtgttgtctcgacttcatggtggtcatgcgtgataacgctatggtcaagtgtgttgcaaaaggaaacggcattgatagtcaaggtggtggaagaagacacacaatggttgtgtgtgccaacatcaattccgactcggcagcggctcatcatcaaagcgcctaccaatcagccacttggtatcaaggagagtgtttgatggttaggtacaacttaaggctcggttggggtaccaacaagcagttccgacatacaccattcatataccttgaacatgtccatttgtacatggtgtctcttgcaaaatag

SEQ ID NO: 95467 - DNA, 939 bp, Glycine max
  Peptide Sequence Number=SeqID_212245
atgtcggtgtttcatggggattgtcacaggtgtgtcagagatggattgatttggccaccatctaatccactgcggcaaaatggcctcaacattaaattattggcaattggttgtcatagggtcctaattaaaaactttttctttaggataagaattccatatccatttcaatggggagcaccttcatttgatgcaggtgaagcctttgccatgatgatggcatcttttgttgctcttgtggagtccagtggagctttcattgctgtatataggtatgcaagtgcaacgccattgccaccatctattctcagtcggggtattggttggcagggagttggcattctgttatcaggattgtttggaacagtcaatggatcctctgtgtctgtagaaaatgcaggtcttttggctttgacacgtgttggaagtagaagagtggtgcaaatctctgccggatttatgattttcttttcaattcttggaaaatttggagcagtttttgcctctatcccacctcccattattgctgccctgtactgcttgttctttgcttatgttggtgctggtggtcttagttttcttcagttctgcaacctcaacagttttagaacaaagttcattttaggcttctcaatcttcgtgggcttgtccgtgccacagtacttcaacgagtacacagcaattaatggttatggtccagtccacacaggcgcaagatggttcaatgatataatcaacgtcccattccaatcaaagccatttgttgctggtgttgtggcatattttctagacaacactttgtttaagagagaagctgctattaggaaggacagaggtaaacattggtgggacaagtacaagtccttcaagggtgacacaagaagtgaggagttctattcccttcctttcaatctaaacaagtacttcccctctgtttaa

SEQ ID NO: 95468 - DNA, 204 bp, Glycine max
  Peptide Sequence Number=SeqID_212246
atggtgctaacggttgccattttcaccacgggggagaaggtcaaattaatcgacaaagaagaggttgaggttggacatgatgaggtttgggttggacgtgtggagcaggggatgaaatggactcaggcgaggaagatgaagcagaagatggtgatccaactttgctggtttcgggttgaagggatatctgattgggtttattag

SEQ ID NO: 95469 - DNA, 141 bp, Glycine max
  Peptide Sequence Number=SeqID_212247
atggcaggaggaggagctccagctaaagcagatgagccacagccacatccaccaaaggatcagttaccaaatatttcttactgtattactagtcctcctccatggctggcaattcaggcttcttttcgctcttactattaa

SEQ ID NO: 95470 - DNA, 297 bp, Glycine max
  Peptide Sequence Number=SeqID_212248
atggacaaggagaagaaaggcgtagggaaaaggtctcatatgctcaaaaagcaaacaaaggaaagaaatagtgggctattaaaagagtacattaagaaaggagaggtaggcatagtgtgcttacaagagactaaaatggaaggtgttagggataaggaagatggaaatgtatgggggaagtcattagtattatacatgcctactctcaatgcagtttggcacaaaaaaggagcttctgggatgagcttcaagaaattaaagggaaagtggatgatggcatacaatgcatccttgtag

SEQ ID NO: 95471 - DNA, 222 bp, Glycine max
  Peptide Sequence Number=SeqID_212249
atgaagatcttcattctctttagcataacctttgcttatggtttccttggaagtgttgtctcaaatgccaatccgcttccatatgaagtcattttcgactttggtgactctatatgggacactggaaatgctgctaagtaccaccaacaaatgcctaacaatagtccttatggttcaacatactttaagcatccttgtgggtgcatgcaaatggacgactaa

SEQ ID NO: 95472 - DNA, 129 bp, Glycine max
  Peptide Sequence Number=SeqID_212250
atgtgtttcagtgaagaaaatctaagccgaggtgctgtcgtaacgcttccaagacatttccgtgagcaaatccatgaagattttccgtcgttcttcaccgttattcgttcgttctgtggtcttcaatcg

SEQ ID NO: 95473 - DNA, 198 bp, Glycine max
  Peptide Sequence Number=SeqID_212251
atggttgttaccatcaccaccatcatgattgtcgccataaccatcgttgttgccataaacatgattgtcgttgtcgttgccagcaccgccgttgatgatcatggtagtggttgtagtggcggtcatgacatttgtaacagaaacgatcatgatggttgtggtggtcatggtgatcatagagattttagaatgtcataa

SEQ ID NO: 95474 - DNA, 261 bp, Glycine max
  Peptide Sequence Number=SeqID_212252
atgtgtcacccaactgcatatgtttgtgtttactacaacggccaaatttgcaacactaatgagggcaccaccttcgttagtaacaacacaaaaactttcatggtcaacaagatgatgctgatgttcgacaaatgttcaaccatttcgtacaacaacccatcactaccatttgtggagttattttccataatatgtgacaatcataacccaacaagcaaccaacatggctcaagctccaatcttgaggacttatcagaatga

SEQ ID NO: 95475 - DNA, 918 bp, Glycine max
  Peptide Sequence Number=SeqID_212253
atggaccagtcaatggtggtgactcacttcccaaggcaaccaatctccagtcacattctccacacgtcgcctcaccttcctcatggttgcggagttagggttttgcgcggatctagggtttcgcgggttctgagggctgcgggtgtggaattaggagggggatttgatggtacgcgttggggaaaatgcgaggctatgcatgggtgtggaggtgagaagggtaaggggactcggcacatgtggaaagcccccgttcgtggcgactcgtctctgaacgccgatgtttcttcgtcttcttcgtcgtcatcttcgacagtgaagtcgttctgcaaggacggtcgcaaaattagcgttggtgaatgtgctctcttcaaaccatctgaagatcgcccaccatttattggtataattcattgtctgacatttggcaaagagaaaaaattgaagttaggtgttagttggctttatcgatccattgaagtaaaactcaacaagggcgtgccattggaggctgctccaaatgaaatcttctacaccttccataaggatgagactgatgctgaatcgctgctccatccatgtaaagttgcatttcttcgtaagggtgctgaacttccatcagggttttcttcatttgtgtgcaggagggtttatgacattgcaaacaagtgtttatggtggttaaatgatcaagattatattaatgattgtcaagaagaagtagatcaactattatacaggacttgtgtacgaatgcatgcaacagtgcagccaggtggtcgatctcctaagccaatgagtagtccaacatcaacatcacagttaaaatctgtttcagatagtgtccagaacaatacttcttcctttccatctcacattaaggggaggaaaagggaaagggcagattcaaggctctga

SEQ ID NO: 95476 - DNA, 3591 bp, Glycine max
  Peptide Sequence Number=SeqID_212254
atgaatataaaagatgcaaagtctggttcaggtcccactgttcactggcctgccaaatcacgttcttctgatgttggtcatggcgggaatagacattcaggtgcatcatctgatattgccatgaagagttctgttacacagctttctgcatccaaaacagcctctgtgaagattgtccagggagagaatactattagatctgcatcaacatctacatttccagggcctgctaaatcagtgctgtcacctgcatctgtgactgcaaacctaaaagatggacagccctgtattgccgctgtcagtggaggttctgatcttcccatggtgaatgcaagggatgagaaaagtagtagttctagtcaatctcacaacaacagtcaatcttgttctagtgaccatgctaaaactggaggtcattcaggaaaggaggatgccagaagctctactgcaatgagcgtgaataagatatctggaggctcttcacggcaccgaaaatctattaatggatttccaggttcaactccatccggagggcaaagggaaactggatcaagtaggaattcctccttgcacaaaaatttaacttcagagaaaatatctcaacctggattaatggataaggcacttgatggaacttctcttgaaggagttacttgcaagttgattgttaaaattccaagccaaggtagaagccctgctcaaagtgctagtgcaggttcttttgatgatcctacaatcatgaatagtcgagcctcatctcctgttcttccagagaagcacgatcagtttgatcactgctcaaaggaaaagagtgacctttatcgagccaatattggctcagatattaatactgaatcttggcagagtaatgattttaaagatgtattgactggctctgatgaggctgatggatcacctgctgcagttactgatgaagagcgctgtcggattgtcaatgattgtaagaaaacatttgaggtaccaaaagccgcttcctcatcatctggaaatgaaaataaagctggaaatttgcaggatgcttcttacagctcaataaatgctttaattgaaggtgttaagtactctgaggctgatgatgttggaatgaatcttcttgcgagtgtggctgctggagagattttgaaatccgaattgttaactccgactggatctccagaaagaaacactgctgctgttgaacagtcatgcacaggcaatgatatggttaagtcatctgaagaaaatcttgtccgggatgaatgccactcaaataatggtcttgatggtgaacataagaatcagggttctgtaacagatgatttaggggcaaatgacgaaagtgattctgattttcgagcttcaggtgagaaagctgcaagagagctaaataagagtgttaatgcatgtagtatggatttgcaacaggtttctgaaattattttagaaagcaaaggaaaattaaacgaaaaatctgtatctactgcattgcgtggcctttctgaaagttctgtacaagaagctagagatggtgacagaagcaagcagctccaggaggttggtcggggagtgaatggtggtgaaattgttgatgttaaggtcagttctgttgcagaagttgaggctgaagcaactgaaaaattgtcacatatagctgtgaaagtggatgtacagagtgataattgtactgctgaaggatcgagtggtggtggacggacagctgctgttcttgttccgtctgatttggcaagaggaaaagatgagaatgtactccattcttctgcttatagtgttgataaggttcctgaagacttgactgaacgggagtctgaaaaagctgatgatgttgatgctgagaatcttcctagtcagtctaaaaaggaaagaaatgagtgtgaaagtgataccttgacaatgcctgagaatagaggtttatgctctatcgtgactggtattgctgctgaacatgtggaggaaaatttagaaactaaagaggttcatgaccaacctgccagagaggaacttcccaaagattcacctagtgtccgttcacaagaaatggataagcatcttgattctaaaggatcaaaattgactgccatggaagcggaggaggctgaggagtgtacctctaccactgcagatgcttcttccgtgtctgctgcagctgtgtcagatgcagatgcaaaggttgaatttgatttaaatgaagggctcaatgcagatgatgagaaatgcggtgagttcaacagcagtgcacctgctggtcgtttggtcagtcctgtgccatttcctgcttcatctatgtcttgtggtattcctgctcctgtcactggggctgctgctgcaaaggggcgctttgtgcctcctgaagatttattgagaagtaaaggggaaattggttggaagggatccgctgccactagtgcatttaggccagccgagctcaggaaagttatggaaatgccttttggggcgctaacttcctctatacctgatgctccagctggaaagcagagtcgagcaccattggatattgacttgaatgtggctgatgaaagaatacttgatgatatttcttctcaaccctgtgctcgtcacacggattctgtatctcttacaactgatggtcatgatcctgtaagcagtaaaatggcttcacctgttcgctgctctggagggcttggccttgacttgaaccaggtggatgaagcttctgacgtgggcaattgcttgagcagtaatcataaaattgatgtgccaattatgaaggtgaagtcatcattgggtggcccaccaaatcgagaagtgaatgtccacagggactttgatttgaacaatggaccttcagttgatgaagtcaccactgaatcctcattgttctctcagcatgccaggagcagtgtgccatctcaaccacctgtttctggacttagggtgagtactgctgagccagtcaacttctcttggcttccttccagtggcaacacctattctgctgtcacaatatcttcaattatgcctgatagaggggatcagcccttttcaattgttgctccaaatgggccacaaaggttgttgactcctgctgctggtggcaacccatttggacctgatgtttataagggaccagtattgtcatctccatttgaatatcctgtcttcccttttaattccagctttcctcttccatcagcttctttttctgccggatcaactacttatgtatatccaacatcaggcaatcggctttgctttcctgtggtaaattcacagttaatggggcctgctggtgcggtttcatctcattacccccggccttatgttgttggccttacagaaggtagcaatagtggtagtgctgagaccagtagaaaatgggcaaggcagggtttagatcttaatgcgggacctggaggttcagacatggaggggagagacgacaattctcctcttccatctaggcaactttctgttgctagttcacaggccctagctgaggagcaagcaaggatccagttggctggtagtgtttgtaagaggaaggagcctgatggtgggtgggatggctacaaccaatcctcatggcaatag

SEQ ID NO: 95477 - DNA, 300 bp, Glycine max
  Peptide Sequence Number=SeqID_212255
atggcaataatgagcaacataatcacaattgaacagtcaaccattactctgagcaaccaattagatttgaaaaacaagaaaaaagaaaacactttgggtactgacttctgcatttacgattgtgtttatgatgagcatgcagatctacgagaagacaagcactacatggctgatcatcccagcttggtgccagtgactactgatcaaggtgaggaactccgtaaacacattggagctacctactatattgagtgcagctcaaaaactcagcaggtgtgtcatgtggatgatgcgcaataa

SEQ ID NO: 95478 - DNA, 789 bp, Glycine max
  Peptide Sequence Number=SeqID_212256
atgtccgatatacctagaagagtgcaagagtatgaaggggaagtgagacttccacttttgatctcaaaagcaagcttacaacttgagggttttgttgatccaaaggaagttgggaaggttagtgagaattcaattgtttttctagtcttgtatgtagatgacatactactcatcgggaacgacatcccatcactacaacatgtaaagacatggttggaaagtttcttctcgataaacaacttaggcaaaagatcccacgtgttaggaatcaggatctatagatatagatcactaagattgattggccttagtcagagtacatatattgacaaagttcttaggtgctttagtatgcatgattctaggaagggtttcatgcctgcatcacatggtatgcacttgtccaagggacaatcccttactacatcttataagagggaacacatgagtaagatctcatacgcttttgcaataagatcaatcatatacactatggtgtgtactcaaccagatgcctcatatgctttgagtatgacaagcaaataccaatctgattttggtgaaagtcactatatggatgttaagaacatactaaacaatgttatgagttggaagagttcaaagcaggagatagttgttgattctattatagaggttgagtatatagctacctcaagtgcaactaaggaagctatttggatcagaaagttcattagtgaacttagcgtcgttcttagcattatggacctgattgacctctattgtgacaacgatggagcgattgtgtaa

SEQ ID NO: 95479 - DNA, 858 bp, Glycine max
  Peptide Sequence Number=SeqID_212257
atgagtctcaaacccatatgggtattcttcattgccatctttttgtttcttctagtggccaattcagaagaagaagaagtgatcaaggccctagtcacgttcatggataaattggcaccaggaaatgtaccaagagaccctatgtggggttggaaccttaactcagatccttgcattgataagtggcatggtgtgaagtgctactcagacaacaaatatgttaagagtgtaattcttgagaaattcaactttggtggagttgtagatgctagttctgtttgcattgctaagtctcttcgaatccttaggctgacggacaacattttacatgattcgatatccgaggatataggaaattgccagtccttgactcaattgttcttaagtgggaaccaactctctggggaccttcctatttcaattggcaagctaagtaacatgaaacggctgcatgtttccgacaatcacttcactggagagcttcctaacatggttcatgtttcgggtttgatatccttttttgctcaaaacaacaacttcactggggagattcctagttttgacttctccaaccttgatgcctttaatgtctctaacaacaatttacaaggtcaagttcctgatgtcaaaggaaaattccatgaagacagcttttctgggaatcctaacttatgtggaaaaccgctttcacaagaatgtccaccacctgaaaagaaggaccaaaactcattccctaatgatttgtccatttattcaggttacttagtccttggtttaattgtcctatcaagcttatcgataccgtcgacctcgagggggggcccggtaccagcttttgttccctttagtgagggttaa

SEQ ID NO: 95480 - DNA, 1512 bp, Glycine max
  Peptide Sequence Number=SeqID_212258
atggagaagcagaagctgaaacaactcttactctctcatccttccacgttacacttcctactgtttcaactcggtcgattcctctgtaaactcggtcataactcagccgctatgctcaaaggcaagctcaagcttccagctccggacaaggttgggagggtctttcccgaccgtctcgacagcttggtctcagggttctacgaaaaaggccatgaaatcgaaggctctgagtttaaacttgagtccggcgaggagctcgagccagttcagcccggcgagttaggatttcacatggagagtgatgatgatgatgacaaggagcgaaaaattcggcagagaccgaacagagattctgtcactcaggtttcggtgttgaaatccgtttcagaggaagagaaaagatcagatctggaatacgagctttctcaaagggagataaatttggaaaagttgcaaagaattgccaacattggtattcctgatggaggaggtttgcgtgcaacggcttggaagctactcttgggttacttaccttcatctcatgacttgtgggacaagaaactaaaagagaataggcaaaagtatgctaatctgaaagaggatcttctctgcaatccgttttcactgatcatattattgaatctaagacagtcaagacatatttggaaggaatgtgaggaattaagttcaacaaggcggcatgaggacaatgatgttgatggcccccttaggcgacatgaaatttctcacgaagatcaccctttgagccttggtaaggctagtctttggagtcaatattttcagtatacagagatcgtagaacagatagatcgagatctgcagcgtacacatccagatttgccatttttctcaggggagtcatcaattagttgcaaaaatagggaagcgatgaagaatatccttctcctttttgcaaagttaaatcctgagattcgttatgtgcaaggcatgaacgaggtcttggcaccaatatactatgtatttagtactgaccccgacaagcaaaatgctgcaaatgtagaagcagatagtttttcttgttttgttcgaatcttgggtgactcagtggatcatttctgccaacaattggataatagttcaagtggcatccttgctacactttctcgcttgtcagatttattagaagtaaatgatgaacaattatggcgtcatcttgaattgagaacaaaggttaaaccacaattctatgcattccgatggattacactcctactcacgcaagagttcaaatttgagtctatcttgagaatatgggatacacttctgagtaacccttttggtgttcaggatatgcttcttcggatctgttgcgcaatgctactttgcgtgaaaagcaaactgctaagtggtgattttgtgaccaatataaaacttttacaacactaccctgatgatattaacgtagaatacctgctccaggttgccaaggatattagtcctgacacatctaattattgtttatcactttga

SEQ ID NO: 95481 - DNA, 1897 bp, Glycine max
  Peptide Sequence Number=SeqID_212259
ttggaacctcttacgtgccgatcaacgtctcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcctagttttgacttctccaaccttgatgcctttaatgtctctaacaacaatttacaaggtcaagttcctgatgtcaaaggaaaattccatgaagacagcttttctgggaatcctaacttatgtggaaaaccgctttcacaagaatgtccaccacctgaaaagaaggaccaaaactcattccctaatgatttgtccatttattcaggttacttagtccttggtttaattgtcctgcttttcttgaccttcaagcttttaagtaagctcaagatcaaagaaaaagcattggatgttgaaaagaaggaaatggcagaagaaactgttagtgttgctggcaaggctagtgaaatatccaattccatcgtgtcaaagaatggcactgtgattagatcagagtgttccttgacatctttggaaagtgggatgacaacatcaggccttgttcttctttcaagtcgaacgcttcgaggattgcaatttgaggacttgcttggtgcccctgctgaattgattaggaggggaaagcatggaagcctctacaaggttatgctcgataatggggtgttgttggcagtgaagaggatcaaggattgggggatttcaaagcaagattttgagagaaggatgaatttgatagcccaagcgaagcatccacgcgtattgccacctgttgcatactattgctctcagcaagagaagctcctagcatatgaatatctgcagaatggtagtctcttcatgtttctctatggatctcaaagtggccactcttttgactggagaagcagattaaatgttgctgctaatatagccgaggctttggcatatatgcatgaggagtttcttgagaatggaattggacatggtaacttaaagtcaagtaacattttgtttgacaagaatatggatccatgcataagcgaatatggcctaatgatggcagaaaatcaagatcaacttgtcccttcccataacaaaggcctcaaaagcaaagatctgattgcagctaccttcaaagctgatgtacatgcctttggtatgatacttctcgagcttctgacagggaaagtaattaaaaatgatggatttgatctagtcaaatgggtgaattcagtggttagagaggaatggactgttgaagtttttgacaagtccctaatctcacaaggttcttctgaagagaagatgatgtgtttgttgcaagtagcattaaaatgcgtaaatccttctccaaatgataggccaagagaaattaaaccccttagggatgacaaaacagagcaggctgggtgggtggagtggggttctcagcccactagcccaatgtggcctgcccttcccaaccctccaatctattggactaaagttatgaaggatcgagcgtctgaaattatactcaagtcacaaagaggtataaatgtagcgatagaacaacaatatctcaggctaccaccagatcttggagcccttctcaagcttcaccttgtgtttggatggagaatttaa

SEQ ID NO: 95482 - DNA, 168 bp, Glycine max
  Peptide Sequence Number=SeqID_212260
atggagtttgttaccacaatagaggaagaacccatcatcaagtccaaaaaaagaaacacaattagtactaagacaaagaagagtatcttccttgacatgggaggatttgaggatgattctattctacccacatttcttcatttacttgcctctgattcctcacgatga

SEQ ID NO: 95483 - DNA, 333 bp, Glycine max
  Peptide Sequence Number=SeqID_212261
atgaagaagccagggaggacaactacaaaatttggtgcagataataaacctatgtgcctgcaatcagatctcgaaggatcaaagtgttccatccacaatattagggtttccttcaactcactaacgcaatatgccatagactccattgtcatcaaaacgacaagacgctccatcaagatcggttcaataaaaacccggaactgggggtcaatagcaggtgctggaagattcctcagggagagaaacccggatattaaggttgatttgtttaccatgcgtactttcttcactgggagagaacaagggaacaagtttcttatgctaactttatga

SEQ ID NO: 95484 - DNA, 717 bp, Glycine max
  Peptide Sequence Number=SeqID_212262
atggtgcaatcaaagaagtttagaggtgtcaggcagcgccattggggttcctgggtatccgaaattcgccacccacttctgaagagaagggtgtggctagggacatttgaaacagcagaagaggctgctagagcctatgatcaagctgcgattctgatgagtgggagaaatgccaagaccaatttcccaataacccaaactccagaaggtgatccaaagagcactaacagcgaggacactccctccaccacctcgaaggatctggaggaaatcttacatgcaaagcttcgcaaatgtagcaaggtgccttcaccttctatgacttgtttgaggcttgacacagagaactcacacatcggagtgtggcaaaagcgtgctgggaggcgttctgattcaaattgggtcatgacggttcagctgggaaagaaaactgttaataataatgagactcatcaagctgatagtagcagtagtagttctctttcttcttctctaccttcttctcaacatcaccaccatgagtctccatcattgagtgtggcaggtaatcttcatcaccatcaagaagtcgtgagaggagagattgatgaagaggagagaattgcccttcagatgatagaggagctcctcaacgacagaaactgccctagcccatcatttgacaacaacattcaagaaagggatggtgctgatcatcatgacaacttttttctttaa

SEQ ID NO: 95485 - DNA, 135 bp, Glycine max
  Peptide Sequence Number=SeqID_212263
atgtattctacaaaatcaatttttacacaatttggtcgtggtattcttctttgcgccgctatgttacgatatattttggaggacaaggctgagccaccacccgagggtcgcttgtccgatgcaactgatggttag

SEQ ID NO: 95486 - DNA, 666 bp, Glycine max
  Peptide Sequence Number=SeqID_212264
atggaggcgaaggaagcttttgcaataaaatctgcaataagcttctcttttccttggccatctattagcacgagcttaccattcatggttagttgtatctttgcatttgaggtgaccggaggatcatctcgccttgcagtccataccactgtcctgctctcccctctaaccaaccaaattgcaaccacaaagacattgcctagcccttgcggatataaaccaaatgcaaatttaccagaaggggaaatccagaaagtttttggaacaagtaaagcaccaggatctatccttgtgtattgcgtttcaactcttgtgtctgaggatgatgagacaagcaagtacttggcacctgaatggcagaaggatgcaccgatatcacagagggagatacatctttcaagctgggcatatcaatgctttgcagcagggcagttaaataagcatgttaaagaagatgaaggtactgtagattggaggatactggaaagaatggtgaaggtggggttgtggtgtgtgcaagacagtccacctcttcatccttcaatcaagaacgttgtcttgatgttggaaggattgaaagagattccacatgtgcctagtactgtagtttcattttcatcttgcattgttgttcacgttgttcttgtgattgatatgcaaagctag

SEQ ID NO: 95487 - DNA, 1626 bp, Glycine max
  Peptide Sequence Number=SeqID_212265
atgaaggatgatgctgaaccttcagcaggtgatgtgatgctcgagatctacggcacaagagttgaaatgaagcagatacaaccaggtgcctcacttgtcccaaatactactcttgcttggtggccttccccttctggtcagtttgcatttggtttctatccgcaagagcaaggcgatgcctttgtcattgcaatttggttggttagcggagagaacaagatagttgtgtggactgcaaggcgggatgatcctcctgtcacctcaaatgcaaagctacaactaaccaaggacggtaaattcctactaatagatgagcacggagaagagaagtctattgcagatattattgcaaaagcttcctctgcctccatgcttgattctggaaactttgtactatacaacaataattccagcatcatatggcagagtttcgattacccaactgatactttgttagggggtcaatctcttcctaatggacatcaactggtctctgcttcatctaataacagccactcaactggacggtatcgtttcaagatgcaggatgatggaaatctagttatgtatccagtaagcacaactgacacagcactggatgcttactgggcctctagtactaccaattctggtttcaaaactaatctttatctcaaccaaacaggtttgcttcagattttaaatgacagtgatgggagcattatgaagactctttaccaccattcatcttttcctaatgatgggaaccggatcatttatcgttcaacccttgattttgatgggttttttcggctgtataagcattttgacaatggcagtttccaaaaggcgcaccattggccggatgagaatgcatgtgcagtaaaaggtttttgtggcttcaacagctactgcaccttcaatgacacccaaccgttatgcacttgtcttccggatttcgagttaatatatccaaccgactctactcggggctgtaaaaggagctttcaaaatgaagattgtaatgggcagaaagatagcgcaaccttttacgacatgaagccgatggaagatacttttgtagggacggataatccttattttaaagctaagatgccaaaagaagattgctcctctgcttgtttggctgattgcagttgtgaggctgtgttttacgacgatacggaagaaagctgcatgaaacagaggcttcctttgagatatcttcgtaggccagggcaagatgaatttggtgttaatcaggccttgctattcttgaaggtaggaaacaggagcctcaacaacgggacggggaatgataatcctgtgcctgaacaaccatctccaacaccaatcaagactacaaggaacaaagcaacggtccagattgttgtcattacatcagtgttttctctgcttttatgttcaaccattgtcatctccagccactacatgtacaagattaggatattgagctatgaaaggctgatggaaatgggtaactggggcctcagtgaagagttgactttaaaaaggttttcatacagtgagctgaaaagagcaacaaataatttcaaacaaaaattgggaagaggatcttttggagcagtttacaaagggggtttgaacaaaggtgttggaaaataa

SEQ ID NO: 95488 - DNA, 1062 bp, Glycine max
  Peptide Sequence Number=SeqID_212266
atgaaattcggaaagagcctgagcagccagatcgagaaaaccctgccggagtggcgtgacaagttcctctcctacaaggagctcaagaagaagctcaagcaattcgaccctcccgccgccgccgatgagcgccccggcaaacgcctcaagtccgacgccgttcccgacgccgccgacatgtcgaaggaggagagcgacttccggaacctgctggagaatgaactcgacaaattcaacaccttcttcgtcgagaaggaggaagagtacattatcagactcaaggagttacaagatagggttgccaaagttaaggattcaagtgaagagatgatgaaaatccacaaggaaattgtggacttccatggagagatggtcttgctggaaaactacagtgcccttaactatacagggctagtgaaaatacttaaaaagtatgacaagagaactggtgctctcattcgcttgcccttcattcagaaggtcttgcaacaacctttctttatcactgacttgctctacaagcttgtaaaagagtgtgaaacaatgctggaccgccttttccctgtgaatgatcctgctccagtttccagtgagacaactccccaagctgaaggttttgatccttcaacttcaaccactaccaagagtgatggtttgctgattcccaaggaattagctgagattgagtacatggagagcctttatatgaagagtactgtatcagctttgcatgttttgcaggaaattagaagtggaagctcaacagttagcatgttttcattgccaccgttgaaaataagtggttcagaagaaacatggaagaaaatcccggttctggaacaaacagccaagatgcatttggaggttacatttataagtaccctactccccttccattttctttttctgtttgacaataatagagcagacgccaagctgcactcagaaggtggcgttatagaaaaattcaatggtagtagtggtcggctgaatggtaattacataagtggtactgatagtgtgaatatcgatatcaatggtggaaaacatgtagaagtttaa

SEQ ID NO: 95489 - DNA, 1980 bp, Glycine max
  Peptide Sequence Number=SeqID_212267
atggatgacttgctgcagtgcacgacagctagtcaactcttgaaattacgtattccagaacagggcaccggcaaaagggtgattgagttggggtcacggctctcccccgaaggaaatcaaagttcatgggcatcaagttccggccattttgcttttggcttttactcacaaggtgatggctttgcagttggaatatggctggttaatgttagtccagctgaaaatactattgtctggactgctaaccgtgacagccccccactctcctctaattcaacgttgcagttgaccaagactggccttttgtttttccaagatggacgccaaggccaagttctcctttcaaattttgttgacgtaacttcttcggcatctatgcttgattctggcaactttgtactctatgatgatacccacaacactgttgtctggcaaagctttgagcatccaactgacaccatattaggaggtcagaatttaagtataaatgccaaactggtttctagtgtgtccaattcaagtcattcgagtggacgtttctttctcctcatgcaaggtgatggaaacctcgttgcttaccctgtgaacagcccagaaactggcggtgatgcttactgggcttcaaatactaaaggttcaacattccaacatctcagtcttaatgtcttgggctttctctgtcttagtggtcctggaaatcttcactgtttttttaaccatagcattagccctggaatgaaattacagaacaaaacttcaatctaccgttcaactgttgatgtagacgggaacttgagattgtacgagcaccaattagagggcaatggtagctcacatgtccaagtactgtggagcaccccacttaagaaatgtgaaaccaaggggttttgtggcttcaacagttactgctccatcgtaacaggtcatgccatgtgcgaatgttttcctggtttcgtcccatccaaaagcaacggtagcgtgtctctagattgcgtactggcccatagcaagggtagttgcaaaagcagcgaagatgcaatgatttcgtataaaattactatgttggagaatatgtcttttagtgatagtgatgatccatattgggttagccagatgaagaaggaggagtgcgagaagtctttcctggaagattgtgattgcatggcagtattatatttgaacggtaattgcagaaaatacagacttccgctaacatatggaagaacgattcaaaatcaagtggccgtggccctcttcaaggtgccttcaggaattgtggatagttcaactccaaacaactccacactcaagcctaggatcatcgtcgataacaagaaaagactggtaatggttcttgccattactttgggttgctttttattgttatctttggccttggcagggttcattttcctcatttataagcggaaagtttacaagtacacaaagttgtttaagagtgagaatctgggatttactaaagaatgttctttgcatccgttttcttttgatgaacttgaaatatccactcgaagcttcacagaggagatagagagagggtcctttggagcggtttatagaggcacaattggtgacactaacacaagtatcgccgtcaagagattagagacaattgctgatgaaggggagagggaatttcgaactgaaattactgccattgctcgaacacatcataagaatttggtgaagctcattggtttttgcatcaatggagctaggaagcttcttgtttatgaatatgtcagcaacgggtctcttgcaagtcttctcttcaatgatgagaagcacatgtcttggagagacagactaaaaatcgccttggatgttgctagaggagtcctatatctacatgaagagtgtgaggtccgtattatccattgcagtataaatcctcgaaatatacttatggatgagtatggactgcaaagatctctgattttggattggcaaagctactga

SEQ ID NO: 95490 - DNA, 246 bp, Glycine max
  Peptide Sequence Number=SeqID_212268
atggacacccgtctccgtgtgattggtgatcccatgaatggagttcaacggtacaccaaaatgaaatttggcggagttgttccgtttctcattcctatgacgaggggtgagggtcacaactcactctttgaggattcacctagtgagtgtggtggtggggccgccactgtgagatatgggttaatctctaagggacactcacgaaacaagatacaagcgcaaggccgtgtaacgtgctaccactga

SEQ ID NO: 95491 - DNA, 636 bp, Glycine max
  Peptide Sequence Number=SeqID_212269
atggctgagaagacaaagaaaagactggaggaagctgctcagtctggaagcactgaaggcgtcattgaccctctatctcccatcagacgacacgtgaagtggaagatggcccgcaccgagaaaactgggcagatgacgtctgagatagtaaaggaaatcgctaagaagattgattctttggaggagcaggcgtcacagggtttgtttgtcccccatggacgtccggatctcctgactgctgccattgggcgaccagaacaccctggtcgtggacttgcactgcctccgaagcctgaggttggtccctcagctactcgtgtcagcacaaaggagagttgtgttgatccttcaccgatcgatccagagacaggtgactcaaacaaatgcgggttgtacatcgaagacaatccttctcgcctgattgtcctaggaagagtttatgagggatccacaacggttcacaacatccttttattgcatggccaagtcaaggtaggtgttgaggaggttaaagatgcagaggctcccgttcctgtacccactgacaaggcagctgtgtctctagcaaaacctccagataggccgaatcataaggtcgatgatcccctatatctgatgacattgatcatcacatag

SEQ ID NO: 95492 - DNA, 672 bp, Glycine max
  Peptide Sequence Number=SeqID_212270
atggctacgagacatttatgtagcaaatgtgatgtgagacactggactatagcagctcgagcttatctgatgtatttgctaggttgcactctttttgctaacaagagtgcaatacatgtgcatatggtgttcttggacgcctttcgagacctcagtcagagtggaagctatgcatggggagctgccaccgtagtgcatatgtacgataatttgaatgatgcttctaagagcagcgacagacaacttgttcattttccatctgttgctgaggctattaatgttgaagactatcatgaaaggtcaccatgtgcctgccgctggacctctactaaggcctctatgaagaccaacatcgatgtatattcagatgattcctccacactccctgggttaaagattaggcttagaagactaaatggactggttctacatgatttcacatccattcatgaggctggcacagcccaaggatccagtcagacatccacctgtcgtgcaagattcagatatgtgaaacaagatatgcttcaatacccagtggcggttacaactatagaggaagcacctgtgcatgcaccttctgatgtggagcagcctagacatgcagtggaggcttgccaagcaatagctgaaaggttggagcgattgctcaacctaaaagataggtactga

SEQ ID NO: 95493 - DNA, 132 bp, Glycine max
  Peptide Sequence Number=SeqID_212271
atgtatttcataaattttcttaaagttgtgggacccctcaaaatggaggccctgagccatcgatcaccttctgcatgtgtccaaaacaacactaatggtggaagttggatccttgaggtcaaccatgagtga

SEQ ID NO: 95494 - DNA, 227 bp, Glycine max
  Peptide Sequence Number=SeqID_212272
gcgcagggcgagacaccacagcagcaaggggatggccaacagcgggcaacaaacgcaccaccgccacctcccaagcccctcagctcatctacaaaggcttgagcgttgcctatgacccgtggccgaccagcaggcgaccaagtccaaagccaaaggtaagcaaaagtactaggtccgtgaccaagtcatcacgcgtccagctcaagacgttaaagaagcactactag

SEQ ID NO: 95495 - DNA, 192 bp, Glycine max
  Peptide Sequence Number=SeqID_212273
aagcaagtccctattgctcagaaggatttgatatgggaggatattcaggctgaatttgatatccctgaagcatctgatgttaggacaaaaaagaaaatacttcaggctgtgggggagcagtggagacagtttaagtctgatttgacgttgaaatgggcacttgcagccgacaagggtagtgtcgatgacact

SEQ ID NO: 95496 - DNA, 261 bp, Glycine max
  Peptide Sequence Number=SeqID_212274
atgtcgtggggtcaggagaccttggggacgtcaggtggggtgctattgcccaaaaccaagcttgaccaatcccgacccaacccgggcatagtcggtcagcttgaaaacgaggtcaggaaactaggggagcttctggtaatcgattaccagggggatgtaattgattaccaggcttcagaaaggaactggaacactgtggaggcctctggtaatcgattaccagcctggtgtaatctattacacagagggatgggtccactg

SEQ ID NO: 95497 - DNA, 746 bp, Glycine max
  Peptide Sequence Number=SeqID_212275
gactacacgtcctcgcctgtagaggactacatgtcctcgccatcagagggcagcaccccctcacctttagaggacaacacgtcctcgccatcagagtgctgcacgacctcaccttcagaggactacacgtcctcgcgattagagggctgcacgccctcacctttagaggactacacgtcctcgccatcagagggctgcacaccctcgcctttagaggactacaagtcctcacaatcggagggctgcaagccctcaccttcagaggactacacgtcctcgccatcagacggctgcacaccctcgccattagaggacttcacgttctcgccatcagagggcagcacgccctcaccttcagaggactacacgtcctcgccatcagagggctgcacgccctcagcttcagaggactacacgtcctcgccatcgaaggcctgcatgccctcaccttcagaggactacatgtcctcgccatcagaggactacacatcctctcctgtagaggactacacgtcctcgccatcagagggctacacgccctcaccttcagagaactatacgtcctcgccatcagggggctgcacgccctcaccttcagaggactacacgtcctcgccatcggacggttgcatgccctcaccttcagaggactacatgtcctcgtcatcagaggactacacgtcctcgcctgtagaggactacatgtcctcgctattagagagttctacgtcctcacttgtagatga

SEQ ID NO: 95498 - DNA, 150 bp, Glycine max
  Peptide Sequence Number=SeqID_212276
atgatggaagatgatgacgcagcgattgaggtgaggaaccatgtttccccagagccagaggtggagaacgccggagttgcttcgttgtcgaatccaaagaggcttgtgacaaattcggaatgcaaaatgattttaaaggttcaaaggtag

SEQ ID NO: 95499 - DNA, 495 bp, Glycine max
  Peptide Sequence Number=SeqID_212277
atgtctcttgctacattatttggaaagttacaggaacatgaaatgaaattgttgagattgaatcaacatgaagaaaatgataagaggaagggaatcactcttaaagcttcatcttcaaaccaagaagagagtgataaggaggatacaattgaaatagatgaaaatgatgatcttagtctttttgtaaaaggactcaacaaattcctaagagtcagaggaaatcaaaggagaccaaactttaaaccaaaaagaagggcagaagattcatcctctacttcaaaatgttatgaatgcaaccaacctggacatctaagggttgattgcccgatcttcaagaaaagaatggagaaatctgaaaagaaaaactttaatgaaaagaaggcaaaaagggcctacattacatgggatgataatgatatggactcatctgaagattcagaaaatgaagtggtaaacttgagtctaatggccaaaagttatgaaaacgatgaagag

SEQ ID NO: 95500 - DNA, 585 bp, Glycine max
  Peptide Sequence Number=SeqID_212278
atgtctgatgcatcagttttgacaattttgaatgcctgtggaacggaaaaaatagctcaacattttattggagacccatccttatggaaagataggtctgcagaattattatcaaaccttaagtgtagaaccttagcagattttaggtggtacagagatactttcctaactagggtttacaccagagaagatagtcaacaaccattcaggaaagaaaaatttctagctggtcttcccagatcattaggagacaaggttagggataaaattcgtagtcaatctgccaatggagacattccatatgaaaacttaagctatggtcaattaatttcctatgtccaaaaggtagccttaaaaatctgccaagatgacaaaattcagaggcaattagccaaagaaaaagctcaaacaaagagggatttaggttccttctgtgaacaatttggcttaccagcctgcccaaaacaaaagaagaaacaaacctctaggaaagaaatccaggatcataaaccagccaatagaagaggattttcaaaaagaagatactctcaaaaaccatcgactagtaaggtgtggcgtccctaa

SEQ ID NO: 95501 - DNA, 504 bp, Glycine max
  Peptide Sequence Number=SeqID_212279
atgccctttggcgaagctctgcagcagatgtcactctactctaaatttttgaaagatatgttgacaaggaagcacatgtacattcatcaggaaaacatcatagtggaaggaaattgtagtgctgtaatccaaaagatccttccacctaagcacaaagatcctgggagtgtaaccattccttgcttaataggagatgtcaatgtgggaaaggctctaattgatctgggagccaacattaatttgatgccactctctatgtgcagaagactgggagagttggagattatgcccactcgaaagactttgcaattagctgatcgctccattaccaggccctatggagtgattgaaaacgtgttggtcagggtcaagcattttatcttcccagtagactttgtggtcatggatatctctgaagatattgacatccctgtaatcttgggaaggccattcgtgttaactgcaagctgcatagttgacatggaaagagaaagctgtagttag

SEQ ID NO: 95502 - DNA, 246 bp, Glycine max
  Peptide Sequence Number=SeqID_212280
atggttatttccatacttcaacttgactcgatgaaccttttcgtaaaagcacgagcttggttcaaccccataacccagggaatggcaattttgatcgccaatacttcaacaacatttcatagggatgaaagactcgggaatatgcatactatgcataggaaaatgcaaggctcacgcacgagcaaacatgaaaacaaaaggtatgcagtttgtagaacaaaaagtatgttgaacgcatatgcatga

SEQ ID NO: 95503 - DNA, 408 bp, Glycine max
  Peptide Sequence Number=SeqID_212281
gctgctaatgactgtgaccttgagcctgttgcttatgaatttttcactcaggcatttgtattatatgaagaagaaattgcggactccaaagcccagagggaaagggaataccagggcaatcattcaacttctgctcctaagtattcagcaaagcttttgaagaaacctgatcagtgccgagcagtttatgcatgctctcatctcttttgggttgatgatcaagatggtattaaagatggagaaagaggctcttcgctatgcgaaggtatgggggagggatgttgtacgcagccttacccttgcatatgcaaagaggctgtttccggattcgaacctatgaccaacaagtcaccaaggcacaactttaccgctgcaccagggttcgccctctatgcttctgcatcatga

SEQ ID NO: 95504 - DNA, 1706 bp, Glycine max
  Peptide Sequence Number=SeqID_212282
atgccctttgcttctgcttccatggaaaaaaggagtgaagagctaggattaagcttaatgaacactgattctgctaaccatgacaggattcctggtgttcgccaccagaatgatactaccgtccctctgcctctggtttcaccatctcctttcccccactggcatttgcatgagacatcccaatattataacaatgaaccagctggagttaattcaatgattgattcctctcagttcagaagttatcagaatttccagatggaccataattactatcacagagcagaacataatttccttccatgcgaaacagattcttgttttccatgtccagaaggatacatagggtggccgtatcaatatgataggcacaataatctgacaatccctgtcgatgtgagggatgcttccttcaatctaaataattttgagaagcctggcaatggtgggatgtgtgtgaccccaagttatggttcagctagcaggctacaaatggccaaccctagtggagcatcaatgagtgctaatactggtcagccttcactagatatgaatttgggaatggctctgtgtaatccaaataaaggttgtgtagaaccattgcttacaataggaaaacgtgatgaaagatttatgaccactggttctggaagtaataacaaagagtccaaatccagtgctgtaacactaaaattcaatttgactggtaattctgacagggaatttcttcctccagtcaatatatatcacaatcaactgggtagcagaagttccttaaaccctggtttagacatgaatgccaccttttctgcttttcagaatgacagtgaagtcatatctgatttagctcctgcaagcaatcatgaagctctgtttgattctagacctggtttacgtttggggccatcatatgcttttcaatggccagctgctggagaccaaaaccattatttagggcaggtcaaccgggatttaggtcttggaggtgtgaaagacacaagtatggaatttacagctgtaggtcacaaaaatggccttggatgcatggatctaaattcattgccaattgttggcagtctaactatgccttttgaaagtggacagagatgggcgaatagacagttagctccctcttcaagtggaacggtaactgataagttgcctactgagctgttacctaaaaataatgataagttctcattacagcttttttctagtcctcctttagctgtggccagtggaagcacccgagagcaagatctttcaaattcatggcctcctgtaggtaatcatggtcaatcacaggcaggtggttctattcagcaatcaaactctcttcttcgaccacagtctacttctgatgtaggaatacaagctggaaagggatacattactgctcaagtttcaaggccatccaacttgtcatctctaaagagagctgcttcccaaccactgtcatccactatccagaatcaacaaaggaagactctaccaactcagttcatacatccatcaattccaactccttggaccagattggctccatcagtcccaaatacatcccgggcaatgtctcccttggtccgtccagccctgtctctcacaccccaagctcctcactctgttgttcctccatcattccctatgacttggactaaatctgttctacaagccccaaacacaacctgggcaattcctcccagaat

SEQ ID NO: 95505 - DNA, 890 bp, Glycine max
  Peptide Sequence Number=SeqID_212283
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgcgctggagcctgcccaggcgctgcaagcggcaggcttgcagcgcccgctgcaagagctgcggctggcgctggccagtggcggtcgccccgtgtatgtggccacccccgccactgaacttgagcccggcagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 95506 - DNA, 849 bp, Glycine max
  Peptide Sequence Number=SeqID_212284
atgactatggcattgaaagaggctattaaaatagagttgtcacataaaggatccctagagtcactaataattcagccggaactacaacaattaggcgcgcgtgtcagcactaagggaagtaatgctcaaagcaatgcccagccttcacgggaatatgatggtgatgtgataccaaagatgggactgtatgtgcaacgtaaggatggtacactagggttggtggccatggggagaataatggatagggattcagtgatacgcactgtggcttatgcagatgatgttgtaagggtaagtgtggatacagttatcgatcctgacgctgagatcccctatgccacctcagaaattcaatatgtgaagcagacccttcatacatttgtagcttggcccacagaccttgttaaacttgtattagatgaggatgaagtaattattccgcacaaagtggatgcacatggagataagccgactaatgtggaagcagatgatccaatgcgtggcctgataaagtacagctttgatatttacaacaacccagtggaattcaaatttgatgggagtaaatttggaattgtagatgcacctacatcgatattcctaacatattctgatgttagtgaaataatagcaggagacaaaagtttgaacatatctgtacaacaattatggttgatgtatatgcatgagtggagtgaaaccttgggtcaaggttccaactatgcattccttgagccacagtcgttggtggtttcaaaggatacacatggcgaatgcgaaaaatatcttgaaagatggctgaaggaatctgaccgagaggtgtacattggaccttacttccatcagtaa

SEQ ID NO: 95507 - DNA, 1215 bp, Glycine max
  Peptide Sequence Number=SeqID_212285
atggagtccctcaccctttcagttactgtagccgtagttgctttttctatcctcttgttcctcctgctactcactagaagacatgcgggagtcggagccggagccggagccggatcacttcccccagtaccagcggttccaggattaccagtgatagggaatcttctgcaattgaaggagaagaaaccttacaagaccttcacacatatgactcacaaacatgggcccatctattccatccgaaccggtgcttccactctcattgttctcaactctccccaccttgctaaggaggcaatggtcaccagattttcatcaatttcaacaaggaagctatccaatgcactcaagattctctcttctgataaatgtatggttgccactagtgactacaatgaatttcacaaaacggtcaaaagacatattcttactaacctctcaggagccaatgcacagaagcgacaccgtatccgcagagaagccatgatggaaaatattttgagccagtttagtgaacatatcaagaccttctctgatttggcagctaattttaggaaaatattcgctactcaactatttggattagcactgaagcaagctctgggaagtaatgtagagaccatttatgtggaggaacttgggagtacattatcaaaagaggacatatataagattctagtggtcgatatatcggagggtgcaattgaggtggattggcgagatttctttccatacctgaagtggattccaaataggaggatggagatgaaaattcagaatctgcatgtgcgcagaaaagctgtcatgaaggccttgatgaatgagcagaagaacagaatggcttcaggaaagaaagtacattgctattttgactacctggtgtcggaagctaaagaactgactgaagatcaaatttccatgctaatctgggaaaccattattgggacatctgatactacattagttacaactgaatgggctatgtatgaacttgccaaagacaaaacacgtcaggaccgtctttatgaggagctccaatatgtatgtggacatgaaaatgttatagaagaccaattatctaagctaccttacttgggggcagtattccatgaaactttaaggaagcatagtccagctcccatggttccaccaagatatgttcatgaagacacacaattgggaggatatcatattcctgcaggaagcgaggtctag

SEQ ID NO: 95508 - DNA, 1413 bp, Glycine max
  Peptide Sequence Number=SeqID_212286
atggccgcttcaacgccatactctctcttccttctttctctttacctcgtcattggcattgccagtggcgttcaaaccaagaccttccacttgcagaggaaactgcagcatggcaccccggagtgcctcctcccccaatcaagaaaggagaaaggcgctattatactggaaatgaaggacagaggtgagtgctcagagtcagagagaaaaggtgattgggttgagaaacagttggtactggatggtctccacgttcgttcaattcaaaatcacattcgaaaaaggacctctagtagccaaattgcagattcctcggaaacccaagttccattaacttctggcataaaattccaaactctaaactacattgtgacaatgggattgggtagccagaacatgagcgtgatagtagacactggaagcgacttgacatgggtccaatgcgagccttgccggtcatgttataatcaaaacggacctttgttcaaaccttctacttccccttcctatcaaccaattctgtgcaactcaacaacctgtcagtctctcgaattaggagcatgtggcagtgatccatcaacatctgcaacttgtgactatgtggttaactatggtgatggatcatatactagtggggagctggggattgagaagctgggttttggaggcatttcagtgagtaattttgtgtttggttgtggaaggaacaacaaaggtctctttggaggagcctcagggcttatggggttgggaagaagtgagctctcaatgatctctcaaaccaatgctacatttggaggagttttttcttactgcttaccttcaactgatcaagctggagcttcaggctcgttggttatgggtaatcagtctggagtattcaaaaatgttactcccattgcctacaccaggatgcttcctaatcttcagctgtccaacttttatatactgaatctcactggcatagatgtgggtggtgtgagtctgcatgtgcaagcttcaagttttggaaatggtggggtaatacttgattccgggacagtaatctcaagactggctccatctgtgtacaaggctctgaaggcaaagttcttggaacagttttctggtttcccttcagcaccgggcttttcaattttggatacctgctttaatctcactggatatgaccaagtaaacatacctaccatcagcatgtattttgagggcaatgctgagctgaatgtggatgcaactggcatattctatttagttaaagaggatgcttcgcgggtttgtttggcgcttgctagtctttctgatgagtatgaaatggggatcattggaaactatcagcagaggaaccaaagggtgttatatgatgccaaactctctcaggtaggatttgctaaagagccttgcaccttcacttga

SEQ ID NO: 95509 - DNA, 1554 bp, Glycine max
  Peptide Sequence Number=SeqID_212287
atggcagttgttgaaagaaggagggaattgatattcaggtcgaagcttccggatatctacatccccaaacaccttcccctccacacatactgcttcgagaatttgccagagtacggtgcacgcccctgcttgatcaatgcccccacgggagacgtctacagctacgaggaggtggaaagcaccgccagaaaggtggcgcgggggctgaagaaagagggcgtggaacagggccaggtcatcatgatcctcctccccaattgccccgaattcgtcttctcgtttcttggcgcatcccaccgcggtgccatggccactgctgccaaccctttcttcacccccgccgagattgcaaagcaagcccatgcctccaatgccaagctcctcatcacccaggcctcttactacgacaaagtcaaggacctccgccacatcaagctcgtattcgtcgactcttgtcccccccagcatctccatttctcacagctgtgtgaggataatggtgacgctgatgttgatatcaagcccgatgacgtggttgcattgccttattcttcgggaacaactggtcttcccaagggagtgatgctgagccacaaggggttggtgaccagcattgctcagcaggttgacggtgataatcccaacctctattaccactgccacgacaccatcctctgcgtgcttcccctctttcacatttactctctcaactccgttcttctctgtggcttgcgtgccaaggctaccattctcctcatgcccaagttcgatattaactccttgcttgctctcattcacaagcacaaagtcactattgcccctgtcgtccctcccattgctctcgccatctccaaatcacccgatctccacaattacgacctgtcttccatcagagtcttcaagtccgggggagcccctctcggtaaggaactcgaagacactctcagagctaaattccccaacgccaaacttggccagggatacggaatgactgaggcagggcctgtgctaacaatgtctttagcttttgctagagaaccgatagacgtaaaaccaggtgcatgtggaaccgttgtaagaaatgcagagttgaagattgtcgatcctgaaaccggtcattctttacccagaaaccactccggcgaaatttgcatacgaggcgaccagattatgaaaggtgacatcggttacatcgacgatgacgatgagttattcatcgttgacaggctcaaggaattaatcaaatacaaaggatttcaagtggctccagctgaacttgaagcccttcttctcactcatcctaagatctctgatgctgctgttgttccaatgaaggatgaagccgcgggagaggtacctgttgcatttgtggtcatatcaaatggttataccgacacaacccaggatgaaattaagcagtttatctccaaacaggtggtgttttacaaaagaataaaccgagtattcttcattgatgcaattcccaagtcaccgtcaggcaaaatcttgcgcaaggatctaagagcaaagctaacagcaactgttccaacatga

SEQ ID NO: 95510 - DNA, 1071 bp, Glycine max
  Peptide Sequence Number=SeqID_212288
atggagatttgccgcaacatcattttccccctcaggcgtctctgccttgctctctctgctcgcctcaagcctcgcaaaaacggagctggactgctcaagcttcaggatgatgtacagacatgcggatatcaagatgtacaagtgatgtgggaaatgctacagagaacagaagcattttggaacaaatgctatgaaattgaaaactttgcaggctttgctggagctgaaccggcatcacttgctggtacgggtgatattagcggaacagatacttatggtcaggctgcttcaaatttagttgctggtagtagtcttgagcagactattcagcaaattatggacctgggtggtggcagttgggacagagatacagttagtcgtgctcttcgagcagcttacaataacccaaagcgtgctagaattcctgaagcagcagaaattgctgtgccagctgctccttacccaatcagtcaaacaacggaaacaggtggggtcaccgccggggctgtttctggggtaatacttatagttcaaatggatcatcagaagtttttgtaccttgtcaccgccggggctgtttctggtgctggagctggaattggatcccttgagctttataagaaatgccaagacataaagcaaaaatatttgttgttggagcattctcgtctgttacaattattttatggtttatatgattggattggagctatttggaaatgtatgatgaatatgcatatgcctagtcaatatactgcaggcatttttagtttcaagcattacgctcaatggtgcaatccaatccacaaattctgcagacttattcaagagcatcatggtgaatttctccagttgattaacgatcctgttgagggttctgaaggtgatatatttgatcaacctgagcaagatatgcctcatgctatcaatgtgacgccagcggagcaggaggcaattggaaggcttgaggctatgggatttgatagagcctcagtcatcgaggcatgtgaccgtgacgagcaattggcagccaactacttactggaaaatgctggagattttgaggattaa

SEQ ID NO: 95511 - DNA, 318 bp, Glycine max
  Peptide Sequence Number=SeqID_212289
atggcaaagaagacggtgaagaggaagggccacaaacacaacgaaaagggagaagcgaaggtcggagggaagaatgcagcggccgggggattccgtgcggaaccggtgactgatggccccgggatgggggagggtgcatggtgcttggcgttaacggagagatgggaaactgtcatgggaaggggacacggtgtggaagaagatgggaaaagttggctgattaccttggaaagcaatgacatcgaatttgaaatccatggaagcttggtggcggcggaaggtttggcacctcgattctacactagtaatttctactga

SEQ ID NO: 95512 - DNA, 721 bp, Glycine max
  Peptide Sequence Number=SeqID_212290
ggttgttcagcaatccctactcggttcaatcttgtcaaatatgcttctagttcttggctgtgcattctttactggtggccttgcccactacaaaaaagtacaggtttttgataaggcggctgctgttgtcaattctggcttactcttgatggctgttatgggaatactatttcctgctgtgctttactttactcactccgaagttcatcaagggaagtcagtcttgtctctttcaagatttagcagctgcataatgctactggcctatgcaagctaccttttctttcaacttagaagtcagcaaaatgtttatagtccggttggtgagggaggagagaatggtgaaaattctgatgtggaggaagatcttgaattaactcaatgggaggcaataatctggcttgctatcttgacagcatgggtatctatattgtctggataccttgtagacgccatacagggagcatctgagtcattgaatatgtcagtggcttttatttctgtcatcttgcttccaattgtaggcaatgctgcagaacatgccagtgctatcatgtttgccgtgaaggacaagcttgatatcactattggagttgctattggatcatctacacagatatctatgtttgtggagaaagttgatgattcttattctcttgaaaattgtagatccctttctgtgtggttgttggatggtgcatgggaaaagaaatggacttaa

SEQ ID NO: 95513 - DNA, 966 bp, Glycine max
  Peptide Sequence Number=SeqID_212291
atggactcaacaactgcagtgttgctgatatttgtttcagttctagtgtgctgccacagtactgttatcgtatccaaggatgggagtggaaattatacaacggtgagtgaagccattatgaaagctccggacatgagtgataagccttacaccattcacgttcgagccggtacttatgaagagtacgtaaccattcctgctaaaaagactaatattaagctcgttggagatggacctcacctcaccaaattagttggctaccaaaatggttccaccatagacgtacgaggagatgggttcatggcagaaaagatgggatttgagaactgggcagggctgaaggcaagcgcggcggtggcggttaggaatgaggcaaagaagagtgtattcttcgaatgctcaatccaaggagtccaagacacactttgggcggtttcggggagtcagttctacaaaaactgcgacatctacggcacggtggacttcatatacggcaacgcagcggcagtgttccaggactgcatgctgtacgcgcgatacagcgagtacgtgaccttcaccgcacagtcgcgagaggatccaaaggagaagactggcttcagtttccaaagatgcaaattcacaatgtccccacaggactcggctagaaaatcgaaggtgcttcgtgcaacgctggggcgtcctttgagagcctattccacagtggccattttccactcttacatcgactccatggtcgatcctaaaggttgggagcccatggcccaccagcccactgacaaagtcacttacatcgagtttcataattttgggccgggctccaaaactgaccatagggttgactggcctggtgttaagcaaacggtggatgctttacctgaatcgggttatactctaatcaaagaacaacagttgataatggaaactgaactttcaaaggaatacatgaagaacatagatgactaa

SEQ ID NO: 95514 - DNA, 1998 bp, Glycine max
  Peptide Sequence Number=SeqID_212292
atggagacggcgtggtaccaaaggagcctctctctcctgcctgcgctcgagggagcaattgaagagaagaagaatgaggctgtccctgttgctcctgctgttggaatggaatttgacagctacgatgatgtctattacttctataattggtacgccaaggaacagggttttggggttagggtcactaatacctggtaccgcaagaccaaggaacgttacagagccaaacttagctgcagcagtgctggcttcaagaaaagaactgaagccaatcgccccagacccgaaaccagaacaggttgtcctgctatgatcaagttcaggttgatggactccactagatggagaattattgaagttgagcttgaccacaatcacttgattaaccccaccagtggaaagttttacaagtctcataagcatattcctcttgggaccaaaagaaccttccacttagacgacgaccatgaccaccaccaccacttagatgcagctgctgctcaacaggttcacaaaattaccatgtttcgaactgtcatagtcgatgctcaggatgaaggggaatcccaaaacgccctctattccaatcagttgaagctgaacaaaggcgattctcaagccattcttaatttttttagtcaccagcaattggcagatccacacttcttctatgtggtggatgtcaatgagaggggatgcttgcggaatttgttctgggccgatgcaaagtccagagtggcatacacttattttggtgatgttgtagcaattgatactgcgtgtttgacagctgaatttcaagttccactggttctgttccttgggataaaccaccataagcaatccatcttgtttggttgtggattgcttgctggtgacaccattgaatcatatacatggctgttcagggcgtggcttacgtgtatcttaggacgccccccacaagttatcattaccaaccaatgtggaatcttgcaaactgtggttgccgatgtctttccaagatctacacactgcctttgcttgtttaatataatgcaaaaaattccagaaaaactgggagtctgcattgattatgaagcaaccaatgcagctttgagcagagcagtttattcctctctgatggccgaggaatttgaagcaacttgggaggacatgatgaaaagcaatgaaactagagacaataaatggcttcaatctttatatgaagatcggaaacggtgggctccagtttatctgaaggaaatcttcttggcaggaatgcttccaattcaaccaagtgatgttgcatcatttttctttgacgggtacctcaatgaacaaacttctctaaaagaatttttagaaaaatatgatcagattttacagacaaagcgacaacttgaggctttggcagatttggactcaaaatcttctagctttgagccaaaatcaaggtcttactttgtcttgcaggtttcaaagttatacaccaatgaaatattaagaatgtttgaaagggaagtggaagggatgttttcttgctttaactccagacagataaatgctgatggcccagtcgtcacatacattgtccaggaacaagttgaagttgagggaaatcagagagatgcaagagattacaaggtgtgttataatgaagctgaaatggaggtcctttgcatctgtggtttgttcaatttcagaggttacttgtgtaggcatgctttatttatcttaagccaaaatgggataaaagagatcccagctcagtacattctttcacgatggagaaaagatatgaagcgtagcaatgttgatgatcacaacggtggtggcattcatattagtaatccagttcataggtatgaccatttatacagacaggttgtgaaggttgtagaggaaggtaagaaatctcatgatcattacaggactgcggtacatgcattggagaatatattgagcaagcttcatcttgttaacgttgaggatcccaatataatgtacaagtattga

SEQ ID NO: 95515 - DNA, 368 bp, Glycine max
  Peptide Sequence Number=SeqID_212293
caaggagggaaacaaccacaatgggaagcggacccgacaaggttgtggggggcagctgtatgggttcaaaaagtggaggtgatggtggaggtggcgacggaggcggcatggctggtggagtttgcatgatcgtggttgcgataagcatgggtgatggagtcagctcgaacggcggagacagcggtggagtcagtggcgaagtccgcggcagaggcagtaatggtgcgagacttggtggtggtcgggttgccgaggtagtcataggagaagagcgtccagtcgggtgtcctggtggcggttccgagagtagtgtgggtggtaggcagccatggaaacttcgtatggtgagtgacaaccatggaagataa

SEQ ID NO: 95516 - DNA, 263 bp, Glycine max
  Peptide Sequence Number=SeqID_212294
atggggggttcggtggtggaggacaaccacgacctcgaccacgacctcgacctcgacgatactcccttagcatctgcctcttctaaatcccaccagcaattccatagcttcgatttcgaggatacaaccaagatcaacctcttgcttccctttggtccattcgccattctcctacattacgtaactggacaccatggatgggtcttcttcttcaccttattggggattactccttcggcagaacgtctcggttatgctaccga

SEQ ID NO: 95517 - DNA, 3261 bp, Glycine max
  Peptide Sequence Number=SeqID_212295
atgtccatgatttggattgttttcttttccttgtcttgcatgtcttgtgctgttgtttcttcactcacctccgatggggtgactctcttgtcactcttgaggcactggacatccgtgcctccttccataaacgccacctggcttgcctccgataccactccatgctcctcctgggtaggagtacaatgtgaccattcccaccatgtcgtcaaccttaccctcccagattatggtattgctggtcaattaggacctgaaattggaaatttaagtcgcctagagtacttagaacttgctagcaacaaccttactggtcaaatacctgacgccttcaaaaacatgcacaacctcaatttactcagccttccatataatcaactgtctggtgaaattccagattccttgactcatgctccccaactaaatcttgttgatctttctcataacactttaagtggatccatccccacaagtattgggaacatgactcagctcttgcagttgtatcttcagagtaaccagttgtctgggacaattccctcatccattgggaactgcagcaaattacaagaattgtttttggataaaaatcacttggagggtatcctgcctcagagtcttaacaatctcaatgatcttgcttattttgatgttgccagcaatagacttaagggtaccattccttttggttctgctgccagttgtaaaaatttgaagaatttggatctctcattcaatgactttagtggaggccttccctcaagcttggggaactgtagcgctttatctgaattttctgccgtgaactgcaatttggatggcaatattcctccctcctttggtctactgaccaagctttctattctataccttcccgagaaccacttatctggaaaagtacctccagaaattggcaactgcatgtctttgacagagttacatctgtattccaatcaacttgagggaaacattccaagtgaactgggaaaactaagaaaactagtggatcttgaattgttttcaaatcaattgacgggtgaaattccactcagcatctggaagattaaatctctgaagcatctccttgtgtataataacagtctttctggggaacttcctttggagatgacagagctcaagcaactgaaaaacatctcattgtttagcaaccagttctccggagtcataccgcaaagcttgggaattaacagcagtttagttcttttggattttacaaataataaattcactggcaacatcccaccaaatctgtgttttggcaagaaattaaacatcctgaatttgggcatcaaccaacttcaaggcagcattcctcctgatgttgggagatgtacaacccttagaaggttaattcttcaacaaaataactttactgggcctcttcctgatttcaaaagcaatccaaatctcgaacatatggatatcagcagcaacaaaatccatggtgaaattccatcaagtttgcgaaattgcagacatatcactcacctaattttgtccatgaacaaatttaatgggcctataccctcagagctagggaacattgtcaatcttcaaactttgaatctcgctcacaacaacttagaaggtcctttgccctctcagctgtcaaagtgtaccaaaatggacaggtttgatgttggatttaatttcctaaatggttcattgccatcaggtctgcagagctggacaaggctaaccacattaattttgagtgagaatcactttagtgggggcctcccagctttcttgtcggaatataaaatgctttctgaactacaacttggtggcaatatgtttggtggcagaattcctagatcggttggagcattgcagagtttgaggtatggtatgaatctgagttcaaatgggctgataggagacattcctgttgagattggaaacttgaactttttggaaagactggatctgtctcagaacaatttgaccggaagcatagaagttcttggtgaactcctctccttagttgaagtcaatatttcatacaattcttttcatggtcgtgtaccaaagaagctaatgaaattgctcaagtctcccttgtcatcatttttgggcaatcctggcctatgtaccaccaccaggtgttcagcatctgatggcttggcttgcactgcaagaagctctataaaaccatgtgatgacaaatctactaaacagaaaggcctcagtaaagttgaaattgtgatgatagctctcgggtcctcaatacttgttgttttgctgttgctgggattagtttatattttttattttggaagaaaagcttaccaggaagtccatatctttgctgaagggggttcttcttcccttcttaacgaagtcatggaggctacagcaaacctaaatgatcggtatattattggcagaggagcctatggagttgtttataaagccctggtgggtccagacaaagcctttgctgcgaagaagataggatttgctgcgagcaaaggtaagaacttgagcatggccagagaaattgaaacccttgggaaaattcggcatcgaaatctggtcaaattggaagacttttggttgagagaagattatggtataattttgtacagctacatggcaaatggaagtcttcatgatgttttgcacgaaaagacaccaccactaaccttagagtggaatgtccggaataagatagctgttggaattgctcatggattggcttatctccattatgactgtgatcctcccatagtgcaccgagacatcaagccaagcaatatacttctagactctgatatggagcctcacattgctgactttggtattgccaaacttctggatcagtcttctgcttcaaatccttccatttctgttccgggtacaattggttatattgcaccagagaatgcttatacaacaacaaatagtagggagtctgatgtatacagttacggggtagttttgcttgagctgataaccagaaagaaggcagcagaatcagatccttccttcatggagggtactatagtagtggattgggttaggtctgtgtggagggaaacaggagacattaatcaaattgttgattcaagccttgcagaggaatttctagatatccatataatggaaaatattaccaaagtgcttatggtggctctgagatgtactgagaaggatccacacaagagacccacaatgagagatgttaccaagcagttagcagatgctaatccacgggcaagaagtacaaagggctag

SEQ ID NO: 95518 - DNA, 393 bp, Glycine max
  Peptide Sequence Number=SeqID_212296
atgcacctagcaactcccgtgaccttactgcttctttctcttcctccttctacgcaacctttgttggcagcgtgggttgattcttcttctttctcctcctcctcctgtgcgacctcgattggtggtggtgcttcaccttgcagcgcgttcttcttcttcgttctactgctcaccattgctgacgacgtcgaggctagtattgatccgcatagggatttaggtcttccgaggcatgtcatcgcgaagacgttggagcagcatctaaatgaagtcacgccagacacatcgacacatgagatcatccaaaaatgtctcaggattgtcagggttgtcacagaagacgacaatctgtatgtgaggtctcaacgtagacggtgcacggatcagccatag

SEQ ID NO: 95519 - DNA, 246 bp, Glycine max
  Peptide Sequence Number=SeqID_212297
atggaaataaatatacatcccgtcgaatttcgagataagggtaagaaggaaaatgagaagtcagaaatggagatgggtaagcaaaactcgaccaaatccaccctgttgccatgcctaaggattatgcagtggcagctgataaattgcctttcctcgatgcttattataacgtttgaaagcagagaattgttaaaagcaagaacctcttcttcaaggaccgcaggaataaaagcgcagttagattag

SEQ ID NO: 95520 - DNA, 472 bp, Glycine max
  Peptide Sequence Number=SeqID_212298
tactggtgcagcatcacagttgccatctaccttgaagcggacaagaaaagcaacacggctaagatcattggcgactagaccagttggggcagagagaccgctggtccatgtcgatcctgtgactgggaagggcgacggtccccacataaagaagttaagaacatatttggggatcgtcgctcatgataaggtcgatgtcacatacgagaattggaaacaagtccctgctaatcagaaggatttgatatgggaggatattcaactgaatttgatatccctgaaatgggcactttcagccgacaaggaaagtgtcgatgacactgtatgcgaaaagtacgacattagcaaggagaagtggacccaattttgtcagacccgtaggcatatggctgagacaaaattcaaaacgggatgtgtacctaggagcctacctgaatggggcacattggcaaatggtcatcattttgcctaa

SEQ ID NO: 95521 - DNA, 252 bp, Glycine max
  Peptide Sequence Number=SeqID_212299
atggtaaagaaagccaaggaaagtttgacgctaaggcagatgagggtattttccttggatactttggaagatactcaaaatgaagaaagaaatatgaaaagaaagagagatgatgaagacaaggatgatcaagatgacacagcacaagaaaatgataatcttcctaaagaatggaaaacttcaaaaaatcatcctcttgacaacatcatcggtgacatctcaaaaggggtaacaactagacacccctcttaa

SEQ ID NO: 95522 - DNA, 232 bp, Glycine max
  Peptide Sequence Number=SeqID_212300
tggcgtctacccagacttatcttccttcactggaagtggcgtctaccctgacttatcttccttcaccggaagtggcgtcatccaaacctccgtagcctgtatcaaacgatccgccccgcaagattcacatcacaaaggaagtgttgatcctagaaccggagctctgataccaaatgatatgaaccctcatggcacaagggctgacttaggatcgtctaggattaaaccttga

SEQ ID NO: 95523 - DNA, 522 bp, Glycine max
  Peptide Sequence Number=SeqID_212301
atggtgcaaggaacttttggctacctggatccggagtacatgcttacaagccaactaacggagaaaagtgatgtctacagctttggggtggtgcttgtagagctgctaacaggggagaaacctcattcttttggcaagccagaagagaaaagaagtcttgccaaccactttctatcttgcttgaaagaggatcgcctgtttgatgtttttcaagttggcattgtgaatgaagaaaataaaaaggagatcgtggaggttgctattcttgctgcaaagtgcttgagactcaatggagaggaaaggcctagcatgaaggaagtcgcaatggagttggatgcaatacggcaaaaggagaagcacccatggatcagtggagaccaaaatatcgaggagacccaattcttgcttcatgatgcatcatctagcatttatgcagatggtgatagcagcagccaccaatatactactgggtatgacagcatcagggatcatgtattaattgcattggataatggaagatga

SEQ ID NO: 95524 - DNA, 339 bp, Glycine max
  Peptide Sequence Number=SeqID_212302
atgaacggtcttacgctggaaatatcttctgccgccattgaattaataaaaaagcatcaggggctttctctggagaaatatcgtgacgaacacggattatgggttatcggctacggccacgttatccgcgatcgggagcagtttcacggtcctgtcactccgctggaggccgacgcgctgcttcacgaggacattcgcttgtgcgaggcgctgctgcgggaaaatgtgacacgtccattaacccaacagcagcatgacacgctggtgatgatgatgttcagcttcggagagataccttcgctgccggaagcgatttttcaggccgtcgcccgggtgtag

SEQ ID NO: 95525 - DNA, 1046 bp, Glycine max
  Peptide Sequence Number=SeqID_212303
atggtcggcgggcgccgcgttttcgctcttcggcccggtgctctgccgttgatactgctcggcaaactgcagcagcgcaggcacgccgtcgtccgcctgcgcaacgccggtgaacagcagagcgacacagccgaacagacgcagcctcatttaacctgctctccgcgatccgccagcccgcgcatccaccgtctcctgcgtgtcgccgtttacccgcgcgcgcagattggcgtactgcgaagcgccgctcatcaggctgtcgaaggcctgtttatagcgctgatgctgcttctcgttgatgttgctgctggcactgctgcagctgctcggcctcacgctgcttgcgcaaagcctcttctgacggcgcttgcacagcctgattttgggtgcggcggcgctcaacgccaacaggcacagcaggcccatgcgcagggtgcgattgaggggctttatcatcattgcgttttttgtccttgtagacgcttattcgtattccagcgtaaaagtggccaccgcgctgaaggtgccgcggccaatggtcttcgtttggatagcctccggctccccctgcacataggcctgcagcgtgagcgtggtgttgccggcattcaggcggaatttatcgctggcgcgattgagcggcagcgccttgccgctgctgtcctccagcccgatgccgatccccgaagccatgctgccggcatccagcgccagcaggccgggcagtttggcgttctcggtgccggtaaacgtaatggccaccgtattgcccaggctgagatcgcactcggtcaggtgcaacgcgaaagtttggctatgggtgcgggtgttcagatacagcgtcccgtgaaagcgcatgttttccgccgcgtccgccggctgtgccatcatgccggccaccatgaccatgcctgcccccaacagcgcgctccggcgccggcggaaatcgatcgccgcacggtaggcgccggcgctcagcgtcgccggggtgcgcaccggcgtcaccgtatacgtcagggtgttttgtcccggcgtcagcaagatcg

SEQ ID NO: 95526 - DNA, 114 bp, Glycine max
  Peptide Sequence Number=SeqID_212304
atgcagtatctaggaagtgatcctaggtcgtctcccaacgagcaatggtcaatcaaagctgcctgcaccagcgatttcaacctagaaatcaagagtagtgtttatgttgcttaa

SEQ ID NO: 95527 - DNA, 1389 bp, Glycine max
  Peptide Sequence Number=SeqID_212305
atgtgcgccgcgcatgatctgaccaaagcccatcagcatgccgagcgcaatgccgccgcaccagcaccaccaggccaggcgcgggcgctgcggataaaacaggaaaaacaacgccatgaccgcgaaaccgctcgaggcgtgcccgccggggaaacagcggccggggcccggcagcgccggcaccgcaccgaacaacgggaaggacatcgccttgccgccgtactcgatcagatcccacggacaggagtgcgcgctggtggccttgagaatgcccaccaccagcgggccgatgccgagaagcaacatgctgacgatcaggcgcgcgctgcggcgatagatgccccaaaacagcgccagtatcgccccgacgatcactatttgcttcagcaggcggtggttgatcagatccagccaatcattgttttgccacgggaaatgcccgctggcggcatcgtaccaaaggttgccgatcgcccagtccagctgttcgctgcgggagagccacaggaacagcaggccgctgatcagcaggccaaaaacctgccaacgaataacgcgcgtgtcttgctgttggcggctgccggtgcggccttttctccgctgagctttggccagcctgcggcggccgggccgatcgtggtgcagggtgccatgccggtggaggcggaacgtttcgcccagcggttggaaaacccgcgcgaggagcagattggcggctggcgattttggcacggcaccgtagacggctacccggtggtggtgtcggagacgctgaagggcatgtccaacgccgcggcggccacggcgatcgccgccacgcagttccgcccggtggcgatcatcaaccagggcaccgccggcggccatgatccggcactgaaagtatatgacatcgtgctgggcaaatattcggtcaatctcggggcgttcaaaacgccggccaagatgttgggggaaggcagcgactcgcggcagtggcagccgatggatctgttggcttccaaaggcagcgccggcgaggacaaaaaggcgcacagcctgcgccagtttcccgccgaccccaacctgctggcgattgcgcaaagcgttaagagcgattaccgacagggcaaggtcgtggaaggggtgatcggctcggccgacgtgtggaacagcgagctggaccgcattcgctatttccacgacagctatcaaacttcggtcgaagagatggagaccgcctccgccgcgcagatcgccgccgaattcaaggtgccgttcgtcggcattcgcgtgttgtccaacaacatcaccaatcagggcaaatacgatccgcaaaccgggctggcatgccaggattatgtttatcaggtggtgaaggcctatatcgccaacctgaagaaacactga

SEQ ID NO: 95528 - DNA, 396 bp, Glycine max
  Peptide Sequence Number=SeqID_212306
atgaggggcgttgggaagacgcaactcaagattgcatcgtcattggtgtatggattattctgtgtgaggaaagcatccagatgttcatctagatcagtggttccatcgtaccactctaggttgagtggtttccaacctagggtgtgggagcagagtgctcgtcgccttagaggcatctcacacaagcctccagttgatcatgtatctgtcatggttgttggagaaggattgaagcctttggaaggggtttttcatctgaggccagaccgcgtgctcaccatgggtgaaaaaaagaaaggttgcagggtatgttttaccacgaccccacagtgggtgacaaatgcacttaccaaaattgggagcttcctcatgtcagggtggacatggctaaggtag

SEQ ID NO: 95529 - DNA, 645 bp, Glycine max
  Peptide Sequence Number=SeqID_212307
atggttgagtggggtctcggacttcatacgtcggcattgaaggtgcctttgacaggaggggggacttgcaaaacagaggactccgacgctcaaggagtttgtcctgtgtcgagggagtttgtctggggcgatagtcttgacaagcagaggcgtggtagccttgacgaatgtgagagtcacagttcgatgtggcttgtcaagcccctgagcctgggcatgcattgttcgtgctgcttgtgtcatgtcatctgtgatggacttgtttttggtgttccatgtgagctcccaccaattaccgaaaagttcatctcccctataaaatggagtggacatttgattcgagtcactgctcattgtcctcctgctttcttgcttttagattttcggcttccccttcttctttcttcgttgcttaagcccattagagattgggaagtcatcttgataggcggttcctggtctaaggatactcaccgtggtgcctctgacagtgagtccttttcctcgaagaggggcacgaccttcttcgactgcctgggagctagtcccggttactgtaatcctcccccttctgcttctggggtgcgaggagagctagtggtggtggagaggattgacgagaggctgagtgctcaccatggataa

SEQ ID NO: 95530 - DNA, 396 bp, Glycine max
  Peptide Sequence Number=SeqID_212308
cttatttttgaactgacggaaaaccactcgctcagtaatccggagcaggcgcaacaaaccctcgcgcggttgcaggagttgggatgccgggtggcgattgatgatttcggtaccggctatgccagctatgcgcggctgaaaacgcttaacgtggatatgctgaaaattgacggtagctttatccgtaatctggtcaccagtagtctggattatcaggttgtggtgtcgatttgccggttggcgcaaatcaaaaatatgcaggtagtggcggagtatgtggaatcgccggagatccgccaggcggtgatttcgctggggattgattatatgcagggctttgacattggaatgccggttccgatagaacaactggcctgcgcggctgacgtcgcataa

SEQ ID NO: 95531 - DNA, 285 bp, Glycine max
  Peptide Sequence Number=SeqID_212309
atgagatctttgtctcaacacattggagggtacatcctttgtggtacaagtagagggtacatctacttgggtttgactgagaacaagagaaggtacatctcttgtggatcagttctaatgaagggtacatccactaggttcaaagagaacaagggagggccactcgatccaacaccaccctcgcgcttagcctggctgaaggcacctactgcggttagcgcactgatcttgcgcttagcgcgcgactttgatgctaatgctctgccatattctcctttgcgctga

SEQ ID NO: 95532 - DNA, 231 bp, Glycine max
  Peptide Sequence Number=SeqID_212310
atgatgtcaacgtcatcacgtcggctcggcgactcctcaccagaatttcacttcttgcaccctgctgctgtcattctgctcccacgaacaatgttcgtgatcatcacagcccccctcccatatgtgatcagcctgggagcccaaaggtgttgcctaccaaatgacaagtcccctcagtacaaagtacacttgaccacagttattatatttcctgtgtcgtatgagctatga

SEQ ID NO: 95533 - DNA, 285 bp, Glycine max
  Peptide Sequence Number=SeqID_212311
atggaactaaaatttatcaaattgagtttgtgtctgcattttaatcttagaatgtgcgtattttacatgaatttgagaaatgatggtcccgccgaaggcagtggcgggactgccaatcagcccatcccgtcattactgttggtggtacccctctctcctcagcatgtcccgcaaatattgttggcggtacccctcggcatcccctatcccgccattgtcactgacggttcaatcttttcgccagtatcaatgatgacacctatatccagaagtgaccccccgtaa

SEQ ID NO: 95534 - DNA, 150 bp, Glycine max
  Peptide Sequence Number=SeqID_212312
atggaatcgcacgaagacagaaccctatcaaagcaatcagaggagaaacttgaggaatctcaagaaattgctagagatgccgttatcgctgccggaacatacgtgagcccgcttagaggtaagggatgcgtttatcgcaattggggttag

SEQ ID NO: 95535 - DNA, 1539 bp, Glycine max
  Peptide Sequence Number=SeqID_212313
atgaggcaagtgaagcaaattcatggttacactctaagaaatggcatagaccagaccaaaatccttattgagaagctacttgaaatcccaaaccttcactatgcacacaaggtgttgcaccattccccaaagccaacccttttcctctacaacaagctcattcaagcctactcctcccaccctcaacaccaacaccaatgtttctccctttactcccaaatgctccttcatagcttcctaccaaaccaacacactttcaactttctcttctctgcatgcacctccctttcttccccatcccttggccaaatgctccatacccatttcatcaaatcaggctttgaacctgacctctttgcagccactgctttgcttgacatgtatacaaaagttggtactttggagctggcacgcaaactgtttgatcaaatgcctgtgagaggggtgcccacgtggaatgctatgatggctgggcatgcaagatttggtgatatggatgtagctttggaattgtttagattgatgccttctaggaatgtggtgtcatggaccaccatgatatcaggttactcgcggagcaaaaagtacggggaggctttggggttgttcctgaggatggagcaggagaaagggatgatgcccaatgcagtaaccttggcaagcatttttccagcttttgcaaatcttggagcactggagattgggcagagggttgaagcatacgcaaggaagaatgggttctttaagaatttatatgtgagcaatgctgtgttggagatgtatgcaaaatgtggtaagattgatgttgcttggaaggtgttcaatgagattggcagcttgagaaacttgtgctcttggaattcaatgatcatgggtttggctgtccatggagaatgttgcaagacccttaagctttatgatcaaatgctgggagaaggaacttcacctgatgatgtgacatttgtggggctcctcttggcatgtactcatggaggcatggttgaaaaaggcaggcatatcttcaagtcaatgaccacatccttcaacattattcccaaactagaacactatggatgcatggttgatctcctaggccgtgccgggcaattgagagaagcttatgaggtaatacaaagaatgcccatgaaaccagactcagtgatatggggagctctattgggagcttgcagcttccatgataatgttgagctggctgagattgcagccgagtctctatttgcacttgagccttggaatccaggaaactatgtcattctttccaacatttatgcatcagctggccaatgggatggagttgcaaagctcaggaaagtgatgaagggaagcaaaattacaaagtcagctggacatagtttcattgaagagggaggccaactgcataagttcattgtggaagatagatcacatcctgaaagcaacgaaatttttgccttgcttgatggagtttatgaaatgataaagcttaatagaagtgcatttgaatgtcatttggatcttgatttgagcaactattcatag

SEQ ID NO: 95536 - DNA, 3015 bp, Glycine max
  Peptide Sequence Number=SeqID_212314
atgatggttctagatgtgttatctggtcctaccggaacggccatttctcaaactgtagataccattgctgacttcctagttactgccaatgatgtccttgtgcaaaaggatagttttaaggaacttgctgcttacatggaaagaattaagccagtcttagaagaattgaggaaaggaaaagtcagtgattctgagaggttcaaccgcaccattgagatcatgaataaagaaattaaagatgcaaaccaactatgtctagattgcagcaagaagagtaagttttatctactaatgaactgcaggtccatagctaagagcttagaaaaccacacaaaacagctgagtagggcacttggtcttcttcctttagccacaacaggactttcttcaggaataggtgaagaaattgaaaagctatgcgaagatatgaagacagctggatttaaggcagctctagctgaagaagagattttagagaaaatcgagtcagggataagggaaaacaatgttgaccgttcctacgccaataagttgctacttgacattactgatgctgttgggattgggaatgagaggtcaacaataaagatagaacttgaagagtttaagagtgagattgaaaatgcgcgtgttaggaaggacttggccgaggctatgcaaatggatcaaatcattgctttgttggaaagggctgatgcagcttcatcaactaaggacaaggaactcaaatactttgcgaaacgccaatctttgggtactcaaatcatggagcctttgcagtcattttattgccccatcacccaggatgttatggtggatcctgtagaaatttcatcagggcagacatttgagagaagtgccatagaaaagtggtttgctgaaggaaacaaattgtgccccttgaccttgattcctttagacacatcaattttgagacctaacaaaaagttgaaacaatccatacaagagtggaaagatagaaatataatgattacaattgccacattgaaagaaaaaatcctatctggaaatgatgaagaagtgctgcatgatctggaaactcttcagactttgtgtgaagaaaaaaaccaacacagggaatgggtgattttagaggattacatacaaactctcatccaaattttgtcaaaaaaccgtgatataaggaaattatctcttttcatccttggcatgctggcaaaggacaatgaagacgctaagaaaagaatttcagccgctgaccatgcaattgaatcgattgttcggtctcttggacgtcgtcctgaggaaaggaagttagcagtggcgttactgctcgagttatccaaatatgatgcggcacgagaacacattggaaaagttcaaggttgcatactactattggtgaccatgtctagtggagatgacaatcaagctgctagagatgcaacagagctattggagaatctttcgtactccgctcagaatgttatacagatggcaaaaacaaattacttcaagcatttattgcagcatctctccacaggaccagatgacgtaaagatgactatggccacaaatttagccgaaatggagttaactgaccacaatagggagtccttatttgatggtggtgtactggttcctcttcttcacatgttcttacataatgatctacaggtgaaaactgttgctattaaggcacttaagaatttatccagctcaaagaaaaatggacaggaaatgataagacagggagctgcacggccactacttaaccttcttttcaatcaaagcttacacaccacaggtttgtgggaagatgtagcagccataattatgcaacttgctgcatcaactatctctcaggattcccaaacacctgttttattactagattttgatgatgatgtttcccgtctcttcaatttagttagtgtcccacagtctgctgtgcaagtgcaacaaaacattatccagaccttttattccttgtgtcaaacaccctcagcttcatttatcagaaccaaactaatagagtgctcagcggttccagaattggttcaactgtgtgagaatgaaaacctaaacctacgagcaagtgctgtaaagttgttttcttgcttggtagagagttgtgacgaaggcatcatacaggagcatgtgaatcagaaatgcattaatactctactccagatcataaaatctccatctgatgaagaggaaatactttctgccatgggaataatatgctatcttcccgaagttgaccagataactcaatggcttttggatgctggtgcactgccaatcattaaaacttacgtccaaaatggggaaaacagagatcatcaaaggaataacttagtagagaatgccattggtgccctatgtcgttttacagttccaacaaacttggaatggcaaaaaagtgcagctgaaactgggatcatgactcttttagtgcagctgcttgaaaatggaacaaacttgacaaagcaacgcgtggcacagtctcttgctcaattttctaaaagctcatttaagctgagccggccaatatcaaagcgcaaaggactgtggtgtttctcagctcctgctgacattggctgcatggttcatgaaggaatatgctcagtcaaatcatcattttgccttttggaggctaatgcagttggaccactcacaaggactcttggggaacctgatcccggagtttgtgaggcttctttggacgctctattaacattaattgaaggtgaaagacttcagagtggtagtaaagtgctttcagaagcaaatgccataccactaataataagataccttggctccacctcccctggcttgcaggagaagtctctacatgctttggaaaggatttttcggctggtcgaatacaaacagatgtatggagcctcagctcaaatgcctctagttgacttaactcagaggggtaatggtagtgttaggtccatgtcagctagaatattggcacatttgaacgtgcttcacgatcaatcttcatatttctaa

SEQ ID NO: 95537 - DNA, 208 bp, Glycine max
  Peptide Sequence Number=SeqID_212315
tattttcgggccagatgtcctggacattgtatccgacatcgtggatcctgcagcttttgtcttgccttgtgcattgtgcagcaactccagtattttcgggcaggatgtcctggacattgtatccgacatcgtggatcctgcagcttcaattcttcatttgacattttatcttgccttgtgcattgtgcagcccgatcttattccttga

SEQ ID NO: 95538 - DNA, 914 bp, Glycine max
  Peptide Sequence Number=SeqID_212316
atgctggccgggtttacgcacgaacctgtggtggcgctttcagaaaaactctcggcgttaactggcttgggtcacgccttctatggctcggatggtgccagtgcgacggagattgcactgaagatgagctttcattattggcgcaatatcggccagccactgaaaacgaaatttatcagcctgcaaaacagctatcacggcgaaacgttgggtgcactcagcgtcaccgatgttgccatttttaaagacacgtatgcgccactgattttgcagtcggcgcaaatgcaaagccccgatagccggctggcggaagcgggtgaaacggaagaggcatatgctttacgttgtgctgaggcgctggaagcctatgtggccgagcatcatgccaccctggctgcatttattatcgaacctttggtgcaaggtgcagcaggcatggcgatgtatcacccggtgtatttgcaacgggcacgcgaaatttgcagccgttaccaggtgcatgtaatcgccgatgaaatcgccgtcgggtttggccgcaccggcaccttgtttgcctgtgagcaggcgggtgagaaagtgagcgatattgctgattttatctgcctgtccaaaggcattaccggggggtacttaccgttgtccgtggtgttgacgacagataaggtttatcaggctttttatcacgaccagactgttaaaggttttttgcatagccatagctataccggtaacccactcgcgtgtagtgcggcagtggctacgttgcaattgtttgagtctgcggatgtgctcgcgaataatctgcggacggcgcagaccttgctggcgtctgtcaatgaatacgactttgataggcaacatattcgccaacgcggcatgattacggcgtttgaagtcaccacagataacccgca

SEQ ID NO: 95539 - DNA, 516 bp, Glycine max
  Peptide Sequence Number=SeqID_212317
atggacggaatcgttagcgcgtgttgtggcgaggagagggtgatggtgttcacgatgaacagcaaggagtgcgtggacccggacctgctgcggccgggtcgagtcgacgtgcacatccacttcccggtgtgcgatttctcggcgttcaagacgctggcgagcagctacctcggcgtgaggaagcacaagctgttcgcgcaggtggaggagattttccggcacggcgcgactctcagccccgcggagatcagcgagttgatgatcgcgaatcggacctcgccgagtcgcgccatcaaatcggtgatcggggcgctgcaatcggacggtgatgggagaagatcgtatgctgattcgatcagacggcggatagagggtgatgacgtggacaaagcgccctgtggtggggacgggttctctacggttaaagatatccggaagttgtacggtttcttcaaattgcggaacggcagaagaacttctcaacaacagtctaattcctctccccatgatacttga

SEQ ID NO: 95540 - DNA, 510 bp, Glycine max
  Peptide Sequence Number=SeqID_212318
atggccatcgctgaagccttggaacgggaaaccaagagggaccggaaggaagaacacggccgaaacaagttccgaggagctttatggggcagcaacagtgagcttaagctccgaagaaatgaaagggatcagtcgcgggtcgaagtcatgatcttgaaggatgagttaaaggcttctcttaggtccaaaagaagtttgtcccaacagttaagcgagacagaagggaatatgttagccatcattgataaatacaaagaagagctaaacctagcggcaactcatgagcaaaggctaaaggatgagtacgccaaggtatcagtggaaaaggatgcgaaagggagggtaatcgattcattgtacagagaggcaatgatgtggatgaatatattcgctttcaccttgaatggaagtcaagagcttccccaactgctagctaaggccaaagcaatggcgaatgtctacctagccccaaagaaattcatgggctcctcaactattgcaagcacatga

SEQ ID NO: 95541 - DNA, 786 bp, Glycine max
  Peptide Sequence Number=SeqID_212319
atgaacccagaaatgaatggggttgaggctgagaagaggcaagagaatggacatgagaaagtggattatgatgtgcaagagaaaatagactatgtttttaaggtggtggtgataggggactcagcagttggaaagactcaaatactctcaaggtttgcaaagaatgagttctgctttgactcaaagtccaccattggggttgaattccagactaggactgtcactattaatgccaaagtcatcaaagctcagatctgggacactgctggccaggaaagaggggataaaccaacaaaaataaattctcacaaatttaacacattacataggtacagggctgtaacaagtgcatactacagaggtgcattaggggcaatgcttgtctacgacataacgaagaggcaatcgtttgatcatgtagcgagatgggtggaggagctgcgtgcgcacgcagatagctccattgtgatcatgttggttgggaacaaagctgatcttgtggaccagagaatggtaccaactgaggatgcagtggagtttgctgaggaccaaggcctcttcttctccgagacttcagctctcagtggtgacaatgtggagagtgcatttctcaaattgctagaagagatcaatagggtagtgtccaaaaaggctttggaatgtggtttagggaaggagaatggtgacaccaatgttgcctcactcaaaggaacaaaggttgatataatcttaggtcctgaattggaaattagtgagatgaagaaattgtcttcgtgctcttgttaa

SEQ ID NO: 95542 - DNA, 207 bp, Glycine max
  Peptide Sequence Number=SeqID_212320
atggcaccttgtgtgacaagcttgaactcggagttagagcttcaattggatccctgcagggggtgtgatgcgctgaaggtgcggtgcatgaaggtcgtagtgaagacattaaagatggaaaccatactgctagaagatgacaatgttgcaaaagcacttcttagctttatttcagagtcctgggttctgactcctcaaattttataa

SEQ ID NO: 95543 - DNA, 591 bp, Glycine max
  Peptide Sequence Number=SeqID_212321
atggcttctttgttcttgtacaccttgtgggcaggatatttggggtggcagtggaggagagtgaggactattcagaatgagattaatgagttaaagaaacaagtgaagcctaccccagtcaccccagaagaagtgccaccaccatcagaaattgagctcaaaattcagcaacttactgaggagaggaaagagctgctaaaagggtcttacaaggataggcattataatgcaggatccatacttctaggatttggggtgcttgaggctgttggtggaggattgaacacttggattaggacagggaagctattcccaggcccacatttgtttggaggagcagttttcaaacatgtagctttctggttcattgttggtatggaaaatgactgtttaggccaaattttgtctccagctattgcagtgttgtgggcactttcagcagcattggtaccatcaatgcagagagggagtgaaacagcaagaagtcttcacattgctttgaatacattaaacgtgctgctatttgtgtcacagcttcccactggatttgacattttattgaaagtgtttgagttcacaaactggccttga

SEQ ID NO: 95544 - DNA, 396 bp, Glycine max
  Peptide Sequence Number=SeqID_212322
atggccaacccaattccaattcgtccatggccccgcttaccttctctcgaagcaacaaacacttcctctcatgaaaaaaccaaagaaaacgaaacgaaagtgaaaggtattcttcacacaaacccttcgggttatgatgaggccaatggtataagggtcataacaattgtaggggaaaatagaggtgctgaaatgaaaataacccaatcccaaaagaaacagcaacccattcaaaagagtgataaagctgtgagaacactatcttccactccaataatgaatgttgtgtacagtactaacagcaatgtacagtgtgtcaacaactcactggtgttcaacagtactagttgcaaccaccataatccaggagtattgcaccttattatccccaattaa

SEQ ID NO: 95545 - DNA, 654 bp, Glycine max
  Peptide Sequence Number=SeqID_212323
atgactaacccaattccaattcgtccatggtctcgcttggcctctctaagatcagttcctgctccagagtcacatcctaaacctcacactgcagaactttctcttaaagcaacaaacaccttttctaatgacaacaatgaaagtgccacaaaatctcttccaataacaccagatcttcacagcccaattgaacaaaagctcaaactcactacccccatcacctttccaactgccaaattgaaggctcagcctcaaattgaagggaacattgaaaagcctgatggaaatggcaatggcattggccaaaaaaatgaaaaagaggttatgatgacaaccaaagaaaacgaattaatgaaagagaaaggtattcacaccaagctttcgggttctgggggtcaatatggcataagggtcataacaatttcaggggaaaataaaggtgcatgcattcaaataaccaaatcccacaagaaaccctttcacaaaatgagatccctgtatgctaacagcaatgtgcagtgtgtcaacaactcaatggtgttccacactagtttaacacaccatgatccaggagtgcaccttattatcccaaaaaaacaatttggcgagggattaatccatctcaaggaacgtgatagtggtcagcgcaattga

SEQ ID NO: 95546 - DNA, 870 bp, Glycine max
  Peptide Sequence Number=SeqID_212324
atgaagatcttcaattgggttcacaagaggtttcatcatcacaacactctgaaagatgggtttgctacaaacatgaaaaagactgaacctacaattaacaacacggatagtcaagctttgctgaaacaagttgccctcactgaatcacttggtggatgggaagatggcattctaaccattggcactctcggctatgatcccttaaagagcatcaaccctcacaaagaatactttgctttggagattgaagttgaacaagaagatggtgaaggagagaacaacatcatggttgatgatcatcaggaggaggaaaagggctataatgctgcgcacgaggaactgaatccattgatatacaactcatttgagcacaactttgaggtggatgttgttagtgaaaacaaccatgatgatggtgatgtggtagttagaagcttcaatgatgaaattgttgtggctccacctgtgatctcttatgaagtcatggaatcaaacgatgtggatgctgatgaaaagaagaagaaaggagaaaggatcacactagctgatctcttcttggctgacactgatgttaagataaagcttgacccttatgccaaagtctgccaccttgcttcaagtgaaaaaccaaaccttaaagcaaagcatggactctcttttgccaagaagctcattccccgtgttaaagacaatccccatccaatgaaagatatcaaaaaactgatgaagaagatgttgaagaggaaaatccacccggatcttgatgtcaagaatcacaaaccagaaggtcaggaagtgagtgcagcaggattaaacattgataatcacatgaatgaaggcaatggctcaagttatttccttccaatttaa

SEQ ID NO: 95547 - DNA, 177 bp, Glycine max
  Peptide Sequence Number=SeqID_212325
atggtaaacaaagtacaaacacatatttcaaagtttgactttaatgatctgagcgttagacacgatgtctcgtctgtggaagagactgagatgggttcaaaaaccaagacttttacctttgaagaggtggctaaacacaatcacaggaaggattgttggattatagtcaaagggaag

SEQ ID NO: 95548 - DNA, 477 bp, Glycine max
  Peptide Sequence Number=SeqID_212326
atgtcgtttgaggaattccaacggtaccccaaacaggctataaatgtattggaatacaagtgtgagtgtaaatctccccgtgtttactcccctcaattccccaacaactggtatcagagccaggtgtatgatgtcaccccatttttggatgatcatccaggaggtgatgaagttttagtgactgcaacagagaaggatgccaccactgattttgaagatattggccacagtgattcagcaacacagatgatggaaaaatactttgttggggaggttgacaccaacactcttccagcacaagttaccagcaacaacagtgtacgccaaccaacacaagcaccacctgcctataacaatcaatcttcaggatttgttgtgaagatgttgcagtacatagtgccattgctgatattggcctttgcatttggcctgcagtactatggcaaaaaaaacaagtccactgagtcagaaaattga

SEQ ID NO: 95549 - DNA, 537 bp, Glycine max
  Peptide Sequence Number=SeqID_212327
atgcaaaaagggaagtgggaaattggaggaaagaagagagagaggaggaaaaaggagggtggggcatttttgtccattcacctttctattggaggtgcaagaagcaaaaagggagtgcaggaagcaattacctgtagtggcagaacccctgcatggtttgagccatgggggagttcactagcacttgtagggctaggctatggtttagcttctccaggtcgtcaaaaacggtgtcattacagcggaacaaggtttgggagtgagagtgagaaggcatggagtggaaggcgcgtgactctgtctggacgaacttcatgtatttgtaggcatcttccagaagtgttgcctagtccattttcttgtcccacaacatcaacttctgaagacatcgcgttttctcgcttagcttttgacgacattggtgagtcaggttgctttgcgagatcactagaggacattgtgactccacgcgctgttgcttttgctctgacgagcaaaagggagggagacaatggtggtattgggggaagaagttga

SEQ ID NO: 95550 - DNA, 276 bp, Glycine max
  Peptide Sequence Number=SeqID_212328
atgccgactgcaccggaagctgttgagctgctatcctcgaattggagtcagatgaaatctaacatggtatcagagcggactctgaccctgggacctcgccttcgcttccgctgcgacgagcacccaccatttgtggttcacgcaccaagcccaacaagtgttgggcgtgaagggggtgtattgggaaatacccaagtcccacatcggctgcctcaatccttggagtgcagcttatatacctgttggacaacttcacttaatgccaattggttttaa

SEQ ID NO: 95551 - DNA, 847 bp, Glycine max
  Peptide Sequence Number=SeqID_212329
agggttacacgtcctccacttcagaggactacatgacctcccgtttagaggactgcacgccctcgccttaacaggactgcatgttctcaccttcagaggactacacaacctcgccttccgagggctagacgccctcgccttcagaggagtacacatcctccccttgagagggctacacgccctcgccttcgtaggtgggctacacgtccttgcctttagaggactacacatccaagccttcagagggctacacgtcattgccttaagaggactacatgtcctccacttcagaggactacatgtcctccacatcagaggactacacgttctcccctttggaggactacatgtccttgccttacgagggctacacggcttcaccttttcaggactacacgccctcaccttcagaggattacacgtcctcgccttcagaggactacacgtcctcaccttcagaggactgcacgttctcaccttttatcggctacatgcccttgccttcataggactacacgtcctcaccttcaaagggctacacgtcatcgccttaagagggctacacgtcctcgccttcagtgggctccaagctctcgccttcatagggctacacacccccaccttaaaaggactactcatcctcaccttcagaggactacacgtcctcaccttcagaggactgcacgccctcgccttcacaggattgcatgttctcacctacagaggactacacaacgtcgccttccgagggctagacgcgctcgccttcagaggagtacacatcctccccttgagagggctacacgccctcgccttcgtagggttacacacccttaccttcaaagga

SEQ ID NO: 95552 - DNA, 543 bp, Glycine max
  Peptide Sequence Number=SeqID_212330
atggagggcggcatagggtcacatactaaacatcactcccaaagaagagaaaaggataggaaggactcaagagagagaaaagttccattggctacccttagcttccaaggggtatgccctctattagtggacttcccctgttatggaaagaagggattcatgggggatcctctagtagagtattggaatgatcttaagagtgcccttaggaaaagacacattccttcctactatgaaatgaagcttatggacaagctccaatggcttagagaagggagtatgagtgttgaagaatatagacaacaaatggaactactctttttaagagctggacttagggaggaggaaagaacaagcatagctaggttccttagtgggcttaatatagaagtgagggacaaggttgaactctttccatatagggacctagatgagctagtccaactttgtataagagaggagcaacaacttaaaagaaagccttcttcaaaatcttatggctctcacttttatccaaggaaggaccaagcccatggaatttag

SEQ ID NO: 95553 - DNA, 1007 bp, Glycine max
  Peptide Sequence Number=SeqID_212331
acagaacgacgaaaaacggcagttcggacacggcggcgctcggcgccgaagccatgatccttcatcaccatcagcccctgtcaggccggcattccgcccggccttctcaacggcaaattttgtcgcgacgcggctttttcggcgccagcagataatccactacgctttcgtcaacgcagctgtcgatgccgttcagcgccagcgtatgcccgtcgcgttcgcgggtgatcagcgggcttttaaaggcggcggccatcacctgcgcgttgcggtacggcgtggtcggatcgtagcgctgggcgacgaacagcagcggcggcagcgcggcggacgccaccggcgtgtgcggccgatctttgccgcgatacggccacagatcgcacatctccagcgggtattcgtgcagcggcagatagtgggcatacaaagcggcggtattgatctcctgcctctgccggcgcaactgctgcggatcggccgtcgggttggcgacgtcagcgcaggtgatgacgttcagggcgtcatcggcatccggcgaatagctttcgtcgatcagatcggaaacctgctgcccggcgatcccggcatcgagctggcgcagcacggtcgccagctcatgccaacgctccggccacagcagcagcgaacgcgtgaccgtcagcacgtcgtcggcggagatttcataacccgccgcggtgacgaacggctgctcatgcagcttgcgcagcaaggcgtgatagcgctgcagcgcctgattggcgccgccacccagctggcagctgtcggtttttccgcagtaggcggcgaagcgcaggaagctttgctggaagccccgctcctggttcagccgctgggtgaaatcgtcctccgccagatccaccaccccgtcgagcaccagcgcgcgcgttttcttcggaaaacgctcggcatacagcgccgccaccttggtgccgtaagagtacgccaccgccgtcagccccggttcgcccagcgcgtggcggatcgcg

SEQ ID NO: 95554 - DNA, 342 bp, Glycine max
  Peptide Sequence Number=SeqID_212332
atggagcatgaaacattccatgcaacttggttggcagagattgatttctctcccaatggcttggatggtggaagcagtcaatactgtatcatcatcgtgattttgcaaagaatattactcggtgaaagagcagtctacgcaatgatgctggtgtttccacctgaattttctcctttgaaatctattttatttggaaatccttcccaagacaccgttgaaccactgatggaggctttggaggaagattataaagatggaaatgagataaatgaatcaaggcagtttattggaggagtattggatcttgaaaagagaatcaatagactagatacattgacttag

SEQ ID NO: 95555 - DNA, 332 bp, Glycine max
  Peptide Sequence Number=SeqID_212333
atgcccggcgcatgtcattgcgctacgaccgcagcaacaagcggatgtcctcacccacctgccgctgatccaccacgtgcagccgccgctgctggtccatcgcctcgatgccgaggccggccagcagcggacgaccgttatcgcccagcagcgtgggcgcctgatacagcagcagttcgtccacccagccgccgcgcagcaaggcaccggccagcgtcgcgccggcttcgcagtgccagtaccgcgcccaggtccaaccgcccatcaacgcagggtgcgctggcaaattcggcgtcggccgcatccggtgcgcttactgctgtgccatgcag

SEQ ID NO: 95556 - DNA, 375 bp, Glycine max
  Peptide Sequence Number=SeqID_212334
atgaaaatagagcagcttgttccttgtaaggtcacagcatatacgccgagaaagggaaggcaaactggcagcaactcttggctagtgtggcttagatgcaagagactaatagaaagtaacgtggccacagttgctatcaccagcgctgccactgaggcagatcctactcatccgtctaccatgaatcaagcccatcaacccaccccagacatggtgggacaagggggagaggtgttggggagtgccgatggcccgcacacggggtataatagaaatgcttatccctacagcttaccctccaattatacgccgcccaccatgcacgagaacgttgatcatgccattcccgttacctttgagggtcagcaaccctaa

SEQ ID NO: 95557 - DNA, 1401 bp, Glycine max
  Peptide Sequence Number=SeqID_212335
atgggtgatggcggttccggaaaagagccaccagatggtaggggtggcgataaacaacgtgtctattcaaagataaggtcatggggaaataaggcggttgctccaccacgtcaacaggaggatgctttggtcgtcaagcttcttggaaagagtattgtttacaatgtaatgaaaagcaggttaacacgactatggagattaacactagggttcgatatcctagatattggcaataatttctatatggtgaaatttgatacagagatggaccgaaccaaggtcatggaggaagggccatggatgatatttgatcattatctcagtacaaaaaatgctatctccaaagtgctggtcaacaaaatctgtcctcatttggatcacttgattggaccactgcaaagtagcttcatcaccaagagaggtaggtctgataatgctctattctgtcaggaatttgataatcaggtgtataagaagaagagaggaaaaaagggatttgtcatattcaaaattgattttgaaaaagcttatggtagagtggattggggttttgtaaaaatgacactacaagaatttggtttccctcctcagatagttactctaatcatgaattgcaccaattccaccaagctatcaatgaaatggaatggtgaaaagctaagaagttttgaacccaatagaaggcttagacagggagaacccatgtcactttatctgtttgtgctatgcatggaaaaattatctttgtttatacaacagaaggtgcaagagagagcttggttgccagtaaagcttaagtgtaatgctcctaaggttcttgatgctttctgtcatgcttctggattgtgtgttaatatccacaagtccaaattcatgacatccaataatgtgtctaatacaaaagtggataagtttaaaatgatctctcactttcatcacaccaagcaaataggtaaatatcttgggtttcctatgccgaaagggagaataaagaatagtgttttcaactttgttcttgacaagatcaattcaagactagctaggtggaaaatgaacttgttgaacagggcaggccgtgtgaccttacctaagtcagttctctccttaatgccaacacaagtcatgggtctagttattggagaaacaatacttgtatggggaactatattacatgcagaggcgatggaggatgcatcatatacatacaactccataataaaggacactgattttctcaaattgggattccaggaactccagaatcatgtcatcgataatgagatggatgatattatcatatggggaccttcaagcaatggtgtttatacgtctaactctgccttcaaatggttaatggtcgaaagtccatcacctaatacacatcgtgccaattggtcctag

SEQ ID NO: 95558 - DNA, 2281 bp, Glycine max
  Peptide Sequence Number=SeqID_212336
atggggagaggacgagggcgagggcgagggcggccggctaaaattccgatgccaccgtcaacaactactcaaaaatcaccaccgaaattgaacccggaacctagcaatgctagtcatgaagttactgttgaagactatgtgagctctgaggatgatgaatctgaagaaaccccaattccttcagctaacctaccgaactgcaatgtaccagagaaacctaaagaggagacgaacgaaaataaggtaccaagaaagctatggactgatgtaattagtggaaatcgtaagcctgagaatgggatgactcttgagttttttgctccaaagattgtggaaggaaagccgattgctaaaattgaacctgaagacatcattggtgagcttaaatattgggaatctgctttgattatgtatgtcatagggagagatcttagtatgaattctgttaagcaattcatggaaaagaattggagttttgtgaaattgccagatctgttctataatgatgaaggatacttcattatgcgtttccattcttcccaggacaaggatgaaattttatcgaagggtccttacacaattatgaacatgactatgctccttagagattggtcccctgagtttaatctcaagagagacatgctgagaacaatccctatctggattaagcttcctcaattacctttatacctttggggtgcgaaaaccatggggaaaattggtagtatactgggaaaaccgatagttacagatgaatgcacagctcaaaggctgagaatctcttatgctagaatgttagtggagattgatatcacccaagaaatgccaaaggaagtcactattgctgataatgaagggcatgagttaattcaagctgtggagtatgaatggaaaccaaagtactgtggaaagtgtaaaaagtttggacatgtgtgtgaaaaacctaaagtcagaaaagagaaagtttgggtaccaaaacctattctgaaaagtaatgagcaagaggaaggggggcctagcaataaggagacacagatgatcaacactactaatactgaggacctggtttcagagtggactacagtacagaaggcaggaaaaaagacagttactgatacaggtacaatgcagaaagctggaaagaagataattatcgatacaggagaaagtgccatgatgatttcttggaacattaggggactaaataaggttggtaagacgatagagattagttcccgtctcaagagtctcaaccccactattattgttcttcttgaaactcgactaagaaagaataaagctcttactgttagaaataaactcaatctgaatatgaagtatctggataactatgataagcatgaaaatgggagaatctggtttatttgggatgatagcaaagttatgatcaagcacatttgtagtacttctcagctgattcactgtggtgtctataatcccaatggtgatttcttgcattggtgcacggctatttatgctcttaatcacttagatgatagaaggaagctttggaaagatatcgaagatctcagagttcagcaggctgatccttggtgtcttttgggcgatttcaacaatgttctaaaggctgaagatagaattggtggcagagatgtaactgagtctgaatatgctgatttgagagagatgatgtctagagttggtttgtatgaaatggatacttgtggagatttctttacttggaccaacaaacaagctgataataccatatactctaggattgacagatttttgggtaatctcaattggctgcaaatgcatattgattccactttaaaaattttggctcctagtatttcagaccatgcccttatgtttctcagttgtaaagatcaaagtagcaggctcaggggtagatttaagtacagaaacagtctggctaggttgaatggtttccatgatgaagttaagaagaattggaacttgggtgtacatggtaatcctatgtataaactttggactaagctcagtagacttcaatctgttctgaaaaacctcagcagtcctctaaatggcctaagggagaaaattgatgaagctagaagaaacttgcagcaagctcatgaagatttatgcagagatagatttaatgtggataacattaacagggtaaaggacaggacttctgagcttcttcaactcaatgagttggaggatagtgatttgagacaaaaggctaagatttattggattcgtcagggggatggtaataacagctactttcatgctactatcaaag

SEQ ID NO: 95559 - DNA, 255 bp, Glycine max
  Peptide Sequence Number=SeqID_212337
atggagtttatcataactgatccagatcaagtgcgtttagcttcctggagagcttttgagggggcaaaaacagttattttccaagaactaatcattcccaaaagtgccctaaaagggtacttgatagcctcacacacaacagactatcagaatccaatgttcttattcaacactgttgcagtgattgtgctggttgttgcaaagttcccccacatgcacaaggtcaggatatttggaatcaatgctgataagtga

SEQ ID NO: 95560 - DNA, 306 bp, Glycine max
  Peptide Sequence Number=SeqID_212338
atggccagagggtcagtgtttgttggaaaggagaacagtgggtgccacttcataacagagtgcaagaaggtggctgagaaagtatggttttcagttctgattcaaaggaagcaagagatagaaggatacagcaaagtgtgcgagattaacgatggtccaagcgatgccaggggaacaaccgaagacggagagtacgaggatccaagaaaagaaaaggatgaggatgtatgtggtccaaacgccagggtacgtgaaccactccgtgttcctgttcagatccgccggtggcaccgccttcacgtacag

SEQ ID NO: 95561 - DNA, 1494 bp, Glycine max
  Peptide Sequence Number=SeqID_212339
atgatcgcagtcagatctgtcacctatgtctttaatatcaatggcaggttcactagaagattagaggctaggagaggaattagacaaggggatcctatctcccccttgctgttcatcctggttatggagtatctcaacagaattctaagccaactggataaaattcctaactttaattatcattctaaatgtgagaagatgaagataactaatttgtgttttgcggatgaccttctccttttttccaggggtgatatcggttcagtgcagattatgcttgacaagttcaacactttcctccgttctatgggccttcatgtgaatccttcaaagtgcaacatatactgcggatctgttgatattaatgtcaaagagcaattattgttgatttctggttttaaagaaggaaaaatgctctttaggtatcttggtattcctttatccagcaaaaaactcaacataaagcattatcaagttctcatagataaaattgttggtcggattactcattggagtgctggtcttctctcttatgctggtagagtgcaacttattcaaagtgtcatctttgctacaatcaatttttggatgcaatgtctgcccctgccaaaatttgtgatcatgagaataaatgctatttgtaggagttttctgtggataggtaatagcaacatttctaggaagtctccaattgcttgggaaaaagtctgcagtccaaagattaatggtggtttgaacatcatcaacttagctatatggaataaaatcagtatcctgaaattactttggaatgtccgtaataaatctgataatctttggattaaatggttgcacacgtactatattcaaggtcaatcaatttggagtatggttttgaagaagagtcactcttggattatgagtagcatgatgaagttgaggccccttttgctgcaatatcagtccagaatgcaggatgtttttaaaatgaaaaaaatttatttggctctgtttgaggaaagtgagaaaatgagttggaggactctaatgtgcaacaatctggccagaccgcgggctcttttttgtttgtggcaggcatgtcacttcaggcttgctagcaaagatcgcctgataaaatttggtttgaatgttgatgctaactgtgctttttgttcctctatggaatcccatgaacatctcttttttggttgtattgagttgaagactatttggactgcggttcttaattggttgcagataattcatatgccaagtacttggtcagaagaattgaattggattactaggaagtgtaaaggaaagggatggcgtgctatgttactcaaatgtgcttttactgaaacaatatatcatatttgggcttatagaaaccatagggtttttggtggaaatgtaaataacaggaaagttgaggattcgattatcagtacgataatctatagagtgtggaatagaaagaggtataggaggtatattgctgagttgatgatatag

SEQ ID NO: 95562 - DNA, 135 bp, Glycine max
  Peptide Sequence Number=SeqID_212340
atgaattctggtgctgtcttggcattgcctccagtaagcaatgtattcaggacaagggaacctcatgattttgaggatgactttgtggagaaagatccaactggccgagggaggtggaatgttttaattgcttag

SEQ ID NO: 95563 - DNA, 1867 bp, Glycine max
  Peptide Sequence Number=SeqID_212341
ttataggggttttgatgaagttgatggaatagaagttgcttggaaccaagttaagattgatggcctcatgcattcagtagatgatcttgcgaaattgtattctgaagttaatctattgaagtctttgaaacatgaaaatatcattaagttctatgattcttggattgatgataagcagaaaactgttaacatgattactgaactcttcacatcaggaaatttaaggctatatcgtaagaagcataaatatgttgaaatgaaagctataaaaggttgggccaggcagatccttcatggcttagtatatcttcacagtcacaggccacccattattcacagagacttgaaatgtgacaacatctttgtgaatggaaaccaaggtgaagttaagataggggaccttggtttagcagttgtcatgcaacaaccaactgcccaaagtgttattgggactcctgagtttatggctccagaactatatgaagaggcatacactgaacttgttgacatctattcttttgggatgtgcatattggagatggttactcttgaatatccctatagtgaatgcaaaaatcctgctcaaatctttaagaaagttacctcaggcatcaaacctgcttcccttaataaggtgagtgatccccaacttaaggagtttattgagaaatgtttggttccagcatctgagagattgtcagcagaggagcttcttaaagacccatttctacaagttgagaatccaaaggatcccatcctttatcctttacaaccgcctagccgaacactgagagcatattcattcaagtctggttctctatctatggacatggattctgactgcaaaccgttttctatgagtatctgttctgaaagcaaccaggaaaacccacattgtcctgtttttgaagtgcagcggacaaataataaacacgagtttaggttgaaagggactaaaaatgatgataactcggtatcattgaccttgcgtattgctgatacatgtggtcgagtccggaatatacattttctcttttaccttgatacagatactgcagtctctgtggccacagagatggttgaacatttggagctggcagatcatgatgtagatttcatagctgagcttattgattacttgataatgaaacttctaccttggtggaagccctcacctgatcatttctcatgtggagaattaagtccttatagtacaaatatagatggccaatggccatggggttctgtcctaactagtattccctctgaattggctattgatcaggatggcttctctgggtctgatacaactcccaaagaagattttgttgcatctgagaagagcagcgtttccaaaaatgatagcaatgctacttttgagggtgattgtaattcttctagtctggttaaattggaagatcgatattcacaaggatctagagcttctgagatgattgttgaaaacacttctatgaaaaatgacaattgtcatgattccaatgctgatgtaagttctgaaagcttaagtaattccatgtctgaacttgagattgggggtgcatattttgaggactgtaaattgcaaccagcagaatattgttctggagaaggagttgtgataaatgaattcccaaagaactcagggtcagttcttggaacgtccattaatgttgagaaccctacaaatagttgttcttatgtgtcatcaacagaagaggacattattgatcttgagctacagtttaaacttgatgaaattgaggcacactatcagcattggattgatgaacttaagaaaatgatgttggaggcattggattccaccagaaggagttgggtggccaagaagaaattggctgttcagtga

SEQ ID NO: 95564 - DNA, 824 bp, Glycine max
  Peptide Sequence Number=SeqID_212342
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaagatgtaggtaaaaagccagcctattgcaagataagagtgacaccatttcaaagcaaaaccaccataatgacaggagtttggctccagcagcaagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 95565 - DNA, 258 bp, Glycine max
  Peptide Sequence Number=SeqID_212343
atggcggagttgatggcatcacaggcatactgctgctttaagtgccagaaccttgttgcttttcatgatgatattgtctccaaagatttccaggctaggcagcttatcactggtcttcacacattggttgatgtgttttgctcagattgtggagaggaacttgtttggaaatatattaaagcttatgaggaaacacaaaagtacaaagaaggaaaatgcgtactagacaagttcaagataatcaagagcaatggatag

SEQ ID NO: 95566 - DNA, 1074 bp, Glycine max
  Peptide Sequence Number=SeqID_212344
atgaggccgatttttgctgggaacttggagtacgatactcgtcaatcagagcttgagcgcttgttctcaaagtatggaaggattgaccgcgtggacatgaaatctggaacttctactaagggaaaatatgctgagcttctgtcttggtttgccaacctctctgcaaattttttttgggaaggaaaacttcctgcttgtctgctctccttctactcacagatctgcattttcacatctgatcactggtcactcacctcatcatctcccaacattgacatttccatcagaatgttgaataacatgccgatgtctttcataatcatttctgcctctaatactagttatgttacaggttttgcttttgtctattatgaggatgagcgtgatgcagaagaagcaattcgtgcacttgacaatgttccatttggtcatgaaaagcgaaggctgtcagtggagtgggctaggggtgaacgtggacgtcatcgtgatggatcgaaggcaaaccagaagccaacaaaaaccctttttgtgattaactttgacccaatccgtactagagttcgtgatatagaaaaacactttgaaccttatgggaatgttcttcatgttcgaattcggcggaactttgcatttgtgcagtttgagacacaagaagatgctaccaaagctatagagtgtacaaatatgagtaagatcctggacagggtggtgtctgtggagtatgctctgagggatgatggtgagaggggggacaattatgacagtcctagaagaggtggttatgagagatcacccagtccttatcacaggcgaccaagtcctgactatggtcgtccacgcagccctgtctatgataggtacaatggtggtggaccagacaggcggaggagtcctgattatggcaggcacagaagtcctgattatggcaggcgcaggagtcctgattatggaaggcgcaagagtcctgattatgggaaacccaggagtcctgaatatgccgttcgccggtgcgaagtcagtgccaatggttctataggacctgaatatgagaccggaaaccctgtttattgttga

SEQ ID NO: 95567 - DNA, 1248 bp, Glycine max
  Peptide Sequence Number=SeqID_212345
atggctcaaaagaatgcaattgtgagaaagcttccaagtgtggaaactttgggatgtaccactgtgatatgttcagacaaaactggcactttgacaacaaatcagatggctgtgacagagttctttactttgggagggaaaaccactgcttctagactcattggtgttgaaggcacaacttatgatcctaaggatgggggcattgttgattggggttgctataacatggatgtcaatttgcaagtcatggctgaaatatgtgctgtttgtaatgatgccgggatttacttcgacggtcgcctttttagagccacaggtttgcctactgaagctgctctcaaagttttggttgaaaaaatgggagttccagatgcaaagtcaaggaacaaaattcgcgataatacagaacttgctgcaaacaacatgatgaatggcaacactgtggtgaagttaggatgctgtgagtggtggaataaaagatccaaaaaggtagctactttggagtttgatcgaattcggaagtcgatgagtgtcattgttcgtgaaccaaatggtcaaaatcggcttcttgtcaagggtgctgttgagagtttactggagcgtagttcacatgtgcaacttgctgatggatctgtggttccaatagatgatcaatgcagggaactacttcttcaaagactccaggagatgagttcaaagggattgcgttgcttgggtttcgcatataacgacgacttaggagaattttcagactattatgctgacactcatcctgcacacaagaaattgcttgatccaacacactactcatccattgaaagtgatctagtttttgttggcattattggtttaagagaccctcctcgtgaggaagttcacaaagcaattgaggattgtaaggaagctggcattagagttatggtgataactggagataataagtcaacagcagaggctatttgtagggaaatcaaattgttctctaaagatgaggatctcacagggcaaagtttgactggtaaggaattcatctcattttctccttcagaacaagttaaaatattgttgagacctggaggcaaggttttctctcgagctgagcctagacacaagcaagaaattgttagactactgaaggaaatgggagagattgttgcaatgactggagatggtgtaaatgatgcacctgctcttaagcttgccgacatagggattgctatgggcatcactgggacagaggtgacataa

SEQ ID NO: 95568 - DNA, 433 bp, Glycine max
  Peptide Sequence Number=SeqID_212346
atggtacgtatgagcacactcaccagcgttgaccgcatcgaactgatgcagacgtttatccgcattgttgaaagcggctcgctgtcggcggccgcggcgcagctcggcaccacccaacccaccgtgagtcgccgtctgcaggcgctggaacagcggctcggtctgaaactgattttacgcaccacccatgcgctgaaactcaccgacgacggggaacgctgctatgtccaggcgcggcagctggtggcgacctggcacgcgctggaagatgagttaaccggcgcgaatgacgacccgatcggcacgctgcgcgtgcgtgcgccgcatgcatttggtcaggatcaattgattgcgccgctgatggattatctgcagcgctatccgcgcctggcagtggagtggatgctcaacgaccgcacgccggactttgtca

SEQ ID NO: 95569 - DNA, 477 bp, Glycine max
  Peptide Sequence Number=SeqID_212347
atgtctgccatgtctcaatcttctgccatgcctgctgaaaagctgccggcaccgctggtgtttacgctggcggccggtgccggtctcagcgtggcatcgatttactacagccagccgatgctggatatcatcagtaaacagttcaatgtgggcattggcagcgtcggtatggtgccgatgctgacccaggccggttacgcgctggggattctgctgctggccccgcttggtgaccgccacgatcgccgcaccatcattctgattaaaggcttgctgctggtcgccgcgctgctgctgtgcggcttttccggcggtatcaatgcgttgctgatcgccagctttgttaccggattaaccgctaccgtggcgcaggacattgtgccagcgtcagcggcgctggcaccggagcgcagccgtggcaaaaccgtcggcacggtgatgaccgggctgctggtcggcattctgctgtcgcgcgtg

SEQ ID NO: 95570 - DNA, 345 bp, Glycine max
  Peptide Sequence Number=SeqID_212348
atgaaaatcctgatgagtcataacaacagcttccagaattgccccatgtatggtgttgcttgtcaatgttatgattcaacaagcgattctcctcaaatttcagccagcccgtatcaattagacctcacactttatgcttcggggtcatacaatgctcaatggaatgccccagggctcctccatgataagcacacgttgcgttcgagtcgtatcctcagaaaaatggaggttgaggaaccttggttggggctttttgctgcaaaattcctttttgttggtgttttttggtttatgctaaaggtggtcttcgtcattggaagtgcggtagacaggctttgcggttga

SEQ ID NO: 95571 - DNA, 404 bp, Glycine max
  Peptide Sequence Number=SeqID_212349
cccgcatttgtttgagtcatctgtccctggattgttccctgagggagcaacacaactctcctttgtgctgacacaaggacctgagggaccaacctctggctctggagctgttgtaggtcttcaggaggcatggtggaagaactgcgggacgtttgtggagccgatccaaagacatcctaatgcccatgggggacgaacgatccctgtgacgcctgctcttccaaagaatcctggaccgtcggccttgctgatagcaggatcgacgttgaccacagatctttctaccctaggtggtctagtggccaatgatcatagttgtgtcaccttgcgtgtctgcttcaacgtagatggagatgctgatgcgtctaccggaggaggaggaggaggaggaggaggcgaggcag

SEQ ID NO: 95572 - DNA, 180 bp, Glycine max
  Peptide Sequence Number=SeqID_212350
atggcacatgctacagaagataaaactacacaaagcaaaacaattaggagcattgtttgttctgattgtgatggaaatggtgcaaaatcatgtactcaatgcaaaggtactggagttaattctgtagatcacttcaatggacaatttaaagctggtggattgtgttggctatgcaggtag

SEQ ID NO: 95573 - DNA, 957 bp, Glycine max
  Peptide Sequence Number=SeqID_212351
atgaatagaaaacttcgggagaaagggatgagacttgaagagttgactttaaaaaggttttcatacagtgagctgaaaagagcaacaaataatttcaaacaaaaattgggaagaggatcttttggagcagtttacaaagggggtttgaacaaaggtaggaggttaattgcagtgaagagactagagaagttggtggaagaaggagaaagggagttccaagcagaaatgagagccattggaaaaacccaccacaggaacctagttcgcttgttgggtttctgtgccgagggttctaaaaggcttctggtttatgagtacatgcctaatggttcccttgaaaaccttatctttggagctcagagtcagagacgtccagggtgggatgagagagtaagaatagcactggagatagcaaaagggattctgtatctccatgaagagtgtgaggcaccaatcattcattgtgacataaagcctcaaaacattttgatggatgagttctggactgcaaagatatctgatttcgggctagcaaaacttctgatgccagatcaaaccagaaccatcacaggggctagagggacaagagggtatgtggctcctgaatgggacaagctgaacatcccaatatctgtcaaggttgatgtttatagctacggaatagtgctgttagaaattttatgttgcaggagaaatatcgaagttcatgtctccgaacccgaagcggctcttctctccaactgggcttataaatgttttgtttctggacaacttaataagctttttctttgggaatccgtggataataaaacttccgtggaaaatatagttaaggtggcactttggtgcatccaagatgaaccttttcttcgcccaacaatgaagagtgtggtgttgatgttagaaggaatcactgatatagcaattcctccatgtcccaattcaagttatgtgtga

SEQ ID NO: 95574 - DNA, 963 bp, Glycine max
  Peptide Sequence Number=SeqID_212352
atggatgccatattgggttccctaatgattttagtgatgacttcagcagtacaagcccaattgaaaactgggttttattctacttcatgtccaaatgctgaggcaatagtacggtccaccgttgtatcccacttcagcaaggatctatccattgctcctggcctgctcaggcttcatttccatgattgctttgtccagggatgcgatggttcaattttaattgcagactcttctgcagagaagaatgcattgccaaacattggtctaagaggttttgaagtgatcgatgacgcaaaatcacaaatagaggccatatgtcctggaattgtctcatgtgctgacatcctagcattagcagctcgtgatgctgtcgatttgagtgatggcccaagttggccagtacccacaggaagaagagatgggaggatttctttatcatctcaagcctcaaatatgccttcaccacttgactcagtttcagtccagaggcaaaaatttgcggcgaaaggtctagatgatcatgatcttgtcacgttagttggtgcacatactataggccagacagaatgcaggttcttcagctatcgtctatacaatttcaccacctctggtagtgctgatcccactataaacgtagctttcttagctcaacttcaagcactttgtccaaaaaatggagatggcttgagaagggtggccttggacaaagatagcccagccaaatttgatgttagtttcttcaagaatgtacgtgatggtaatggggttcttgagtcagaccagaggttgtgggaagattctgctactcaaagtgtggtgcaaaattatgctgggaatgttagagggtttctggggttgagatttgactttgaatttccaaaggctatgattaagttaagcagtgtagaggtgaagattggtactgatggagagatcagaaaagtgtgttcaaaatttaattga

SEQ ID NO: 95575 - DNA, 2847 bp, Glycine max
  Peptide Sequence Number=SeqID_212353
atggagatggattttgttataatacctgatttggagagatggagggcgagccctggtgcagcggtaaagttgtgccttggtgacttgttggtcatgggttcgaatccggaaacagtctctttgcatatgcaaggttatgtatttgtgaactatactgctgcattgtatagggataataactatttctcttctatctttgcaggggatatgctaaatttccctcagacccccagatctcttccgcgagttatgactgatccagtaatcatgtctagtggagatggtaaacaaagtaatgatgatgattcaggtgttttctcatcagaataccgtcgcaagataattatagtatcaaattctcttcctctcaatgcaaaaagggataaagtatctggcaaatggtgcttcagttacgacgaggattcaattttttggcagttaaaggatggtctctcacctgaggctgatgttgtttatgtgggatctctcaaggctgatgttgatgcaaatgagcaagagaaagtttcccttcagttgctggaggaattcaattgcgtgcctacttttattccttcagacctctacaaacaattccatgatggtttctgcaagcaacaattgtggcccctattccattacatgttgcccatgtatccaggcaatcgccgctttgataggtcacagtggcaggcttatgtttctgctaacaagatatttgcagataaagtcatggaggtccttaatccagaagatgattatgtatgggttcatgattatcatcttatggtccttccaacatttctgcgaaagcggtgtagtcgagtcaggcttggttttttcctccacagtccatttccttcatcggaagtttataaaactctgcctgtcagaggtgaaattttgaaagcattgcttaatgcagatttagttggtttccacacctttgattacgctcgccattttctctcctgctgcaggcgaatgcttggcttggaacatgaatctaagaggggttacatagggcttgaatactttggccgtacaatattcattaaaatattgcctccggggattcacatgggtcgacttcaatctaccttagatcacccttcctcttccaacaaagtcagagaaatccaccaacaatttaaggggaaaaagcttatagttggtgttgatgatatggacttattcaaaggtatcggtttaaaattcttggccatggagcaactcctgcagcaatatccagaacagcaaggtgaattaatattgatccaaattttaaatcccccaagtagttctgacaaagatgttgaggatgcaaaggaggaggcctacatttcagccaaaaggataaatgaaaggtttggtttggaaggttatgaacctatcatcatcattgatcgccatgttcctttctacgagaaggcagcctattatgctttggcagaatgttgcattgtgaatgcagtgcgtgatggtttgaatttggttccttacaagtacactgtgtgtaggcagggaagttctaaactggacgaagctttagaaatcgcttctgactccccacgtgtaagcgcacttgtcgtttctgagtttataggttgctcaccatctcttagtggggcaataagggtaaacccatgggatattgatgcagtagctgaagcactaaatttggcaatcacaatgcctgatggagagaagcagcttcgacatgaaaagcactatcggtatgttagttctcatgatgtggcatactgggctcgaagcttcgagcaagatctagtgttctcgtgcaaggatcattataataaccgatgctggggctttggctttggcctgaacttcagaattttgtccctatctcctagtttcaggaggctatccatagaccacattgtccctgcatatgaaaggagcagttgcagggcaatctttttggattatgatggtacggttgtgcctcaggcttccattgttaaaccccccagtcctgaagtcatatctgtgctaaataatatatgcagtgatgttagaaacactgtgtttattgttagtggcaggggaaaaacctcactgagtgaatggtttgatcagtgtgagaatcttggtatagcagctgagcatggttatttcataagcggttgtcatgtcactgtcaagttctttaagctgatggtttttttgtttgatttttaccataggtggggtaaacatactagttggcaaatgagtcatgcagatacagattttgcatggaaaaagattgctgaacctgtgatgagatcttatatggaggctacagacggctcctctgtagagaccaaagagagtgccttggtatggcattaccgtgacgccgatcctgatttcggatcttggcaagccatggagctgctggatcaccttgaaaatgtacttgcaaatgagcctgtagttgtcaaaaagggacaacacattattgaagtcaagcctcagggcattactaaagggtcagttgcacaggaagttctttcttccctaaccaagaagggtaaatcgccagattttgtactgtgcattggtgatgatagatctgatgaggacatgtttgagagcatattagccaaaccttatagtactacctcatcctcagcaccacaaatctttgcatgcactgttggacaaaaaccgagcaaagctaggtactacctagatgacactgtcgatgtgatggcattacttgagggtcttggtgctacttcagggcctaaatcaagatattctacagaaaccccttttgagaaaagagaaaatgttggtagcagcagctttaggtctcagaaactgagcacaggggattag

SEQ ID NO: 95576 - DNA, 216 bp, Glycine max
  Peptide Sequence Number=SeqID_212354
atggacgaagatcaatggaggtatgactttgcgatgtcacacgaagttgatatggattatgattatgataatcaagaagaatgtggagtgaatgaacgacatgtcgattgttcaaatgcttttaatacatctcagggttgcgttgtaggttttgaagattgtgatcgtggagcttctgtgcatttggaaaaaaaaatcccaaacatgggtacttga

SEQ ID NO: 95577 - DNA, 246 bp, Glycine max
  Peptide Sequence Number=SeqID_212355
atggaacaacgattccgttgtggtaggcccattgatcatgtcccctccaccttcaatagaaaggtcgtgaagattctactcctgacttaccttgacattccaactgaggaagaggttataacggtgattaacgcaggtgccaaggttaggttgacatggcaggcaaacctatatcaccgggggtgcgggacgaatgtgtggccttatcttccattgggtgatgttgtgctacctaggggtccttag

SEQ ID NO: 95578 - DNA, 1263 bp, Glycine max
  Peptide Sequence Number=SeqID_212356
atggagaccaacaacaaacagcagaagaagaagtggtttattccactggttctgtctctactactgtccaccctgctcatacttttttccatcttcgtctcctccgattcctcctccctgctctacctctaccgtacacgtggcagggtggaggagcctcgtttcgtggagtcaaagctgaggttgtccgccacgtcatccagtgactctgttcccaggatcgcgtacctgatctcggggtcaatgggcgatggcggcactctgaagagaaccctcaaggccctttaccatcccaggaaccaatacgttgtgcacttggacctcgaagcttcttctcaagaaagattggagcttgcaaactttgtgaagaacgaacctctcttttccaaagtgggcaatgttagaatggttgttaaggccaacttggttacttataggggacccactatggtcactaatactctccacgctgctgccattttgttaaaggaaggtggactctgggattggttcatcaatctcagcgcttccgattaccctttgatcactcaagatgatctgctgcacacactgtcatcaattccaagacaccttaactttattgagcacaccagtgatattggctggaaggaagatcagagagccaagcctgttatcattgatccagctctttatagtgtcaataaatctgatttattttgggtgacagagaaaagaaatgttcccacagcatataagctgtttacaggttctgcctggatgatgctctctcgccaatttgttgaatatttgttatggggatgggataacttgcctagaattgtcttgatgtattatgccaattttctatcctcccctgaagggtattttcacacagtcatctgcaatgctgaggagttccgaaacaccactgtgaaccatgacctccacttcatatcatgggacaaccctccaaaacaacatccacatttccttacaattgataactaccagaaaatggttgacagcaacactccctttgctcgaaaatttggcaggaatgaaccactcttggataagattgatactgaactcttgggacgaaatgaacatggttatgtgcctggcaggtggtttgaccaagcaaatccaaacatcaccgaatcatattctgccataagaaatatcactgaacttaagcctggccctggggcagaaaggcttaaacgccttatcaatggtttgttatcatcagaagattttcacactaagcagtgttcttga

SEQ ID NO: 95579 - DNA, 381 bp, Glycine max
  Peptide Sequence Number=SeqID_212357
atggacaaggcagaggcaattcttgctctgataccaaattttaagagtttttttttatgtggtgatgacgaaaatggtgatggtagtgatgtcaacaacaatgacagtgatagagatatcagtggtgatcacagtgacaatgacggcggtggtggtagaggtgatattggtagtggtggcaatgacgatgtggtggtggtaacagtgttagtggtgacaaccaatggttgtggtggaagcaacgtcggtggtgttggtgacgataatggtggcaatgacggtggtggggtggtagtggaagcggttggtggtggtaacagaggtggtattattggtagtggtgatggtgacaaaggtgatctagttggtagtggtggctga

SEQ ID NO: 95580 - DNA, 932 bp, Glycine max
  Peptide Sequence Number=SeqID_212358
acgtggctgttggatacaaggaccctcgagtcaagcttcatattatagatggaactctttttttgaattctgtcccaaaagggatgtatgatgcaataatagtggatgccttcgacccaataaggcctgatcatgagctttttgaatctgagttctttgaactggtttcaaaggctcttcgtccaggaggagtattgtgcatccaagcagagagtatttggtttcattccttggatatcgaagaactcctcaccaaatgccgccaaactttcaaaggctcctctgattatgcatggacaactgtccctgcatatccaaggcaagcttcattcaacaatccttctgtttcactaatggtatcagagcctggttcatttcccatggccactgagttgcaagcagccatggaaaatttcttacgatcaaaagaatattggtcagcaattgatcgtgcaatcttggaaactattctttgcaaagaaactttcaaggatatttgggaatccatgaagagaaaatatgaaggctttgtcagagtgaagcgtgcacagcttcaagccttgaggagagattttgagacactggctatgaaggatggagaatctgtgacaacctattttgcaagaacaatggagattagtaacaagatgtggttccatgacgaaaagatgacagatgtcactatggttgagaagattttgcgctccctaacaacaaatttcaattatgttgtttgctcaattgaagagtcaaaagacatagatgtgttgtctattgatgaattgcaaagctccttgttggaaggagaagggggagaggtagaggtaggggtagaggaaaaggagaacgtggaagcagagaagataacaagaatcccagagctaatactacaagcaaaggcagaggacaatactctaacagatccaagctag

SEQ ID NO: 95581 - DNA, 345 bp, Glycine max
  Peptide Sequence Number=SeqID_212359
atggatcacgtaccgaataggaatgaggaacaagagagagctccgagaataacgaggatcccttcgccaagaaacccttcaggcttcagccttcaccgagaagccgatcgaggaacaggaaccctagctgtcgtgaacgagagagagtccgcagtgcagttcactgaatattcagctcacaacttttttttcccgaaacgggtcgggtcgaaccaaaccggttacaaaacggagcggtttttaacccgtttcactgaatattcgacacacaccctatcagtaagagctagtctacctcggcctagaatacagactaattacccaaaggttccagagaacaaatga

SEQ ID NO: 95582 - DNA, 510 bp, Glycine max
  Peptide Sequence Number=SeqID_212360
atggagaatcatccttcaggccgtgtgatcagcaatggtaaaattggtttctctactccaaattgcacacatgaacgagatgatgaggaacctgaaattcgtgtacatccacaaattccagagtggttttcagagaattctccattatggccaggccaagcacacttcttgaaggtagaaaagatttgtttccaagggaaatctgaataccagaatatgctagtttttcagtcatcaacatatggtaaggtttttgtccttgatggagccctccaactcacagagaaggacgaatgtgcttaccaagaaatgatgactcaccttccactttgctctatccctagcccaaaaaaggtgctgcttattggtggtggagatggtggtatcctaagggaaatttcccgccactcgtctgttgaacaaatcgacatatgtgaaatagacacaatgctgattgatgtaagcaaaatgtttgacctcctttcccttaaccaaagagtcaaactttga

SEQ ID NO: 95583 - DNA, 228 bp, Glycine max
  Peptide Sequence Number=SeqID_212361
gttgttcttcccagtcctataccaacaaggacagagcctgcaccaactgagtcacaacctccagtagtagacccaccggcttctctagaggttgagatactatctcctccactagctccaccggcaccacctttgatactcattcttgatgactcagatgctgaagctgttgctccttctaactcaccagcctactacctagaggatggttcggacttttctgactag

SEQ ID NO: 95584 - DNA, 264 bp, Glycine max
  Peptide Sequence Number=SeqID_212362
atgtttacaagattccatcaacatccccatgataagtctggcttaggtctggagaaagaggcatcatcctccaagtcacagtttgattcacacaaatatgacttcaatggatccatagaaaaggaccaatatatagtcaagacagaagatgacatgtccttctttactgcctgtgatataaatggcagcggaatggagaaggaagagagagaggagatgccacttcaaggagaagatgagtctagaagaagctcaccaccatag

SEQ ID NO: 95585 - DNA, 327 bp, Glycine max
  Peptide Sequence Number=SeqID_212363
atggtttgtcaacttttaacaagtacaaaggatacaccatctgtgatcaagtatgcaaaaagcaataagaagccaatagccaccatcaaatttcaacaaaaatttgttggagttaagctggcaccagctgttaactttaactcatcaagaggtccttcaacaagttatcattgggtcttgaagcctcacataatggcacctggctctaatgttcttgttgcttatgttcctacagaaccgacaactagaattggcaccaatgtgatgttatctagtggctacaagttgctgtctggaaccccaacaaagcacttgatccaagtttga

SEQ ID NO: 95586 - DNA, 1422 bp, Glycine max
  Peptide Sequence Number=SeqID_212364
atggaaccaaggaagaacgaagtaattgtgattctaggaatcaacaacgaaaaggatgccaaaaacgtgttcctagaagattccttcatccatggaggatgggtgagcttccaaagtttagaagaagaggggtttactatcaaagggtgcaaagtctatgttagtgacagggatagattttgcacatataagatgatggtgggtaagaaagtggatctgcttgaagtcatcttctattactggatgcaaaccttcaaaggcagattcaacccaaaagtgaagaagaaccatgtcccttatgtcaagaaagagcttaaggacaaaccacagtctgtggttggtcagacgatgggcactcaggatcaactttcaccccctcatacccaacctaaacctactctctctcccatcaataaaaagaaagttgcaacctttgctaaggataaaaagaagtctctggttgaagcatacaagaaggccaagttggatgaaactttggaaagaaaggaagctcaagagttggaagaaagttttctttcatctatgaaagctctgtcaactgaagagaataagaagaaattggctaaatatgccagacttgctaccttggccaccatgatgtacatagatggtgagctagtgcctaaagttgtaattgttgaatcaattcaagcccatactgaacaagaactcaagaaggttgagatggatgaactaaaaagggttcaatttgcagcaaaatatgtagctgaattcttatctatggatgttgctcaaaggcaggaagtagatgaagacattatggaaacataccctagagtagatcatgtgtatccaagaccagtgtttgaagttaatgagcagatcattattgttgcacaatccgttgcaatggatgaagacagactaggcacatggaggaagcacatggagttgcagaaagaagaagatgcacttagtgcatatggggaaaaggaaccaatgcttagagacttctctatcagatacactattgctcctgatcccaacaatcttcaacaactcttgggtattatgtggacaatgaatataattctttcatgggatcacactaccttaggtgagacttttcagattgaggatatcaacttggaggaacttgaagccaactcaagagaaatcagatcaaggaaagctttattgagaaggattgaaagtcttaacactcatattcctttcatgattgggtctcaattctcttgcctacctactccagaaatccaattccagatagctaaatgctacaagggaaaggagattcttattaaagatgatgaagatgctcctccaactagatatgtgaaagctcatcctgaaaagttgttcaaacatgagcttaaggctattaagcagaaaattgagcacaaaagtcttgattggtaa

SEQ ID NO: 95587 - DNA, 324 bp, Glycine max
  Peptide Sequence Number=SeqID_212365
atgtatttggcgttggaagggtcctcaacagttgaggctatttctttgaaaaattgcttggaatgccttgctaacaaatgctttcaggcatcttctggtgacctccgaaggttgccacaagctccgttgtcacctccttcactttgtcgtgacctccgaattatgccgcaagctccgttgccattcgtcattgtcattgtctatcttactcagtctcaacagccaactgcctctggccgttgtgcactttcattcatacacgcctggtgtttatcatattatcaatttgttgacattgtgaatttgtgtttgtttaaaccctaa

SEQ ID NO: 95588 - DNA, 2058 bp, Glycine max
  Peptide Sequence Number=SeqID_212366
atgagcagcgatttgtaccgattcgcagtatcatcccacttcagtagttttccaaaatcgttctccctccgtaagaaagttccatggtggtaccagatcctggacccgcggtcgaggttcgtggcgcgatggaaccgcacgttcctctacgtgtgcatcgtggctctcttcctggaccctctctacttctacttccccatcaccggggacaaggcctgcatgcagaccgacattgtcctcggcgtcttcgtcacgttctcccgcaccatcgctgacctcttcttcctcttccacatggtcctcaagttccggacagcttttgtctctcccctctccagcgtctacggccgcaaggacctcgtcaccgatcctcgccagatcgcttcgcgctacctccgctccgatttcgccattgatctcttcgccacccttcctctgcctcagatagtgatctggttcgtgattccggcagtgaaagattcaacggcggctcatgtaaatcataccctgtccttgattgttctcattcagtttattcctcggttgttccagatttttcctctgcaacggagaatcttgaagactagtgggcttattgccaaaactgccttggcaggggccttatacaatcttggatcctacatgctagccagccatgttttaggagcttcgtggtacgtgtcatcgattcagcggcagtacgagtgttggataataacatgcaagaaggagatgaacagaacgcactctccatcatgtaacccttcctttctcgactgtggcaccctcgccgaccatgaaaggcaagcttggttcaaacgcaccagagttctcaccgcatgcgatgccctcaatgataaaaacgagtttcagtttggaatgttcgctgatgctttcactgatcacgtctcctcatcaagattcttccagaaatacttttactgcctctggtggggtttgaagaatttaagttcgtatggacaaaatcttcagacaagcacttacagtggtgaaacattgttttcaagtttcatatgcatcgcaggtctaatcctgtttgcgcatctcattggtaacatgcagaattatctgcaatcttcaactgcaaaagttgaagagtggagacttaaacagaaagatacagaagagtggatgaatcaccggcagcttccaccagaactgcaacaacgtgttcgacggttcgttcaatataaatggcttgccaccagaggagtggacgaagaagccattttgcgcgctttgcctttggaccttcgccgccagattcagaggcatctctgtctcgacattgttcgccgagttccatttttcggccaaatggatgaccagcttctagatgcaatatgcgaacgtcttgtgtcatcgttaaacacaaaagacacatacatcgttcgcgaaggcgatccggtgagagaaatgctcttcatcatcagagggcaagtagagagttccacaaccgatggtggaagaacaggttttttcaactccatcaccctcagacccggcgacttttgcggcgaagaattgctaacatgggccttgatgccctcttcaactctcaatctcccatcttccactcagacagtgaagaccctcaccgaagtggaagcatttgccttaagagccgaagatctcaaattcgtggccagccagttcaagcgcctacacagcaagaaactgcaacacgcttttaggtactattcacatcagtggagggcttggggggcacattttatacaagctgcgtggagacggcaccgcaagaggaaattggcgatggagttgttgaaggagaacttgtactacacgaatgtggtggaagatgatgatgatgaagaagaaggtagtgcaggagagagttcaatggcggggcatactcagaattttggggccacatttttggcttcgaaatttgctgcaaacactaagaaaggggcaattaaaaaggtggctattaaacttcctgatgctgatagtttgaagatgcccaagatgttcaaacccacggaacctgatttctcaacattccatgattag

SEQ ID NO: 95589 - DNA, 603 bp, Glycine max
  Peptide Sequence Number=SeqID_212367
atggccgataaaatcaacaattcatgcgaacatcaacgccgtcccctatcgttccccgccgtgcgtccctgcgtatcaacatctccctccaccctcctcgcctccctcatcaccctcgcccaaaacatatgcaacttccattccaattcctttgtttttcaccgcagaaatgttagagaaacaacgcgccagatcgcgattctcctcgtgctcttccaagaactccacgaccgtggttcaatcatccctcactctatccgcctctgcttctctgacctccacgtcaccttccagaagatccacttcttaatgcaagactgctcccgcgaaagcgcgcgcctctggatgctaacgaaatcccaattcatcgctacgcagtttcgcgtcctcgttcgcgaagtggcgatagtcctagatgcaatacccgtgtgttgcattgatataaacaatgaaataaaagagctagttgagttagtgaccaagcaggccaatagaggcaacctccaactcgaccgaaacgacgagaatgaagcaaaacgacttcgtttccttctggcccagctcgagagaggaatcgagcctgacgtggacgtagtgaaatca

SEQ ID NO: 95590 - DNA, 447 bp, Glycine max
  Peptide Sequence Number=SeqID_212368
atgcatattttgtcactggctggtcttccaccaggggttccaaatgttgtgtctggttttggtccaactgcaggttcagctcttgccagtcatatggatgtggacaagagcaatcttaagcctgtgacattggaactaggaggaaaatcaccattcatagtgtgtgaggatgctgatgttgacaaggcagtcgaacttgcacactttgctctgttcttcaatcagggtcaatgctgttgtgccgggtcacgtacttacgtgcatgaacggatatacgatgagatttttgagaaagcgaaggcaactgctttgagacgtgttgtcggtgatacatttaagaagggcttggaccaaggtccccagggagagaagggtatctacagccttcagaattacttgcaggttaaggcagttgttacacctctcaaaaatccctcacagttgtaa

SEQ ID NO: 95591 - DNA, 630 bp, Glycine max
  Peptide Sequence Number=SeqID_212369
atggtatgcttgttgaagctttctcaagaaaaggagattaaggaggcagcatgggattttgatggaaacaagagtcccgaatcgaatggttttaattttaattttatcaaatcatgttgggagatggttaaagttgacattgtaagggcttttaaggaattccattttgaccaaagactcccaagggaaactaatgcatcattccttactcttattcctaagaaggaaaatgcacttgggttggaggagtttagatcgattttccttattggatgcttatataaaaccattgcaaaggtgttggcaaataggatggggagggtgttgggaaaggtggtggatgagaagcaatcgacattttttagtaataagttttatcaacagaatccagtgtggaggatagctgacaacagaatccagtgtaaagcgaatctgcataaaaggaacgctctacctactgttttgacgaatttaaatatagagcgtgaaactggtgtaaagcaatgcaattgcgttagttcaaaaagggaagtatggggtagtgaattggtaatgggagtgaaggaaactaccattgtcttcatgagtgggcaaggtttaattggtttagtggttatgggactgatttaa

SEQ ID NO: 95592 - DNA, 705 bp, Glycine max
  Peptide Sequence Number=SeqID_212370
atgggcgtcgccctggggaatgagcacggcgttgcccgcggacagcggatgcagcgcgccgtcggcgctgcgcagcgccgcgttgccaaccgccaggtagtggaagtaggcgtggccggggcgggcgcggaaacccaggccgaccggcgcgccgacctggatgcggcggtattgcacgccgcgcaggcgcatgccggtcagcacggtctgcgatggccgcatgtcgcgcgcggcggatgcgccgcccgcctggatggcggtgttttcgctggcgatgggggtgttcggcttgctgaccgcggagtacctgccggccagcctgctgacgccgatggcgctcgacctgggcgtctccgaggcgctggccgggcaggcggtgacggtgacggcggtggtggcgctgtttgccggactgctggtgccgggtctgacgcgcgcgctcgatcggcgcgtggtgctgctggccttcagcaccctgatggtggcctccaatctgctggtggcgctgtcttccagcctggtggtgctgctggcgatgcgtattttgctcggcgttgcgctgggcggtttctggagcatggcggcggcggtggccatgcgcctggtgccgcccgccctgctgccgcgcgcgttggcgatcatcttcagtggcattgccgtggggaccgtggtggcggtgccgctcggcagctatctgggcggcag

SEQ ID NO: 95593 - DNA, 315 bp, Glycine max
  Peptide Sequence Number=SeqID_212371
atgcatcctccaccaaaagagtttggagctatgcttcatgattgccaaagtgtggaccctctagtgcaatcctccattctccctttttcttcggagccccatgaatgtcattgcctagcgttgttcatgcatcctccacccaaagagtttggagctatgcttcatgattgcctaagtgtggaccctctagtgcaatcctccattctccacttttttcggagccccatgaatgtcattgccaagcgctgttcatgcatcctccacccaaagagtttggagctatgcttcatgattgccaaagtgtggaccctctag

SEQ ID NO: 95594 - DNA, 459 bp, Glycine max
  Peptide Sequence Number=SeqID_212372
atggaaacagctaaatcaactcaacaagcactccaaagtgtagaaatccaggttggtgagctagcagatgtagtaactcaatttatgtccagacgagaaaaatcctttgtagaggctgaagctcaagagaaaagccctataaaagagcatgagtcaagagaaaaagatgaggagaaagatgaggaacaagcacaacaacaatgggataagtactcaatagtagaaaaccaacaagaaaatattctccccagcaataaccttcctcatcaactaattgacaagaaaggaagccaaggagagcatgaggaaaccttaagtgacattctttctttaataactaacacctttcttgaaatgatttggaatgtccttccaaattatatgaagttcatggaatttttagctaaaaggcgaaacttcaaggaagatgtgttctttgtgactttcatgccaccttga

SEQ ID NO: 95595 - DNA, 570 bp, Glycine max
  Peptide Sequence Number=SeqID_212373
atgtgcgtgtcgatgcattgcgacgaagaagactgtgaagaaggtatctacagcgacgtacaggcagcgcctggatcgtctgaggatcccaaatgtttgctggatgtcatatgcgaagcaccgacctgtgcaggactttcatccaatttcgtgcttctcgggacagctcccttgggggcctgttgttgtcagatacagaccagagagggttatgcgtcagttcggtgtcatatgatgacgtggatgatacttggacgcactactcagaccatctggcggcagcaggtgatctatgtgttgtgtcagacggttcctcctcgagatgcatatgcgacgcagcccagtcatatccctcatgaggtagcactggcatcgacacatgcggatcctgatgcgaacgagcctggacatgcagtggcttgtcatgtgatcgtggaggcgttggagcagcatctaaatgcgccaggcacatccacacatgaagaggtcatccaaaaatgtctcaggattgccaagggtgtcacagaagacgtgaggtctcgacgtaggcgccgcacggatcaacaatag

SEQ ID NO: 95596 - DNA, 207 bp, Glycine max
  Peptide Sequence Number=SeqID_212374
atggttgttgtcatcaaggcaatcatgggatgctttgacttggcttcagaacttgaagtaaattttagtaaaagtagtttttggaggtatggggatggagggaggagctttgtggaagaagaaccaaacagtggagatatcccaagaatgattttgatgcatcaaggatcactttggttgaagtctagagctttggaggctttgtag

SEQ ID NO: 95597 - DNA, 1146 bp, Glycine max
  Peptide Sequence Number=SeqID_212375
atgcagtttttgtcatggtttctctccaggaggctcgtgttcggaaccgaggaacagaaaaccaaagcagcgtacgagattcgtttgctggcgaagtccagcgttttcaacagggcgtgtttggtggaaatgggaactgtgccgccacttttggatcttctcgccgcagacgacagaaacttgcaagagagcgcaatcagtgctctgatgaagctctcgaagcacaccagcggccagaaactcataattgagagcagaggcttggcgccgattctcaaagttctcaaaagagggctcagcttagaagcgcgccacgtggcagccgcggttatattctacctttcttcatcaaaagagtaccgaaaactaataggggaaaaccccgatgtgattcccgcgttggtggaaatggtgaaagaagaaacaacttttggaaaaaacaattccgtggttgcgatcttcggacttctcttgcgtcggaaaaaccacgcgattgtgttatcagcgggtgcggttcctgttcttgttaatacgttagcttcttcgggtaacgctaatcttgttactgattccttggccgttctggtggcgttggcggagagtgtggaaggggcttatgctctgttacgagcagaggcgttgcctttggtggctaagattttgcaatctgctacttcgcgctcagggaaggagtactgtgcgtccattttgctggctctctgtgttaatgttggtgcggaagtgaccggtgttctggccaaggaggcttcggttatgccttcgctgtattcgcttctgacggacggtactcctcacgcggccaagaaagcgcgtgcgctcatcaatgttatacttgagttcagcgacaagaggttttctggaaccgtgggttcctctgtctcgcggcaaagggtggttctggtttggaggttgagaaataattgtgtattccaaggttctgatgttaatatggagggaatgagagaccacatgggactgaagttggacgtgttgagagtggagagctttatggagaaggttgagactatggactatggaggattcctggcttcatcgataaatcttgtgactggaaatccttgcatagtctccatcaccttttccatcacgtcggaaatcaattaa

SEQ ID NO: 95598 - DNA, 210 bp, Glycine max
  Peptide Sequence Number=SeqID_212376
atggccttcctttccatgctccacaacgcggattcacacacaccggaacttcatcgcactgattggggggtttaccacctgaggcgtgtggtggatgacgtcgaagaggagccgcacctggtgtcgctgttccacgtgttcggcaaaaaagaagaggcaagagggaaaggagatgtggccaaagaggagaaaaaaaaggagcaaaaataa

SEQ ID NO: 95599 - DNA, 462 bp, Glycine max
  Peptide Sequence Number=SeqID_212377
atggtgctgagctttgtagtaactagtaacagaagcaatgtgagaaagatggactgggtgggaggactttattgcaatttaacagttattgttttcaaggagagggcgagtcctggtgcagcggtaaagttgtgccttggtgacttgttggtcatgggtttgaatccggaaacagcctctttgcatatgcaaggcacacttcaggggctctaccctaaaagccacccatttctttgggtattagagaatgcttattcaacttttgtttggggtctgggagtcattctaatgttacttatttctgttgcactttttgtattacaactttcagagtgggatgacaaggaagaagggaaggaagtgactcaacagtgggaggatgattgggatgatgatgatgttagtgatgatttttctctccagttgagaagggagttggagagcaacaccgagaagaactaa

SEQ ID NO: 95600 - DNA, 453 bp, Glycine max
  Peptide Sequence Number=SeqID_212378
atggaaattgtgatttccttgatcatactctttatggggatagcaattttgatggtcatccatgtctgcgtcgtggggagggccttcacagggaataacagcaacaacgaagaagaatttactcatcgcagcatcagtgccatgaagagaatgtttggcggcaacaaggttggtaacctgaaaaaccttccttgctttgagtacgaggagaaagcatgtaaagagaaagggtgttgtggccttgtggattgtgctgtttgcttggagaattttaagattggtgatgtgtgcaggttgttacccaattgcggccacagcttccatgtacagtgtatagattcgtggattctgcaaacacccgtttgtcccatttgtagaacatgggttcattcacctgttgtgatgagggaacaaagtgctgtttctgaaaatgtagaaatatcgactgcatag

SEQ ID NO: 95601 - DNA, 1047 bp, Glycine max
  Peptide Sequence Number=SeqID_212379
tccgatgcgctgacgttggaaaaccgcgttatctataccgatttcaacatcaaccgtcctaccgcttacaacatccaatacgccgagattgacggccaggaagttcacgtagagccggtggatgagttcgtcaacatcttcggcggatcgaccttcaaggataaaaccgatacccattcggcgttcgctgagctgacctatgcgctgacgccgcaggtggacgtgaccgccgccagccgtctggaacgcgaacaccgccgccgcgacggcggcagtcaggcggtgcgtatcgacttcgatgaaacctacaccgtgttcctgccgaagctggacgtggcctggaaaccgacggatacccaaacctacggcgccaagatcgcgcgcggctataacgccggcggcggcggcatcacgatcggcacgccggtggtcagctatacctacggttccgagtatgtgtggaactatgagctgtacacccgccatcacctgaaagacgccaacgtggtgctgacgggtaacatcttctacaacgattacaaagacatgcagctgccgtactcgttgggtgagaactccagcgtgatccgcaacgccgacaaggtggaaacctacggcgcggaaatcggcgccacctggcagccgcgttgggactttgagctgttcggcaacctcggcctgctgaaaaccgacatcaagaaattctcgggcagcggcgtggaagggcatgagctggcgcgcgcaccggcttacaccgccaatatgggcgccaaatatcagttcctgaaagggtgggagctgagcagcaacgtggcgttttcggactcctattactcggcgtatgacaacgattcgcgcgggcgtatcggctcctattggacggccaacgcccagctggcttacaccttcgactacggccgcgccacgctgtatgcgaaaaacctgtttgattccgaccgccgcgagatggtcagaagtaatgacatctacacggcgaccctgcagcgaggccgcctggtcggcgcggcggttgagctgaatttctaa

SEQ ID NO: 95602 - DNA, 1439 bp, Glycine max
  Peptide Sequence Number=SeqID_212380
ccgcaactgccggacgccgagctgttcggcatgatccccggcccggacttcgctggcggcggcccagatcatcacgccggccgccgacatcgcgcagatctacgccggcgggcgcggctcgctcaaggtgcgggcgcgctggcagttcgaggaaatggcgcgcggccagtggcagctggtggtcaccgagctgccgcccggcacctcgtgccagaaggtgctcgaagaaatcgaggaaatcaccaaccccaaggtcaagagcggcaagaagagcctgacgcccgagcagacgcaggccaaggccgtgatgctgaacctgctggacgcggtgcgcgacgaatccggcaaggacgccgccgtgcgcctggtgttcgaacccaagacctcgcgcgtcgaccgcgacgagttcgtcaacaccctgctggcgcagaccagcatggaaagcagcgcctcggtcaacctggtctgcattggcaccgacggccgtccgcgccagaagggcctgcgcgacatcctggccgaatggctggcgttccgcaccaataccgtgctgcgccgcacccgcttccgtctggacaaggtcatcgaccgcatccacgtgctggaaggccgcatggtggtctacctgaacgtggacgaagtgatccagaccatccgcgaatcggacgagccgcgggcggcattgatggagcgcttcaacctgtccgaccggcaggccgaggacatcctggaaatgcgcctgcgccagctggcgcgcctggaaggcttcaagatcgagcaggagctcgaggacaagcgcaaggagcaggtcgcgctgcaggaactgctggacaatcccaacaccctcaagcgctgctcatcaaggaaatcgaggccgacgccaagcaatatggcgacgaccgcccgcaccctgatcgagaccgccgagcgcgccgtgctcgaaaccaaggtgctggacgaaccggtcaccgtgatcgtgtcgcagaagggctggctgcgcgcccgccagggccacggccacgatgcctcgcaggcgacgatctctatggcgcctttgaatgccgcaccaccgacacgctgatcgccatgggcgacaacggccgtgtctactcggtgccggtggccgggctgctttcggcgcgcggcgatggccagccggtcaccaccatgatcgacctgaaaagcggcacccgcatcgtccacaccatcgcggcggcggccgacagccgctggctgctggccacgcgcggcggctatggctttgccgccaagctgtcggacatgaccagccgccagcgcgcgggcaagcagttcatcacgctggaggcgggcgacgaactgctgcgtccggtgccgctgttcgatgacgcaacgcagctggcgctgctgtcgcagaagggcaagttcctggtgttcgggctggatgaagtcaagtcgct

SEQ ID NO: 95603 - DNA, 814 bp, Glycine max
  Peptide Sequence Number=SeqID_212381
ttctgaggaccgtccaccaaagcagtctaaagtcagaggtcatttggtgaaaattgatgctgaaagtctcaagatattcctggagacacctgtggtattagccgaggggcagaccttacccgcatactccagatactgtaggttgcctacagactacagagagatagaggctgccttatgcatacctggccgagggtttatcttcaactctgaggaccatcctgggaagattcttaggaaggatctgactacactagctcagatgtggagtgtcctctcatactccaacttggcccccacatcacacacttctgacttgacagtggatagagctatgctgatctttggcctagtctctcgcatggatatgaacataggagcgttgatctctggccagatgacctctatagcccagtctagcacttctagacttgagttccctgctctgatcaccgcattatgtagagacagaggggttgtctctgatagcctcacttttgagcgtctgagcccgttcattaacttggcctacatcaagaagaactattcgaaccccgaggatctaacagtttctatccgaggggttaggagggcgagggctaggccaactgagctcccttccacttctgcggctcctactctagcatccacgtcagtagctccttctattccagcccagacagattctcagcgctttgaagccatgcttcagagtatccatcagggacaaattattcttttacagagtttacaggtggcggcgcctccagtatctattcccttagtcgagcagtttagagagttggtagtctag

SEQ ID NO: 95604 - DNA, 852 bp, Glycine max
  misc_feature (3)..(3): n is a, c, g, or t
  Peptide Sequence Number=SeqID_212382
gcnactctagaggatccccatggtgatggcgcgggccagcggctgcttgagcacccattgggtcacgaaggcgcccaggccgatcagcggattgaccgccagcgccgtcaccatggctgcgccactggcgtcgagattggggatcacgaccgctttcagatcccaacgctcctgcacgatgttgacgccccccgccagcacgatggccgcgaccgggccattgatcttgtagccctcggtattcagcgaaccatcggccagcttgatctggccgcgcacggtatcgaaaggaaagccgtcgcgcagcagcagctccagcaggcgcgccgtacgcgaattcacgtgcatgaagcggcccttgtccaggctgatctcggcgtcgcccaccaggtcggcgatgtcatgggtccatggcaggttgcgccaggtcgccttgcccttgatgctgccggtcccgccggacacgacccggtcaaagccgatacgatccatgaagctgccgacgttctcgaacttggcggtggcgtccaccgtcaagccacgctccgggccttcgaggcgccaggcaccggtcgcattcaaggccgcggcgtcattggtgatcgacagtttatccaggcgccactggcgaccacgctccagattcgtgcccagcacctgcaattcgcccaggttcttgccatagaggcggaattccttggcctgcaggtcgatggcgggaatgtccgacaggtcgttgccggaggaaagcgccttgtcggcctcgttggtgtcgtcggcgccgcccagcgcaagatacttgaaacgggcggtgatctggccggcgatcgcgccggacgcttcgcgccatga

SEQ ID NO: 95605 - DNA, 135 bp, Glycine max
  Peptide Sequence Number=SeqID_212383
atgggagtgagagtggtcgcaagcttcaaaccgaaaaagagtaccagtggtgagacagaggagactgagagtacgagtgtgagtgcgagttgcagtgtcgcgaaagtgacaaggtcaaggttctatttcttttaa

SEQ ID NO: 95606 - DNA, 264 bp, Glycine max
  Peptide Sequence Number=SeqID_212384
atggatacaaatgcatacatacacgacaagcataatacatacatgggcgaacaagggagtcgatttaataaacaaataatctacaagaaaaccgtcacccctgaaaaaagcaaagaaaaagactcaaaaggtcacaaccatgtgcagagcggagatataagagtcattgaaagggttgataatgatgagtgcaaaaaaacatcagttagcattgttcaacttctaaaacaacaagcacatcatcaataccaaaattctaaataa

SEQ ID NO: 95607 - DNA, 1575 bp, Glycine max
  Peptide Sequence Number=SeqID_212385
atgggtgaggacaaaaccacacaactccccagaagaatgaccaggtcttcagcttcatcttctgcatccacttcaaataacgtagctgcagcaaaagtaacttgccttgaacctctaacaattaatgaccttttagtcggaggagatcccatcagtctcaacgacataatatctagctttcctggtagaagtagccagattcttgaggtcgtgcgtcatttgggacctttgaattcaccaatccttcctttgtttgtgtatggaagttcttctactggaaaaaccagtatcattcttcaattattcaggcatctcaacaggcctattgtttattctagttgtaggacatgttataaccagaacatcttgtttgaatctattctaaatcagctacttctccatagaaaaaatgctgccaatggttattcgaatgcaaaacgctgtgaaagaccatctgattttgtcaattttcttcgagaagcgttgaccaatgttataaacaatctgaagaagtcagagaagttgatctcaaatgagatgacacaagggaaaattggaaatatgatctacttggtgtttgacaattttcagcttgttagggagtgggataagagttcaactatattgcccttgctgtttaatctctatgatctgctaaatatgcctgaggtgggtttgatttttatcagcagtacttctccagataccttttactctaacatgggttatgtggagcctatccccatttactttcctgattacacagaagaagatattcgtcaaatattattgagaaaccaagtgaaccagaagctatattcctcatttctggatgtatctctgaagtctttctgtggaattactaagcagattgatcatttatctgctgccttaaagccactatatgaaaagtattgtgagcctttaagtgataagggaaagggagttgctcctaatcaagaaatgaagcgaaggctgcttgctcatatcaaccctcatattgcctcctctttgaatgagatatttaaggtttcatctctttcttcaactgaagttgagatccgtaaagaggaaaagcggaagggaaataataggagattggagcaatctgaagaacttggcagtcttgattttcatgtatctactagtgcaaaatatcttctgatttcagcattccttgcctccagaaacccagcaactcttgatgcttcactttttgattccaaaggtggttctgataatcggaagcgaaagaggaagccctctgagaaagcacaggaacggaaggaaactttagaacaggaactactaatgaaaggacctggaactttcccactggagaggttgttagccatctttcaatgccttgtatcagttgcagaagaaccatctgacgagcaggagcaaaataatgatggattaggagttgaaggtggcaatggtggactgatgtctgatgttcttttacagctatccagtctctgcaatgctaattttatattcaaaggaaggagctgtcccattgaaggctcaatgcggtatcgaacaaccatatctgaagaccttgctctgaag

SEQ ID NO: 95608 - DNA, 1350 bp, Glycine max
  Peptide Sequence Number=SeqID_212386
atggtaagatgcttggagtatgaaccagatgagccaccgacaatggatgaagtagaggtggaacttgagcatgttctgtcattgcatgaacaagcagatatatctaacaccaacgtggctgaggcacatcaccctgggcgtctgaatgaagtgaatgattggttggataaagttgaagccatgcaaactgcaaagggaagtccaagctattcagcaaaaagtttctcaaggcattttgatgtagtggctcaggaagtgccacatgctttggtagatgaaatacctctagaggccacagtaggtctagaatcaacctttgatgaacttagtggatgttttgatgacaatcatgttggagttattggcttgtatgggataggggaaaagcacgtaatcaaggatgtctacgaaggtcttttagctgaatttggtgatgatgtctacgaagcacgtaatcaaggagaagaaatcatagcaagcttgaagcttacttgtttgttggaggacagagagagagaaaacaggattaagatgcatgatatgatcagagacatggctttgtggctagcatgtgatcatggatccaacaccagcattcaaatcctctcaggaaaatcagattgctcaaatctctcgactatgattgtcagaaattctgagctaacagacctttctgatgagatctttctgactgcaaacactcttggagtgttagacttgtcagggaataaaagagtaaaagaattacatgcgattattggggagttagttagcttgcagcatttggatctatcaggtactggtatacaagaattgccaagggagctccagaacttgaaaaagttgagcaccacgagagagaaaagcacaatagatttgagccaatacccaacagagctcgttagaaacttctcaatcattgcttacgttgatcatggcaagttcacactcgctgatcggcttctagaactcactggaaccattaagaaaggccatggccaaccccagtatcttgataaactgcaggtggagagagaaagaggaatcacagttaaagcccagacagcaacaatgttttataagcacagtgtaaatggcaatgattgcaatgatggaaaggaaggaaatgagtcacctaagtttttgctgaatcttattgacactcctggacatgttgattttagttatgaagtgtcgaggtcactggcagcttgtcagggtgtgcttttggttgttgatgctgctcagggagtccaagcacaaactgttgctaacttttaccttgcctttgagtctaacctaacaattgtgcctgttataaagcccgagattgaccatgcacaagattga

SEQ ID NO: 95609 - DNA, 378 bp, Glycine max
  Peptide Sequence Number=SeqID_212387
atggagagttgggcacgggataattgtctcaacgaaaatggcaacaatgtcctcaccggagtccggcgagtccctgaccggagcttgacgaatccgatcacgggtccggcgtggcgcttcatcatctcctgctggatctgcgagggatcgagcttggagatatcggagggagggaaagagggttcgggtttcttgccccattctcgccacgcgtcgtcctcctcgtcgtcgaacacgtcgtccaactcgtcggggatgtggaccttgcgctttccggcgagggcaaaatgggaatttgcagacgcgaggaggaggaagagaaggagagtggggacgggttggaaggtcatggggaagagaggatcaaaggaggaatga

SEQ ID NO: 95610 - DNA, 1017 bp, Glycine max
  Peptide Sequence Number=SeqID_212388
atggcggataagtttggcaatgctgaaaggaaagacagggagatgggtcatctctatgctttggactttgatggagttatctgtgatagctgtggtgagacagctatctctgctcttaaggctgccaaattgagatggcctcccttgtttgatggtgtggattcaaccatagaagattggattgttgaccagatgattacaactaatgatgctaattctaaacgtgaaaatgaaaattccaaccaagagaccataaatggaaataacttatggactggttgtagatgtgaagtgggaatgtgggatttcgttccttttcattataaagaaaaagattgcggggtacggccagtggtggaaactggatatgaaactcttttacttgtgaggttgttgcttgagactagagttccatccatcaggaagtcttcggtttcggaggggctcaaagttgaggatatactggagaactggttcaaattgaagcctatcattatggaagaatggaatgagaatagagaagaactaatagacctttttgggaaggtcagagatgactggttggagagggatttcacaggttggattggagcaaacagactctatcctggtactgctgatgctttaagatttgcaagctcaaaagtgtacattgtcaccacaaaacagagccgctttgctgatgctttactaagagagcttgctggagtgactatagcaccagaaagattatatggtctaggaacagggttatcccaaggtggaagtgctaaagaagcttcagaaaatgccagaacaccaggggctgacactacagttaagatattgtgctttcagagctttgtggaagacaggcttgcaacccttaagaatgtcatcaaagagccagagctagataactggaatttatatctagtgaattgggggttcaacactcagaaagagagagaagaagcacaagccaaccctaggattcaagttattgagctctctgacttcagtagcaagctgaagtag

SEQ ID NO: 95611 - DNA, 201 bp, Glycine max
  Peptide Sequence Number=SeqID_212389
atggctccgtctgaaggtaaagtgaagtgtaatattggtgcagccttctttaaagaaagtaactctatgggtattggagtttgcttgaggggtcaccatgttgatagccagagagtgtacaatggtatgaagcgtaggtctctagacccttctgaatttggcattattattatgcagtgtaaggagtgtctgtttggttag

SEQ ID NO: 95612 - DNA, 672 bp, Glycine max
  Peptide Sequence Number=SeqID_212390
atggaaatctgtgttacaactagtacatcagcagggcttgagcagattctaccttggatgttttatcataaagtcattggtgtgacaaatttttttctttttgttgaggggaaggctgcttctcctgaagtatcaaatgtcctagaatcaattcctggtgttaaggttgtatatagaacaaaacagctggaagaacaacaggctaagagccgtatttggaatgagacatggctggcaggtttcttttataaaccctgcaattatgaactttttgtgaagcaatctctcaacatggagatggctattgttatggcaagggattctggcatgaactggattcttcatcttgatacagatgaattaatgcacccagctggtgctcgggaatattctttaaggcagttgctccttgatgttccaggacatgttgatatggtcatatttcctaactatgagagcagtatcgagcgagatgatatcaaagaaccttttagtgagttgaggtacaagcctaagccttttagttttagttcaaagtttgagattattaggcaaactggtgcatcgggtcactgtactttagaggggttaaaaattcttgaaggttgcgatgttgtgatggaaaacatttattgctgggttgagtgtcatgttggaatttttttcagctga

SEQ ID NO: 95613 - DNA, 366 bp, Glycine max
  Peptide Sequence Number=SeqID_212391
atggtgaaactggatattctcttgaacggacaaccagttgatgcaatggctaccatagttcataacacgaaagcatatcgtgttgggcgtgaactgacagagaaattgaagggcgtcttagacaggcaaatgtttgaggtaaacatacaagctgccattgggtcaaaaatcatagcaagagacctaagcttctgtttaaagatttccgctatgaggaaaaatgtccttgctaagtgttatggtggtgatgtttctcgaaaaaggaagttattggagaagcaaaaggaaggaaagaagagaatgaagcgtgttggttccgtcgatgtaccacaagaagcatttcacgaattattgaaggtttcttag

SEQ ID NO: 95614 - DNA, 390 bp, Glycine max
  Peptide Sequence Number=SeqID_212392
atgaggtccttcaatagtgatttttcaccatggagatgcagcggaagacaaaggagaagaggagaggggagacaccatccactaaggaataagccatggaagaaggagcttcaccaccaagaatgtgccttggataagaagcttgaagaggatgcgttaatagaggaaaagaaagagagagaaagagagagggaggagcatgaaattgaaggaggaaaagggggagagaagttgaactttgagttgtgtctcacaagactctctcattcatcaaaacaaagaatcaagctgaatgatttgatgatgccaagggatcacatgcttctcaaagctttattcaagacaaagaaattaaagatattcaagatggatgatcaagacagtctctag

SEQ ID NO: 95615 - DNA, 510 bp, Glycine max
  Peptide Sequence Number=SeqID_212393
tatgagcgtgtacattaagctggcaaaaactcttctcgttgtggatgtgtcaaaagaactactcacggtcttccatgtgcatgggttatttaagcctcaagtgaccataatcaaagagatggaaaccatatccaagcgatgtgaagagcttgatgtttgtggcaaagttactctaaagagtaaactctgggaaattgcctaccctgatttaaaatctatgtgtcctcctccaaaaaaggtgaacaccaaagatgcacaaaacaaaccaatgatcaaacaccaaagatcaacaaagtgtgatccgtattactgggataaagattcatggtcattggtacgcaactatttgcttaaagaacttgccaaatggtttgatgagtatatcaacttctttggcggcatagacagatttgaggaattaaataggtctttacttattgatggattatccatggttattatggataagtggatggatataaccgacatgggatatgtcattgcatcaag

SEQ ID NO: 95616 - DNA, 168 bp, Glycine max
  Peptide Sequence Number=SeqID_212394
atgacggaagattcatcaaagttcacacatatctctcccaagaaaagtgggcatgttacttatggtgataacaacaaaggtagaattcttggagttggaaaaatagatgatgatccatggctatggcataaacgtattgctcacataaacatgggaacacttaaataa

SEQ ID NO: 95617 - DNA, 791 bp, Glycine max
  Peptide Sequence Number=SeqID_212395
atggcagacaacacacgcatgaaggagcttacaggggatgtcaaaaggatcctggagatgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcagaacagtttcgttggccaaactctatgaagagaaatatacacctaaactcaaacctttttcttcgagtttttcttccaaaacacaaacctcaaacacaaactcaaacctaaacataaaccaaaacagcccgcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctaca

SEQ ID NO: 95618 - DNA, 619 bp, Glycine max
  misc_feature (43)..(43): n is a, c, g, or t
  Peptide Sequence Number=SeqID_212396
atgtttgggtttggctatgatccgtcaagtgacaaatacaagnttgtagcaattgcattgactatgctctcacttgacgtatttgaaaagactgagatgaaagtttatggcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttctattgacctggagaaggagacttgcagatcactgtttcttcccgacgatttttgcttttttgatacaaatattggagtttttagagactcgctgtgcgtttggcaagatagcaacacccatcttggcttgtggcagatgaggaagtttggagatgacaagtcttggattcaattaataaattttagttatttacatcttaatattcgtcctaatgaagaaaaatcgatgattttaccattgtgcatgtctaacaatggagacttcttcatgatgaaattcactagaaatgctgatgatgaataccaaacaattctgtataaccagagggatggtaagtctcaagtttctgtcgtttcctcag

SEQ ID NO: 95619 - DNA, 318 bp, Glycine max
  Peptide Sequence Number=SeqID_212397
atgaaagttcagatttcaaagctcatttggagcacaaaatttcgtgctcttctctccctctcccttcattcatctccttcttcctccaagctcttatccatggcctcctatggtggtgagcttcttctagactcatcttctccttgtagtggcgtctcctctctctcttccttctccattccactgccattcatcttccaagaagcaaaggaatccattgatgaagaagatcctaggcctaaaagctccaatggagcttgcatcactgacccattaactgccctaactcctttagactggtggtccctaggctcttga

SEQ ID NO: 95620 - DNA, 141 bp, Glycine max
  Peptide Sequence Number=SeqID_212398
atggccagggcacaaaatcccacagcacaccatagtgcctatttaaggaaaagagctctggaggcagcaagaggagcaactttggcagagatacctaggttttgcctaaccttacaagagggatttgcggacgaagcttag

SEQ ID NO: 95621 - DNA, 176 bp, Glycine max
  Peptide Sequence Number=SeqID_212399
ttgtctccagaatagatccattggatttaatgatgaaatatgtgcaatttcaagtgaaaaagaggctaagtcatgaagtgccaaaagtgaaaaagcgtgagatcagtgcgctaagcgcaacaggtgtctttagccaggctcagcacaagactggcgctaagcctgaatccacttaa

SEQ ID NO: 95622 - DNA, 516 bp, Glycine max
  Peptide Sequence Number=SeqID_212400
atggcgagcaacccttccagagctcagaagaaagccaagtattccaagaggaagcaagtcaatggagtagaaatggttatcgatgctgatgtatggaaaggagtaactggactagacatgggtgaagtcagtaaatttgaagaatttgctgatgggtacaaaaagatgcagacctacaggggaatgcttcttgacccaacaatgaatttgaggaatcgcctagatgtaggtggtcaaacagtagaagacataatactagtgtacctcattacttatattctcactctgagattcattgactatttcaatgtcaatgtatctaacgagatggcggattttaccaaagcatctagtgagatcaccaaaaggcatctcaagaatcttgggatgaggtttgttgaacatgagtggattatggctggaaagccaccagcagtaggaaacatggatcagatggatgaagaagctgaagcagaagctccacaagagcttgcacatcaatggagtcctttttag

SEQ ID NO: 95623 - DNA, 141 bp, Glycine max
  Peptide Sequence Number=SeqID_212401
atggactcgggaaggttccagattagtataccaggtgacggcttccccagaaagcctgggccaccaagatcacttcatggtgaagtaaccagctcgcctgggcgagctcagcttgccagggcgagggttgctttagaatga

SEQ ID NO: 95624 - DNA, 315 bp, Glycine max
  Peptide Sequence Number=SeqID_212402
atgactgaagacattgtcgtctttaagtcgccaactgaagacattgtccccagtggagtcaccaactgtcgcaacctacccttcgatgggggtgcgaaaaggccaaaatcatgggccaaagcgtttgcctccaagggagaaaacgagtggagtcgccaccaatctttatttgaggaaaacgttaaaaaaaccataaaggacgaaggtctgtgtatttttgaaaatgagggttcgagagttgtttatgcatggggaagggtattgccctcactcctatgtatcctcaggtacgatgaggaacttagacctatgtag

SEQ ID NO: 95625 - DNA, 201 bp, Glycine max
  Peptide Sequence Number=SeqID_212403
atggtagccataaccctagccaaggttcctcaacctccatttttccggggatacaactcaaatgcaacatgtgcttatcatggaggagttttggggcattccattgagcattgtatgaccctgaaacataaggtcatgacaaaagacaacaatgggtacctcagagccctacactggggaaatgagaggcaccatgcatga

SEQ ID NO: 95626 - DNA, 606 bp, Glycine max
  Peptide Sequence Number=SeqID_212404
atgggggcatactcgaaagatgaaaaattgttgatgcatttcttccaagagagacttattggggcagtcgtcacatggtatactaatctggaaccttcccaagtccattcttggaaggacctaatggttgccttcattaggcagtatcagtacaattttaatatggctccgaatagaatgcagctacataacatgtgtaaaaaggagcatgaatctttcaaagaatacacccaaaggtggagggatctggcagctcaagtagcacctccaatgatggaaagggagatgatcacaatgatagtagacacgttactggtgttctactatgagaagatggtggattacatgcctttaagctttgctgatttagtttttgtcggtgaaatgatcgaagtgggtctgaaaagaggcaagtatgatcatcctgctttgatgaataggaagcctggggcaaatgtagagaatgaggaggagggaggaacccatgttgtgattgccgttcctacatggccaaatttcccactagctcaacaatatcaatactcagccaatagcccttctcattacccaccaccctatcaaccaagaacactcaatcatccataa

SEQ ID NO: 95627 - DNA, 384 bp, Glycine max
  Peptide Sequence Number=SeqID_212405
atggaaaagagggagaagggtgagggagagggagaagatgtggaggaggtaggcgggagagaaaagggagaagaagatggtggtgaattctggggtggttgcatgcaatctggcggaggtgccggtggtgggcccggccggaaaccggcggggcgggcgccatcgacgtcatcagcggctgcatcgccgtcttcttcgtcatccgcggcctcacatttggagtcattgcagcagcagcagcaacaacaacaacaacagcagcagatagtgatggcaagtgtggtacctggttttgctgctaattcagattttggaacacatgggagtgtgaaaaaatgggttgtggtggaatttgcaattaatgcacttggtgttggggtttag

SEQ ID NO: 95628 - DNA, 387 bp, Glycine max
  Peptide Sequence Number=SeqID_212406
atgcagtcatttcaacagcaactgcttagaaaacctgaagggagtgaagcatttttggcatatcaagctggtcttcaaggagtatttgggagtaacaatttcccatctagttccatgcagttacctcagcaatctcgaaaatttgttgatttagctcagcatggctccaaccaggttcaaggtgttgagcagcaaatgctaaatcctgtacaagcagcatactttcagtatgctctgcaggcttcgcaacaaaagtctgctttggcaatgcagtcacagcagcaacctaaagtgggaatgctgggcccttcatctgtaaaggatcaggaaatgagaatgggaaatttgaaaatgcaggatcttatgtccatgcaggcagtgaatcag

SEQ ID NO: 95629 - DNA, 613 bp, Glycine max
  Peptide Sequence Number=SeqID_212407
atgggattgaatcaagcacccacttttaagaaaagaacagcggatggatcaactccaacgtcaagctttccacaagacatatggaaagagctgggatctggctatgataaagtctctgttgaagccattgcatccctcactcagtattacgatcagtcgctaaggaagcatttggaggagaaagcgaaggctttagcggttcaaggtgaatgggcttcattcattgatatcttggtgctattggtgtttggagttgtcctctttccaaatacggatgggctagtggatctagtggcgatcgacgccttccttgcttatcactatagcaaggaaagtccggtcgttgctgttttggccgatgcttatgacatatttgaccggagatgcgagaagagaggcgcaaggatcgtctgttgcacaaccgttccttatatatggttggtctctcacctctttcatcatgaaagtagacctgtctgtcccctacaaggtcaccgcatgtgcgtcgagaaaggggaggcaaattgggagcagctcttggctggaatggtagaggcatccattaattggttcccccgatggaaggaaggaaaagctatagttttgtcctcat

SEQ ID NO: 95630 - DNA, 408 bp, Glycine max
  Peptide Sequence Number=SeqID_212408
atggtggtagtggtgttgctgtcgacaacaaatgatggtggtagtagttgtgataatgttggtggcgatgacaaaggtggtattggtgttagtggtggtgacaatgacgatgtcaatgaagggtgtggtggtagcagtggtagaggtagtagcgatagtggtgagagcagcattagtagtagcaatggtggtgtggtgacagcaaaaagtgcaattttcaaatatatctgtctgagaagaactaggatgatgtgtccgagatggattgctaacaaatcagaaattactgctatttttaggattgatctccctatgactatgagtgttgactctagcgtacttcaagtgaaccatggtccaagaccttcaaagtttgatcgatgctctagtgtagttgaaacacgatga

SEQ ID NO: 95631 - DNA, 5007 bp, Glycine max
  Peptide Sequence Number=SeqID_212409
ggaccagctgttggaaacttaatgcctggaaatattataagacctgtgcaagctctggcaactcagcagagcatcccgaacactatgaacaaccagattgcaatggctgctcagttgcgggctatgcaagcatgggcacatgaacgaaatattgatctgtcacatcctgcaaatgctaacttaatggctcagctcattccactgatgcaatcaaggatagttcaacaaccaaaggcaaacgatactaacttaggtgcaatgtcatcacctgtccctgtttcaaaccaacaggttacttctccggcagtcgcaagtgagagttcagcacatgctaattcatctagtgatgtgtctgcacaatctggttctgcaaaagccaggcagacggctccacccagccatttgagtccaccaattagtgctggtatagccagtagctctagtgacatggcagcacagcaattcagtcttcatggcagagacgctcaaggatctttgaagcaatcagttctaaccataaatggaatgccttctgtgcatccacagcagtcctctgcaaacatgaacttaggtgcagatcatcctctgaatgtaaaaacttcatcatctggttcagaaccagcgaaaatgcagtacatcagacaactaagccaatctacttctcaggctggaggtctgacaaatgaaggtggatcaggaaatcaccccaaaactcaggggggaccatctcagatgcctcaacaacgaaatggttttaccaaacaacagcttcatgttcttaaggcacaaatactagcatttaggcgtctgaagaaagcagaaggtgcactcccccaagaacttcttcgggccatcattccaccacctcttgatttgcaagtgcagcagccaattcattctgaaggagcacaaaatcaggagaaatctgctggaaatattgtggcagaacacccgaggcagaatgaggtcaatgccaaagattcacagcctatctcatccattaatggaaagaactcttcaaaacaggaagtctttgtcagagatgagaactccactgtaacggcagttcaggtgcaaggcacacctcgtgtgacaaaggaatctgctggaaaggaagagcagcagtctgttgcatgctctgctaagtcagatcaggaaagtgaacatggaattggcagaactcctgttagaaatgagttagtattagataagggaaaagctgttgctgctccccaggcttcagtaaatgacgcaatgcaactcaataaacctgcacaagcaagtgctgtttcccagacaaaggatgtgggatccaccagaaaatatcatggacccctatttgattttcctttcttcaccagaaaacatgattcgtttgggtcatcaatgatgatcaacaacaataatttgtcattggcatatgatgtgaaagagcttctttttgaggaaggcatagaggtccttggcaagagaaggacagagagtttaaagaagattgaaggtttattggcggtaaacttggagaggaaaagaattaggccagatcttgtgttgaggttgcaaattgaagagaaaaaacttcgccttttagatcttcaggcacgtttaagggatgagattgatcaacagcaacaagagataatggcaatgccagataggccataccgcaagtttgttaggttatgtgaacgtcagcgtatggaacttgctagacaagtgcaggcatctcagagagctttaagggagaagcaactgaaatctatatttcaatggcgcaagaagcttcttgaaacacactgggccattcgtgatgcccgtactgctcgcaacaggggggtggccaaatatcatgaaaggatgttgagagagttctcaaaacgtaaggatgatgaccgaaataaaaggatggaagccttaaaaaataatgatgttgacagatatagggagatgttgctggagcagcagactagcatccaaggtgatgctgcagagagatatgctgttctttcaactttcttaacccagactgaagagtatctccataaattaggaagtaagataactgctgctaagaatcaacaggaaggtctttctgaagaagaagtcagagcggcagcagcctgtgctggagaggaagtgatgattagaaatcgttttatggagatgaatgctcctaaagacaattcatctgtcagcaagtattacagccttgctcatgctgtgagtgagaaggttgtatgccaaccatcaatgttacgggcaggaacactaagagactatcaacttgttggtttgcaatggatgctttccttgtataacaacaaattaaatggaattttggcagatgagatgggtcttggcaaaactgtacaggttatggcattaattgcatacttgatggagtttaaaggaaactatggcccacatcttataatagtcccaaatgctgttatggttaactggaaggagattatggctatgaaatttaatgtcctggtgactacttatgagttcatcatgtatgaccgggcaaggctttcaaaaattgattggaagtatatcataattgatgaagcacagagaatgaaggatagagattcagttctagctcgtgatcttgatagatatcgttgtcaaaggcgcctgcttctgacaggaacacctttgcagaatgatttgaaggaactgtggtcgcttttaaatttacttcttccagaggtttttgacaataagaaagcctttaacgattggttttcaaagccatttcaaaaggaaggtcccactcaaaatacagaggatgattggcttgagactgagaaaaaagttatcattatccaccgtcttcatcagattcttgagcctttcatgctcaggcgtcgtgttgaagatgttgagggttcactaccaccaaaggtctctatagttttacgatgtaagatgtcagctgtccagagtgccatttatgactgggtcaaatcaactggtacccttcgtcttgatcctgagggtgagaacagtaagattcaaaagaatcctcattaccaggcaaaagagtacaagactttaaataacagatgtatggagctacgtaaaacttgcaatcatccatctctgaattacccattacttggtgaattatctacaaattcaattgtaaaatcttgtgggaaattgtggatcctggataggatccttataaagcttcaaagaactggtcatcgggttttgctgtttagtaccatgacaaaacttctagacctcttggaagactacctgaattggcgaagacttgtgtacagaagaattgatgggacaactaatttggatgaccgtgaatcggccataatggactttaatagccctgattccgactgtttcatcttcttgcttagtattcgagctgccgggagaggccttaaccttcagtctgctgacacagttgtcatttatgatcctgacccaaaccctaaaaatgaggagcaggctgtggccagagctcatcgtattggacagaaaagagaagtcagagttatctacatggaagctgttgttgacaaaatctctagccatcagaaggaagatgaattgagaagtggaggcactgttgatatggaggatgaacttgtgggtaaggatcgctatataggatccattgagagcctcataaggaacaatattcaacaatataagatagatatggccgatgaggttatcaatgctggacgtttcgatcaaaggacaacacatgaagagaggcgtttgaccttagagacattgttacatgatgaagaacggtatcaagaaaatgtccatgatgttccttctcttcaggaggtaaatcgcatgattgctaggagtgaagaggaagttgaattgtttgatcaaatggatgaagaactggattggcctgaggacgtgatgcaacatgatgaggttcctgagtggctccgagccaatacaagagaagtgaatgctgctattgctgctttatctaaaagaccatcaaagaacactttattgggtggtagtattggcatggaatccagtgaggtgggttctgaaaggagaaggggacggcccaagggaaaaaagcatcctaattataaagagttggaagatgaaaatggagagtattctgaagcaaattctgaagacagaaatgaagattctgcacaagaaggggaaaatggagagtttgaagatgatgggtatagtggggctgatggaaatcgattggaagaggatggtctaacttctgatgctggatatgaaattgccctttcttcagaaaatgctagaaataatcatgtggttgaagaagctggttcctcaggatcatcctccgacagtcaaagattgacaaagacagtttcaccatcagtttcttccaaaaaatttggctccctctctgcattggatgccaggccaggctccatttcgaaaattatgggagatgagttagaggaaggggaaattgtagtatctggtgattctcacatggatcatcaacagtcaggtagttggattcatgatcgtgatgaaggtgaagatgaacaagttttgcagaaaccaaagattaagcgtaagcgtagtcttcgtgttcgtccccgccatgccatggaaaggcccgaggacaagtctggcagtgagatgatttctcttcaacgtggagaatcatctgttttggcagattataaatatcaaattcaaaaaaggattgatccagaatcaaaatcttttggagactccaatgccagcaagcatgataagaatgaagcatcactaaaaaataagcaaaagttaccttcaaggaaaatagctaattcatccaaattgcatggatcacctaagtctaatcgtttgaattgcacatctgctccttcagaggatggcaatgaacaccccacagaaagttgggaggggaagcatctcaatccaaatggatcttcagctcatgggactaagacaaccgaaatcatccagagaggagtatgtgccattatgtga

SEQ ID NO: 95632 - DNA, 2652 bp, Glycine max
  Peptide Sequence Number=SeqID_212410
atggctgtggtgagtcctatgcctgcaacaacacaaaggatgggttcagtgaggtcactttctgatgctggtggaaaatttttggaagagcctaatccaagtgtggttgatcagccaatctatgttgctgtgacaaaagaggtgaaggagagcagattaaatctgatatgggcaatacaaaactccggaggaaagagaatttgcattctttatgtgcatgttcgtgcaacaatggtccccctactgggaggtaaattccctgcaagtgcactaaaagaggagcaggttcaagcatactgggaagaagaaaggcaaggcatgcataggattctggatgactatcttcgtatttgtcaacggatgggggtgagagcagagaaactgcatattgaaatggatagcattgaaaaaggaattttagaactcatctcccagcatggcatccaaaagcttgttatgggagcagcatctgataagtactataatagaagaatgatggacctcaaatccaagaaagccatctctgtgtgtaaacaagctccagcttcttgtcatatacagtttgtctgcaaagggcgcctaatacacacaagggatcgcagttccaatgaaggtaatgcagatgtcacatctcctttggtgcagcaagtgccaaactctgtgagatctttgagatctcagtctgtaacacttggtcaagatcgccgagcaaatctgaccaatcctgctctagagttatttcgcagagtaaggtctgccaatgatgggcatggagcaagctttatgactgtttcttctccagaagacactgaagggttttcaactccacatgacaggatgggtaccgaagtaagttctgatgaatcagataggctgtcaaggatgagtccttcgggattgtcaacatgctctgacagtgcagttgaactagcattcaccccaagtttgattaatgaaagcagtgagaatgcattggagttgactttgagtcgccggattatagaggatcttcattattcatctcctcctagtacactggatggtggaatggatgatactatctacgaacaacttgagcaggctagagctgaggctgagaatgctacgctaaatgcataccaagaaactgtaaggcgtaggaaagctgaaaaagatgcctttgaagctatacgcaaggttaaagcttctgaaagtttatatacagaggagttgaacctgagaaaaatgacagaggaaaaacttaggaaagaaaaggaagaacttgagagtatgaagagcttgagagacaaagttaaggaagaactctgccttgctcttgatcagaaggaatcactagagagtcaaattgcatcatctgaacttatggtaaaggagttggagcagaagattttatctgctgtggatctgttacaaagctacaagaatgaacgagatgaattgcagatgcagcgcgataatgcattgagagaggctgaagagttgaggaaaaaacaaggagaggcctcaggcaccaatgtgcctcaattgttctcagaattctctttttcagagattaaagaagcaactagtaacttcaatccatcctcaaagattggagaaggtggatatggaagtatatttaaaggtgtcttgcgacacactgaggtggctataaaaatgttgaactctgacagcatgcaaggacccttggagtttcaacaggaggttgatgtgttgagcaagcttaggcatcctaatcttatcacactcataggggcctgtccagattcatgggctcttgtctatgagtatttacccaatggaagccttgaagatcgtcttgcctgcaagaataacacccctccgttgtcatggcaagctcgaattcgcattgctgctgaactatgctccgctctcatctttcttcattccagtaaacctcacagcgtagtgcatggtgacttaaaaccctccaacattctccttgatgcaaaccttattagcaagcttagtgactttggaatctgtcgaatattatcaaactgcgagagttccagtagcaatactacagagttttggagaactgacccaaagggaacttttgtctacatggatcctgaattccttgcctcaggggaacttactccaaagtcagatgtttattcatttggaatcatattgttgagattgttgactgggagaccagcattgggaataacaaaggaagtgaaatatgcattagacactggaaagttgaaatccctattggatcctttggctggagactggccatttgtgcaggctgaacagttggctcgcttggctttgaggtgttgtgatatgaatagaaagagccgaccggatctttattcagatgtctggagggtacttgatgcaatgagggtttcttctggaggtgcaaactcctttggattaagttctgaagggcttttacaacctccttcatattttatttgtccaatcttccaggaagttatgagagatccacatgtagctgcagatggttttacatatgaagctgaggctatacgaggatggcttgatggtggtcatgacaattcaccaatgactaacagtaagcttgcacatcacaatcttgttcccaaccgcgctcttcgctctgcaatccaggactggcttcaaaaccactga

SEQ ID NO: 95633 - DNA, 451 bp, Glycine max
  Peptide Sequence Number=SeqID_212411
atgagtcgattgatgttgggaagcgagtatgcatcctttaggcaaggcttgttgagctcgtcagcactcatcactgagcttccatcgttgttgtgccacgggtttggctttgaggaaaatgaagagtttgtggcatatgaaattggggtgctcattaagtctttcccctatcttggtgcattggtgtggctcattgccgagctggaaatagcacaactcctatgtcaatgttggcctcatatcttcctcgtatctccttgggttgaggcttttggcgtagcactctcaggcttccacttggtcttcttttatcgtgacaatgccaccatgttggttggggaacttcattgtgagatgagtaacgttctcgacaactctcctcgtccgaaagtggtcattagctctactgcaccgtgggtgtggacttatccccctgtaaaagtgatcaagg

SEQ ID NO: 95634 - DNA, 618 bp, Glycine max
  Peptide Sequence Number=SeqID_212412
atggcagccaaggtcatccacgccagttactattgttcgaccttaaggacgaattgcgccaaaccatttcccacgcccaaggaacaggtcgaattcctccttattgtggtggactacttcactaagtgcatcaaagtcaagcctctcacaatgatcacaactcacaaagttcagaagtttacatggaagaacattatctgcaggtacgacctacctcaagccatcgtgatggacaacggaagactgttcatagaaaaaatctatgaagagttcctcaagcagctcagcaccaagcatctcccatcctcgatcaagcatccccaaccaatgggcaagcgtaatatgaggctgtcgcaacatgcccttttgcgggcaagcgaggcgaggctcacgggtgcgctttccaagggaggaaaatgcgtggagtcaccaccaacgtttatttgtggaaaacgtcggaaaaaccgaaggaaaccggtcataaagaatattccaagttcgggagttgtatttacgtttgaagaaggtattagcacctctcacgtcgacaaaagcgaggctcttgctcctacgtaccctccatcgaagaggaaatcagacctacgtagttctttctaa

SEQ ID NO: 95635 - DNA, 744 bp, Glycine max
  Peptide Sequence Number=SeqID_212413
atgtacccatcacacggcaaggcgacattcataactgaaaatgtcaacttctgctacaaagtcatgccattcggtttgaagaatgccaacaccagataccagagactattggaaaatgtcttcaaagacctactttggaaaattatcaaggtctacatcgatgatatggttgtaaagtcgactgaccccagcaatcatctgaaagacttggcggagatattcgctgaactccgaaagcacatgtgcctgaacccagagaagtacatctttggggtcgaaggggagtcactaggttacagtgaaaaccgaccaccccttcaagcaggtactcagaaagcccgacctcacggccgaatgtcaagttcccccttaccgaggacaacagtgaaggctggtggacgttgtatgtggacgaagccttcgatagaaagggcaacaataggcgtcacccttgaagggccaaataatgtcattatcgagcagttagtaaatttcgactggaagtcttcaaacaaccaagaagagtgtaaagctctcattgcaggactgaagctagcgatcgaggttggcgtaaaaaaattgaggtgcatgagcaactctaagctcatcactgagaaggttaacaaggtcttccaagctagagagacatgcaaaagtactaccatatggtcaagcaactcttggagcatttcgagcaaatggtctacatcgacagggaacagaacaaccgagctgatgctttag

SEQ ID NO: 95636 - DNA, 285 bp, Glycine max
  Peptide Sequence Number=SeqID_212414
atggaaggttcccaacaaaacactcactatcctaaggaaaaattgcctaaaattattacacacaaatggaagtttggtaacctattggaggctcccaacacacttccaatgaaaggcctttttgttacaaaacttgcaagcaatgaagtgcttcttagtccaatagcacttaaggtggttggccccttgcttctggactcaaattcttcaagggatggcaccaatcctccttccaattccctatatggcaacccacaaacaaggaaacaaagagacaagcaataa

SEQ ID NO: 95637 - DNA, 390 bp, Glycine max
  Peptide Sequence Number=SeqID_212415
atgtatgtccgtacatgtttttgtgatgctctaataaaggagcatctgatctgcctccatagcatccctaggttgggtttactctcatcagtcatccctagtgtgcaaagtgacatcaatgctttgaagtcattacagcgaaggaaggattctgtagacttttctttttcaccattttcatcaaagcttctttctttgtctcttttccattcttcagaatttctggtgcctttatactggtcagattttgaccctatagataaggtgatgagaatcctgaaactggccaaatacaggctaaaggcccaagtggagaaggacgaaggcccaagtggagaaggacaaagcccccgagtggagaaggatgaaggcccaagtggagaaggatga

SEQ ID NO: 95638 - DNA, 669 bp, Glycine max
  Peptide Sequence Number=SeqID_212416
atgacgcctgtgacggaaccatcccttgctgcgtctactattatggttgttgtttttgctgagactatggttgaggttgaggttgaacatgaggcggtggcggtggcagtggcaatggcactggcggtggagagtgagagacgagaaaagtctttagaattggactttgcacttctctttccagagcgccatgttcttttgcgtgttttgcctgttcttgttgtcctagtggcatcttcagagaaagacaacgagtctttgtacaagagggtgaaaatcaacagactaatcaatatatttaagaatgaagcagtcattcctccatttctagatctgccctgggatgaactaatgaactttgaatttctaaagcattttgtgtatgctccaaggccaggtcctaaacgtggtccatactcatgcttacagcaactcacccaaactcacaaggacagagatcaagctatttttgttttccaaaacactcttcaatctttttctcggttcagaatattgagtgcaggaaaaggaaaaattccacatctattaagcagatgcactgcacgcatatgggaacaatgtgcttggaaattttctcaaccttgcaaagatgcatccctatcgttctctgattataaaaagttaatctccttgaaaatatacatgtag

SEQ ID NO: 95639 - DNA, 1827 bp, Glycine max
  Peptide Sequence Number=SeqID_212417
atggagctccgccgccgctcctccgccgcggccaaagcctccgacgccctccccctccctctccacgtcaccaacgccttcttcttcacccttttcttctccctcgcctactacctcctccagcggtggcgcgacaagatccgctcctcctcccctctccacctcctctccctctccgacatcgccgccatcttcgccctcctcgcctccgtcatctacctccttggcttcttcggcatccacttcgttcagtccttcgttgcacgtcccgccgacgaagaaccatcccaatgcgcctccattgacagagccgacgaggatatcgccaactccatcatagaaggagacgcacagccttctcccttgtgcagggtcgacaatgatatgaagggaaagaaagtcatacagcgtcctttcgaatgtaccaaaccaattcttaccgaactgatttcgtccattgacagagtggacagtgataatatcattgccgaccctgtcattaacggaaaagaagccgtgcaaccttctttccaatgtacgaaaccaattctcaccaaactgatttcgtccgacgatgatatcatcattgtcgactctgtcataaacgggaccgtcccatcgtattctctcgaatcgtgcctgggggattcccgccgggcggcagcgatccggcgggaggtggtgcagagagaaacggggcggtcgctggcgggtctacccctggaggattttgattacgatgcaattctggggcagtgctgcgagatgccggtggggtacgtgcagcttccggtgggggtggcggggccgctgctgctggacggggcggagtacacggtgccgatggcgacgacggaggggtgcctcgtggcgagtacaaacagagggtgcaaggcgatttacgcgtccggtggggcgagcagtgtggtgttcagagatgggatgagtagagcgccggttgtgagattcgcgaccgtgactagggctgcggagttgatgttctatttggaagatcctctcaattttgataccttggcggtcgttttcaacaggtcaagtagatttggcaggcttcaaagcattaagtgctctattgcagggaagaatgtttatattagatttacctgtagcacaggtgacgccatggggatgaacatggtttccaaaggggtccagaatgttcttgatttccttcaaagtgatttccctgatatggatgttattggcatctctggaaattactgttcagacaagaaacctgctgcagtaaattggattgagggacgtgggaagtcagtggtttgtgaagcaattatcaaagatgatgtggtgaagaaggtgctgaagaccagtgtggctgctttggtagagcttaacatgctcaaaaaccttgctggttctgctgttgctggtgctcttggtggattcaatgctcatgccagcaacattgtttctgccatttttatagccactggtcaagatccagctcagaatgtggagagttctcattgcataaccatgatggaagccgtgaatgatggcagagaccttcacatctcagtgaccatgccttccatagaggttggtacagtggggggtggaacacaactaccatctcaatctgcttgcttgaatctgctcggcgtaaagggtgcgagcaaggattcaccgggatcgaactcgagacttttggccaccattgttgctggatctgttctagcaggggagctgtcactgatgtctgctatagctgcagggcagctagtgaagagccacatgaaatataacagatcaagcaaagatatgtctaaagtgtcatcatcctga

SEQ ID NO: 95640 - DNA, 814 bp, Glycine max
  Peptide Sequence Number=SeqID_212418
atggccaaaactaaaacaatagctatcaaaagcccttcaatctgctctagctcagaaagtgaagctattcactcacgtatactcaaaacccaagataaagctaccatgaccttaacacccccttctactaatggcatagtgattgtctctccaagaaataagatctttgttaaggtggagaagactcaaaagaaaagaaaagagattaggatacaaagctcctactctttgaaggagaagtttaataaaagttgggatgggaagaaagtcatgaatggaagatatattgatttcctagagatggtcctcaaagagaatgtggataacaacaacttcaccttgagggccacactgaaggtaactaagattctaatcgaacaacttttggttgatttgttgggagcccctattgatagtgaaaggctctatgctgattggttagaggatagttcattggatcaacatgctttttatgctgccaagggcaccttccaagaagtaaatgaccatgatcttttgtctagggctagtaggagccctttgtccaagtcagatgaggtgaaggagacgttagaggaagttgtggagaaggaaattgcttcttctccaattgttgaatcatttgccatagaagagagatttgagaaagaagaattcccattgcgtaaggaggatgtatcaaaggaagacctttttgaagaaccattagaatatggttcctatcatgttgactcagaacaccattctgaggaagagcaaaaggataaggaagaccattttgagcatcaaaatgagttatataaagttgatgcaa

SEQ ID NO: 95641 - DNA, 159 bp, Glycine max
  Peptide Sequence Number=SeqID_212419
atgatgaaggaagtgatccacggtcacaactctgcagcgccttggctccacttttcctcttctccttcttcttctacatttttctctggtttaaggttgctgaaaaagccatctagtgtaggggaaactcgcccaggcgagctgcttgctaagggctaa

SEQ ID NO: 95642 - DNA, 789 bp, Glycine max
  Peptide Sequence Number=SeqID_212420
atgttgaatgccttagggctttctaaaattggaattggaacaagcaaactaccatgtggcatgttgctattgtcttcaaaggttaaagtccctacttggattgatggtgtggaaagctgtgagtatgttggcgttggtgcaagatttggccctacattagaatcaaaagaaaaacatgctaaccatactagagttgcgatagcggaccctcctgattgttgtagcaagcctaagaataagctcactggcgagatcattttggtgcaccgaggacaatgtagtttcacaaccaaggcaaatatagctgaagaagctggtgcttcagccatcctcattataaattatcgtacagaacttttcaagatggtttgtgaagcgaatgaaactgatgttgatattggaatacctgctgtcatgcttccacaagatgctggtgaaaacttgaaaaatcacatactaaacaattcagtagaagtgtttttatggcttatggctgtcggtaccattctctgtgcttcttactggtctgcctggactgcaagagagtctgccattgagcaggagaagctattaaaggatgcttcagatgaatacataaatgcagagaatgctggttctagtgcatatgtggaaatcagtactgcagcggcaatatcatttgttgtgattgcttcttgtttcttggttatgctttacaaattaatggcatattggtttgttgaagttctggtggttttattttgcattggtggggttgaggcacacgcaaaatcttgggtggttacttag

SEQ ID NO: 95643 - DNA, 345 bp, Glycine max
  Peptide Sequence Number=SeqID_212421
atggatgaaggccaatcaagaagaaaagaggcatgtgactacaaaatttttatgggatcagataatggtaccaggacaaagttgttgtcacagccaggccttctgggagcaatactatcagggtgtactatgtccccagccaaactcaaagtgacaaacaccatgaacatagaacagcacagagcacaggtagctccaagtgaaaccatgatggtggtgagaactgagaagccgccagatgcaaaattgaggagagaaacccaaaggggtgggggtgtgaaggttaatgggtgtttgtgtacgtcgaatgtaggatgggacataaataaaaaacaccgcgtgtaa

SEQ ID NO: 95644 - DNA, 231 bp, Glycine max
  Peptide Sequence Number=SeqID_212422
atggtcttctggactcttatgtccatagcaaacatggggtcgaaccaagtgccctcttttaaaaaaaggttctatcatgtcaaagtcaagatcctagaactagctagcttgcgagagctagggcagcggatggatcaagttcgatatcaagccttccacaaggcatatgggaaaatctgggatttggccatgatagaagtgtccgttgaagccatcgcatccctcgcttag

SEQ ID NO: 95645 - DNA, 681 bp, Glycine max
  Peptide Sequence Number=SeqID_212423
atggtgaagaattttgtcaaagatccaaaggaagttaaaacttctaagaataaaaagaaaaatagaaggaaaaaagagcaacaacagaagaactcttctctgaaggaagcttctgaagtgaacaaggaagtaaatggtcaaagtatcagacaccaaagtgctgaagctgatagaattgctgagacctcaaattcacatacagaagatgtatttgctcatagagaatttgatgatggagatatagatgatgggattgatcctgcgctaaaggaaaaaattgacagctgtacaaatctgtcagctattgaaacaaaactagtacaccggtggaactgtagctggaataggttgaggaacagggatacaagtagaagaatcagtacaattctcatgacgttgagattgggacgccctagtcttagatggcatgcaaaaagagaatggacagttacagcagaaaaatcttatgtgcttggtaccattggacacagggaagtggaagattttgcccgccgattgaattctgactggccagagaggatgcaagaacttttatcttcaggacaagaaaggaagatgatgctttttactcccaacggaaatagttttctgaggcgaaatgcttgtatgttttttccctgtgttttgagtgattttacttatccgttatatgcttgttag

SEQ ID NO: 95646 - DNA, 321 bp, Glycine max
  Peptide Sequence Number=SeqID_212424
atgtcagaagtacctgccatggctgtattgagcatgacgggtagtcagggatctgatgcattctcacaatctggtctgtattccatcaccaagtcattggaccacgctatgctaatattcatgagtttcaatgtcagggtgcatttgcttggactattgaataccgcaggggtgcttgctgctgtctttggtacagctgcaactggtttcataatccagcaaggttcttggaatgatgttttcaaggttgctgttgcattgtacatagtaggcacattggtgtggaatatattttcaactggggagaaagttcttgactga

SEQ ID NO: 95647 - DNA, 1026 bp, Glycine max
  Peptide Sequence Number=SeqID_212425
atgactatttcttggtttctttctctaatgaagaggataaagaaaaaggccatgactgagggactatgtctcatttatgatcattatctagtggtcagagaatggtcccccattcatccatccatagaggcaattgagaaagtagtagtttgggtccatgtctttagactaccgattgaatattacgatgccaaattgcttcatgctattagggatagaattgggaggacaatgcgtgttgaccgaaccactctgtatcaggaaagagggaaatgtgctagactatgtgtagaggttgatctcacacaacccttattagctctttttgaattgaacaacatgtactgcaaaattgaatatgaagagcttcattttcttttccttacttgtggaagattaggacactacatggagggttgccctgacaaagacaaacccaacacatggaatggagagaaaccacctcagaaggatgcaatagagaatattggggataatgaacaagttcctaatgaggggccttgggcaggagtaaaaaagctcgtagaccgaggaaaggaaaggaaaaagaacaaggctttgttggagatgttcattctaaagcctcaggaaaggtttgtagtcttgagccatttgaaaataatattacaaaaaatgagaatgagacaactggaccctcaaatcacatggcttccatggttaagagtgttcacgaagacaataaggagaacaaaaaaagtgtcaaaattgagtagaatggttgttgaaggagtgaccgacattattatccaaccgggacaagagcataacaatcagaggccccacttggaaaataaaggaggagacacacgattaatgcatgagacatatgaaaatactactatgggacaaaacaacatgaatcaccatgtaattgaggaggatactggccaagatattaatataatggaagtaggggttacccaaaaaattgacaacacaatgcatcaattacctaaacccccaaacccatgtgggatcgggtag

SEQ ID NO: 95648 - DNA, 567 bp, Glycine max
  Peptide Sequence Number=SeqID_212426
atgtttgctgtgatggaaacccgtattgacccttcgaagctggaagaaacttttagactcttggggtttcatggttataccttttctccaacaaggggttttgttggaggcatagctgttgcttggaaaactgataaggatcaagatacacttggtaaggtcctatgtcccatggatatcaaagtgtgtttgaagggctggaccgagctttatgaaactctcaatggagacttcaataacatcttattagctcaaattgtctttagaagtactaaaaagaagaagaaaattcttaatagctcaaattggaggaaaccaatagtggtcgcacttggcaacctacaggcttcactttcgtggaaatccaacctcaggattaaaattcaagtttatgatgatgaaataaagaatgcagtgcttaacatggccccttggaaatcccctggacctgatggttttcttgcgggtttttaccatcacgagtgggatgtggtgggccctacggtgtgcaattccatcaaagatctttggaatctcccgcatatgatcgaagtacaaagaaactga

SEQ ID NO: 95649 - DNA, 586 bp, Glycine max
  Peptide Sequence Number=SeqID_212427
atgcgatcagagaagaaaccatggtcaccactcctctgtgacgaactcatcgaggaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtatgcctcggatccatccctgaaatccacatggaatcgtgtgatgtaagttcgttattccattccctacaaattgaaacgttcttgttcaatttcgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgg

SEQ ID NO: 95650 - DNA, 483 bp, Glycine max
  Peptide Sequence Number=SeqID_212428
atgtatattgtccctgatttccttcttgctatggaaaattcctatggtagagaacttctccactctccgggtcaatggaatatggaattactgaccactctgttccctaatgatatcacccaaagaatcttgcctatccttcctccttatgatcagatgagagaagacaaaatggtgtggtcaggtaagaatttaggccaatgcaaaccaatgtctcaacaaatttcatactctagagcccagtctagatggaagaaaatatggaagttaaaggtccttcaacataatggtcacaatagttgtgctgaaatgtgggttgtcacttgccaccgtcactggatatggagtaacaaacatatccatgatagtaattttgtgagactgggaaaaccttgggaagagggtaagagttgttgttgttcgtacaatgtagctctgaatatagttgatactacgcaagtgggtcaaaaggtggaaatttag

SEQ ID NO: 95651 - DNA, 300 bp, Glycine max
  Peptide Sequence Number=SeqID_212429
atggcctttatttggggtgaccaggggacaactagaaaatctcatgttgtcggttggaaaactatgatgctccctaagcacgaagaggggatggcaatctgtaatcttgttgagatgaataaagcctaccttatgaaaatgggatggactctttgtttgaaaaattatggcttgtggggagaagtccttattggaaaatatggtaagaggggaagtctgaatcaaatgactttggaggctaaaggtattgattctcatatcgggaagtcgatctctaaaggcctcagttggctaagctag

SEQ ID NO: 95652 - DNA, 414 bp, Glycine max
  Peptide Sequence Number=SeqID_212430
atgacaactaagaaccagaacaaaattgaatacccgggggagaatcttggtatgtttaaggagtgcgttgtgttcgatcttcgcgaggttgagtttgttattgttattattgggttgggagatggtgatacaaggcatataggcttcaaggttgagatgcctggtccatatgaaattgcttctagtgaggtgactgttggacgcgtacctgataaagctgatctagtaattccagttgcaacagtgtctggtgtgcatgcacgcattcagaagaaacaagggaatcttcttgtcacagatttggatagcactaatgggacattcatcaatgacaagcggctaagacctggcgttgttgccaccatatcacctgggagttgtattacatttggtacctacttaacaaacttctaa

SEQ ID NO: 95653 - DNA, 845 bp, Glycine max
  Peptide Sequence Number=SeqID_212431
atgagttgcacagattcgctaagcacaccgcttcatctcactaagcgcactgcttcagttcatccgagctttgcatgtctagagattctagagagaaaggtccaagttccagagatttttgagagattttgctgtgtgaagatctgcagagaccagagcttgaagcaggagccgatgcatgctttgttagggtcattcaacagtggaaactggtctgattctaaattccttgatagtgcagggctaagttgtcgtactatcacgaggaattggggccagctaagtggaccatgtcttgctaaacggccaatggcttctaggaaacgcaagagtattggttcaagacccacaacacaatatgatacaaggagatttcactccttagatgcttggaaccggtacacatataatgtcttggggagaaacattttgcctaagaggaaggtagagctctaccacactgagctagataattttaagactgaattggagaggcgtaatttccataaacgcctcattaattttgttgatgggagcatagacttggctttggtgaaagagttctatgcaaacttatacagctctgagggcccttcaccaaagcaagccatagtcagaggctatttaatgaagattgatgctgacagtctcaacacattcctggagacacctgtggtatttccagagggtgagactttacccacatactccaggtactgcaggctgcccatagattacagagagattgaggctgccttatgcatactgagccgagggttcattttgaacgctaagggccatcctgggaggattctcaggaaaagatttgactactttagcccagg

SEQ ID NO: 95654 - DNA, 303 bp, Glycine max
  Peptide Sequence Number=SeqID_212432
atgaaggattgggggaattttatccacttaatccttggggaggattctgagcattccgctccgattacaacgttcttcttggtgtggaggttcggcggcaaaagaggagagggggaaaatcatgtctttcacgctgaaaaatgtatttataacctacggatctcgcttagcaagctcattttgttaagcgggagttcactttttgtgcttagcgtgacaattcgcgctgagcacaactccctttgtgttaattctcgctcagtgcaattccctcttgggttggaattgtgcttagcgcactaa

SEQ ID NO: 95655 - DNA, 355 bp, Glycine max
  Peptide Sequence Number=SeqID_212433
atggattatgcaatcgtcccctctttggcttccggaatgttacggaactttacggattgcgcattaacacttcctttcaactcccgacatgtcacagaatttcacggattgcctaacgattgttgccaagtacctcgaagtggtcaagcgaaggtcgcattccacgaaaaagatgaagctaagagatggcttcactcatttaaaggcaatagtcttaagacatgggataaagttgtggagaaatttctcaagaaatattttcccgagtctaagactgcagaaggcaaagccaccatctcttcttttcaccaatttcctgatgaatctttgagtgaggccttggaaagattccgtg

SEQ ID NO: 95656 - DNA, 1110 bp, Glycine max
  Peptide Sequence Number=SeqID_212434
ggcgcgagagaaggagagtgacagacaaagacagaagaaatgagagatggagcgaaacagacacggcgaggacgagtgtgaagcagtatcgaaacacggcgaggactagcacaaacagaagaactccaaacggttccccttcaaggagatggaggaacaatgactacgctaatgaagagttgctatggaggcacttcaaaaagtggggtgacgtacgtgatgtatacatcgctaaaaggctcaacaaggatggcaggagatacaggttcatgcggttcaagggagtctcggatgcaaaaggattggaggtgagactggacaacatcttcatcaacgattgtaaactatttgtcaaccttcctaggttcgacaaaccagttcggaatacagagttgcagaaaaagaaccccattgggaggaagtacaccgacgaagcaagtaagccctgcggggtaactactggtgctcttcgaagatcatatgtggacgtgatgactaagggggggtgccaaggagacaaaaggacagacgaggcacaaacaccaactattctgatcaacccagatgaaggcggggaatattggtgtaacgaaacctgggtgggcatgctaaagaaggtgatggaggtggaaaccttagaggatcgtatcacttgggagttaggatataacgtccacaaatgtagacccaataacagggttgtttggctccagctgtggggatttccgatacaggtgtgggaaatgaaaaatctcaggagggctgtagctgctattggggatgtcatcgtccgtgtgggggagcttgagtatcgggtatggattgtggaagagacagggttcgaaggtgggtcgaaccggaaaggaagctcgccgtccgatgggtggtcggagatgataacatcggacgacggaggggaggttggcgatgttcttgacgacactaataccaatttctccttctcgtcggagctgcccaaccagaaattgtctccgtctcgtacccaacgggcagaaggagggaccgatgtgcactgttgtgatcttagacccctgggtaatatccaggcagacgttacacccaaagaaaagtcaaaaggcactgtagaag

SEQ ID NO: 95657 - DNA, 282 bp, Glycine max
  Peptide Sequence Number=SeqID_212435
atggccaagtttgatctagatatagttctcgagttttacgccaatgcttggcctacagaggagggcgtacgggacctccggtcatgggtaaggggccagtggattcctttcgatgcagacgcccttagtcaattcctgggatacccgctagtattggaggagggccaagagtgcgaatacggtcagaggaggaaccgggccaacgggtttgacgaggaggccattgctcagctgctatgcataccaggtcaggattttgcccggaccgctgctgggagacgg

SEQ ID NO: 95658 - DNA, 246 bp, Glycine max
  Peptide Sequence Number=SeqID_212436
atggcttccaaagacctggagcagctgacacaaaaaatcagggaccagctagaggagtcaatcacagaaaaacacaaaggattgtacatcgaagaaaatcctccccgtctagttggaattggaagaccttatgaggggttgaccaccgttcataacatccttttggccaatgatcaagtcaaggttggtgttgaggaagttcgagatgcaaatgctcacattcttgtacccattaaagagatttag

SEQ ID NO: 95659 - DNA, 132 bp, Glycine max
  Peptide Sequence Number=SeqID_212437
atggccctcggtgttcgcttactcgaacccactcaaggctgccttgcagcggcgttttccacttgtcccgagctgggaagggatgacgatctatcggttgtgaccctagcctctatttgcgttcgttcctaa

SEQ ID NO: 95660 - DNA, 565 bp, Glycine max
  Peptide Sequence Number=SeqID_212438
atgcggtcgtatcggcgtgttagaataccggcccgggggcaaccccgggatcactccgaagggttggcagtgtcgaatccccgccttggcacaggcggccgggacggcccggaacgcgctgtcaacgcagttgttccgattctcatgtccgtccaacgcaccctctcgatcatcaagcccgacgccgtcgccaagaacgtcatcggccagatcgtcgcccgcttcgagcaagccggcctgaaggtcatcgccgcccgcctggcccagctgtcgcgcgccgacgccgagcgtttctacgccgtgcacaaagagcgccccttcttcaaggacctggtcgacttcatggtctcgggccccgtgttcgtgcaagtgctggaaggcgaagacgccatccagaagaaccgcgacctgatgggcgccaccgaccccaagaaggccgccccgggcaccatccgcgccgacttcgccgacagcatcgacgccaacgccgtgcacggctcggacgcgccggaaacggccgctgtcgaagtggctttcttcttccccgaaatcaacatccacagcc

SEQ ID NO: 95661 - DNA, 696 bp, Glycine max
  Peptide Sequence Number=SeqID_212439
atgactcaagccgctcccccgaacgccgcgtccgccgcgaccgactccccggaactctccaagagcttcgaacccgccgaactcgaatcccgctggtacgccgagtgggaaaagcgcggctacttcgccgcggggtcgcacgtaaaaacggggaccgaaggtcagccttacgtcatccagttcccgccgcccaacgtgacgggcaccctgcacatgggccatgcgttcaaccagaccatcatggatggcctgatccgctaccaccgcatgctgggcgacgacaccgttttcattccggggacggatcacgccggcatcgccacgcagatcgtggttgaaagacagctcgacgcgcagaaggtttcccgccacgacctcggccgcgagaaattcgtcgaaaaagtgtgggagtggaaggaaaagtcgggcaacgccatcaccggccaggtgcgccggctgggcgcctcggccgactggccgcgcgagtacttcaccatggacgaccgcatgtcgcgcggcgtggtggagaccttcgtgcgcctgcataaacagggcctgatctaccgcggcaagcgcctggtcaactgggatcccaagctgctgacggccgtgtccgacctggaagtccagtcggaagagaccgacggccacatgtggcacatcctctaccccttcgtcgacggtccgcagaccatc

SEQ ID NO: 95662 - DNA, 463 bp, Glycine max
  Peptide Sequence Number=SeqID_212440
attctctcatcatgctaagcacgctgtagctacgcttagcggtagatgcgagctgagcccacaggttccgcttagcgcgactgctccttgtggaagcaatgtcttccaagattattttgatgatgccaaagaatcaagagttaagcaagttccaaagaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactcaatcaagataagtactaaacaaggtacatccacttggttgttcaaagagaacaagggagggtacatcccttgtggatctttggcttgtaaaggattttacagggttgaaagaaatctcaagaaccgttggttgcttggagactggatgtag

SEQ ID NO: 95663 - DNA, 204 bp, Glycine max
  Peptide Sequence Number=SeqID_212441
acttatattcataaggagacaggctttcgctgtcggtctttgaaggagattaagaattacgagaaatatggaagtccccctcgacgtcacaaagtgaaaacacaagccaaagaagaaagcaatgacaaaaccaaaaatgaaacagaatattggttaaagtttactgacaactacaagctcatgagtagaactgaaagtgattaa

SEQ ID NO: 95664 - DNA, 231 bp, Glycine max
  Peptide Sequence Number=SeqID_212442
atggctgcaactgatttcacttatgaatgcttgtgcattcaataccctgatgaggatgtcccatatgttcttaaaactggattgatccacttgttacccaagtttcatggtctagcaggactcagtaacatggagagaagtatgatagatgctgccagtggtggagcccttggtgacatgtcccctcctgaagctagaaatttaattgagaagatggattccaactcctag

SEQ ID NO: 95665 - DNA, 207 bp, Glycine max
  Peptide Sequence Number=SeqID_212443
atgacttatattcataaggagacaggctttcgctgtcggtctttgaaggagattaagaattacgagaaatatggaagtccccctcgacgtcacaaagtgaaaacacaagccaaagaagaaagcaatgacaaaaccaaaaatgaaacagaatattggttaaagtttactgacaactacaagctcatgagtagaactgaaagtgattaa

SEQ ID NO: 95666 - DNA, 240 bp, Glycine max
  Peptide Sequence Number=SeqID_212444
atgacttatattcagtgtcggtctttggaggagattaagaattacaagaaatatggaagtcgtcctcggcgtcacaaggtgaaaacacaagacaaagaagaaagcaatgacaaaaccaaaaatgaaatagatgaaatgcttgttgctcaaggaaaagcaaaagcagaagttatgagaacttttgttgaagagtttctttcggaagcttattacaatcagcttcacatgttcaacccataa

SEQ ID NO: 95667 - DNA, 225 bp, Glycine max
  Peptide Sequence Number=SeqID_212445
atggcgataaggtttgcggatgacaataatttatctctgcatgtcatcgggctcgccgcttctgcattacaaaaggtgcagaatgatcataatttgtctctgcgtgccaccggacttgatcgtctctggatggcaaaaagactcaatcgtctctggatggcgaaaagttgtgcggattaccataatttgtctctgcatgccatcgggctcgccgcctctggatga

SEQ ID NO: 95668 - DNA, 453 bp, Glycine max
  Peptide Sequence Number=SeqID_212446
atggcttctaacactatcatccaatgcaatccttcaactcatacaaaaaggaaatatgacgtgtttgtgagctttcgtggtgaagactcacacaacaactccactggttttctctttgaagctctccgaaaaaaaggcattgatgtcttcagagatgatgtgagtctcaacaaaggaaaatccatagcacccaagctgcttcaagccattgaagggtctcgccttttcattgtggtgttctcaaagaactatgcttcctctacttggtgcttgcgtgaactagcacacatctgcaattgcattgaaatatcgccaagacatgttctgcctattttttacgatgttggtccatcagaggtgcgaaaacaaagtggaagttatgagaagcctttgcccaacacgaagaaagatttagtgaggataaagagaagatggaggaattgcaaagattga

SEQ ID NO: 95669 - DNA, 552 bp, Glycine max
  Peptide Sequence Number=SeqID_212447
atggatgtgttgcgaataagttttgatgagctcaatgacaaagataagaaaatatttctagatattgcttgcttcttcgctgattatgacgaggattatgttaaggaaattatagatttttgcagatttcatcctgaaaatggcttacgagttcttgttgataaatcactcataagtattgaatttggaaagatttatatgcatggcttgttgagagatttgcgtaggtatattgttcgagaagaatcacctaaagagccaagaaaatggaataggttgtgggattacaaagatctccacgaagttatgttagataataagccgcataagctcgttgagatgtcccttcctgatagtaacatgaaacaattatgggaagacacaaagcctcaacacaatttgagacatttagatatctctcactccaaaaatctaatcaagataccaaatttgggtgaggctataaatcttgagcatctaaatctcaaaggatgtacacaactcgggaagattgatccatccattggtcttctaagaaagcttgcattttag

SEQ ID NO: 95670 - DNA, 303 bp, Glycine max
  Peptide Sequence Number=SeqID_212448
atggagaattggaatgctaacgctgcctctactacgcatccttttttgtttgattgttgcaaattaaatttgcatccatattcaacaatgcctccaattcttcactatgatggaagtgtagctgaaatcatgttgccagttactacttgtttccctcaattctcaaaaacccttgctttcgaggcaatgaatcttcgtggtgcatcattgttaagtttgatagttgtagatcctgttcgtgtatccaacgatacccatatttcttcatctcatcatgagaaccgtgggaaccctttattttga

SEQ ID NO: 95671 - DNA, 1095 bp, Glycine max
  Peptide Sequence Number=SeqID_212449
atggcagccgaaagcaaaacttaccaagacacagcagacacgagaagaggagcaaaaagtgctttggtgccaatggctgcaaggaaagcaacgtcagcagacacaatagacatagtagacacgaagcaagaaaacttaccaaagtgcagcgaagagggtggcttttcgaccagagcacgaccagggtggctttgcgagactccgcatgatgggtcaaggacaatggcagtgcagagggtggctttccaaggtgggtcaggagcaatggcagtgacgggggcgaaagtatatcttgaagccatagttatcgaatatcattttcctcaaacaatgatgagggtcgatgctctatcaaaaatgagtcaccttaagttgctcacacttcagttcgtgaaattttcaggaagcctcaattatctctccgatgaattaggatatcttaattggtttgaatatccttttgattgtttgccaccaagttttcagccagacaaacttgttgagttgatcttgagatgcaatagcattaaacaattgtgggaaggcacaaagcatctacccaatttgagacgtttgaatctctctcactccaaaaatctatttgagatgggaaatttaggtgaatccctaaatcttgagagtttatatctggaagggtgtatacaaattaagcatatcgatccatccattggtattctaaggaaacttatttttgtgaacttgaaagactgcaaaagtcttactaagttaccacactttggagaggactttagtcttgaaattctatatctcgaaggatgtatgcaactgaggtggattgatccgtccattgatcatctaagaaaacttagtgttttgaatctgaaagactgcataaatctattgttggatgaatcaagggatgtcgagaatttgaagaagcttgaaataggtgaagctcccattcattcccaatcttcatcttcctatttgaaagcacatgatgattttgttagttgtttgtttccttcctcgcctattttccaatctatgcatcaactagatcttagtttatgcaatttacttcaaatccctgatgctattggaaatttatga

SEQ ID NO: 95672 - DNA, 210 bp, Glycine max
  Peptide Sequence Number=SeqID_212450
atgaccaaacttggtctctgcttgtcatcgggcccgccgcctctggatgacaaaaagggtgcgaataaccataaaggtatctccgcgtatcatggggtgcagaatgaccaaacttgggctctggcttgtcatcgggcccgccgcctcggggatgacaaaagggtgcgaataaccataaaggtatctccgcgtatcatgggtgcagaatga

SEQ ID NO: 95673 - DNA, 228 bp, Glycine max
  Peptide Sequence Number=SeqID_212451
tataccgttgaacccgcactctccctgcccgccagtgcagcgcgtagcgaaattgtgtttaaaaccgcgcgcaaagacgatgtcgattttctttatcacgaatggggcgtgctgcgtgaaatcaccatcattcagtcgccggtgcgtatggactttggctacacctttaccgcgctggacccggacgggcaccgcctgcgtgtttgctatttacagctggatgagtaa

SEQ ID NO: 95674 - DNA, 588 bp, Glycine max
  Peptide Sequence Number=SeqID_212452
atgaccagtaatctgcttaacctgcgccagcagcgcgcgacgcgcacgctattttttatcgccggactgggcatggccgcctgggcgccgcttattcccttcgccaaagcgcaactggcgatcaatgacggcatgctggggctgctgctttatgccctttaccggcgcgctgattgcccattttggctgtcgcacgctgctgctgctgtgcggtgccggactggccctggatctgccgctgctgatgctgctgaactcaccgctgccaatagcgggcgcgctgttgctcttcggcgcgatcaacggactgatggatgtcagcatgaattatcaggcggtgatcgtggagcgcgaggccggggtcagcaagatgtcgggctttcacggcttttacagtcttggcagcattgctggcgccggcgcggtgagtctgctgctgtggctgcaggttgcgcccctgctggcgctgctgccgctgtgtgcgttgattgtattgctgctgctgatgagccataccgccctgttgccccgtcgtcgcacggatgcaaaaccaacgcgcggtacgctgcgcgccctgacgcaccgtaa

SEQ ID NO: 95675 - DNA, 255 bp, Glycine max
  Peptide Sequence Number=SeqID_212453
atggaggagaagagcaagtgtggacatgaggaacattcgtgtactgaaagcccaacactcaacgtcgacccaccatgcccagttgcaagacacatgaagtggaagatcaccagcacaaagcggcatggccaaatgacgaacaagcaacacaggggagttttgttccacatgggcgacaggacatactcaacacgacccttggctgacctgagcatccaggccgtgttcgcgtcgcaaggacaggtgtcacaataa

SEQ ID NO: 95676 - DNA, 201 bp, Glycine max
  Peptide Sequence Number=SeqID_212454
atggtgccttttggaggaagcaacctagctcgccaggcgagctgggtggcaagcttctccttcttatccaagccgaggcgcttccgtaacgcttccgagacgtttccgtgggtgatttggcgaagattttccgccgttcttcatcgttcttcggtcttcaaccgaaatcctaccgttcggtcatgccgtaaccacgtttaa

SEQ ID NO: 95677 - DNA, 426 bp, Glycine max
  Peptide Sequence Number=SeqID_212455
atggtgatcattttaaaggaagggtcgaggctagcagtgtgggggagtccttgctctagcggtaatgtggcaaacaaagttgtagtcgatatcgaggatgaatcattcttggagaatgcctatgacgaccacaaacgatggcatcaacctcatcatgggtctcccctcctccatgagctttggcaagggggtgtttgggttatagttggtggtgttgggcttggcaaagatggcacaatggattggttgatggtgcacatgatatggtgtggtggtttggatggtacctgggattatcggtgtttgggtggctatggtggtcattgggtgcgcatcgacattttggtaggagatggtgacacaccagttgatggtgcggtggtgatgggtgagggtggtgcagtgggagaagaagagaagaaataa

SEQ ID NO: 95678 - DNA, 1506 bp, Glycine max
  Peptide Sequence Number=SeqID_212456
atggagtttgctctaaattacctaaatgccactgtcactggagttctttctctaaccctcttctttttgtttttgtataatcccttcaaatttgcattaggtaaaaaagaggctcccaaagttgcaggtgcatggccaatacttggtcacctaccactattgagtggttcagagacaccccataaggttttggatgctttggctgataagtatggacccatattcaccatcaacaatggtgtcaaaaaggttttgcttctggccattgaactcatgtgctacaaccaagccatgtttgggtttgcaccctatggtccttattggcgcgaactaagaaagattgtaaacttagaaatcctctccaatcgccgagtagagcaactagagaatgttcgtgtctccgaagttcaaagtttgatcaaagggctcttcaatgtttggtcaagcaacaagaataatgagtctggctatgcgttggtggagctgaaacaatggttttctcatttgacattcaacacggttcttcgaatggtcgtcggaaagcgacttttcggtgctagaactatggatgatgagaaggctcagagatgtgtgaaggctgtgaaggagttcatgcgtctgatgggggtgttcacggtggcagatgctattcctttcttgagatggtttgattttggtggctatgagaaggccatgaaggaaactgccaaggatttggatgagatttttggtgagtggttagaggagcacaaacaaaatagggcttttggtgagaacaacgttgatggaattcaagacttcatggacgtcatgctttccttgtttgatggaaaaacaattgatgggatagatgcagataccatcatcaaatccactttactgtcagtaatttcaggaggaactgaaacaaatattactactcttacatgggcagtatgtttgatattgagaaatcctattgtattggaaaaagttatagcagaacttgactttcaagttggaaaagaaagatgtataactgagtctgatataagtaagttaacataccttcaagctgtggtcaaagaaactttaagattataccctgcaggtcctctttcagcacctcgtgaattcatagaggattgcactttaggtggctacaatgtcaaaaaaggaactcgtctaattacaaatctttggaagatccacacagatcttagtgtttggtcaaatccattagagttcaaaccagaaaggtttctaaccacccataaagacattgatgttaggggacatcattttgagctattaccatttggtggtggtagaagagtgtgccctggaatatcctttagccttcaaatggttcatttgactcttgccagtctttgtcattctttttcattcttaaatccatcaaatgaacctattgatatgactgaaacctttggattaaccaatactaaagctactccacttgagattttaattaagccacgattatcttctagttgttatgtatga

SEQ ID NO: 95679 - DNA, 111 bp, Glycine max
  Peptide Sequence Number=SeqID_212457
atggcatcgcttaaacgagctaagtcaatgagtagctatgggattattggaggaattgatagtttagtcgataaacattcgtttgattctcgaactgagaagagaaactaa

SEQ ID NO: 95680 - DNA, 842 bp, Glycine max
  Peptide Sequence Number=SeqID_212458
atgagtgcttccactatcaaccaatatggttatacgagcactattgatcagtccatacaggcgaaaagtatcagaggcggagacaccggccagtgcgtgaaggctgatgtggggttgaagagaggaatggtcttttggaggggagccaaacgaacttttggaggtgtgtttcttgcggtccagggcgaatcgagcttcgattgcctggagaagagctggccaggaagtgatgaatccgttcccgaacatccactgaaaccaactgagagcgggtccatcgagatccaccctaatggatcatggccgtcaaaccgaggcacgtcgagcttgaccgacaaccgtggaggtgaaggaggctggtttgttgctggagtggtggaggtcaaaccagttgttatgtgctggtatgagactaacgtgaggaagaagaagaaaagccttggttcgaggtcaaggtccctcctgggtccttcgcgggcgttcctctcgagttgtactttcgttgttgctggtgcgttcctctcgagttactcctttgccactgctgggctaaatcaaacatgtgcatcctatgaggaaccgtcatctataacttggtggtcatcatctgatgaagtaggggcctacgtcctatacaaacctcttgaagaccgtgagtggagtaaaagaattgaaagtatctttcctggaagtgaattaccaagtttgttcaacaatcagcgtcaaggaaggaaaacagtttcagagatgggtagtcctcaaaaaccaaatttcacctgttatattccaggggttctcaatgaagatccaatcacagatgaatcagatcacctttggctatg

SEQ ID NO: 95681 - DNA, 2159 bp, Glycine max
  Peptide Sequence Number=SeqID_212459
atggcacttagagtgatggtgggcaatggttcatttcagcattgcgagcaactgtgccctgatacaaaggtgcttattcaaggtcatactttcactgttaagcgcatgatctctactaactccacctcaggcctgtttcatatttcgcttttacctatttcccaagctgaacccacagatcctcctcaccccattcccaccattaacgaactattactcaaataccagtccatatttcaccaaccctcatctttacccccaccacaacaacacgatcatcatatcaacctccttcttacagctaacctcgttaatgtcagaccttacagataccctcactttcagaagacggagattgaaaagcaggtatcggagttacttgatttcggccttatccagccaagccgtagtccattttcttctctggtattgttggtgaagaagaaagatgggacgtggcgtatgtgtgtcgactatagggcactcaattcaatcacggtaagggatcgctttccgattccaacaatcgaagaacttctcaataagctggggaatgcctcttggttctcaaagcttgacttacggcaaggcttccatcagatcttaatggcagacgaagacatttcaaagacagcctttcggacacaccatggccactacgagtaccgggttatgccgttcggactctgcaacatgctgtcaacattccaggcggccatgaacaacctgctccgccctttcctacgcaaattcacggctagatattacctcaagaagtttgtgaagggatatgcagccatcatggcgcctctaactaagttactctgcaaggatgcctttcactgggtatcggagtctcaaactgccttcgagaaactgaaaacaaccatgactgccgcaccggtgctggctcttctcaatttcgtgattcctttcgccctggaaacaagtgcatccagcacagttatgggccctgtccttcatcaacagggacaccctatagcgtacttcagtaaacccttctgctttcatcttcaacaagcttatgcatatgttatggagttgcatgccattgtcgctgcaggatatgattacgatatccagtataagaccagagtttcaaatacagtcgtggattccctcttgcaccgggatacctcacctccaagccattattttgtgcttttgatccctcatcttgatttcatgactcagttgaatggaacattattagctagttcagagtttcagaagcaacgagaagccatattatctcacccggaagcctaccctagtttctccatctcagacgatcttatcatcttcaagggcacaatctggctcgactcccagaatccattcattccaaccttgttgcatgaatatcacgtgacacctctgggcggccactttggaattaaacacattacgcgtaaaaatgctgggttacttcaacccattctgatacctaccggagtttgggaagatctttccatggattttgtcactcaacatccaagctcccatgggttcactgttgtcctcatcttggttgataggttctctaagggagttcatcttggcgccctatccactcagttcacagcattcaaggtggccaatctattcatggatactggagttgttcaagatgagtggtacgactctacgtatgagtaccgcctaccatccataagcggatggtcagatggagagtggtcatataacacatcgcaacattcgagtactgagctcaccccttatgaagtgatctatggcaaacctcctccttccattccaagttatctccgtggctcctcccgcaatgaggtagttgataccatgcttagcacgagggaagagacttacgcaactcttagacgtaaactcctcaaggcacaagataccatgaaacattttgcggataagatgcgtcgagatgctcaatatgaggttggccagttggtgtatgttagacttcgtccatatcgacaactttcactctattcccaagcacctaacaagctcgctaagatgtcgtatatcgcctacaactgcccgaagggtccaagattcaccctgtatttcactgttcattgttgcggcctcaccatggtcccattgatctacaagcaacccccttcaaccaaatgcacttc

SEQ ID NO: 95682 - DNA, 324 bp, Glycine max
  Peptide Sequence Number=SeqID_212460
atgggagaagaacaaagcaaagttattagagaagaagtggacaaactcctcaatgaaaacttgatcagagaagttaggtactccacctggctcgctaacgttgtcatggtcaaaaaggccaacgaaaaatggctagtcaatggagcatctgggttccaagtgctaagcttcctggaggcttacttcggatacaaccagatcaagatgcatgcttcatatgaggataaaatgacatttatcattgaagatgccaacttttgctataggctcatgcccttcgacctcaaaaatgcaagcgctacataccactggctgatggactga

SEQ ID NO: 95683 - DNA, 279 bp, Glycine max
  Peptide Sequence Number=SeqID_212461
atgggttttgaattcatagtccaggcttgcttggtagatggtcaggggtcggattggagacccttcatccatgctccctggtgggaggatatggtgcttccttcaggctctctacatagcatagtcgtgcttgctttcgggaactgcattttcaaaagcagtgtggagactatggctccaagcttattaagtgtttttttgccgatcaaagcaaaatatgatgcgtctgcatcaacaagtagatattgtatgttaaagctcctggagatcttgccttga

SEQ ID NO: 95684 - DNA, 279 bp, Glycine max
  Peptide Sequence Number=SeqID_212462
atgaaacttcttttttgggaaggccttctattctttcttctgagggtttatggccgaagggttgaggctttggctcaaaaaggcttgcagaaggcaagacatgacctatttcttgcaatcgatttttctcaagcaaagaaaggattaaaaacagcttgcaattcgggcacggttggtatccgagattacaatttatcatcaaaagggagtttcagacaaaccatcgcaaagtacatacgacaatatgctagatgcgataaaattactcacaccgagtaa

SEQ ID NO: 95685 - DNA, 285 bp, Glycine max
  Peptide Sequence Number=SeqID_212463
atgacatcttaccatgaaggactggctatggttctcattgaagcccaggcgtttggaattcctgctttggcatatgatgttagtggccccgctgaagtcatcgtggatggtcagactggctatttagttaatgatggagatgaagaacaatttatcagtaaattgtctttacttttagataatgaatcactaagggaagatatgtctgataaatgttcagattatttaaatcgcttcaaaattgaaatgattgctgaaaaatggaaacgcttatttgaggcttaa

SEQ ID NO: 95686 - DNA, 261 bp, Glycine max
  Peptide Sequence Number=SeqID_212464
atgattgcttgggactcccttgggcaagccattagagatgctacattttggcttgaggctggtatagagattagagaactagaagttgcaacattcagaaacaaagaggatcgtggtaggcagttattccatggactagtcgatgattgtagaagacttttcgtgatccttatagggataagcttctcttcaccaagagaaattaatgctggttggaggaggtctctcgccaattggaccaaatcatatcttgtgatgtaa

SEQ ID NO: 95687 - DNA, 231 bp, Glycine max
  Peptide Sequence Number=SeqID_212465
atgtggatggaaacaaaaattccattggcaaagcttgaagaagataacaaggcgcaagtcagaaggtggattatggtggatgaaaactctcttttagccagagtcttgaaaggtaaatgtttccctaaatcaatgttggggacggtggggaaggatataaacttagcttctcatggtctagtatcatggtggccaaatggattattggtgaaggttgtatctggaggatag

SEQ ID NO: 95688 - DNA, 2082 bp, Glycine max
  Peptide Sequence Number=SeqID_212466
atggaagcggtggcggaggggctatggggactcgcggagtaccacgagaagagaggggaaatagggaaagcagtgaagtgcctcgaagccatatgccaaagcgacgcgtcgtttttccctatcgtcgaggtcaagactcgtcttcgcatcgccacgcttctcctccagcattctcacaacgtcaaccacgccaagtcacacctcgaacgttcccaattgcttctgaagtctattccgtcttgcttcgaattgaagtgcagagcgtacagcttgctcagccagtgttaccatctcgtcggagctattccgccgcagaaacaggtcttgcacaagggactcgagctcactgcgtccgttggatacgagatttccatgaagttgtggttttgcaacttcaattcacagcttgcaaatgctttatcaattgaaggagactaccagggttcaatctctgccttagagtgtggatatgcctgtgctactgaagtatgcttcccggagttgcagttgttttttgccacttcaatattgcatgtccgcctcatgcaatgggatgatgataatttggttgagcaagctgttaatagatgcaaccagatttgggagtcaattgatccagataaaaatgctgcaccccatgtagacaatctggatgctgccatgaagattgatatgcagcaaacacaacgtatacaagagctagtgaatgagctcaatgctttagaccaaagtctctcccgatctgaccttcactacagggataggacagcattatctaaaaagcaaacaatgattcaggagcaactgaaaagcatgactggattgtgttcaattgggcaggaatcactgcaaccagtatattttgggaatgtcagaaggataataggagataagcttcagttagcacctcctcctattgatggcgaatggcttcctaaaagtgctgtctatgcattagttgatctaatagtagttgtatttgggcgcccaaaaggactttttaaggagtgtgcaaaacgcatacagtctgggatgaatataattcaagatgagttagtgaagcttggaattactgatggtgttagagaagtggatttacaacactcttctatttggatggctggtgtgtacttaatgctactaattcagtttcttgaaaacaaagtggctatagagctcacacgagcagaatttgttgaagcacaagaggctttggtacagatgaaaaattggttcatgcggtttccaaccatattacaggcatgtgaatgcatcattgagatgcttagaggccaatatgctcattcagttggctgttatcacgaagctgcttttcattttattgaagcagtgaagcttacagacagcaaatcaatgcaagctatgtgccaagtttatgcagctgtctcttacatctgcattggtgatgctgaatcttcttcacaggcacttgatttgattgggccagtttatggagtaatggattctttcgtaggagttagagagaaaacaggtgttctttttgcttatggtcttttattgatgaagcaacaggatctacaagaagcaaggaatcgcctggcaaggggattgcagctgacacatacgtatttggggaaccttcaacttgtttcacaatatttgacgatccttggtagtttggccctggcattacgtgacactgtacaagccagagagatattgagatcttctttgaccttagcaaagaaactttatgatattcctactcagatttgggtgctatctgttttgacagccttatataaagaattaggtgaaagggggaatgaaatggagaatgctgagtatcaaaacaaaaaattagaagatttgcagaggagacttactaatgcacatgcatccatttatcatattgaaataatcgacaaagtaagacttgaagttcaccaattaaatgatttggacatcaagcgtgcagtggcaggcccaactatgggagtcaatcttgatattccagaatcaattggcaaatccattattgtgaattacttgctatctattgctccaaggtccaagtgggatgaagagtttagcagatag

SEQ ID NO: 95689 - DNA, 765 bp, Glycine max
  Peptide Sequence Number=SeqID_212467
atgctcgctgctgctgcttcagcttctcggcaccttcttcagcgtgatgccaccagcatcggtgcttgcagtggcagtggcaatagagttcgttctcttttgactgcttctgccatcaccacaacctacccaattcgctttagaaaatgttatggaatcagtttcaataatccaaagcacagaacgtgcccaagtttgtttttagctgtaaaggggttcctctctgattcatcaaattctaattccccacatggcagggttaccagaccttacttaccaaaccctgttactagttctactgtggatgggcgagcattgttctccacttcaactaaaactgatgatggaagtcagagccagaaggctgctgcttcttccaccattggtaaatcatcaccaccaccgccccctggtgggcaagctgctgatgtgaagatccttcgcacgcttgccagttacttgtggatgaaagataatctcgagtttcgggttcggattgttgctgcattgggtttgcttgttggggctaagattttgaatgttcaggtgcctttcctgttcaagcttgcagttgattcgttgacggctgccacagggagtgtgggtgctcttgcttcgaattcaagtgggttggctttttttgcaacccctgtggcagttttgattggatatgggattgctcggtcaggagcttctgctttcaatgctggtttacctatgagagtgacattggcaggctttgcaattctaaattctaattcttag

SEQ ID NO: 95690 - DNA, 513 bp, Glycine max
  Peptide Sequence Number=SeqID_212468
atggcgctcgatttgtttgatatggaggtggtggatctggtcagaagtgcagttccactagcactaacagctgaggatgatcctatgagggaggagttaaagaagcttgtggagaagaaggaagaaatcgactcgttggcgcacaagcaggtgcgtcacatcctgtggtctggactaggattcggtgtgatcactgttggactattcttcaggctaacattctgggaattctcatgggatgtaatggaacctatcacatattttaccacttccactggcctagtggtaggctatgcctacttcttgttcacttcaagagaccccacttaccaagacttcatgaagaggctctttttctccaggcagaggaagctgcacatgaggtacaattttgatgttgacagattcaaggagcttcaatgtaagtgcaaaacacccttaaatgccaaaaccattttgaagaatcgcaaagggttggaactggatttggaggatgctttgaacaaagattaa

SEQ ID NO: 95691 - DNA, 759 bp, Glycine max
  Peptide Sequence Number=SeqID_212469
atggaattaacttcttcttttggtttaaccttcttctatgactatgctactccaagcaaagtagtcctatggctggcatctatcttctccggcatcatcttatgcgttcttatgaagttattggatgaaggctttgtattggatgtgggagaaatcctaagaatggtaaaatgtgggattgcagggtgtgattgcataagaatggtttatacatcaactgctattttaagttctttgttgttcaagggatatggaaaattgagcagtgcagagaaaattgaatggaataacaggggattctctacatttcacgctctttttgtatcatctgcatctttctacctcctcatcttatcagatgtcttcaatgtgaattcacatggcgacgtagttattaatagatcatcaacattatcagatgcagtattggggatttctattggttattttctaacagatttggcaatgattctttggaattttccagctttagggggtcttgaatatgttctacaccacggcctatccataggttctattacactatgtctgctaagtggtcaagttcacatctacatactaatggttcttttctctgagagcactactccttttgtaaatcttagatggtacttggatattgctggccttaagagctccaaactttacatttggaatggcatcgcattgttctttgggtggttggtactgtctaatatactctctttaatcttgacctcaactctaattcctctgtaa

SEQ ID NO: 95692 - DNA, 561 bp, Glycine max
  Peptide Sequence Number=SeqID_212470
atggtagcaggtatattggcctacaaatttggagctccctttgcgctgattacttccttatctgttgctgcctatgttacttttacactgactatcacacagtggaggactaaattcaggaaagccatgaataaggcagataatgatgctagtacaagggttattgattcacttattaattatgagactgtgaaatattttaataatgaagtttatgaagctgataactatgacaagtacctaaagaggtatgaggatgctgctctgaaaacccaacgcagtcttgctttgttgaactttggtcaaaatgttatatttagtaccgctctttcatcagcaatggtgctttgctctcatggaatcatggatggcacgatgactgttggtgatttggtaatggtgaatggactactcttccaactatctcttccactcaatttccttggtagtgtttatcgtgagactattcagagtctagttgacatgaagtccatgtttcagctacttgagtatgtaccatacaaaatatggattgctagaatttttgggcagcatggataa

SEQ ID NO: 95693 - DNA, 213 bp, Glycine max
  Peptide Sequence Number=SeqID_212471
atggatgagagtggcagctatcatgctgccatgctccactccttaatacacaatgcaaagtgtttcatgttttgcaatgtgaaatgcaccacagtgccagggtgcagctcaagtagcagttgctattacaacattcagacaaaagcaattgatcatctggctgctgcagagatccttctgatcctgaagttcccattgctggccctactctaa

SEQ ID NO: 95694 - DNA, 303 bp, Glycine max
  Peptide Sequence Number=SeqID_212472
atgataaagatagatgatcaagatattcgggaggtaacctttgagagtttgcggaagtccattggtgttgttccacaagatactgtacttttcaatgatacaatatttcataacattcactatggtcggctttctgcaacggaagaggaggtctatgaagctgctcagcaagcagcaattcataacactatcatgaagtttcccgataaatattcaactgttgtgggagagcgagggctaaagggtaagaaggggtatgggattgcaaatctcaactcgctggatgagacacccgcaatttag

SEQ ID NO: 95695 - DNA, 522 bp, Glycine max
  Peptide Sequence Number=SeqID_212473
atggcgggaacgacgatgccgccattggcagcagcgggacggggtctgagtctgactaggagagatgaagaagtccataccgccattcgtactagcgggactaggagagatgaaggcgagagacccgccattggcactggcgggacatgccaacgtgtgccaatggcgggtctctctccgcttcttcatctcccccgtcccgctgctgccaatggcggcattgctgttcccgccattgccagtggcgttacaagcttcacgccagtaacaatggcgacacccacggttccgccattgcaagtggcgggttccttcatgcatggttccgccattgagaatggcgtaaagcacccaaagggttccgccattggtaatggcgagataccccatgccattaaccatccatcatccatcataatggcgccatccatgcaccatctttctgccagtcagactggcgaatttgacttcgcttttgtactgattctgcgagaccctctggcgagttttgctttgtattga

SEQ ID NO: 95696 - DNA, 600 bp, Glycine max
  Peptide Sequence Number=SeqID_212474
atggtgtctcaccttgagaagcaaggtgaagacattggtactcattcttcggctcttgtggaagaaaacactactcaagaacaaccagcagcagcagctaaaaccacagaagcaaggaaccaatatcaaagcttaagggaactttttaatggagaaagttcaacgccatgccttgcaagtgatgtacatgatcagaccaatgacaagggaaaggaagtgcataaaaaattcccaacaataatagtcttagaagaagaatgccaaaatgctgaacatggctgggctgatgatgctcctgttgctgctgccgaaaccggttttcaccaaaaaaatggtgaaattgatcaaaagggaaaaggcaaacatagtaatgcagtactctcttttagttactctgacttgcaaaggggtgttggaatgcaaaaccctatgggtccatttccaaagcagcagccattactactctctgctgagttgttggtgccttctgggatggaggggaggtggatgagaaatctcgatcttaaccagccaccaccacaagatgaggaactggaagaggcacaaaatgaagtggataatcattatctaagagattaa

SEQ ID NO: 95697 - DNA, 375 bp, Glycine max
  Peptide Sequence Number=SeqID_212475
atggttctctttcacatagaaagttgttgtccaaaacgctctgaatcccctcctttaggtttttataaaaggagatatgttcgtgtcattcaaatagagactggatatggtatccttcagatgtcaggagatgaaaaatctaagataaaggatgcagataactctactgcttcgttcatgcttctggccttacaggagtgtaagaaattaatcatttgtgagaaagaccttaaaagaaaaacttcgagcatacagaaaggaaatgaagtggaacattacctacagtatgcttttctttgcacctctagaatccgatggagtctttttgaccttcgagtactacggtcatcgttcatggctgtcccgtcatggtga

SEQ ID NO: 95698 - DNA, 1410 bp, Glycine max
  Peptide Sequence Number=SeqID_212476
atggattttgttctaaattaccttaatgccaatacaattggagttctttcgctaatcctcttctgtttgtttttgtatcatcccttcaaatttgctcgaggtaaaaaagaggctcccacagttgcaggtgcatggccaatacttggtcaccttccactgttaaatggttcacatataccccatagagccttgggtgatttggctgacaagtatggacccatattcaccatcaaacttggcgtcaaaaaggctttagtaattagcaattgggaaatagctaaggaatgcttcaccacaaatgacatttttgtttcgtctcgccctaagcttgttgccgttgagtacatgggctacaaccaagccatgttaggctttgcaccctatggtccttattggcgcgaactacgaaaggttgcaacgttagagatcctctctaatcgccgagtggagcaactacaagatgttcgtgtctctgaagttcaacattcgattaaagatctcttcaatgtttggtgtagcaaaaagaacgagtctggttatgcattggtagagctgaaacaatggttttatcatttgacattcaacatggttcttcaaatggtcgttgggaagcgatatttcagtgctacaactgtggatgatcaagagatggctcaaagatgtgtgaaagctgtgaaggagttcatgcgtctcataggggtgtttacagtgggagatgctattccttttttgagaaggtttgattttggtggccatgagaaggccatgaaagaaactgggaaagaactggataatattttgggtgagtggttagaggagcaccgacaaaacaggtctttgggtgaaagtattgatcgagacttcatggatgtgatgatttccttgcttgatggaaaaacaattcaagggattgatgccgataccatcatcaaatccactgtactggcagtaattttaggagcaactgacacaaccagtactactcttacgtgggcaatatgcttgatgttgagaaatccttttgcgttggaaaatgttaaagcggaacttgacatccaagttggaaaagaaagatgtataactgaatctgatataagtaagttaacataccttcaagctgttgtcaaagaaactttaagattataccctgcaggtcctctctcagtacctcgagaattcacggagaattgcactttaggtggctacaacattgaaaaaggaacacgtctaattacaaatctttggaagattcacacagatattaatgtttggtcagatccattagagttcaaaccagaaaggtttctcaccacccacaaagatgttgatgttaggggtcatcattttgagctattaccatttggaggtggtagaagaatttgtcctggaatatcctttggccttcaaatg

SEQ ID NO: 95699 - DNA, 1224 bp, Glycine max
  Peptide Sequence Number=SeqID_212477
atgaaagaagagctgaaagctattgaaaagaataatacatggcaacttgtgcctttgcctgctaagaaaaaacctattgcagtaaagtgggtttataaggtaaaaaagaatctgaaaggagagatttccaagtataaggccaggctagtggcaaagggattcttgcaaaaggctggcattgattttaaggaggtgtttgcacctgttgcaagaatggagacagtgagaattattactgctatagcaagtcaaaaagggtggcatatgcaccatatggatgtgaaatcagccttcttgaatggtcctctagaggaggaggtttatgtgagtcaaccacctgggtttgaaataaaaggaagtgaagagaaagtgtatagattgaacaaggctttgtatggcttaaagcaggcgcctagagcctggaacaggcgcattgatggctttctaatgaagcttggattcctcaaatgtacaactgagcatggtgtttatataaagggcagcaatactactaacttgactgtagtgtgcctaactgatgagggagtgatcatgcatcaagggaggtatgcaagagatgtactgaagaagttcaaaatggttgactgcaattctgcaaacacacccattgccactggtgtgaacttggtgaaagatcctaatgaagaagaagtagatgcaactttgtatagacaaatggtgggctcactgagatatatggagaatcctaaactttctcacttccgtgctgccaagagaataatgaggtatgtgaaaggtactctcgattatggtattctattttccagtgctgccaaaaaatgtaatgttctgggatatagtgattctgattggtgtggagataagagtgataggaagagcaaagtaggttatgtgttcttctatggtgatgccccaatctcgtggagttcaaagaaggaacaagtggtggctctctcctcatgtgaggcagaatacattgcagttgctatggcagcatgtcaagctcaatggcttgataatatttttggtgaattgaagatgaaggaaaagggtgctattacactgatggtggacaacaaatctgccatcaatctagctaaacacccagttgctcatgggaggagcaaacacattgaaacacgatttcatttccttagagagcaagtgacaaaaggcaagctaagtgttaagtattgtccaactactgtgcaagtagcataa

SEQ ID NO: 95700 - DNA, 222 bp, Glycine max
  Peptide Sequence Number=SeqID_212478
atggcggatgtggtgattgtaatggtggcgattgaatggtgtggtggtggtgataggtcggaccagttgattgaggactggagggagggaactagctgggatttcttggactgggattccttatacaagactcacacatactcctgcaaaagcgttgagcataaccctagtgcactaacagtagacctctatctagagacgtggtctgaaacccctgcctag

SEQ ID NO: 95701 - DNA, 894 bp, Glycine max
  Peptide Sequence Number=SeqID_212479
atggctcttaatcttctaaacctttcaatcttgttcgttttactcaacatcatcaatccgtttccctttgcagagccaagaactttagaagcctctacaactcctttttccaaaactctccaaaacctgaggggtgttcacaggggacaaaatgcaaaaggtgtgggcgaactcagaggctaccttcaaaaatatggctacctaacaaagggtagttcttccaacgacaacttcgacgaaaacgtcgagtccgccctaaagcactaccaagcattccatcacttacgcgacactggtgtggtggatgacgatactataaaaaaaatgagcctcccacgttgtggaatgcctgatattatcaccaaccctaaccctaaccctaacgggttggtgggggctcctgaaaactacaccttcttccctgggtcgccaaaatggagcaaattttttttaacctatcgacgcacatcaggtgctacagtgtccatcaatgaaaccgctgtgagacgagcaatgcgggatgcctttcaatcctgggcaaacgtcagccccttcacattcaatgaaactacagatcgttcagctgacataacctatggatttcacagaggactccaccttgatttgtacccatttgacgggccaggaagggtgctagcccatgcttttgcgccggaagatgggaggattcactttgatgcagacgaactgtggagatctaacgggtcagacattgattttcaaacagtgggtttgcatgaattgggtcactctctagggcttggacatagtaacgatacagacgccgttatgcaacccaattatgatggacaaagaaggtctctgagccaggatgatattgatggcatacaagctctatatggacagaactag

SEQ ID NO: 95702 - DNA, 1014 bp, Glycine max
  Peptide Sequence Number=SeqID_212480
atggataatatcactactagaaaaactattatctatgacgctgtttttaagacggttctaaaggaccgtcttagaataggaggcgatgcttacgctagtgaagtgagtgagcgagcaagtgaggttccgcaaccacttacccactccgccgtcatcatcctccgggctccggggccggagcccttcacctacctggatgacttcccccaccctgatcccaaccacgatgagacgatccttgccatcccccgcgccgcctccgacaagaacatctccaccaaggaacgtcgcgccaggcggcttcggagcatcgtgttcgagcaagaagacggccagcatagcggcaagaagcacctcatttatcctccttctccttttgtggcgaagtcagtggcgagagaggacgacattagggaatgtgcaaccactgttcacgctgccaattctaatgttctgtccgggattggattttctcgccccgtttttcaccatgacgggtcatggctcgtggcttactttattgatgcttttgacttggcaggttcaaaaggagggggtgggagtgggaacatttctgccttgctgagtggtgttccgcgggatgttaatatgcaactgttacaggtaacctcaggaatgacctttagcagtaagacaattggcggcaatttgaattctaaggttaaatctgctgtgatgaagggttcaacactaatgaaacctactactagtctgttggctaagcaaaatcagccccatccaattgttagctcaaggttattagaagtaaatttgcccccatgtttggctggtagcatggaagttggtgatgtgaagcagcaagttaattttgtccacaaggcacctaagaaggtaagggttgtaatgcaattaatttcaacgtcttcacttcactgcaatgattctgataagatatatatgattagtgatctccaaggaactgaagtttgctggttgcaggatttggacctgcattttcttgataaatgttag

SEQ ID NO: 95703 - DNA, 669 bp, Glycine max
  Peptide Sequence Number=SeqID_212481
atggcaatggcaaatgcagcataccctgcatatatgttggagactagaaaaactgctccaggtcttcgtttagtggataagtgggcggtattaattggtggaggtcggaaccataggatgggtttgtttgatatggtgatgataaaagataatcatatatcagcagctggaggtgttgctgatgctcttaaagctgttgacctgtatctggagcaaaacaatcttcaaatggaggttgaggtgatttcacacctccgtaccctccttcctttcctgcctgccacatttgcagtggtgacaactgaaattctcgtccctactgccctagtggagaccaggactcttgaggaagtggaagaagttttacattattcatctcaaacaaagacttctttgactcgaataatgttggacaatatggttgtacctctaccaaatggggatgtggacatatctatgctaaaagaagctgtgcagttgataaatgggagatatgagactgaggcatcaggcaatgtcacactagatactgtacataaaattgggcaaagcggagtgacctacatttctagtggttcgttgactcattctgtgaaagcactagacatctccctcaaaattgataccgaattagcactcaaagttggaaggcgcactggacgagcttga

SEQ ID NO: 95704 - DNA, 2046 bp, Glycine max
  Peptide Sequence Number=SeqID_212482
atgaggggaccctccccgagctccgtggaaccgcgccaccgctcctcctcttccttcaggttttacattgcggttgcgatcgtggtttcatcgcatttcttgacattgcgggatgcggcctcaattgaggtcgcattgcggtttcgtgaggatactggcaagagaaggtctcaaagaattaaagattttaaagatgttgagaaggcgttgcatattccattccaagacaggattataacttgcaggccgaattggaagttagttttggttattattgtattgggaaccttagttacaattttccatcctccagctgtttataatactgatcatctatcaaactctttatcacggccaacttttataaacaactggaaaggagggttcaatggcattgattcacgttatgcatcattattaaatattgagtgggaccaagtatctaatgttcttgaaaatttgaaggataaggatacataccagggtgttggcttattaaacttcaatgacagtgagaatgaccagtggaaggagctgataccagaagctgagcatgtagtccttcacctgaactacacttcaagtaatattacttgggatgtcctgtatccagaatggatagacgaagaagaagaatacgagttccctacatgtccaacactacctaggattcaggtaccaggaaagcctcggcttgatcttattgctgtcaagcttccctgcaacaagtcagggtgctggtcaagagatgtagctcgtttgcacctgcagattgaagctgcgagacttgctgcctcatccaaaggatatcatcctgtgcgtttgcttttggtcactgattgcttcccaaccccaaatctctttacttgcaaggaacttatacagcgtgaagggaatacctggctttatgaacccaacctgaatacacttagagagaagctgcagctgcccattggttcatgtgaactgacagttcctttgaaagctaaagagactaactgtattcctttaacagaaaatttttattcagaaaggccacaccgagaagcttatgcaaccatcctgcactctgcacagatgtatgtttgtggagccattactgcagctcagagtattcgcatgtcgggttcaacacgagatcttgtgattcttgttgatgaaacaattagtgagtatcatagagggggcttgaaggctgctggatggaagatccatacaatccaaagaatcaggaatccaaaagcagaaccagaggcatataacgagtggaactacagcaaattccgtctctggcagctaacagattatgataaaatcattttcattgatgctgaccttcttatacttagaaacatcgatttcctttttgagatgccagaaatatctgccataggaaacaatgctacgctgttcaactcaggtgtaatggtggttgaaccatcaaattgtacatttcaacttcttatggatcacatcaacgagattgtctcctacaatggtggggaccaggggtatctgaatgaactcttcacatggtggcaccggattccaaaacacatgaacttcttgaagcacttctgggaaggtgatgaggaagagaaaaaagcaatgaaaactcgtctcttcagagctgatccaccaatcctttatgtcatccattatctgggtaataagccatggctttgcttccgagactatgactgcaactggaacgtggacatcctgcaggagtttgcaagcaatgtagctcatgcaagatggtggaaggtgcatgatgcaatgccagaaaacttgcagaagttctgtttgcttaggtccaagcagaaggctgcattagagtgggatcgtcgacaagctgaaaagggaaactacagtgatggtcactggaaaattaagataaaagacccaagattgaacacttgctttgaggatttctgtttctgggagagcatgttatggcattggggtgaaaagaattggacagataattctactgttaacaattcaccacttattgtccaaacccaatctctctcttccttatga

SEQ ID NO: 95705 - DNA, 405 bp, Glycine max
  Peptide Sequence Number=SeqID_212483
gatgggttgccaacatttcctgatgaggaggcgtttgcatgcattgagagggaactaggactatctattgactctattttctctactatatctccaacggctgtagcagcagccagtttgggtcaagtttataaaggccggttgaagtactctgggaaacttgttgctgttaaggttcaacgccctgatattgaagaagctataggaatggacttctacctaattagaggtttagggtctctcataaataaatatgtggactttatcaccagtgatgttgttgctcttattgatgaatttgcacgtagagtctttcaggagctcaactatgtgcagccaggcatgcatcatgattcatctattagtaattttttgcatctgttgcaatccttgatgatgctgtaa

SEQ ID NO: 95706 - DNA, 330 bp, Glycine max
  Peptide Sequence Number=SeqID_212484
atgagggtcagagccagtttctttgtgctgttctcattgtcatgccttctttgtgtgttactttcaagtgctcaacaacttccacctgatgctgttgtttcggctcgtttgttagattcccatcttcaagattcggcctttagggcccttttcagtccaataaccggtgtgccctatgatgctcaagtgcccaccaacctttcagggatcaaagtttcagcaatgaggcttaggagtggtagtttgaggacaaggggtgttcttagctacaaagaatttgagatcccaattggggttgttgagaagccctatgtggagaggcttgtgttg

SEQ ID NO: 95707 - DNA, 216 bp, Glycine max
  Peptide Sequence Number=SeqID_212485
atgggggagggatgttgtacgcagccttacccttgcatatgcaaagaggctgtttccggattcgaacccatgaccaacaagtcaccaaggcacaactttaccgctgcaccagggctcgccctcaggaggaagaagagcatgtacataatggaaaccaactatgcactcaaatctcacgaaaacgtgcctaccaatttggtacaagaaccacagtaa

SEQ ID NO: 95708 - DNA, 294 bp, Glycine max
  Peptide Sequence Number=SeqID_212486
atgcaacaagggcacttctctatagttgtggaatccaatgcaccatcaccagcgcctagtagtggtggggaatttcaagatgctagtgggaagaacaataagaaaaataacaagttcatgttgaggatattggctccattgagaagacacacgaaagggacaaggatgcagcaattggaatgtgtagcttatagcaatgaaatcatggatatgacatccattggtgacatcaaagtaccattagcatttgggactcgtacaagaccaatgatagaacatgattactttccttag

SEQ ID NO: 95709 - DNA, 186 bp, Glycine max
  Peptide Sequence Number=SeqID_212487
atggggaaacagattgtgccggtgaaatcagtgatctacgcgctctcccctttccagcagaagataatgccgggtctctggaaggacttgcccacaaagattcaccacaaggtctccgagaattggatcagcgccactctcttgcttggtcccctcgtcggaacctacacaggaaatattaggtga

SEQ ID NO: 95710 - DNA, 375 bp, Glycine max
  Peptide Sequence Number=SeqID_212488
atgaatgtagatttagaaggtgaatgtaaaaattattcttcaactcttagcatgctccctttatttaaaaattggctcctcattctttcaaaggtgaacatagaccttccacccttgcggaagaggtcaaggtcaagttcttcatcatggggaagttacattgcgaggcctctagatgaaatcaaagaagcaacaaaagaggaaagactttgtgctctggaggctgcagaggcaatccaaatcaatttgaactcatcaaatccatcatttatcaagtcaatggttcggtctcatgtttatagctgcttttggttgggtcttccttctaaattttgtgaggaacatctgccaaaaactttacatgacatggtttag

SEQ ID NO: 95711 - DNA, 630 bp, Glycine max
  Peptide Sequence Number=SeqID_212489
atgactcatagaggtagaggtaccattagtggtggtggcaatgcaaatgatggcaacaatgacaatgtcatgaaggtagcggtattggtggtggcaggtaatggtgacaacattagtggtggtgacagaggtgatattagtagtgaggacggtgatggaagtgatattattggtggtggtggtggtgacatcaagttgcagtggtgtggtgttggtgtcacgaaagtgctatcgttagtagtagtggtgacaatgacggtggcagtgacctctaatggtggtagtggtaacaacgctattgacgacgatagtgacagtgatgatgatgatgacaatagtggcagtggtagtaatgttggtggcgataatcaggttgataacgatggtggtgacagtgaaaataatgatagtggtagtacggtactagtggtcatggtgataacaaccaattatgataattacaacaatggtgatggtgacaataatatgatagtgacaatgacggaggtgacattgatgatgacgatggtggtaatgccaacaacaatgatggtggtcacaaaaattgtaggagtggtgacaacaaaaaatgttattgtcaaatgtgaaaaatatatatttttaaactaa

SEQ ID NO: 95712 - DNA, 1203 bp, Glycine max
  Peptide Sequence Number=SeqID_212490
atggatgagaattgcggttcaaggccactactggggaaccagaaccatgatgggaactcttttaactctcttagaacagctttcttgttcaagcttcccgataatgaccgttctggcctcgactctgagtctccctttcagtttgaccatcaagtttcctctaccaaccacttaagtcaaggtctctctctgatttctctcttgaaagttaaagttgcgttgtgtgtgcgcgcgtgcctgcatgttctatggcttagagagaaagaatattatgaaagacagtttgctactctaaaatcatttgaagaagttgactccatagtaatatcggactgcactgatgtagaagacattggaaaacaagctgaacatgaacgggcaatgaagatttctaattatgcaaatgcagttttattggcattgaagatttatgtgactataaggagtggatcaatagctgttgcagcatcaacattggattctcttcttgacttcatggctggtggcatactttgctttacccaccttgcaatgaaggatataaatatgtacaaatacccaattggaaagttgagggggcagccagtgggcataattatctttgcagctgtcatagcaacacttggctttcaagtattgatcacggctgtacaacaactaatagaaaacaatcctcctgagaagatgtcttttgatcagctagtatggttgtactctgttatgatatttgcaacagtggatcactactttgatgttgtaacaaatgtgattggattaattgcggctgttcttggtgataaattttactggtggatcgacccggtcggtgctattttactttcaatttacactattacaaattggtctggcactgtgatggaaaatgcagtattgcagaagctgacatatcttgtcgtaatgcacgctcaaattaagcgcattgacactgtccgtgcctacacatttggcgttctatattttgtggaggttgacactgaactaccagaggatttacccttaaaagaagctcatgccattggagagagccttcagataaagctagagaaacttccagaagttgagagggcatttgttcatctagacttcgaatgtgatcacaaaccagagcactcgatcagttcttaccaaactgccggacactcagccttaaattcaagttcatctttctacatggatatataa

SEQ ID NO: 95713 - DNA, 705 bp, Glycine max
  Peptide Sequence Number=SeqID_212491
atggtttcaatgcttctgctcaatcttttatatcattaccaaaaggatctcattcttagagccgagtactttcatttgatgacacttgagggaggttgcaagaatgtaatcccatccatagatccacaaggcatgaatcaattgattttcttattcctcaaatcttgtccagagattgaatgcctctttggtagtaccaatgctaatctgcttatgaccaaagttgtgttctgcaacctagttaccttaaggttgagtcgtatgcatggtctgcaagaagtgtttagtgacccctcttcgcaatgctttctcaaaaatttacaagagttagaggtagaagaatgtagacaattgcatagcatatcctttcctaggaactcaaaggtatgcagttttacagaattgaaaataaatggttgtccgatgctaacttctctcttcatgccatctagtgtccaaactctggagctgctagaggttctggaaatatacgactgtagtgaattgaagcgcataatagaagaagtggaagaagggaatgttgaatatgttagcaatcaaagtcatatttctttggcgctcccaaaattaaggagtctttatgtttacggatgtcacagattggaatatatattccctgtgtgttttgctcgagggctaggccttaatccagaaaaaacagcttcagtgtcacttgtttcgtga

SEQ ID NO: 95714 - DNA, 1014 bp, Glycine max
  Peptide Sequence Number=SeqID_212492
atggctgcggctacaaacaattttagtgactctgcacaaattgggcaagggggttatgggagggtttataaaggtgttcttccagatggtactgttgttgccataaaacgtgcacaggagggttcactgcaaggtgagagggagtttctcactgaaatacagttgctatcaaggttacatcaccgcaatcttgtgtctcttgttggatattgtgatgaagagggtgaacagatgttggtttatgaatacatgccaaatggaactctaagggataacctttctgcttattcaaaaaaacctcttactttttccatgaggttgaagattgctctagggtctgctaaaggtcttctgtatctacacaccgaagtagattctccaatattccaccgagatgtcaaggccagcaatatattattggactccaagttcactgcaaaagttgctgattttggactttcaagacttgccccagttccagatatcgaaggaaacgtacctggtcatatatctacagtggtaaaggggaccccgggttatcttgatccagagtacttcttaactcgcaaattgactgacaagagtgatgtttatagtcttggtgttgtatttctggaacttgtgactgggaggccaccaatctttcatggcaaaaatattattagacaggttaatgaggaataccaatctggtggagtattttcggttgttgataaacgtatcgagtcttatccttctgagtgtgcggataaatttttgactttagccttaaagtgttgcaaagatgaaccagatgagcggcctaaaatgatagatgtggccagagagcttgaaagcatctgttctatgttaactgagaccgacgctatggaggcagaatatgttacaagtgattctggaagggtattcaatccacattcttcttcatctactaccaggactccttttgtttcagcagatgtgtcaggtagtgaccttgtcagtggaaagataccaaccattaggccaagatga

SEQ ID NO: 95715 - DNA, 378 bp, Glycine max
  Peptide Sequence Number=SeqID_212493
atggttaaggaggagtgtaaggaggtaagtgtctcctccgagaggacactttttagcactgccacacctcttgggcttaaggttattcctcaagtaaaagagttgttggatgagggtttgacctgggtgctcatatgggacaccttagtgatcaagaggttcccacagaccctacgagaaaaaggtgttgagggaagaagcccagagtttcaagaacctatggatttgaggtcaaatccttttcaagggagaggggataatgcaatcctacccccaaggacattagatagaagatcccaagaagattggaccagagatgcacgagaaggccctacggttctcatgagccttaacgtagattttgggcccatggactaa

SEQ ID NO: 95716 - DNA, 261 bp, Glycine max
  Peptide Sequence Number=SeqID_212494
atgttagcgagtctgctcaaattggacaggggggttatgggaagaggagggttcgtactgcaaggtgagagggagttccttacagaaatagaattgctatcaaggctacatcatcgcaaccttgtgtctctgattggatactgtgatcaagagggtgaacagatgttggtctacgaatatatgtcaaatggagcgttaaggaatcacctttctggtatattttatgctcttatttttcttattttccgtgttgtctattaa

SEQ ID NO: 95717 - DNA, 798 bp, Glycine max
  Peptide Sequence Number=SeqID_212495
atggaagaaattgaagagtcaatacatgtcgaaatcgttgatgaacaaattgtatctgaaacagaaactgtatgggatgaagatgcaagagagttcgaatctccaacagtatgtgaatgccttcaatcagattaccaacgatcaggcaaggctggatgtaagattgaggacaagtataagacatttattatgttgtgttctttgctttcttcttatgaacatttggtgacaatgtacaagaaagactcactcaatgaatctggcggcaatataggctgcacttatgtctcactctctatgaagacaaaatgtagtgggagttcgcaaggcgatggtctatatgtgaaggggaaacaggaacatggaaggacacaaggcaagggttctgttggtaggcaaaggaagaagtccaagtctagagaatgcaagaaaacaatggagtgctacaaatgcaaccagaagagggcatttctagagggtttgcccagagactactacaatgaaggacatgttctctctagttcatgcaattggttgacaaatgcatggattattgattccagatgttcttaccatatgactcccaacagggagtggtttcaccacatacatgtgttgattgctatggatgatggtggagtgagaacgttgtgtgatgtccaacatatccctgagttacggaagaatttgatctcacttcataccttacaggccaatggtttcattaatagaactaatggagatcagaataacctcagagtgtataagggggcattgattgtgatgaaagcagaatag

SEQ ID NO: 95718 - DNA, 186 bp, Glycine max
  Peptide Sequence Number=SeqID_212496
atgttcatgtctttgaaaaactgcatgtcttgtgagaagttgttgatggaaacattgaatgctattcatgtcatgcaaaaacgagctattttgaagaagtgccaaaggagtcatcgcgctaagcgagctcaatgggctcagtccgcatcaatgcctaagcccagcaccagcgcgcttagcgagtaa

SEQ ID NO: 95719 - DNA, 252 bp, Glycine max
  Peptide Sequence Number=SeqID_212497
atgaattgggatttccctattgggccaggtcatttcggaacaagcggatcatttatgatgaagaggatgagcttcaagagaatgattcagagttcttgcaagatcgacaattctttacagatgaagagatgtcaagggaacttcttacttcccaaacagatcttcgaaggagaaacaagcattatgagtcattcattttctctattccctttgttattttcttcccatgtactgaatattgccctcttgtaa

SEQ ID NO: 95720 - DNA, 441 bp, Glycine max
  Peptide Sequence Number=SeqID_212498
atgctgagcggagaagctgaggattggtggaagttttctagtcaaaccttgccaagtaaggaaggagttatagtgtgggctgcattcaaggagagtttcttgggtaactacttcccaagggacttgcgcaagaaaaaagccagagaactcttggagctgaacaaatgccgcatctgtgagactagcgttaaagggaagcaagccgagcctaagtttggagatttggatgcaagacgatctacaataaggtatgcattcacaattggcaattctcttgtcaagtggaaggctgcacttcatcccacagtttccttgtctactacaaaggctgaatacatggctctggcagaagtagcaaaggaaggtatctggctaaaaagtcttcttagcaatcttgggtttccacaagataaagctatcattttctctgggacagtctga

SEQ ID NO: 95721 - DNA, 351 bp, Glycine max
  Peptide Sequence Number=SeqID_212499
atggtgataagcctgagtcaaggtcacccttgttgtgcacagacaactcccttgtcgtgcaaggtcaccttgtcatgcacagacaagtatcaaggtcaccctgtaatgcacagacaactccccccctcctccatggtgatcagcctgagtctcaaaggagttccaaaccgagtgacatgcccccaagtacaagtattcctactcatgagaaactccaactctctaactgatgcaatcctccctaggaagggaccagtcactagagccatgagcaagaggctccaagatgattggactagagctgctgaagaaggccctaggattctcatgaacctcagggtagatttctaa

SEQ ID NO: 95722 - DNA, 249 bp, Glycine max
  Peptide Sequence Number=SeqID_212500
atgggggatgcggagaaacagagatctggcacgaaacaacaaacacggagaacaattgaagaatccgagttcgaaaggagttgcaagagaaagaaatcaaaacgagaagaagccggtgaggaagaggtaacaactaatagaaccgaacgcaattgggtccaagacgaaatcgttgaagaagaagaagaattaaaagaaggtgaagatgaaggagacgaattcgaagatggattgtgtcttcgtcgatga

SEQ ID NO: 95723 - DNA, 1965 bp, Glycine max
  Peptide Sequence Number=SeqID_212501
atgaagttctactcctcccaagtgcatcgtttccttttcatcattgttattcttttccccctggctattgctgacttaagttctgacaagcaagcccttctggattttgctgctgctgtcccccatcgccgtaaccttaagtggaatccagctaccccaatctgttcatcttgggtaggcatcacttgcaatccaaatggcactcgtgttgtttctgtccggctccctggaattggactagttggcaccatccctgccaatacacttggcaagattgactcactcagaaatatcagcctccgagccaacttactcagtggaagtcttcctcctgatattacgtctcttccttctctacaatatctctaccttcagcataataacctttctggtagcgtacctacctcgttgtccacccgcctcaatgtacttgatttgtcatacaattccttcagtggtgctattccaaagacattacaaaacataacacaactaattaagttgaacctccagaacaactccctatctggacagataccaaatctcaatgtcactaagctcaggcacttgaatttaagctacaaccatttgaatggctctatccctgatgctcttcagattttcccgaattcttcctttgagggtaactctctatgtggattacctctaaagtcatgctctgtagtctcctctacacctccatcaactcctgtctcaccatccactcctgcaagacacagctccaaaagtaaactgagtaaggcagctatcattgcaattgcagttggtgggggtgtgctattgcttttagtagctctcatcattgttctttgctgtttaaagaaaaaagatgatagaagccccagcgtaactaaaggcaagggtcctagtggtgggagaagtgagaagccgaaagaagagtttggaagtggggtgcaagaacctgagaaaaacaagttggttttctttgagggcagttcttataattttgaccttgaggatttgctgagagcttcagctgaagttcttggaaagggtagttatggtactgcgtataaggctatattggaggagtcaacaacagttgtggtgaaaaggttgaaggaagttgtggtaggcaaaagggaatttgaacagcagatggaaattgtgggaagggttggacatcacccaaatgttgtgccccttcgtgcttattattattctaaggacgagaagctcttggtttatgactacatcccaagtggcaatctatctaccctcttgcatgtttaccttcttatgggtatatatgctcctgagtcagctaaatcagatccgaatttgattacaggtaacagggcaagtggaaggactccattagattggaattcccgaataaaaatctctgttggaattgccagaggaattgctcacatacattctgttggcggtccaaaattcacgcacggaaatgtcaaatcctcgaatgtcctcctcaaccatgataatgatggctgcatttctgattttggcctgaccccgcttatgaatgttcctgcaaccccttctagagccgcaggttatcgcgctcctgaggtgattgaaacccgaaagcacacccataaatcagatgtgtacagtttcggaatcctccttctagaaatgcttactgggaaggcaccacaacagtctccaggacgcgatgacatggttgatctcccaaggtgggtccagtctgttgttagggaagagtggacggctgaggttttcgatgtggagctaatgaggtaccaaaacattgaagaggaaatggtgcaaatgttgcaaattgccatggcctgtgtggcaaaggttccagatatgaggcctagcatggatgaagtagtgagaatgattgaagagatccggctatctgactcagaaaaccggccatcttcagaagagaatagatccaaggaggaatcagctgctcaaactccataa

SEQ ID NO: 95724 - DNA, 222 bp, Glycine max
  Peptide Sequence Number=SeqID_212502
atgagtaatcacccgaaaggaagcaaagatgaagcacgaggattcatggaacagctcagagctttaaaccacaggccaagatgcattctcggtgaagaagctaagcaagttggtgctttaactgtgcttcaaattctcaactttagattggagcatggaagctcaacagccaaaagaaattgcatgaaattgaagggcattttcgggtgggttgaggagtga

SEQ ID NO: 95725 - DNA, 591 bp, Glycine max
  Peptide Sequence Number=SeqID_212503
atgaagttcagcaggctgtcccttggaaatgttgctccaaaaattgaaggtattgatctatataatcctcttcatttttctcctgctaaatttaatactatcccttatattcgacccagcgtgcccgtcttcctttacatcttccagatgatgttgacacggaagataggttgggtgttgcttaatagcatgtccaagaagatgttcgagtttgactcgaacataggagagggtgtggacaaggctattctagagctattgccagcctcattggacgtgtgggccatcttgtccttatcttcgacaggcaaccctattactattttggatgctgatgaggatgaagtcatcgaggttacgcccaaagtttcgccacctgttctggctaagaggaagcacaatgaatgggttggggggtcctatcaacgcaagaagtcgagggcccccttttgtcttcgagctttgaaacaggctaacatattgatgtccagtttgagtcccccttctctcgctagcgctcgtgatccaccttcgacccctttgactgttcaagctattgttgccactgcaactgtttttaatcctctgtga

SEQ ID NO: 95726 - DNA, 324 bp, Glycine max
  Peptide Sequence Number=SeqID_212504
atgaaaggacagaaaaggaaggagaatatgaagagaaaggagatattttctggtttagttgcttttcggactaaggtgttccacccaaacatcaacagcaatggcagtatatgtcttgacattctcaaggaacaatggagcccagctctaaccatttccaaggttgcatttaggactaaggtccttttgtcaatttgctcattgttgacggatcccaaccctgatgatccacttgtacctgagattgcacacatgtacaagaccgacagggccaagtatgaggctacagcccgcagctggacccagaagtatgccatgggatga

SEQ ID NO: 95727 - DNA, 459 bp, Glycine max
  Peptide Sequence Number=SeqID_212505
atggatgccctacaatacattaaggaagtacaatgtgcatttcacgacagcagagaaaagtttgacaagtttatggatgtcatgaaagattacaaatttcatagaattgatgttgggattgtcgtagaaaaagtagaggagattcttaaagaccatggggatttgattttggggttcaacaagtttttgtcaaagggatataaaatcttacttctagatgagggtgaggatgggtttggaaatgtttcgaaatatttgaagaagattcaggatcgatttgaaaacaaagatcatgtttacaagtcatttctaaatatacttcttaagtacaaaaataatggagtcactctttatgatacataccatgaggctgctacactttttgagggtcaccgtgatcttgttcgtgacttcactaagtttctgccatctgtacatctaaggggaaaatctacttaa

SEQ ID NO: 95728 - DNA, 441 bp, Glycine max
  Peptide Sequence Number=SeqID_212506
atggatgccctacaatatattaaggaagtacaatgtgcatttcacaaaagcagagaaaagtttgacaagtttatggatgtcatgaaagattacaaatttcatagaaaattggaggagattcttaatgaccatgggtatttgattttgggattcaacaagtttttgccaaagggatatgaaatcttacttctagatgagggtgagggtgaggatgggtttggaaatgctttgaaatatttgaagaagattcaggatcgatttgaaaacaaagatcatgtttacaagtcatttctaaatatacttcttaagtacaaaaatattggggttactctttatgatgcataccatgaggttgctacactttttgagggtcaccgtgatcttgttcgtgacttcactaagtttctgccatctatacatctaaggggaaaatctacttaa

SEQ ID NO: 95729 - DNA, 849 bp, Glycine max
  Peptide Sequence Number=SeqID_212507
atgtccgtacactcaaaactgaagcaccaccccatgaaccttgcaaccccaagttcccattttgacaacgacccaccatgcaaaaccaagaccaaaacccaaaggaggctccttcggatcatagtcaccgaccatgacgccaccgattcagactccgacgaagaagaagaacaacaacaacaaacaacaagagtgaagagagaaatcacccaaatcaacatgcaacttcctctctcatacaatagttcctttccctcttcatcttcttattactcttcggcttcagcttgcacttcatcggaacaaaacctaaagtgtaagagaccaaacaaaaagccgccaccgttctccgccgtggtccgccgccgcaacaacaagtttcgcggcgtccggcagcggccttgggggcggtgggcagccgagatccgcgaccccacccgccggaaacgcctctggctcggaaccttcgacacggcggaggaagccgctacggagtacgacagagccgccgtgaaactcaagggcccgaacgccgtcaccaactttcctctcacgccggaggccgcggcggaggctccggtggtctccgtcgacaacctcagctctgacggcggcgcgtcgtactccgacttagtggcctctcccacgtccgttttagcctacgagtgcgactcgacgccgttcgacggtttccgttacctcgacgtggaggcgttcgagttccacatcgatgcgccgttaagtttgccggacgttaacgttgcgctgacgtgtcatcacgggaagaaggaggaggaggtggcgttcgatgaattcgatatcgacgaattcatgacttggccttactag

SEQ ID NO: 95730 - DNA, 459 bp, Glycine max
  Peptide Sequence Number=SeqID_212508
atggatgccctacaatatattaaggaagtacaatgtgcatttcacgacagcagagaaaagtttgacaagtttatggatgtcatgaaagattacaaatttcatagaattgatgttgggattgtcgtagaaaaaatggaggagattcttaaagaccatggggatttgattttgggattcaacaagtttttgccaaagggatatgaaatcttacttctagatgagggtgaggatgggtttggaaatgcttcaaaatatttgaagaagattcaggatcgatttgaaaacaaagatcatgtttacaagtcatttctaaatatacttcttaagtacaaaaataatggagtcactctttatgatacataccatgaggttgctacactttttgagggtcaccgtgatcttgttcgtgacttcactaagtttctaccatctgtacatctaaggggaaaatctacttaa

SEQ ID NO: 95731 - DNA, 288 bp, Glycine max
  Peptide Sequence Number=SeqID_212509
atggccgacgaaacaccaaatgagatgaaggaggaggttccagaaattgttccttttgatcctaccaagaagaagaagaagaagaagattacaattgtagatcctgctgatgaccctgtggagaaattggctgagaagacagaaaacctctcagtttctgagggggttgagactgcatttgctggtttgaaaaagaagaagaagaagcctgttgaaatgagtaacttgaatgatgagagtggagatgcaaatgaagatttggatggtgagcagcatatacctgtgtaa

SEQ ID NO: 95732 - DNA, 354 bp, Glycine max
  Peptide Sequence Number=SeqID_212510
atgtcggacgaagccgctgctccgcctctctttctccgtcctctgcgacgccaccaactccttctccacacgcctcagccacaagcgaatcgagcggcattgggctggcactggcgcactgcgccgcagtggagggcatgcaggtctccattctctggcacggtgccagagaagctggagaaggcatgcaacgcgatccgcctcgccacgaggatcaaggtggcagcgtttgtggcaaacatgcagggcgtggaggaatcgtgccacgcgttcgccacggaagccaacaggccctcaacggcaaatatggcaaacttggagggtgagaagagggagactaggaagtttttttaa

SEQ ID NO: 95733 - DNA, 153 bp, Glycine max
  Peptide Sequence Number=SeqID_212511
atgaggttcttgctgcctctcaagattcttcccctcagcctgaggttcttgctcctactgttgatgaggttcccacccctcaagggcacaattcctatgccttggaccacaatgttaagagaaatattattttatcatgaagttgtttgttaa

SEQ ID NO: 95734 - DNA, 162 bp, Glycine max
  Peptide Sequence Number=SeqID_212512
atggcagcttctggggttcattctagcaagcaaatgaggaggttggaatcgaggaagtcacattcttggtggtgggatagtcacatcagccccaagaattctaagtggctttcagaaaaccttgaaggttttattgttaaaaagattgtattgttgctctga

SEQ ID NO: 95735 - DNA, 171 bp, Glycine max
  Peptide Sequence Number=SeqID_212513
atggagaatcgcttgacaatcaattcgtggggctccggactcgatggtggaggatgcatgaatgacaatcaattcatggggctccgaataagatttgattgtggaagatgcacgaaccgcacttggcaatcaattgttggcactccggactcgatggtggaggatgcatga

SEQ ID NO: 95736 - DNA, 927 bp, Glycine max
  Peptide Sequence Number=SeqID_212514
atggcggcgcagcacatcttcgatttccggcaacgagacgcgcacgccgcggatcttcacatacccgttcacccgggtggcgaacatgatgttgccgtccgcacggtagtagccctgatcgccggtgcggaaagcgcgcagcggttgcccgtccggcccttcaagggtgacgaagtcatgctgcttcagctccccctgctccagatagcccaacgccaggttgaccccggcggtatgaatgcggccgaccacgccggccgggcagtggctgccgtcgtcatggcagatgaagtagcggttggccggcagcgggcggccgtaaggcacggtgccgctctcctgcggggcgatcgggtgccagatgctccagatggtggtttcggtcggcccgccgagcgagaacagcgcgagatccgggcgcagggtgcgcagggtttgcaccgtcgccggcttgatgtagtcgccgccttgcgccaccaggcgcagcgaacgcaggctgtcggccgttttgcaggtgagcagcatctccagaatggcgggcaccgaacaccacagggtgacccggtgcttttccaccagctggttccagctgatggcgtccttttcctgatgcggcgccggcagtaccagcgtggcgccggcgcacagcgaaccgaacagatcgaacatcgacatgtcatggtgcggcggcgtgacggaaatgaagacgtcgtcggcagtgaccgcccagcgttgctgagtctggtggacgacgttggcggtagtagctcgcggcctggctggcgctgcgttccgccaacgtctgttcatccggcagcgcaggcgcgcgatccgtcggcgccagcagggccgccggcgttacgccgatcggcgtctccagatcgccgccgtgcaccaccagcgtcggccggcattttccagcagtag

SEQ ID NO: 95737 - DNA, 332 bp, Glycine max
  Peptide Sequence Number=SeqID_212515
atggaagaagaatgtgttcatcaacaaaacgtggctggtaataagtccaatttcccgctacagctgctgaagaaaaaggatgagggaccaccaccatcaccaccgccgagcgccgccaaggccaagcgaccaccgacgaaggacagacacaccaaggtggaggggcgggggcggcggatccggatgccggcggcttgcgcggcgagggtgttccagctgacgcgcgagctcggccacaagtccgacggtgagaccatcgagtggctgctccgggaggccgagcccgctgtcatcgccgccaccggcaccggcaccatcccggcgaacttcac

SEQ ID NO: 95738 - DNA, 567 bp, Glycine max
  Peptide Sequence Number=SeqID_212516
atgaccactcttacacagatatggatgacgttgctacttagcaacattccacccgacgaccataatgtcgatctcccccctacggaagtatcagttggtctgtaccgtcgtgacataggtgaggatcacgcccacgagacgcccaatggacccggagaagtccaacagggccctggggtttccagctctggttacgggcctctgtccgtcctacaaggtgcccatcccccccagcaaggggtagcacccacaagacacccagtggatccggaggagcccaacagggccctggggtttccagctctggttacgggccactgtcagtcctacagggcgcccgtgcccccagcaagttcatgccatcgtgacatagggatcacacccgtaagacactcagtggacccggataagtccaatagggtcctggggtttccagctctgattatgggcctctgtcaattctacggagtgcctgtcacccccagcaaggtcatcaagccccctactaaccgagctttcatcaagaagtattgcgcccccaggaaggcgcaaggcgagacactatag

SEQ ID NO: 95739 - DNA, 495 bp, Glycine max
  Peptide Sequence Number=SeqID_212517
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggaggtaggatgggcagttggtcagatctaggtttctcatttgggatcctgggaaaggatcaagctggcccttgcgaacagcttgatgcactattccttcaaccctttgagcgaaatgtggcaaaaggaaaagatccatggaccgacccatcgtctccaccccgtaggatacgagatcacccaagacgcttcgcatccagg

SEQ ID NO: 95740 - DNA, 216 bp, Glycine max
  Peptide Sequence Number=SeqID_212518
atggttcaagttgaagccagagaacataacatggctggactttgtggagtgtccaaaggaattttaaaaagggagatagataaaaagttgaagaaggcagagaccttaatatgggtggactttgtggagtgtcctaaggttgaagtagtctatggttcaagttggaaaagtggggaccttaaaatggaggaccttgacatagacttgatggagtag

SEQ ID NO: 95741 - DNA, 455 bp, Glycine max
  Peptide Sequence Number=SeqID_212519
atgccgacacccaccaatgccaccggccaccaggtcagcagcagcttggacaggttcaggtgcgtccagcccaggttgctggcgagcatgaacaggccgatcaggatcagcaggacggcggcaacgaggcgacatgctggtccagcgcacccggctcgtagcggtgcgcggggccgctgccccagaccgggcccggccacgcggggtcgccgtcatggcggccgatcacatggaaatgcagctggcgcacgatcttgtcctgctgctcgccgtccagctcgatccactcggtcaccccggccaagcgcggtaccagcaccagccaggggaatcgttcgtcgttcatcagtccgcacttgcgacaacggtccttccgccaccagcacgctatcggtggccaggcgtgaatcgagttcgaaatcgctcatccaagatgctccgagaagaagtccagg

SEQ ID NO: 95742 - DNA, 201 bp, Glycine max
  Peptide Sequence Number=SeqID_212520
atggaaaaatctgacaagaaaaatttcaaagataagaaagaaaagaaagcatacatcacttgggaaaataatgacatggattcatcaagtgattcagaaaatgaaatcataaatctgggccttatggccaaagactatgaaagcagagaagagatgcatttaatgacttgcataaagaatttgtcaaacttgccgaattag

SEQ ID NO: 95743 - DNA, 288 bp, Glycine max
  Peptide Sequence Number=SeqID_212521
atgtgggtgcaagccattggtctatttgctcaagcaacctgtgctcctgagtttggacttccaagaccgttcaatcagagattactcgtcttgcacgttggtgggggtgccgtaaaacaacgaggacaacccttcccttgtattcaagaatcctctacaacaagagacccacagtctcttaatcccttttcagaaataagaagaagagaagaagagatctctcttaaaagagatagcttgtacaatgaagatcaatcaaaattccttattgaatatgcaagtggttga

SEQ ID NO: 95744 - DNA, 1272 bp, Glycine max
  Peptide Sequence Number=SeqID_212522
accgccgcgccgatggctacagcgtctacgtcaccgactcctgggacaacggcgaggatgcgcagggccgtgacatcctgccgccgctggcggaactggacaagcgcgtgcgccaataccacgtgagccgcgacgatgcgaaggtcgaggcgaagctcgtcgccagcatcggtgacaccagcgaagccggtgcactacgcgtagtcgaatcgatctggggcgacccggaaaacgaccgcctgctgattgccgaagaggacgagagctacgccagcgagttcaaggtctacaccctgtcaggccgaaggcgtgaccctgcgcacctgtggcaaggacggctggtggatcactaccgaacagggcaagcagcgcagcgtgttccacctgttcgaccggcatacgctgaagccggtcggtgcgttccagggcaataccgtggccaacaccgatggtatctggatgatgcagcaacccagcgcgcgcttcccgcacggtgcgctgtatgccgtgcacgacgaccagggcgtggttgcgttcgactgggagagcatcgccaagcagttggcgctgccgctggagtgtggcgcatgagcgggcactgcgtgatgcgtacgctggcgctgagcttgctgctggcgttgccgtcattgtcgttcgcagcggccgaaccgaatacccaggtgccggcgggcagccgccactacgcagcaacgacggtacctgaccgcatcgtcgcctcgccggcggtcgatcccagccatggattcgctgtcgcctggcgtaccgacggcagcgtgcaggcaccgctgctggagattgccctcgccggagattcgccggccatcgagggcatccgccaggtgcgcgcaacgacccgttcgctacagaccgagaatggtctgtcgcatcatcatcgcgccgacatcagcggcctgcagccggatacccagtacgtctaccgcgtgcagggcaacggcagctggagcgcctggaaccagttgcgcacactggccgcggccgaccagccgctgaccctgctgtacttcggtgatacccagaacaagaacgtcagccatgtcagccgggtagtgcgcgccgcgcagaaggccgcgccgcaggcgcgcatgagcctgtttgccggcgacctggtcagcggcggcgacaacatggatgacagaaaccctggtggccccggccatcggcaaccacgagtatttcgaggagttcgaggacaccccgcaggaacgccgcgtgctgggcaagcattggccg

SEQ ID NO: 95745 - DNA, 1476 bp, Glycine max
  Peptide Sequence Number=SeqID_212523
atgcagcacgccatccagccgcggcaccagcgcggcaacctgttgtgccagctgctggcagctttccggtgtggcgtgcgccagatccagcagcagcgtagcggcgggctgtttattgagctgattaatcgcctcagcggtttgctgcagcgtggtggcgttgcggccgagcagaatcacgcgcgcaccgtagcgcgcataggtcagggcggcttcgcggccgatgccgtcggaagcaccggtcacaagaatgatgcgattgtccagcaggtcgcttttcggttgataatgcacagcgatgtcctttgcaggtcagagggttttttggctttatgcctcaatttggcgcaaggtgcaatcgccgcaacgcgcattctgtgccgcctgccggcatttcaggcgacgaacggcatcaaagcgggcggcagaatggatttactctccagctatggattatttctggccaaggccgtcaccgtcgtggtggcgatcgcagctattgtactgattgtgctcaatgccgcgctgcgtaaacgtcacagcggcggtcagctgcgcttaacccatctcgacgaagcctatcgcgagatgaaagaggacctgcagctggcgaagatgaagccgcaggcgcaaaaagtgtggctgaagcagcataagaaagaagagaaacagaaagccaaagccgaaaagcgcaatgccaaagccggtgtaactgacgcggcgaagccgactctctatgtgctggagttcaaaggcagtatggacgccggcgaagtcagttcgctgcgcgaagagatctccgcggtgctggcggtggcacagccgggtgatgaagtgctgctgcggctggaaagtcccggtggcgtggtgcacggctatggcctggccgcgtcgcagctacaacgtctgcgtgatgcggggctgcagctgacggcggtagtggataaagttgccgccagcggtggctacatgatggcctgtgtcgcggatcgcatcgtggcggcgccgttctccatcattggttctatcggcgtggtggcgcaaatccccaactttaaccgtctgctgaagcgcaacgatattgatgtggagctgcacactgccggccagtacaagcgtacgctgacgctgtttggtgagaataccgaggaagggcgggagaagtttcaggaagacctgaatgaaacccatcagctgtttaaagattttgtgcatcagatgcgtccggcgctggatctggacaaagtggcgacgggcgaacactggtatggccgtcaggcgctggatctggggctaattgatgagattggtaccagcgatgcgctgatcattgcgcgtatggaccgttttagcgtgctgggcgtgcacttcgcgcgtaagaaaaagatgattgatcgcgtgacccacagtgcgagcgtggcagccgagcggctgattctgaaaatctggcagcgcggtgataaaccgctgttgtga

SEQ ID NO: 95746 - DNA, 498 bp, Glycine max
  Peptide Sequence Number=SeqID_212524
atggtgtttaccggcaacggcaaaggtaaaaccaccgccgcttttggcaccgcgctgcgcgcctgtggccacggtaaaaacgtggctgccgtgcagtttattaagggcgaatggcccaacggcgaacgtaatctgctggcgcagcacggcgtggagtttcaggtgatggccaccggctttacctgggagacgcaaaaccgtgccagcgatacggccgcctgccagcaggtgtggcaacacgccagacgcatgctgcaagacgcgtcgctggatctggtgatccttgatgaaatcacctacatggtgagtatggattatctcgatctggatgagctgatcgctgcactgcagcagcgtccgccgcagcaaagtgtgatcattaccgggcgcggctgtcaccggacgctactggaactggcggataccgtcagcgagatgcgtccggtcaaacacgcgttcgatgccggaattcaggcacagcagggaatcgactggtaa

SEQ ID NO: 95747 - DNA, 189 bp, Glycine max
  Peptide Sequence Number=SeqID_212525
atggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 95748 - DNA, 171 bp, Glycine max
  Peptide Sequence Number=SeqID_212526
atggacattctcatcctaggtcaaggttttatgcggtttgggggtaaaggggatgtcccacattatttccatgatacacatgcaacaatgatgattaggaaattttatgcaaaactggtcatgtatgcacctatgtggacactcaaacatcaagtttttacggtcatgtga

SEQ ID NO: 95749 - DNA, 993 bp, Glycine max
  Peptide Sequence Number=SeqID_212527
atgccattagatattatactctcccatgatcataatcaaatagtggccctgttggactctcgcatggttgggcttgttcaactattgctaaaatctaatgcatcaaacagcttgatagaagattatgcagcctgccttgagttacggtcagaagagcttcagaatcttgaaaataacaatgatgatccaggcattcttattatgcaacttctaattgacaatatcagccggccagcccctaatatcactcatttactgcttaaatttgatctagacacacctattgagcggacagttttacagcctaaattttattacagttgcatgaaggttattcttgatatcctggaaaagcttttgaagcctggtgtaaatgcattacttcatgaatttggttttcagctgctttatgaattgtgtgtagatccactaacaagtggaccaacaatggatctgttgtcaaataaaaagtacctattctttgttaagcaccttgatacaattggtattgccccacttcctaaacgaaatagcaaccagtcacttcgaaacagttcccttcatcagagagcatggcttttgaaacttttagcggttgaactacatgctggtgatgttaggagctccaatcatagagaagcatgtcagacaatcctttcttatctttttgcccatggtcttaatgacattggtgggggccaggccatgcctccatttttgcttcatgatacttctgaaaatgctgctataagaactgtcagcaagagtaaggagggtattgtagatgagtatggtagagtttggaatgctactcatatccctcccatagctcacaatcaatatatgggccaatttcttggggcacagaaggaagaaatcagggaattgattacttctggaactttcgcagttcaatcaaatcagtcacagcaaggaggagggaacaaagcccctaaacctggggatatttccgagaaggaacaaagcccctaa

SEQ ID NO: 95750 - DNA, 855 bp, Glycine max
  Peptide Sequence Number=SeqID_212528
atggggaatggtggcaaagcaagggcaatttcctctgcaatttcagcaatatcagcctcaacaccaagcacaaaactgcccagtgatatgattaccaactcaagaatactaggtccatgtcctacaactaacagctcttgcttaccagattcaagagcaccgtatcatgtaacagctatcagaacaatattcgccaactttgctcttttgaaggtccagaccaaatttacattggtaatggacaaggcaactaaagaggttcttcttcgaggcatagtggatcatgatggcttataccagtttccaagcctccacttgcagcctcagtccaagctgttttttccagcacattgtttagtctctaattctagtttccaaacacctgttataactaattctaatgttcaaaaaaagagaatgagaggagagcgaaacagtagagagagagactgcaggtgggagagagttaggaatagatgggagaggagagagaagggtcctcgtctgatcattgatcggaaaaggaatgaagattatcacagctaccagagagttaattggcgagaacataaggacgtaacttcgttttatttctctagattccctgaagagacaacagaaaaagacctttggaggcatttcaagcaggtggaaaagaagctagacagcatggtttttggggggttaaaaatgtttgtaaacactactaaatttgggagaccaaaacgtgaaaattcacaaacagctgccaggggaagaaatgagggtaaacatcatccagaggggtctagagatacgtacctgagaatgatgccagaaacaaaggtgaacaagggtcgtatgcggaggcagtga

SEQ ID NO: 95751 - DNA, 669 bp, Glycine max
  Peptide Sequence Number=SeqID_212529
atgtgcttggctgcttttaaggcttttgcttgcgtcatgacctttagttttgtcataagttatcagaaagaaccagagctcttgtcgggcaatgatgtgttgtggacgtttgtaaattttgctggagaggaccatacgaatttccaaacgcttgtggcgttcttgaatatgctgagcaccttggcttgtagtcaagaaggtgcttcaaaggtttacgagttgctgcaaggtaaagcattccgttcaattggatggagcactttatttgaatgcttaacaatttatgatgagaaattcaaacagtctcttcaaactgcgggagcaatgctgcctgaaattcaggagggggatgccaaagcccttgtggcatacttgaatattctaaagaaggttgtagaaaatgggaacccaacagaaaggaaaacctggtttcctgatattgaaccattgttcaaacttcttagttacgaaaatgtacccccttatcttaagggtgctctaaggaatgcaatagccacatttattaaggtctctccagtgctgaaggatagcatctggacctatcttgagcaatatgatctgccagtggttgttgggcttgatatcccaaacagtccacaatctatgggtactcaggttggtaaagaaccaactcttctagaagcttag

SEQ ID NO: 95752 - DNA, 570 bp, Glycine max
  Peptide Sequence Number=SeqID_212530
atgcaatttgaactgaacgagattgaagcaaggagagaacaatatccttcaactatatctttccttaatttgataaatgctctaattgcagaagaaagagatttgtctgatagagggcgaaggttcatctatgatcatgtttttgggccatttcctcagagagcctatgcggatccctgtgaaaaatggcagttagttggtgcatgccttaaacattttcacatggtattaagcatgtacgacatcaaggatgaggactacgagggtgtagttgatcagtcacgactttcagcaactaaagaatcatcaccacttcagacacagctcccagttttagagttgctgaaagatttcatgagtggaaagactgccttccggaacataatgagtattcttctgccaggggtgaattctgttattgctgaacgcagtagtcaattatatgggcaacttttagagaatgcagtgcagctttctctggaaattataatccttgtccttgacaaagatttacttctttctgattattggcgtcctctataccagtgtgttgctgataaaaaaatgtga

SEQ ID NO: 95753 - DNA, 486 bp, Glycine max
  Peptide Sequence Number=SeqID_212531
atgactactgggaatgatccacatgttgagggctttgttggtggcataaggcttgcttgggtggtacatttgatgttaatacaagatggtgttccagctagagagactatttcaagtggttcatcaaatgaactgggttatcttagtcaatgcttggaagccattttctcaaataatgtttttcagtttttacttgataaagttcttcgtactgcttccttccagactgaagacgaagatatgatctacatgtacaatgcttatctgcacaagctgattacgtgcttcttgtctaaccctcttgcaagagacaagataaaagaatccaaggagcggattatgagtgtgcttagtccataccgagttgtgggatcacatgattttgcacaggacagtaattcaagttctctacatggcactgagatgggccctttaccatttaattcaatcttggactttgtgagcgaaatttatcagcaaagataa

SEQ ID NO: 95754 - DNA, 684 bp, Glycine max
  Peptide Sequence Number=SeqID_212532
atggcagaatctcctcctcctccttccgctactcctttcccttcatctttagcgttctcgtactcaatttctgagaagctcattgattcgaacttcttgttctggaagcaacaagtagaaccagtgatcaaagcgcatcaactacatcattacttggtgtgtccaaatattcctcttcgatatgcaaatgaaaccgatcagaactctggcactatgaatcatgaaaagattcatgatcactttcataagctaactcaagcaagagctcgtcaacttcgtgcagaattgcggaccactactcttgatagcaaacatgtttcagaattcctcttgcgcatcaaagcccgagctgatgcgctagcttctgtcggagatccaattacaccagagcaacatgttgatgtcatccttgaaggtttgccttttgactacaattttgtgatttccgttattgagagcaaatctcaaccaatgcaaattgaggaagtggaagctcttcttgcgcatgagatgcaattggaaaaatcacagaagaagcttgcctctaaaactgcttcactcaatctaatggaaattgcctccttgaaggtgcaacagcagcagtcatcttctgttcaagcaaatgttgcgtctgaaaatgctaattcaaactacaactcatattctgggtatcgcagctattga

SEQ ID NO: 95755 - DNA, 246 bp, Glycine max
  Peptide Sequence Number=SeqID_212533
gaagtattagaagaaaggacagatgctttatcaggcactgtactcaaaccatcagaaacaaaagcaatcacaagagcaaagagaagacaaaagagaataagagaggcaaaaccagagaagaatatgctcataatcaacaacagaggtaaggcacaaggcaagcaggaaaaagacaagaagaaccccagagcaccacctatggcagaagaagaaagtaaaagcttcaagagtgtgagacgcagatga

SEQ ID NO: 95756 - DNA, 525 bp, Glycine max
  Peptide Sequence Number=SeqID_212534
atgaaagttagactacaacgactcttcaagcatgagctgaaggctttgaaatggaagaaggatcataccagccaagattggtattctttaaaagagcatcatgaagtggggcgtcactatgagactctaaaccatacctttttcattgctgaaactcctttcaacagagtctgcccttggaagagagattttgctattgagtctgactgtaacttctctttcatggttcaattgccccattctagattcgcctttactcacctagtgcaaccaattattgaagaggtgaattataatgcagaagttgatgctaatttaaatactctagcagttaaggtttatgatcctccaccatctggggagtatgttcgctgtgtagaagaggcctttctcataacaagggaagctcttggtagccttgatttccatgctccaattaacttatcatctggtgatgaatttggtgatgagttcttgaggaagtttgatgaagaagttgccaaacaaaagggggagaagatgtaa

SEQ ID NO: 95757 - DNA, 818 bp, Glycine max
  Peptide Sequence Number=SeqID_212535
atggtgtctccgaagcagctcctgggcaccatcgaatctgcgcttctcggcacttcgcctccgatggcggcgcaccgcgtcgaactcttgcacgctctccgcacttctcgaacctccttgcagtcccttctctcgtatccccccccaaagccctctgatcgaagtcaagttcagtcaaagtcagtcagacttcctgattctcctcctatttcacttgatgaccaggatgttcacattgcgctcaaattgagtgacgatctccatctcaatgaagtagattgtgttcgtttgcttgtatcagctaataaagaggctgtggtgctagatcagggactgcaagatgatatattggtagacattcaaaagtatttggaagatcttatcagttctggacttagacagcggttgatttctcttatcaaggaactcaatagagaagagccttctggtttgggtggtcctcagtgtgagagttatgttcttgattcaagaggctctcttgtggagaggcaggcagtggtctctagagaaagacttattctggggcattgtcttgtgctttcgattctggatagtgcttctgaagttagtgagagcaatgccactgtaaaacatcaggattctatgattttccaaccaaatcgtgtgcaaaatcggttgtggtattgttttgctgcaagtctctcatactctcaatctctcttgcttgcttcgtctctggctctctgccatgatatgatggggtctgcttcttctcatctgcgtctcacactcttgaagcttttactttcttcttctgccataggtggtgctctggg

SEQ ID NO: 95758 - DNA, 435 bp, Glycine max
  Peptide Sequence Number=SeqID_212536
atggcgcctaccaggcaccctctggacccagataagtccaacagggccctggggtttccggcgctgatcacgggcctctgtcagtcctacggagttcccgtcacccccagtaaatactgcacgcctaggcaagcacagggtgatgcacatcaggccgcagacgcaccgccaccacctcggcaggccgatccagctaggtcactgggcgtggagcgttatctacagcatttggttcgccagcaggcagccaaccaccatggcaggtgcagatacatgagtgtctctaccggttcagcctcagtcagcaggggcagggttttgccccttttgcatgccctactccggagcagtttggggctgaggtcgcatggcctggagactggcccgatgcccaggcagggagcggataagagccacgtgtggatgaggatatga

SEQ ID NO: 95759 - DNA, 237 bp, Glycine max
  Peptide Sequence Number=SeqID_212537
atgttgaagctcatcaatcaaaggatgcaaatacacatctatccatgctttcagggctcgcttagcaagctagattggctaagcgaggcttatccgcttagcgaggaagcttgctcgctaagcgagaacaaaaccctagagaatgttgagccagagagcagcatgcttggcgcgcagccagcccgtctagcgaggacattatcttttcttgcgcttagcgcatccaagccctcttag

SEQ ID NO: 95760 - DNA, 219 bp, Glycine max
  Peptide Sequence Number=SeqID_212538
atgcaagattgcgctcatgaggaactccttgcagacgttggggagcgcagggatgcagtggtacattgtgaattagacttcgctgacaaagtggaggtcatggaaaaggaagagataaagatgagggaggaggaagatgaaggggaaaaagcttacactttgaggtggtttttagtcatcactatcttagttacattaatggcgctaaggttgtactga

SEQ ID NO: 95761 - DNA, 339 bp, Glycine max
  Peptide Sequence Number=SeqID_212539
atggagctctacggatctacattgtggggctcatcgacatggccgttggtattgatctacgtcattgcaatgggtgcacttcaatcaattttgtttcctttgggtcataaattttctctggctccccatccaaccattctccagcgcaaagcagagggagcaaagagagaagaagaagaagtggaagaaaggattttggggaggattcaacttagttgggttccttgccctcttactaatcgcaactccaattcattaaaaaagttcaagaccaacaacaacgacaacaacaacaacaacaacaacaacaacaataataataataaaattaagacatag

SEQ ID NO: 95762 - DNA, 471 bp, Glycine max
  Peptide Sequence Number=SeqID_212540
atggcagaatatagtgggtatccgcaacaagcgcttcaggatgtcgtcctcaaggttcttcacaaagcagacatttccatcaccgaagtggtaaactttggtcgggtgcaatgtctgaatgaaatccctttgctgggaagtaggcacatgcgtagagttggaagggctggctcccttgggatccatgctggaaattgctgcaggcagagtgagcttggatgccttctcaaatggctgagtagttctggtggtaccattagagccattatagcattaggggtagttcaacatattcagaagatggagtatgaacatactcgtactacatccattgagggtctccagtttcttctccatgtggatccaagcattgaaaacttggatgtgttgattggaaacagaggtttcttggtctacattagtggtggaatgaatggctacggagtgggagctggtattgcctcattataa

SEQ ID NO: 95763 - DNA, 366 bp, Glycine max
  Peptide Sequence Number=SeqID_212541
atggttaaggaggagtgtaaggaggtaagtgtctcctccaagaggttagctaagaaggaaagtcattttacaataaagacaaacattaaagaaacttcccttcttagacaacctccacatcttctcctttgtaaaaggacacttgttagcactgtcatacctcttgagcttgaggttattcctcaagtaaaggagtttttggatgaaggagtaatcaacatgaaaatacagaaaaagtggcgtctcaaatcacctttcctccttctccattctgtttccattgatcttcaagaagcaaaggactccattggtgaagaagattcaaggtctacaagctctacatggagctacatcatgatgaattga

SEQ ID NO: 95764 - DNA, 438 bp, Glycine max
  Peptide Sequence Number=SeqID_212542
atggttgagataactccagtcacaattgttatggaaccaagacctaaggcgaatgacgctccaactgaatcaacctcatatgaagccacctgtaaagattcaactgcagtcatcatccacactaccagctctggacctaatccaatcaactttgctccttcaaatgtactgacaaaaattgaagtgaaggagatgattggactggctatggataactttgttgaaaagcagaaggttgggaatgaagagttcagacgcaccatgcaacaagcaattgctactcaattcagtagtctcagtgaatctctcattttgaacctagaacaagcccaaatgcgtctgttcagtgttgttgttgtacctatgtcgcttccgcctacccaagctctaccaccagcaagtgttccacccacccttccaacccttaattcgaactag

SEQ ID NO: 95765 - DNA, 342 bp, Glycine max
  Peptide Sequence Number=SeqID_212543
atggctgatgaagaagtggaagcaatactttccaagattattttgatgatgccaaagactcaagtcaagaatcaagagtcaagcaaggtacatcctttgtggtacaagtggagtttacatcctttgggttataatactgagaacaagagagggattttacaaggttattggaaatctcaagaaccgatggttgcttggggactggatgtaggcacaggcaaggttcagaccaagaagcaagcccaacaagaagaagaagaagaagaagaagaagaaattgtgtccaaggagcaatggaccaagaaaagacataaggagtctaaaccttttcatccaatctag

SEQ ID NO: 95766 - DNA, 381 bp, Glycine max
  Peptide Sequence Number=SeqID_212544
atggctctcataggttttctcccagttttcttggtacatgctttcttccctaatgcacccaatgacttgtgtgatggagtccatggacaacactgcctcttttctgagaactttggacacaatggtcttccagtccttcatttgaacattcctccagaacattctgataagttatcggtatatcatttgaggattgatgaagtaactacagattctgcaaagaagcaaagtacgttgtatgttgaggctaagaccttccagcatgatgatgccaaagtagtgtttaacgtgagcagttggttctccatcactatgaatggtggtggtgtcagtggtgataatggtggaggtaggagtttgacatgtggatatcactattga

SEQ ID NO: 95767 - DNA, 264 bp, Glycine max
  Peptide Sequence Number=SeqID_212545
atggagagacaacttgagaggaaacattcctacaagaagacctatcactatgactcttctaatggtaaggtcaagtccaagaaggagggatcttccccacctaagcaacaaagttcaaagtctcaaagtcataaacatgatcctaaccctagcacttcttctacatctaggagtagttcaattaaatgcttgggtaaaggtcatatttctcgcaacctatctcacgacaggacgacgaaggaaaataaaataggcgccttctaa

SEQ ID NO: 95768 - DNA, 450 bp, Glycine max
  Peptide Sequence Number=SeqID_212546
atgaaagtaggtggacagaggattaggaagggcggtgaaagggagatacatcccaaaaatcataaagagggaagaggttgggtagcttcaccatctattgttcatgcagggggtttgttatgtatgtgggatgttaattgttttcaccttagtagtgagtttagagggagtgggtacctacgggtggaaggaagtttacttggtaccaaccaaatggaagagcaagaagcaaacttgataaaatgttggcatcaagagagtggtacaacttgtggtcgggatgcacacaatatattcttgataggaatgtctcagatcattgaccaattctcatcaagaatagtattatggactggggacctaaacccttcaaggttcttaattgttgcttcatggatagcaatttctcaaaaaaatttgaagaagcttggaaaaatattagatgtctag

SEQ ID NO: 95769 - DNA, 535 bp, Glycine max
  Peptide Sequence Number=SeqID_212547
atggataatatggatcaaaggatgtttggtgagttgcaaagttttggtcttggtaaacggaagcccaacaaagagttcttggtggctaaaggattaagacaaggaaaccctctagctcctttcttatttaatgtgattgcgaagggcttaagtgggatgatgagagaagcgattaaaaggggactttttaaaagtttctttgtaggtaacaagaaagtggaggtagatgctgaaagatttcaaagagagttgagggatatacatttacaaaaagccatttggactcacggaggtggctacatgatcaatccggcaagaaacaacattgtcttcaggggaggtctcttcgataaggagaagatcatgcaagaagttgtctttcatatgtggacatggttgaagaatttagactcatcgtttggttattcttatgaccaatgttatgtatgtcctgaatggtacccttataccaaatacatggtacagaggttgtattattgggtgagtacagagggaggaattgagactgctacag

SEQ ID NO: 95770 - DNA, 351 bp, Glycine max
  Peptide Sequence Number=SeqID_212548
atgaagatcttgaagaggaagaagctaggaaaaagagagaactacaaggggacttttggaaagagaaagaagaatggcttaaagggcttaaatatagagggggagtgggttgaagatccctgtagattgaaggtggaagttgagaattttttccaacttagatttaaagtagagaaggatagatcaaaattggatggggtgaaattaaatagaatatctagagaggattaccaaatgttacttgtagagtttgaagaaaaggaggttaaagaggaaatatgggagtgtggtgattcaaagagcctaggcccagatgaatatactttcaagttcatcaagaatttctggtag

SEQ ID NO: 95771 - DNA, 282 bp, Glycine max
  Peptide Sequence Number=SeqID_212549
atggcacaccctctgagttttgctcctatttgttccttcaaatcctcgtccacaccaggggcacttacagttaccggtaattcagttgtttcggcttttattaggataaacgaagcatgtcacgattctaaagctcgaaactttcaatctttgaaggttaaggctgcggatgataatccaagcaccaaaacaaagagtattgtttgttctgattgtgagggaaatggtagtgaaggcaatgtcttaaaattctattcacctgataacttactgcttaagtag

SEQ ID NO: 95772 - DNA, 1224 bp, Glycine max
  Peptide Sequence Number=SeqID_212550
atgtcgctatatactgttgcagttggtgggaccagtattgttaccaagaaaagggtattagaattgcttgaaatcattcagtttagatgtccagattccactactcagctctcaaatattgtggctggtatgaaatatgacttgccggcagaagacatacttggaaatccgggaaattccggaaagggtggtgtgtactattattccgagagaggtgatcggctaattgaccttgcttctttccatgacaaactttggcagaaatataattcagcatatgcccaggcaagtaaccttggcagtgaagttgaacttaataatgttcgtgagacaattcaacagttgctgagatggggttggaaatacaataaaaatcttgaggaacaagctgcacaacttcatatgttgactgcttggtctcagattgttgaggtgtctgcttctagaagattaacaatgcttgaagatcgatctgaaattctttttcaggtccttgatgtgtctcttagtgcatctgcttctcctgactgttcattgaggatggcattcatactatcacaggtagcattgacatgcatggctaagctgcgagatgaaagatttttgttccctggcagtctgagttctgataacatcacatgccttgatctcattgtggtgaagcaattatcaaatggtgcttgtctgaccatattgtttaagcttatcatggcaattcttagaaatgaatcttcagaagctcttaggagacggtatgttacacattcagaactcagacgtcaatatgctctacttcttagctatttccagtattgccaaaatgtggttgatcctgatgttccaaccaccgttcttcaattcttgctgctcagtgaacaagataatgaatatattgatctcccaaagattaaatcttcattgcatttacttctccattttgcccagattgacaaagaacaagcagaactggctcgtgcaaacttttcaactttgaggaaagaagctcagagcattttgaatctggtcgtaaaagatgcaacccatggtagtgaacctggaaagacaatatcactttatgttcttgatgcattgattaatatagatcatgagcgctttttcttgagccaacttcaaagcaggggttttttaaggtcttgctttacagccataagcaatgtttgcaatcagtcatggactgttcattccattgcacaagggatctaa

SEQ ID NO: 95773 - DNA, 570 bp, Glycine max
  Peptide Sequence Number=SeqID_212551
atgggacctgagcctgacattgaaagtatgggattttgtctttcactggactcattgcagagggcatgcacttttgaggctgaacttgctttactactaagaatcagtcacaagtatggaaaatccggagcacagattttattttccatgggcatattggagcatcttgcatctggcagagcaatcaatttacagggaagtttaaggtgggttgagacaagacttagaagagatatggctgtggatgttgatagacaacggatgattattactccagtcttgagattagtgttttcactaacttccttggttgatacatctgactttttggaggttaagaataaaattgtccgtgaagtaatcgattttatcaaagggcatcaatcactgtttgatcaagttctccgtttagacattgccgaggcagatgaactaagaacagagcaggtcaatttagttgttggtattcttagcaagatgtgggatctagctgacttaatagattcagagaaaagggagagagagagagagaacgaaagtgagattgtattgataaaatcaacccaatga

SEQ ID NO: 95774 - DNA, 669 bp, Glycine max
  Peptide Sequence Number=SeqID_212552
atggcttccacttcatctcttcctcctccaccaccgttgtctccggcagtgacaccttctccaattacattatttggtataatgaagttcagctggtcatcaaaggagtatctaaactgggaaaaccagattctaaactatcgttcttcctcgtcttgttggatgcaacactttatggcagctctgggagaaactccatgcgcatttttactctattgctcgcacgaagaaaaggcagctttgatcattgattatcttctccacattcagacgcttgttgattcgctcacttccattggtgattctgtttcgcagagtgagcacgtgaatattattcttgagggacatccaacgaagtatgaatcaacgatagccttcatttacaataagtctaaactgatgcctattgtcagttacattaactccggtaattacaacaattttggccgtggtggtggtggctggaataacttctaccacggtggccacgagggaggttgtggccgtggggcacatggtggtggaaacactgatgagaatcctgaaactagccaaatacaggctaaaggcccaagtggagaaggacaaagcccccgagtggagaaggatgaaggcccaaaggcaaagacactatcaagactattaattgttgctgaaggcccagattaa

SEQ ID NO: 95775 - DNA, 717 bp, Glycine max
  Peptide Sequence Number=SeqID_212553
atggtgacatacttccaagtttggccatatgaagagagcaatgagtacggttttgttcaagggctttttggtctgatgcatgctcttttctcacgtgattcaaagattcctagttttgctcaatcaagagtatcacctgagccttcagatgcctcttccagttacgctgcttctgttgaacttcaacaacccacattgagcttgcttaattctcttcttttttctgtcacaactgcttttgaaagggcagctgaggagaaatccttgttactgaataagattcgagacataaatgaactgtcaaggcaggaagttgatgaaatcatcaatatgtgtgtccggcaagactctgtttcatcttcagataacatacataaaaggaggtacattgcaatggtagaaatgtgtcgagttgttgctagtagggatcagctaatcattttattactgccactctctgaacatgtgctaaatatcatccttatccatcttcaagagagctctgttgcactcgattctaccttgagtacaaaaacaattgcatatggtgccaaatatgatgcacaacaggacgttgctatgttatatggaaagttagttccaacccttgagcgacttgagttgctgagtgaggagaaagtagggcacaatctcaaagtattccgcagattagcaacttctgccaaagatcttgcaattcaaaaattgattgtgtag

SEQ ID NO: 95776 - DNA, 321 bp, Glycine max
  Peptide Sequence Number=SeqID_212554
atgggtggtggaagaagtgtttggttgaatcaagaagtggatggttggggggtttatgttctaaaagataagttaaagggtgttaatgtcaaaaaaaaattcactatcaaaacaatcttgaggatgttggaattagctttcaagttgaaagtaaatttcttcaagagttgtttttgggctctcgatgttggtggggagtaccttggtattgggatcaatcctaggagggtggagatgttgaaacccaatatcaataagttttttaggaaattggctctttggaagcataagaatgtgctttttgggataggatttgcttga

SEQ ID NO: 95777 - DNA, 381 bp, Glycine max
  Peptide Sequence Number=SeqID_212555
atggcctccatcatcgtggccatttgctctttcatggcctccatgtcggccttcatcttctcttgtacctcctctacttcacccattattctagctctagcacaggtgaagctggaagtaacaaggatatcaacaatcctaaacgtgtttggcagtagacgaagcaatgatatggttacttacttacttcaacttgactcgatgaaccttttcgtaaaagcacgagcttggttcaaccccgtaacccagggaatggcaattttgatcgccaatacttcaacaacatttcatagggatgaaagactcaggaatacgcatgctatgcatggaaaatgtaattatgagattgagatgcccgaagagacatcctttcttagttaa

SEQ ID NO: 95778 - DNA, 295 bp, Glycine max
  Peptide Sequence Number=SeqID_212556
atgtctcttgcaactctttttgggaagcttcagaaacacaaaatggaacttctaaaactaaaccaacatgaagaaaatgacaagaaaaagaaaggaattgcacttaaggccttatcttctattcaagaagaaagtgacaaagaggacttgaatgaaacagaagaagatgatgattttagtttcttcgtaaagagcttcaataagtttctaaggagcaaaggaaatcaaagaagaacaaactttaatccaaagaaaaaaggagaagattcatcttatgttccacagtgctatgaat

SEQ ID NO: 95779 - DNA, 849 bp, Glycine max
  Peptide Sequence Number=SeqID_212557
atgaagcaggcgatttacgatccggaaaaccgcggccacttcggcctggcgctggcgtcttacggccacttcacctcgccaatccgtcgttatccggatctggcgctgcatcgcgcgatcaaatatcagctggccaaagagcacggcgagccgaaagagcgctggacgccgaccggcggctggcacagcgaattcgaagagatgctgcagctgggcgaacactgctcgatgaccgaacgccgcgcggacgaagcgacgcgtaacgtcgccgactggctgaagtgcgatttcatgcaggatcacgtcggtgaagtgttcagcggcatcatctccagcgtgaccggcttcggtttcttcgtgcgcctgaacgatctgttcatcgacgggctggtgcacgtatcaacgctggataatgattactatcgctacgataatatcggccagcgcctgatcggcgaatcttccggcaccgtctatcgcctgggggatacggtggagatccgcgtggacgcggtgcatatggacgagcgcaagattgacttcgcgctggtgtccagcacccgcaaagcgcgcggtgaaggtaaaaccgagcgcgatcgcgccaagaagggcggccagcgcacgctgcgcgacaacggcaacgcggggcgcggcaagcgccgcggcggcaaaccgccggccaacttcgagccggacagcgccttccgcaagcaggatgacgccaagcccgcggacaacgtgaagaaggcgaaaaagaaagccaagaaagcgtccgacaaaacgcggaaaatcgcggcggcgaccaaagccaaacgcgcagccaagaagaaaggtgccgagcaggcttaa

SEQ ID NO: 95780 - DNA, 165 bp, Glycine max
  Peptide Sequence Number=SeqID_212558
atggccatctttaaggcgctccttgcttcaatcctcatttctctggtcattgtgaatctggtggaatcagatacaatggtaatcaagaacacggtagagggatcaagtcctagcccttccccgccaacgatcggtagaaattcctttagtaaaccttctagttaa

SEQ ID NO: 95781 - DNA, 222 bp, Glycine max
  Peptide Sequence Number=SeqID_212559
tgtaatagacaaaaaggaagtactgagtgcggctattatgtcatgcactggatgtccaccatcattttaggaacttttaggaataactgggaagcgtattttaacgatcctagaccattggagccaaagagattaaaggcgttgcggattcagtgggtacagttttatctccaatgtccacagcctaaatcaaaggctcctgctaggtggattgtcgtcaag

SEQ ID NO: 95782 - DNA, 1458 bp, Glycine max
  Peptide Sequence Number=SeqID_212560
atgcatgagctggaagcaatagaggaatatggcaacctgggaaagggagatcgaagaaggaagatggaggtacaagaaaagctatggtgggtgatcaggtgtagtgacttgctcaccaaacaaaaggcaaaagtaagatggctagtggaggatgataaaaactctaaatatttttactcctctcttaagtggcgtagaagaaatggaacgttaaagggacttttaatgggtggtgtatgggtggctgagcccggacgggttaaacaagaggtacaaaattttattgagaacaagttctgtgaaattgaatttggtagacctaaattagatgaagtgcaattcaagaaactttcctcacttgagaattctggattatcaactcagtttttgaaagaggtcaaaaaggcaatttgggattatgaagatcttaaatctccaggacctgatggatacaactttcgtttcattaaagcattctggcgactaatgagaaatgacgtgatgagatttttgggggagtttcacgccaatgttgtccttcctaaaggtgggaattcctctttcatatcgcttattcctaagattacgacaaaggtactttcaaacagactgaaacttgtccttagatcggtaattgatgagaggcaatcagctttcctagggggcttacgattaggccaattaggacttcctgcgctacatgatgaagagattaggattgatggttgcttgcaaagtagcagaatctttgttcttgttaatggaaacctgcctaaagaattttcggtatccaaagggttgagacaaggggatcctcttgccccgtttttatttaatatcgctgctgagggtcttataggaataatgagggaagccataagtaaaaactttattccagcttcttggtgggtgagaaaaaggtgtcaatcaatctcctacagtatgcggatgacactgtcttcatcggggaagcatcgttacaacgtgttatctctatcgagagcatgttatcctgttttgaattggtttctggccttaaaattaacttcaacaaaagcggctttggcactattagggtttatgagtggaggtgggaacttatggaggaaaagaaaagtctcaagtgaaattttagaatctaaatttgggggttgtttagtcagagaggagctggagataagtggtttgaatccatggttgtgcgaaaagttggtcatggggacaaaactctttcttggagatacttgggtggggaatgaacctcttgcttttaaatacccacggctatatgcgacttcttgtcaaagggagaaaaaagtgtgtgagatgggagtgtggtcttggaacttagagtggcgtatactaaatttcttatgggagcaggaacaattgaatcagttactatatgatgtgaacaattacaatttgagacaatcccaaggggactcctggatctag

SEQ ID NO: 95783 - DNA, 189 bp, Glycine max
  Peptide Sequence Number=SeqID_212561
atgaaacctaaggtggcggtaagattggttcatatgggagagggatttcgtggtgcaagcggaaggtatggaagtttattcatggctggatcttcaggtgcctctgccgaccctattcaacactacttgcaacacgatttttgcaagcagtttgcgagcgtagatggcagacctaggaccctaagttag

SEQ ID NO: 95784 - DNA, 382 bp, Glycine max
  Peptide Sequence Number=SeqID_212562
ggtacatcctttgtggtacaagtatagggtacatctacttgggttgttgactgagagcaagagagggtacatctcttgtggatcagttctagtggagggtacatccactaggttgttcaaagagaacaagggagggatagtttggaacattggtaaagttggaccttttaatcgtggatatggtaaatctgagctatgcaaggatgttagtgaaggtggcttcgccactacatgtaacgacgaggatggtttcagtactatgttaggaggcaacataatatccttagattctgaaaacgagtctcaaagcattggcggtgtcttaagccaacggggagatgtatggagaccatgggatcagagggaagagtcattgaggtag

SEQ ID NO: 95785 - DNA, 309 bp, Glycine max
  Peptide Sequence Number=SeqID_212563
atggggaggtgtccaagcagctttaacacaacaatcatggttccatttttggcagcaccaaggtttatttgcggtggcaagcaagaaaaaaggtgggcaactgtatggctcttcccggcttggtctatttggaatcaccgtaatggtgtaattcaaaaaggctcaaccatgtctacaggtggttatggactcgtttctagtatcctcatggtcttgtttaaaggccaaatctacaacattctctgcttctttcttggcatggagtactcaaccatgactatgcttctaatcaagttcgctcctatgtaa

SEQ ID NO: 95786 - DNA, 363 bp, Glycine max
  Peptide Sequence Number=SeqID_212564
atggagttgaatattcaaaggagtaatttggacagactcaataactgttgggtaggacacctaatagatctctctttagttgatagattagaagatgtatatgtcaatgagaatgccaaaaagataaagtttaactatttgggggatgacatggtgttgatcttagggtgcacgaaagaatggtttaatgaaagcactaaaagttgtcatcataaaaaagggggagattgtagaagcaaacttcatgatgaatcaagattgattcaaagaagttttgatgataacaaagatgatgacaaaaagctcaaaagtcaagaacacttcatgataacaaagatgatgatctcaagaatcaaagaatga

SEQ ID NO: 95787 - DNA, 1158 bp, Glycine max
  Peptide Sequence Number=SeqID_212565
atggcaagttcaagagaaggttatcaagcaaagcaagagggtgacacaaccactaatattgacaagttctccaaggcatcttctactacttcaagacaatggtcagcgttcagaaatccaagaattgtgagagtgtctcgttcttttggagggaaagataggcatagcaaggtttgcaccataagagggttgagggacagaaggattaggctctcggttcccacagctattcagctatatgatcttcaagacaagcttggactaagccaaccaagcaaagtgatagattggttgcttgaagccactaaatttgacattgacaagctccctccactccaattccctcagggttttggtcaatttcatcatcatccacaaaccctattcccttttcatgaatcaagtgctgcctctcatcagctgtctcttggacccttcagtgatgctagctccacttttgtgagggatggagggattcaaaacctcatggcaaagtcaaggtattgggagaacataaactcaatgtcaagattaagaggcaataaggaagctgaaaagggcaagtggatcaaaacaagtgaagaagagaatcatgatcaagatggtgttgttggaggttacaacaacttgcaagtttctactcaaaggcttttcccaatgggtagtagtactactactactactcactcccttttacctggtttgttaaacaattccatgccatataacgcctacagttctgagccttctagtttatctttatcccaatttggaagccatggattgttcccttctcaacaagtagatcctaatccaagcagtggcaacaatggtgtgcaattccaatcttctttgtcattaccttcatcgggctctcaattattgtttggctcatcttctgctacaccatcaatgttcaccacctatgctccatttattgcaccctcagtggaccctgatccaagacagttcaaccacattcatcagttcttgaactcaggctctcaaatcttgcctcctcatcctctcataccatctcttcatcacccattcaattcacagatcagacccttcccagcagcactctttagttcaaagcttttggattcagacagcagcaaccatagccaacaagatcataagggtagcacttcttga

SEQ ID NO: 95788 - DNA, 444 bp, Glycine max
  Peptide Sequence Number=SeqID_212566
atggttgtacaaggcagaaaattttctatgactgactatagtgatggtgcagcatttgatgtgactggcatgccacctgtcaatcaagaaatgcccatcatctcaggcatcgatcaggataatgttagaatgacgacacccccaccctctcctacagagcccgatattccttttgatggtatgtctaggaagagtagacaatccatgtggctaagaaggttgactgcacgaagcttggatcagccacgacctacagtaaacatcaatccaaccactgggagaggctcaggtcctcataaagaaaagtttcatagttatttaggagttgtagcacgagacaagattccgattgtgcactccagctggaatgatgtaccagaaacgctaaagaacatgatatggggtgacattttggcaagtcccttttgtaggtcacatcactga

SEQ ID NO: 95789 - DNA, 456 bp, Glycine max
  Peptide Sequence Number=SeqID_212567
atggagaagaacttcaaatgtaagccacttatggcattttctgtgatgacagaaaatgaagcattcaaagtacggatgaatgcccttatagccaaagctcagaagatgccagaggaaggttggacaatgcaggctggaactcgagtgtttttaggtcatattggggggctggatacagatggaaatgagctgcctagacttgtttatgtttctcgtgcccgtcttagaatccaatgcattctaggacagtcgcatagccatgaccatcgtagactgcgttgcattctaagatgggtctgtccaggcgggcatgtccacatgcccgatgtaaaattctgcgctttctacgatggtcctttccaaccgtcgttgatatggtcacaacttttcactacgtcggagacgacgacgatcgttaaccaacgtaaaatgccttcaataaccgatgttgaatga

SEQ ID NO: 95790 - DNA, 513 bp, Glycine max
  Peptide Sequence Number=SeqID_212568
atgctgttccacaaaggtgtcagtgtttcctgggaagcactgacatctttgtggaacggccgctttgagattatatctttatcaggttctttgcagcaatctgaaaataacagtgaacgcagtagaacatgcactttgaatgtaacccttgcagggtccgatggacgtgttttgggtggcggagttgctggaacgctaattgcagcatcaactgtacaggtcattgtgggcagctttattgcggatgcgaaaaagtcgagctccaatgccctgaaatctgggtcttcttctgcaccaccaccccaaatgctaacctttggttcatccatgaccccaaatagtcctacctctcaagggccttcaactgagtcctctgaggaacaggatcatagtcctttttgtagggggccagggcctgggtctggacatggactctacaataatgctagccagcccgttcataatatgcccatgtaccatcatccactatgggctggccaatctcatcagtaa

SEQ ID NO: 95791 - DNA, 231 bp, Glycine max
  Peptide Sequence Number=SeqID_212569
atgggtgtatgtgtgtgtgttgcactgacctttctagagcctacagttctagagactgagggaagaggcttgggagtggccatggatttgacaagcataggtgatgagaaagaagcagaagatttttgtgttatggcacgagaagaagagaagatgaagttgttgttgcaaatgtatgctgagacctccataaccataaaatttctttctttatcgttattgcttggttga

SEQ ID NO: 95792 - DNA, 396 bp, Glycine max
  Peptide Sequence Number=SeqID_212570
atgcagaactcaactgtgttcccacttggggaacaacctaggagcagccccgcgacagccacgcctcccataaagcttttgacaaggatggagcagctgaagctgctgagcaaagcagagaaagcagggttgctatctgcagcagagaagtttggattctccctctcaacaatagagaggcttggactcctctcaaaggcagaagagttgggtgtgctatctgctgcaactgatcctggaactccaaggacactcttgaccctcagcttggggttgctgatccttggacccttatttgtttacttcgttcctgaggacaaccttggattggtggggttgcaggttgtggttgccttgagccgaagacacgagtatgcagttatgttgaatatttga

SEQ ID NO: 95793 - DNA, 243 bp, Glycine max
  Peptide Sequence Number=SeqID_212571
atgtacctaaacaggcaagctcctggcagtcaacagataaaaggaacaaagaccacaaagcaaggaggcttgtgtggtggctggccagctgtgaatctgtgtgatatatgggatatgggctctggtaatcgattaccaagggaagctaggagggcttctggtaatcgattaccaagggggtgtaatcgattaccaggcttagaaatgaagatcgtgatggcggcgcagctaatccatgattga

SEQ ID NO: 95794 - DNA, 339 bp, Glycine max
  Peptide Sequence Number=SeqID_212572
atggattccttcgagccacagtccattcagaggtctgagcaatcgcagtttgaggctaaaagtttacataaagagttggatgtagagttcaaaacgcgatgtttaccttggagcctacctgaatggatggtggtcatcttacccaaggaacacctagttgtctggttttgttcattgcataacaggccagacaactaccttaaggggataattaacaatgctttaaaaggtcttgatgatgctccacagcctaaatcaaaggctgctgctaggtggattgtcgtcaagtattttaacgatcctagaccattggagctagagagattaaaggcactttag

SEQ ID NO: 95795 - DNA, 450 bp, Glycine max
  Peptide Sequence Number=SeqID_212573
atggtggatgcttttaggacgcatattatgcaaacgaaggagcttggtacttgcccagtgaggcagattggtggatgctctttcttttacatgaggatcagtaatgtctacattgtcattgttgtcagcaacaacgccaatgtcgcttgcgctttcaagtttgttgttgaggctgttgcattgttccgatcatactttggtggagcttttgacgaggatgcaattcgcaataattttgtactcatttatgagctcctagatgaaattatggactttggttacccacaaaatctttcaccagagatcttaaagctttatatcactcaggaaggagtgcgttccccattttcatcaaagctaccacgaagtaagggcatagatagggacatgataggagaaaacatggagatattgacattaccaaaaaaaaagagtcagaataccacatag

SEQ ID NO: 95796 - DNA, 259 bp, Glycine max
  Peptide Sequence Number=SeqID_212574
atgagagagagaaaaaaggaagaaactggattacccgacatcgtcgcgatagaggcggttgatgagaacgtcgccgcggaggttgaggaagtaaatggcggaagcggcaaccggcatctccggtccactttaccggaagatcaatcggagatagtcggagacggcggttccgccgcagatctgtggtttcgagacagagcggaggcgtcgccgccgatttggtggattggattcgttcgtacacgggaaaaggtagcgg

SEQ ID NO: 95797 - DNA, 543 bp, Glycine max
  Peptide Sequence Number=SeqID_212575
atggttttctgtgaacgtggcagcatattgatgggaatagctctgcatgttgaacaagtggcacggtacctagcgtgccttgctcttcttttgtctaggcttggtttgaaagagacagagagagagagacagacaagaagaacaaagatgcaatcttcaaaggagaagctgaaaaacatgaccagtgctgccaaggagcaagtcgacatctataaagcaaaaatagacgagaagacagagaaagcaacggcaagaacagaagaggagagggtgattacccatgaacgtgcaaaggcaaaggaagctgaagcaaagatggagctgcatgaagcaaaagccaggcatgcagcagagaagctaagcaccaaccaatcacattatggtctccaccatggccacaaccctcccctggtaggaacaactgagactcactaccagcaagggcaccaccagccacttggggcagttcctatgcctggagccatttatccatcttatccgctaggagcaaaccctaaccctccaaggaacaaacatatataa

SEQ ID NO: 95798 - DNA, 297 bp, Glycine max
  Peptide Sequence Number=SeqID_212576
atggcacttccccttcttcgaatccccggcatgccactcaccaaccaacaccaatcattcccttccaatacccgccgcaaagccacgacggcgaaggcggagctcgggacggcggtggcgcggacgggcggagccggttaccaatctccgtccgtcgacgttcccacgcataaggtcacagtccacgacagacaacgaggaatcgttcacgagttcgtcgtgcctgagggttatgcacttctttgtgtgggcttcccgacctctgatgttgaagtggaaactcaagatgaagatgag

SEQ ID NO: 95799 - DNA, 954 bp, Glycine max
  Peptide Sequence Number=SeqID_212577
cccacagatagacctgttccaaatgcaactttacaagttactggtgctgttggttggcggagagaagggcttgtgtacaaaaagaatgaggtcttcctggatattgtggaaagtgtaaatcttctaatgtcttcaaaaggttgcctgcctgctaactggtttgggaatttaggtagtgttctgcgttgtgatgtcactgggaagattctcatgaagtgctttctttctggaatgcctgatttaaagttgggtttgaatgacaagattggtcttgagaaagaagcacaacttaaatcccgtcctactaaaagtggtaaaagtatcgagcttgatgatgtcactttccatcaatgtgtaaatttgacaaggttcaactcagagaagacagttagttttgtaccacctgatggtgaatttgaactaatgaagtatcgtataactgagggagttaatcttccgttcaaagtattgccaaccatcaaggaacttggtcgatcacggatagaagtgaacgttaaggtaaagagtgtttttggtgcaaaaatgtttgcacttggggttgtagtcaagattcctgttccaaaacaaacagcaaaaacaaatttcacagttacatctggccgggcaaaatacaatgcttctattgattgtttggtttggaagattagaaaattccctgggcagactgagtcaaccttaagtgcagaagttgaacttatttccacaataacagaaaagaaatcttggactagaccaccaattcagatggagtttcagatagaaaaacttaaatgtaactattgttacttggagtcaaaagtggatatggttcccatgttcacagcatctggtttacgtgttcgtttcctcaaggtgtgggagaagagtgggtacaataccgttgagtgggttcgttacattacaaaagctggatcctacgagattaggtgctag

SEQ ID NO: 95800 - DNA, 476 bp, Glycine max
  Peptide Sequence Number=SeqID_212578
ggatccaaagcactgggatgatcctcttgagtttaggcttgaaaggtttcttagcaatgataatgagagtggaaaaatgggtcaagttggggtcaggggacaccattatcaactttttccttgggagtggaagaagagggtgtccaggagcttcactagcactaaaggttgctcacaccacccttgctgctatgattcaatgctttgaattgaaggctgaagaaaaaggagggtattgtggttgtgttgacatggaagagggaccttcatttattctttcaagtgttgaacccttgatttgtgtccgaaaatcaagactcatgtcattccctttgtatcatgctaaatactatttcttggtgtcactcaaattaagaccaagtatgaaacctagaagcaaagttagactccttgttgatgtagtaaacaaagttagactcttttggtcccttagattgaaaagtaattttttttag

SEQ ID NO: 95801 - DNA, 156 bp, Glycine max
  Peptide Sequence Number=SeqID_212579
atggagagaggcaaaaaagaaaggcctaaggaagtgaaatcttatttctctcctctttcaaggaaatcaaagtgcaccggagataagttcctacagagaaaggtacaagtcttccatggagaaaggtttcaagatcctgttgtttcctatcattga

SEQ ID NO: 95802 - DNA, 678 bp, Glycine max
  Peptide Sequence Number=SeqID_212580
atggttgaagagaagaaggaatccagcagcctaaaaaccagagagaaaatgcagaagaagaaggagaaaagaaaagtggagtcgaggcgctacagagttgtgatcgtggatcacttcctttgttatttctcttttactaattttgctaaaaggcagaagaagaaatgcaaaggtggcaagaagagcaaagttgatccaaaatacattttcaattactacaaagaaccaagtcattggacgcgagattgtctaaagaaagcaaagaaagattcttttgttgctcttgttcagaatgactcctcttcagttgaaggtggagttatgcaaatcagaaggaaatggaagtcaatggtaatgcagggaaccaagcaaggaaatttgtacatccttcagggtttcactatgatatgctctatctttgatgtttcacaatctggaagccatgcgtccaatggctcgtttgataattctctgtggcatctatgcctgggccacgtgagtgaaaaaggtttggatattctaaacaagcaaggcttacttggaaatcaaaaagtggaacctcttatgtttggtgagcactgcatttatgggaagcaacatcaaacaaagctcccaaaggtggcgcacacaacaaagatcatgttgcactgtgtccattttgacagttgggacctttga

SEQ ID NO: 95803 - DNA, 243 bp, Glycine max
  Peptide Sequence Number=SeqID_212581
atggccctttgctcagcgaacatgcacaactcatccttcttccagattcttcctcgcactcagccaaggagtgttgcgctcagcggatggcttgctaagccgacagacaaaggacaactacaaaacatgagagagaaggttatgtttggatgtgagataagtgatagggagaacccatggaaggtgggtagcttagagatagtctctttaagatggtatcctgaaaaggctagagtgaaataa

SEQ ID NO: 95804 - DNA, 522 bp, Glycine max
  Peptide Sequence Number=SeqID_212582
atgccagttccacttgccccatacccaacaccaccagctccatatacaccaccagctaatggtgtacagagtcaacttgtctgttctgggtgcagaaaccttctagtgttcccagttggagccacctctgtgtgctgtgctgtttgcaatgctgtcacagcagtaccacctcctggttatttgaaagttcaatttctacctgtgatttcaaatcaactgatcatgaggcagataaatcagaaacactcgtgtgtgacaggcacagaaatggcccagttagtatgtggaggttgccatactttactcatgtacatccggggcgcgacaagtgtgcaatgttcttgttgtcacactgtcaatctagctttggaagcaaatcaggtggcacatgtcaactgtggcaactgcaggatgctactcgcgtaccaatatggagcaagatccgtgaaatgtgcagtttgcaattttgtaacatcagttggggccacagcaagcaccactgagcagaagttcagcacttaa

SEQ ID NO: 95805 - DNA, 264 bp, Glycine max
  Peptide Sequence Number=SeqID_212583
atgaggagaaattttggagctttaatggaggcttcaatggagaagaaagaagaagaaagaaaagctacgtggaagccgttggggcccgtttttgaaagtaggcaatatatatatcaaaacgctcagaatgagaccctgagcgtggttcagagaaccactaacaacatgctgagcagcaacatcatagacctgcagaagggttcacttgtcgagcaccagaaccagttgtccctggttgttgttggaaagattctaaagggttaa

SEQ ID NO: 95806 - DNA, 363 bp, Glycine max
  Peptide Sequence Number=SeqID_212584
atggtaagggcctttgaggtcttgtgccccttcttcaacattcggtccagtgtgctagtgtttctttatttcttccaaataaaacttatgggcaacattggttgggtctccttgaacagcgtgtctaagaagctgtttaagtttgaatcaaagggtcaacaagcctatcttagagcatctgtcgttgccttctctgaagttgtgaagtccaaccatcatctgtcgtctaaggttggtagtgtgcttgccaagtttttgtgcactcagctggatggtgatgagctatttaagcactgtaggggcttgcaaggggagaaaaatgaattggttgaaaaggtggagagtaatggcggtagagaatga

SEQ ID NO: 95807 - DNA, 312 bp, Glycine max
  Peptide Sequence Number=SeqID_212585
atgttgcaaaagggagcccccatcaccaatagggcttgcaaacaacattcccaaaaaccaaatgcatcttccttctcacgaacaatctcctacaagcaaccatctgcattgttgaagttgttggtggttctagctcctcttttggttctctctccttcgctgggtgttggagtgatggaagattttgcggaagctttgaagcgggaggaagatggaagaaagaagaggtggaactccgatgacgttgagtttggggacacggaaggagttgaggtggaactccgggagggaggggtcatagtcgaggtgtag

SEQ ID NO: 95808 - DNA, 162 bp, Glycine max
  Peptide Sequence Number=SeqID_212586
atgcacaatagcaataacaacttggggaacacagaccaacacccagcgaaggagagagaaccaaaagaggagctagaaccaccaacaacttcaacaatgcagatggttgcttgtaggagattgttcgtgagaaggaagatgcatttggtttttgggaatgtt

SEQ ID NO: 95809 - DNA, 276 bp, Glycine max
  Peptide Sequence Number=SeqID_212587
atgttccttcccatcgtgttccttgtgaaacacccacgaaacgaggtggccagcaaggagagagattcgagtctcgagcacgtggcagaggtcaaatcgaagaagctccttgacatcgacgacgaagtccttggctccttgatcctagccacttcaacagcaccaccatggccacatagtctttgcctccgcaaaacgcagtgtttagggtctcagaagctgggttccaaaggaaggcgccaccagcagcttgggagtgagagagaaaggggttga

SEQ ID NO: 95810 - DNA, 275 bp, Glycine max
  Peptide Sequence Number=SeqID_212588
ggtacatctacttgggtttgactgagaacaagagagggtacatctcttgtggatcagttctagtggagggtacatccactaggttcaaagagaacaagggagggagtcgaggtggaactccgggagggaggggtcgtagtcgaggtgtagcaacatatgcggcaacagcttcgcctcttgggttttggctggaacgagggtggcagcatcggctttcgcagcggaggtggcaatggtttggagtatgggtcccgataaccgaggggtttatgtag

SEQ ID NO: 95811 - DNA, 180 bp, Glycine max
  Peptide Sequence Number=SeqID_212589
ctttcgaagaagttacggaaactcacggattgcgcaacaacacctccttttggtttccgccacaatacggaatttcacggatcgcgtaaccctccttcctcgagacttacatatcgtgcaacaaagggtgccaagtatcttgaagcggccaatcaaaggttgcatgtcatcaagcaataa

SEQ ID NO: 95812 - DNA, 398 bp, Glycine max
  Peptide Sequence Number=SeqID_212590
gcgctcctcctcctcctcccagaagatcacttcttgctgcttcttttcttcttcctgtgtgcttcttcttctccgcaagaccagcgagcccggctgcttcttctccgcgaaccacgcgttttgccttcgagtggaacctcagggtagatgacgccggaaaaaatgggaaaaggagtggttacggtggcgtcttccgaaagaaccgtgaagggttctttcggaacttccagaagaaggtatttcgaaaactttccggaagaagggttcctccggaagtaaccaaaggtcatccggaagaacacgtcttccgaaaatcttctggaacaccttcttctggaaactttccagaagaagtatttcttccggaaaatttccggaagaagaattcttccggatga

SEQ ID NO: 95813 - DNA, 345 bp, Glycine max
  Peptide Sequence Number=SeqID_212591
gattggatattgacaaatattactgattggcggttcaacagccaccatgctggaagctttagatgttgtataggtagtgacagtcctatcgagagtccttcggcttcggttagtaccagaatgctacaaaaggattctataaacctgtcaagtaaatgggaaacaaataagcataggaaagcttatggtttcatttccattccttttctgatcctgtttaaatatttggctactgatagagcatcttttgttgccctgcagttgggtcctgcagtcagccaaatgatgccagttgtggaggcaactcctttttactcaatagctagaaatgcatcagcttcataa

SEQ ID NO: 95814 - DNA, 336 bp, Glycine max
  Peptide Sequence Number=SeqID_212592
atgtgtactctgactctcccagtcccaaggccaacgaccattcttttcaccttactgcactcacagcttgtagggttttgtttttttgtacatgggacgaagaaaacaaaaactaaggcctccacaaaaaagagtcctgatagcattggccgagagcagcaagctaatctcaggagggggagatacaaaatcaacaaaagacctcatcctgatccactccaaatttggcaagagcatttacacattgattcccttcgcggagaacatgatgaagagtcaccgagagggaagggaggaaagctgatctttgatgttttggatcaagggagcatataa

SEQ ID NO: 95815 - DNA, 156 bp, Glycine max
  Peptide Sequence Number=SeqID_212593
atgatagacagagcttcaatgctagatgaggccatagaatatttaaagcagctccagcttcaagtgcaatccataaactccactcttaatctagtgcacaacaacaacaataaaaaaacaagccagacaaacaataagcaccaaatccctacttaa

SEQ ID NO: 95816 - DNA, 501 bp, Glycine max
  Peptide Sequence Number=SeqID_212594
atgcattctgttgcaggaaatatgttcctaaagaagatgcaacactgtaatgtcagttttgggcggcaaaatttggaattggatgacgacgatcttggtgttctacatgcgggtgggtacctcagtggtgtagttgactttcttgtaaaaaatgaaacctttcacgagctcggtgtcgtcgagcttcttcacaatcttgacatcgcggagatcaaccatgtcgggcttggtggcatccacgacgaagagagcggtgtcgacgacgaggggagcgaggagcatggagtattggatgatgaccttgctattgagggaagtgctggcagacttcacaagggagtcgcgatcagagagctcgacggggatggtcatggcggtgagaacatcgacaaccttgaaggtagctttgtggagggtgttggagacgatggtgtggtagatgtcgtgggagaggaggaggagacactactcagtggaaaatattctaagatagttttgtaa

SEQ ID NO: 95817 - DNA, 336 bp, Glycine max
  Peptide Sequence Number=SeqID_212595
atggctcccggggcaaagttctgcttgcttttgaagataataggtcttcaaaaattggggttaggtttgataaatcaattccagatggcaatgatcttggaggcctttgtgaggatgatcgtaggttcttttgttctgatgaccttgaagcaacttgggcatcttttcccaaacaaagtgacaatacagctgcctcaggacgaggctttactttctgattggaagcaacaattagaacgtgatattgaaactatgaaagttcaatccaatattgtcagcgtttgcacatgtgatttgcctttggaatatgtggaatctcatgcattggctttgtga

SEQ ID NO: 95818 - DNA, 621 bp, Glycine max
  Peptide Sequence Number=SeqID_212596
atggaattaggagttggaacacctataaaagtggattcaaataccctaaaggtggagcatggccattttgctcatggtctttacattatatgtgttggatgtggctattatggccatttggagagaaactgtgttaagtgtacggcacaacatgaaagccctaacaagaaccgaccttctccatcaagtacaaaagaccctccaatgactagtccctctaagactaatgtgaagggacaagaagatgttaaggttattaatgttggtgataatgtgcatggagattggcttgttcttcctaggaggaaaaagccaaggaacaaaggtgttaatgaaaaggtctatgatcatatcaatccctttaaagtgatggggtcaattcatgctaggagtaaagatatacagaggaaaaatattaccattattgaggggaaagggtcaattcctatgaaatcccaacgtaaccctaatcccattgttgttgtgcaaaaaagaaggagatattgccacaacaacatgtcacgagctagcaaattgccaccaaccaaagttgaggccaaatctagtccccccaaatcacccaatagtcaattaagaaatgggaagggcatgcaatgttag

SEQ ID NO: 95819 - DNA, 285 bp, Glycine max
  Peptide Sequence Number=SeqID_212597
atgcaacaaacaagcctccacgctgaacagaatccaaataacaattggtcagtaatattgaaagacatggaaatgctcaactgtggttggacactgaacacaaaacaaaggccttcatggaggcagactcatcgagcgcgtcagggccaagaggaacaacatcggacggaggcagaagtggcgacagaaccttggggacggggacctgaacggtggcgtcgtccctgcacgtgtcgacgaggaagtcgtggagcgctcaaacgtcgtggagctcaagaaccctag

SEQ ID NO: 95820 - DNA, 306 bp, Glycine max
  Peptide Sequence Number=SeqID_212598
atggcaaacagaggtgttttgtgtggcaatgacatcaatgatagcaacaatgctgatagtggtgtgtttggcaacaataatggtgatactgatagtaatagtagtggtgacagtagttatggtagaggggacaatgtcaataccaatggttgtgttggtagtggtggtggtgtcggtgacaatgatggtagtggtggaggcaagaatgatgatggcgggaacaatgctggtggtggtaatggtggtgacgagacaattaacaagaatgatcatttgcttgatgtaattaaggagagtgttttttaa

SEQ ID NO: 95821 - DNA, 144 bp, Glycine max
  Peptide Sequence Number=SeqID_212599
atgtttgggaactctatcggagcagtcggaggagaaactggaggaatcttagggaactgctcgagatgttgttatcgctgtcggaagacacgggttggacctgaatcaggagggagaggcctgacggacttcttcggagtgtag

SEQ ID NO: 95822 - DNA, 894 bp, Glycine max
  Peptide Sequence Number=SeqID_212600
tacggctaccttgttacgacttcactccagtcactagccctgccttcggcttccccctccttgcggttaaggtaacgacttcgggcatggccagctcccatagtgtgacgggcggcgagttgcagcctacaatccgaactgaggacgggtttttggggttagctcaccctcgcgggatcgcgatcctttgtcccgtccattggagcacgggggttgcgctcgttgcgggacttaaccccaacacctttacggcacgagctgacgacagccatgcaccacctgtgtccgcgttcccgaaggcacccctctctttcaagaggattcgcggcatgtcaagccctggaaaggttcttcgctttgcatcgaatttaaaccacatgctccaccgcttggtgcgggccccccgtcaatttcctttgagtttcattcttgcgaacgtactccccagggcgggatactttaacgcgttagtctacagcattgcacgggtcggatacgcacagcggcctagagtgctttcgccgttggtgttctttccgatctctacgcattttcaccgctccaccggaaattccctctgcccctaccacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagg

SEQ ID NO: 95823 - DNA, 192 bp, Glycine max
  Peptide Sequence Number=SeqID_212601
atggattccactatgcacgcttcgtcttcttttagaagacttagtttcaggcatggacagaggtggtggcagttgacagcggtggtggtgtggcgtggtcaacgatggtggcgcaatgatggtgggttccattggagaaatggaagaagaagggcaatgagggagaaagtatcattacggtgctacttttag

SEQ ID NO: 95824 - DNA, 201 bp, Glycine max
  Peptide Sequence Number=SeqID_212602
atgtttttttccatctgggttagcattggatggcggatacggcggcgagtagggggagggggagggcgaagcttgggatggaggggcggaggaagggtggcgagagaaggcggatcaaaacatgttctgccatactggggtggcaaaggatgggtcaaagtatggaagaagttccacgatgatggggtgacgattcagtag

SEQ ID NO: 95825 - DNA, 213 bp, Glycine max
  Peptide Sequence Number=SeqID_212603
atgaggtttaagagccaagggacagtagtggagatcaagggagagccaaaactatccagaactttggtttctgcccagacatttctcaaactccctgaaatagaagaggcttcctggctatgggttttggaaccagaccagagtgcagagggtgatcaatggcaaggttcagaagaagagcagcaacaactggctgaggtgttgcaggattga

SEQ ID NO: 95826 - DNA, 654 bp, Glycine max
  Peptide Sequence Number=SeqID_212604
atggttccctcgcaccttctgttgtgctctctacgaaatctggcaaaaataactcacatggaaatgataaaaggaatcaaggggcatggttattatgatgaacttgtgatccccataatagagaacacagcctacgaatatgagcttacagaatctctagctaaagctattgaagcctaccctaaaacaacagcagtgcttgtacgcaatcatggaatatatatttggggagactcgtggatcagtgctaaaactcaggctgagtgttatcattacctgtttgatgctgctatcaaacttcaccaattaggattggactggtctactcctaatcatggtccaataaaaagtcttagaagtctaatgattgctggggagtcaaaggcatccgataagacaaggaaggctagtggtgaaattgatccatttccacgttgcattgtccttgacattgaaggaactactactcccatatcatttgttactgaggttctcttcccatatgcacgtcaaaatgttgggaggcatctatctgtgacatatgatactcctgataccgaagctgatattaagttgctttgctcacaactgattgtccctgccactttatcagcaattgctgctatgcatcatgcccctgttgctgaactctag

SEQ ID NO: 95827 - DNA, 963 bp, Glycine max
  Peptide Sequence Number=SeqID_212605
atgcaatctccttcttccctttacctcaacaagaacttcttcaccacacaccatcaccaccttggcttccaccacaccctctcttccacccacaattcccttacctctcttggcttctcgcccaagccatcatgttccacgaggcttataacagctcaagcttacaggcccaacaatcacaagaggaatggttcccccaaagagggtgcgagggtgaggggcagcaaggacaacatgtggagtattgacaatgagcttgccaaggcgtcttcttctcagaaggagaaaaggaggaggcagagagggaggagtgtggtgaggaggaagggcccaaagggtggaagggttattgtctctggggctatgctgctggaggttgagactgttcttcagactctgaatgtagatgacaccatcttcatgggagaggctaccctctccaatgtagtggcgatcaaatgggtgcctttagtagacacggagaggtatgcacatttgttgaaatgcaaaattttatctttgccttttgtttacttagggattcctattggtgctaatcctaggtgggagctcatgagggagttgggaggattatggtgtgaggtgttagagtctatttatggagggtggagagtgaggaaagtggaaaagggtgataaagtccttttttggtgcaatcgttgggtgggacaacaatccttagctaatgagttccctagattatatctaaactcattacaaaaggaggagtgcatcataaatatgggggagtgggctgagggggtttggaggtggaattttaggtggcatagggactggtttgtgtgggagagggaggtggtggagaggctgagtttgatgctaagtgaagctacgttggtagagggtggggaggattcttggatatggaagcaagatcgaaccaggaactatcttgttaaatcttcatatttggctctatga

SEQ ID NO: 95828 - DNA, 885 bp, Glycine max
  Peptide Sequence Number=SeqID_212606
atgaagcaatatgtgactgagacgattgctgcttgtcacatatgtcaaaagggaaaatatttgacatcctctcccgttggactattgcaacccttacccatccctaatgctgtatgggaagatattagcatggatttcataatagggttgcctaaatcaaaagggtttgactctattctagaaattgtcaggctgcatggtattcctgcatcaatagtcagtgacagagactctatcttcctcagcaaattttggcaggaactattcaatatgcaaggcacagtattgaaaatgagcacagcatatcaccctcaatcagatgggcaaacagaatttctgaacagaatcctagaaacctatcttagatgtttcagttttgagcagcctaaggcatgggcagattttattccttgggcagaatactggtacaacacaacttatcaaggggcagccaaatgcaccccttttgaaacagtgtatgggagggtgcttccttttgccagatttattccaggggaggatcacatgatgaggcatgctaatgcccatagaataccttcaaggatcaaagcaggggactgggtgtatttgaagatcagaccccatacgcaagtatctatgccaagtaggttacatcctaaattggcagcaaggttttatggtccttatctggtggtgaagcagattggaactgtgggtttccaactgcaacttcctgctgaagctcaaattcatccaggacaatcagctgaggatgcaacttgggtggacaaagtttttattcaggagcaattccctcttttcaaccttgaggacaagggtggaggtcagtctgtgactgtaccaaagccgtggctggtttacagcagaaagaatagaaagtaa

SEQ ID NO: 95829 - DNA, 330 bp, Glycine max
  Peptide Sequence Number=SeqID_212607
atgcatctgcttgacactagttgttgcacaattcagagatttctcaacatttcggtaaagaatgcgaaaaatacccaaaaggaaaagaaagggagtcattttggggctttttcagacccctggctcgctcaagctagcctctggctcgcctgggccaccataagacttatgggcgaagtaacaagttcacctgggcaagcaaggttacttcaggttgaagcaacagctcgcctgggcgagctgctgttcaacctcctcccctcatttcctataaataagcgtgagggggctgaagtaatgggggttcagacattgaaagatttagtgtaa

SEQ ID NO: 95830 - DNA, 987 bp, Glycine max
  Peptide Sequence Number=SeqID_212608
atggaaccaatggaaataggtagcaagaatgaacatctatatgactgctatactctttcccgcatagaggtagtaccatcagtttcaggtgagcatacatctcaaatccagagaaaggttaactgggtgactttgaatccttatggtgaaataccacagcatattaaaggcagcaatgtagccaaagatgggcagcacaaatccagcgttaatgtaataaatcatgttttgcctacatttgaatcgtttgactttaaaaggagtgatgtgatggaagaagatgtcatgggctgtgaaccaggccttgtttactttgaagacgggtcatattctcgaggtcctatagatattccagtgggtgaatacaatgatacaaaatactatatctcaccaactttcaagttcgaacaatgcttggttaaaggctgccacaaaaggatccgaattgtccacaccatagaattcatcaatggtggttcagatatacagatattgagagtcgccgtgtatgaagaagaatgggccagtcctgcttccattgattaccaaagtgacatggagttcgacgcaaagccattttcacaaagaaaacgaaccaagccatcagagctaacagggtcatggaaagtctttgaggtaagtgcaactcccgtgtacgatgaggagagcacggcagaagaaggcaatgctgccccgtacatgtacttttgtatggaaaatctaaagaagaggagcctccccaagaacactgactactttggcgaggaggagcggcttgacatgcaggatgtgaccatgctatggcttcctggaggcgtgacatgctatgttgacattaacaagcatggcattggagttggttggtactctgatgaagggatcaaccttgtgatggagagagactatgggttggatggaaagctcaaagaggtgagatggaaatcagaggtgaaaagaaggtggtctagtcctcctcctattgaataa

SEQ ID NO: 95831 - DNA, 1641 bp, Glycine max
  Peptide Sequence Number=SeqID_212609
atggttaagactagaggattaggccatgcgttaggtagggttattgccataggtttgaggagaagggatggtgatgattctgacggtgttccccagcgccgaaggccgaccgcatcggcacacaagcgacgggtacccgtcattgttgatgatgttgtgcctgtggtacctgcggactcgcgtgcggtatcggaggcagaggctgctgtagctgggaatgagcccatggtagatgttgacgcacaggacaccggtccagagactaacacacaggatattggtgcacaggatgttgcagatgagcctgagggatttcttggtggacccagggaccgatcagtgcttacggagtatgctgaccatgttacggccagcgtatggtctggacaggtatttataatattcaagtctgttaatacttcaattcaagaacatcctgagttgaagttatcctcccatgggaggaaggtgcataacttgggtaggcctattcctacaattaaggacatggttgctgggacaggattaagtgctttgatcgcgtgttcgatagacaccgacgatcagggacttatctcctcctttgtcgagaggtggcaccgggagacttctagtttccatttccagcctctacacaccaacgaggtggtgctgttgttggttgagttactgatggtctcagcagaggtggccatggccgaaataggccaatgtggtggaccatatgtatgcctgcagtggctgcgagacgtataccatcatagatgtcaaacgcagcactggatagctaccgctcgcgcttatgttctgcatcttttgggttgcactctttttgctaataagagtgcaacccatgttcatgtcgtacacttacaggccctacgtgatctcacttttgctaggcagtatgcatggggagctattggcctcatccatatgtacgatcagcttaatgatgccagtctcagcaccagccgacagcttgctggttacatcaccttgttacagatatatgagcacttttcgtcagttgcagagtgcaatgctgattcggactatgacgcggtgtcaccacatgcgtgtcgatggattgcgacaaagaagattgtgaagaaactccgctgggggcctgctgttgtcagatacatatccgagagggttatgcgccaattcggctacgtccagtgcattcctgcacaccctgtccattcatgggtgtcatatgatgacatggacgatacgtggacgcactactcaaaccatctggcggcagcaggtgatctatgtgttgtgtcaggtcagtgtgcacctgactacatagactggttcttcatcatatcacatccattcatgactacaccacagacggatcctcctcgagatgcatatgtgacgccacccagtcatatccctcatgaggcagcaccgacatcgacacatgcagatcctgatgcagacgagcccagacatgcagtggcttgccatgcgatcaaggaggcgttggagcagcatctaaatgcgctaggcacatcgacacatgaagaggtcatccaaaaatgcctcaggattgccaggggtgtcacagaagaccgcaatgtgtatgtgaggtctcgacgtaggcggtgcacgaatcaacaatag

SEQ ID NO: 95832 - DNA, 327 bp, Glycine max
  Peptide Sequence Number=SeqID_212610
atgtggacaatcattgaccagtataaagagaagctagatctagctgctagccatgagctaagactagaggatgaacatgcaaaagtatcgactctgcaagcgaaaagggaagcaagagaaagagtgataaattcattacacggagaagctatgatgtggacggataggttcactttcactctgaatgggagtcaagagcttccaagactattagccaaagccaaggcaatggcgaacgtgaactcagctcccaaggcaatcactttcacactaaggcatttgtatttatgctttgactttgacaagataaacaatattgtctcttaa

SEQ ID NO: 95833 - DNA, 390 bp, Glycine max
  Peptide Sequence Number=SeqID_212611
atgcagcaatattcccaatggcaacatattaattcaactcatcatcctcaccaacccggtccaacaaccacaatggacacaatctggagcccaccaccacaaagcttcataaaatgcaatatagacgcgtctatcttcaaggaccttacatcctttggagctggaatgtatttgagagatgccagtgggaatttccttaaagcaaagtctatcaatgcagtaggtcttcaagaaccaaaagaagcccaggcttgggccctcctccaagcaatgatctggacacaacatgtcaccaacagtaacgtgatctttgagcttgattgtaaaatggtggttgatattcttttaacggcttctccaaaggctcttctgattttcatgtcactataa

SEQ ID NO: 95834 - DNA, 306 bp, Glycine max
  Peptide Sequence Number=SeqID_212612
atgtccacactcagtaacgaaggtgttcatcaaaccaaaaaaaggattgccacaacagcggtgtgtgggtggaacgggatgaaagaacttgatttaattatttgttcttatggagatgacgaagagagagcaaaagagagtgttgcttcgagtcaaaaggagaacattgtaggcagagtttctagaagctttgggaaggagataagcattgttggaaagcgagaccttgatccaatgaagtatggttctgacatcgtcaagttctgggaagataatggcagagacaataccattaaggacctttga

SEQ ID NO: 95835 - DNA, 417 bp, Glycine max
  Peptide Sequence Number=SeqID_212613
atggagtggttttatatgatatctcacccattcatgagcccaccacaggttggggagcctcctaaacatccacccatggtgcataatcctatagtagttatgccacatccaactgtgttgcccgatgatataacaactatgccacatccacctgcaacaacacctattgatgttgagatgcctcgaaatgcagtggttgtatgccaaaatatagcagaaagattgcaacacatgttagatatgacgatgatgactgctggaactgatgcatacactataacagaccaatatataagattagccagaactatctcttggtggttgacttctgagagggaaaaacatcatgctttgttggagagaaagagaaacaaggatgacgttataccatcagctttgacatcaacaatgttttga

SEQ ID NO: 95836 - DNA, 351 bp, Glycine max
  Peptide Sequence Number=SeqID_212614
atgatcgcgctaagcgggttcatcgtggctgttgaacaaaatgatgcagacactaagcgcgcttgtgcgctaagcatcaatagtatactgagacttagatggcttctaggaaaagaaaggcaccctctacacctacccaagccaaatttgatagaaccaaattcactttccaagaggcttgggagagatacaccgatattgtggtgcctctttgatgagttcaaggaggaactcgagagacgccattgggatgaggagttgactgactttctggacagcaacattaatgttgccatggtaaaagaattctatggaaacctctatgaccccgaggacaaatcacctaagtag

SEQ ID NO: 95837 - DNA, 387 bp, Glycine max
  Peptide Sequence Number=SeqID_212615
atggctttggctaccattgttggtaggcctatttgggttgatgcaactactcgtgacattcgtcgtggtaaattcatgaaagtttgtatggagactgatctaaataaacttgttaccgacgtgttttgtttcgtgaccattggtatcgagttgaacatgaaggcatgcatagaatatgctcatcatgtggctgctatggccacttgtcaagggagctttcaacagaaccagttccagcaacggtggagaaacaataatcgtcgagcaaaaaggagatatctaatgcaactagcaaaagaggaacctcaagttctagctggcatgaaagttgtcgtctctgacctaatagagacaacgacccttgctacctctttggcatccacttag

SEQ ID NO: 95838 - DNA, 390 bp, Glycine max
  Peptide Sequence Number=SeqID_212616
atgattgtccagactaagggcctcgacaaactcacaagcctcatacttttcagggttactaccctcgacaccggacaacctcttatgccaacaagcgggctcagagcttggggagtttatgtactatttggggtcctcaaaattgacgtggcaagcaatgtccccccttgtgttttcctaacagagggtacctatagtacaacatgcgaaattgtggagctcatccaggctacgtctaccctagcatcaatcaactccagattttgggttgtatgccccgtgggaagatactttagttgtgaagcttctcggcaaaaaggtaatggttacagcatggtaaaatttgatgtggaggatgataggactagggtcatggaggatggaccctag

SEQ ID NO: 95839 - DNA, 492 bp, Glycine max
  Peptide Sequence Number=SeqID_212617
atggctgctgcatctggcatgccagaggaggagacagcgatgtttcccgacaaaagtgtccatcccaggttggatgtctacgtgtgggacatggatgagacccttgtactgctcaactccttgctgaaatcatcatacgctgaggctttcaatggtctgaaggatgtgcagaagggggtggaaatcgggaggacatgggaaaatctcattctacaaatatgtgatgattatttcttctatgaacaaattgaaaattacaataagccttttcttgatgctctggcccaatatgatgatgggagggacctatctgattatgacttcaacgaagatgaattagtttccccacatgatgatgccaacaaaagaaaactggcatataggcatcgagtcattgcccaaaagtacttacagcatatgggaaaagctctttacatgttatcttatgttcttctaagtgcttatagagggaagtttgttcagacagtgtga

SEQ ID NO: 95840 - DNA, 876 bp, Glycine max
  Peptide Sequence Number=SeqID_212618
atggcaatgaagataaccatgggaccatcctggttgataggattaatgcctttgaagtctttgtcggtgaatgttataggagttgacatcgatatcttggatggcatggagatgacgctttcgagattgactacaaagcccttcgttgacatttgcgtctttgctggttacgcctttgtcgacttctctcctttgttttatcccttcttcgatcctcatcttggcttctgtgatgatcatcttggtgaccccaggggcccaactattttcagtgttgtaccatggctttggtggtattggcaatgcttggttctgtctaacctgggtatgggaggaggtactggaggtagttgtataggtatttttgcgttgaaggcttcctcgagaatggtgtccaacttgtgtgagtcggtcctgcctttggctcgttcgcgcaactcgtccatgctgttgggaggttttttacacaagttgtctgcgaacttgccaggttgtagggcgatcaacattgagtgtaatgccactttaggattaagggaagattcaacacatgattgcattgtcagtggtgtagagattaacttgggtgacgaacatgtcaaggtgcttgtctggattggtagttccatcataacgctccagggcgtgattcccgctgagtacattcttgaattgtttgagcggagtgctcgtccccttgggagcatcacgcacaagcctccaagttatcatggtcgaccttcattttttggagttcctccttatggcgttgttccatctccgcaatatgggcttgtagctgctggactgtgtgcaccattggtgaagaaaggccacggggaaagttttaccatggccccacagtggatgccaaat

SEQ ID NO: 95841 - DNA, 1269 bp, Glycine max
  Peptide Sequence Number=SeqID_212619
atgatactgtccacaaaggcccaaaaccaatcgaagaacttgttaagttacaactcaaatggacccaaacctggacagtgtactcagctcaacagggacctcaccagccacgagtataggcacatagctgaagtcccacaaaaaaatgtagcttattcgcatggcaaccatctgatatgccaggttgaagagttactcaaagcccagtttatcagaaaggtcagatattcgacttggctggctaacattgtcatggtaaaaaaggctaatggcaaatggtgtatgtgcactaactacattgaccctaacaaagcatgctccaaagacgtgtatcccttgcccaacatcgacaaactggtcgacaatgcatctgggttccaatttctgagcttcctgaacacttattcagggtataatcagatcaaaatgcaccttcctaacaaggaaaaaatagccttcatcactaaagacaccaacttctactacagggaagtttatgggcttcatgatcacccatttggaatagaagaaaactctgacaagtgcacaacgatactagaaattcatagtcctactaacatcggggaagttcagaagctgaacggtagactagcgttacagtctaggttcctccctaggctcgcggaaaaggcaaagccattctacaagctattatggaaaactgagtcatttctatgggacgaagcttgtatgcaagccttcttggcctttaagaaaactatcacgacaccaacgatcttgagtcaaccccaaagccagggtacctttgctcctttactcttagtagcaaaagaggccatcaattcagccctcgatcaagaagaaggaaaacaccaaattcccatatacttcattagtcgaatccttcatgatgctgaaaagcggatggtagcatggtctatagaactatcagagtttgatctccaatatgagccttgcagccccatgaaaacccagtttatgccagattttctagaaaaatttactggcaatgccctcaaattcaatttcaaggcatcaaacaatcaggttgagtacaaagcacttatagtcagcctaaagctcacaaaagaagttagagcaaggaaactcaggtgctataatgatgtgcagcttgtccagggacatgttacaaacaaatatcaagcccttgatgattttgattatttcgagatgtatcacacactccaagcaccaaccatagacaccaaggaggtcatggcaggagaagaggaagagccagactag

SEQ ID NO: 95842 - DNA, 333 bp, Glycine max
  Peptide Sequence Number=SeqID_212620
atgtcgcaacaatctcaacctcagtacgtaaaggatggtgcgcctattgaagaagttggtccattcagtgaagataacaaagaaataaatttgaataatgacagtgaagattatatagacgaggatgaaaatcaaaacctaaatatggaactaccatcagctatcgagcatgcgtatagtatgccagcacacatgcgtgacatgagcagcaacaatccttcaaaagatcatcaatttgattactttatggattgcccagaagaaccatctatgaaccaggaatgctctttcaaggaatgtagtttcctagcaaagctaatgtcaaatatatag

SEQ ID NO: 95843 - DNA, 894 bp, Glycine max
  Peptide Sequence Number=SeqID_212621
atgggaattcacaatgacatgggctgggagtggaaattttcatggagaagactggtattcgacaatgaaattgatgcaaccatctttcttagggaggtagaaggacaaagcatacaacaacaacaacaacaaaatgacatttgggagtggctaggagatccatcaggcaattactcgactcgcagcgcttacaatctgatgtgggaggaaattgctggtggtcagaaggaggattggagtgtggaactgtggaagacaaagatacctagcaaaattatggggcagattgcttacaaaagagctatggaggatatgctttgccctttctgcaatggagctgtggaggataaatctcacctatttatccattgcaccaaaatccaaccaatttggtgggaatcgatgtcatggatgaatatcaaaggcgctttcccttttagcctgaaacaacacttcattcagcacatctctatccagatcgaaggattaagggctaagcggtggaggtattggtggttggcggactatgtgacaagaaatgcccttgttaagcatcttaggactcatggtattggaggcagtcctggaacatcatttagaataccagattctgagatattgttgtacacaggcattgagaattcatgtgatgacaattatgatcaggcaagtgtagaatcaaattcatggtcaattgaaataaacaattatgactcggccaattcgccatgtaacagcaagtccagttctgtcaattatggggcaaggcacctaaagtttctgctccaaagttctagaagaagagacacaaaagaggcagcctcagatttagaagatgatgtttctgtgaattctttcagctcaaggaacaacttgaaagagctttgtttatga

SEQ ID NO: 95844 - DNA, 507 bp, Glycine max
  Peptide Sequence Number=SeqID_212622
atgacaatcaaaatcgatctagaaaaggcctatgataagattaaattggacttcttccaagagactcttaatgattttggtcgtccatcaaatattttagaccttatatggagttgtatttctactactagaatgaggatgctttggaatggtgaagtattggaggaatttaatccgagaaaaggaaaatacttgggtgttcccgtatttcataaaaggaccacaaaacaggattttgatttcctcttggagaagagcctttggagtgagctatgcaccttgaagaaagcaagggggtctgggttaaggtctactcgagctacgaataaagcatttatgatgaaggcagggtcaaggccgagcacccgtaaggattcctggatgcgtggatcccagattatcaacttcaaaaagaagttgccttatgttccttgtccaattaggagttgcaagctaaagtggcagattgcatcaatattaatgggcattgggatatggatagattaa

SEQ ID NO: 95845 - DNA, 210 bp, Glycine max
  Peptide Sequence Number=SeqID_212623
atggacatgcaagcttaccttgaagaacagtatgttgcacgacgcgtcaacagtcaaaagggcacgatgacccaaggttgcggtggtgccgcgaacaacacgcgacgcagaggtagtggagccgcgacaatgtacccttccttttgcggagttgacggtggtgcgacggagagtgacctcaacaggagacgccgactgatagcacaataa

SEQ ID NO: 95846 - DNA, 159 bp, Glycine max
  Peptide Sequence Number=SeqID_212624
atgtcagatgattttgagaagtattcagaggcaaaagataaacttgaattcatggaatggacattaagatggaggcatgtggcacccactgttcctaatactcttggtatgtacattatatatgcctcaatgcttttacacttccttggttatcaataa

SEQ ID NO: 95847 - DNA, 441 bp, Glycine max
  Peptide Sequence Number=SeqID_212625
atgaatatgttaaaaattgagatttcacaagccgcgcgcgctcgaaaaccttgccctccctcttctctttgtcaccgtgaaatcgctcttctctttctcctcccacctgaaaaactgccggaaaccgctccctcgacacccacattgtcctcgctcaaacccacacaaccccctacactgccagaaaaacccacattgtcctcgctcgaacccacagaaccccctacactgttcttggaagtctggctcgaagaaaacccaacatacactgttgctactagggtgctgaaacagtcgtgggtgctcaaagctcaaagctttctccgtgaggttcataacaagttactgacacttcttgcaattattttggagtttggggcacttgtttggtatgccacaaatattccaaacgccttccatataaatctgtttgatatataa

SEQ ID NO: 95848 - DNA, 420 bp, Glycine max
  Peptide Sequence Number=SeqID_212626
atggcaaaacaagctaaacatgtgttttatgtccaacattcttgtgatgaaaactggttagtggttctacacggaaaaaccattggtgttaatcttgaagatgatgattcaatccctaatacttgtcacactcatttctccacacacatgcctactatcaatggaaaatatgaagttgacgatgtggctacaccatcgagcttcctttctctcgagtcaacgcattcaccatctaggtccaagaggactagaaaaaccacacgattcatatcattgtctgccaaacctatgagtttggagaggccactagttcatgtggattctaacactaggaaagatattggtccatacacaaagaaattaaggacctatttggtggtcatcacccgaaacaaagttaattttatgtatataaattga

SEQ ID NO: 95849 - DNA, 687 bp, Glycine max
  Peptide Sequence Number=SeqID_212627
atgagtcctagaaatcatagtgtctccggagccacattacctgccaaagaattgaagcttatttgggctgggtacaggtcaaccgtatcgggtggtttgggttgcaggctatctccttcagagacaattgcttcacagtgggtggggaagggcgactgggtaagggaagcaaaggtgggggtgggactgcatgaagaggtggaggaggtaagggctgtgacgatcggccacatggcacttggcggggtcaagggttggtgcgcctggacctcgcggcggatttcgggtgtcaaacctgaaacggagcagttgagtaaaaagggtggaggaaggctgatgatgcggttggcgaggtcttcaaagtccgataggtactgcgccaccgtccctttctgtgtcaatttaaacaaggccccggtagggtcttcatattgggagggtgtaggtgatggagatggagtgggtgaggatgttgcagggactgagagcagtggtgggttttggtgggatcggccatggaaaggagatcagagcaccaaattgatagggaaagcgcagggtaagggtctagtttcgaggaccaatgcctctagaagaaaagaagaagaaagaatattagaattagttatgcttgtccccccaaccatcaacatcattcccgcaagatcttcagacgtaatccttaag

SEQ ID NO: 95850 - DNA, 219 bp, Glycine max
  Peptide Sequence Number=SeqID_212628
atggtgttggctgctggtgtttgcacggtgttgggtggttggatggaggtgaggcacggtggtattagcaacaatggatgggggagtgacaataagagaaatggagacaatggtattctagtggtgcaagagatgaatcatagtggtgacgataacggatctgatgatattgattgtagcaatggttatggtaatgataatgatcatgatgatgattga

SEQ ID NO: 95851 - DNA, 1338 bp, Glycine max
  Peptide Sequence Number=SeqID_212629
atgtcactgcaacctggttctggttctggttctggttctgattctggttctggttctgagaagaggaagaaaagctatgacagtgaaatcaatctcgtcgatgacacccccctcaagaaaggaagaagagaagaattgtcttcagaaatcccttccaaagaaaagcttttggaagctattcccgagatgaagcaacgtatatggtctgagtgccctgacgaacaaatggacgcaatgatgcactttacaaatctgttaggatctatagagccccctcgtccaattgatgaggtgattgaggcagaagttgtccctcgctttgtgcaattcttggatatgtatgataaacccgacttgcagtttgaagctgtatggtcgttaaccaatattgctagcggaaaatcccatcacacaagagttgtcgttgaacatggcgcagttcccttgttggtgaaacttctcatccttagcaacaatgaggacgtcatagaacaggtagtatgggctataagtaacattgctggtgaatccccaaaatatagggatcttgttcttgaggaaggtgttcttctaccgttaatatctctgttgggtccaccacttccaacaatgtctatgttgttgactactacatggactttatctaatttggtccgtggaaagcctcacgtacaatttaaacaggtagagcctctcatgcctgtccttaagacactcatcgacatggacaacgaagaagttttattaaatgcatgcagtgctctttatttcctttcaaatgtctcagctggcgcaactcaggctattatcgaagcagaagtttgcccaaaactagtggagcttttgctgtattcatcagattcagttagtttacttgcacttcagactttgggaaacatcgctgctggtaatgatgctcagactcagcatgtaattgataaccaatttctcccacctgttcgtctacttctttttctcacgcgagaacgaaatgaaatcatcttcagaaaagcttgttgggcaatctcaaatatcacagctggtaatagaactcaaatacaggcagtgattgatgccgaaatttttcctattcttgttgggtttttttgtcatcatcatgctgactctgattttgatatcaagaaagaggtggtctgggccatcaccaatgccactagaagaggatctgctgaccaaatcatggacctggcggatcaaggttgcgctaagcctctaagtgaactcttgacccatccaaacccagaaattgtgtcaatttgtgtcgaggggctacagaaaattttgatggctcggataagccaacaacaacgaagatag

SEQ ID NO: 95852 - DNA, 157 bp, Glycine max
  Peptide Sequence Number=SeqID_212630
atggaggaggagaatgttgggaaatgcttgtgcaatggcttgaagcaaattgagggtagtggctgtgtctctttgtgtaaaggagaaaaacaaaagaaggtaaagcttgattatatgaagctttcaacatcagggttggggcagcagggacatgaag

SEQ ID NO: 95853 - DNA, 432 bp, Glycine max
  Peptide Sequence Number=SeqID_212631
atggccgagtcttgcctcctctcttctccctcctcactcttccacaccaaatccaaaccctctctctttacatccccctcacactccaattttcatgcctcaactcctccctcaccgcacgaactcgcgacgccggcgaagatagctttgttgaaccaccagaaagaggccaagctcttcgttgggaacttgccttatgacgttgataaccagaaattggccatgcttttcgaacaagtcggaaccgttgaaatcgctgaggttatttataataggaaaactgaccaaagtcgcgggtttaggtttgtgacgatgagtactgttgaagaagctgaaagcgctgtggagaaattcaaccgctatataatgaagataggaactagctatgcagtgaatccttgttatgagtttgtgactgttgagaagggatga

SEQ ID NO: 95854 - DNA, 335 bp, Glycine max
  Peptide Sequence Number=SeqID_212632
gagaggagaagaagtgtctgaattctgagctatggcatgcatgcacgggccccctagtgtccctaccaacttcagggactcgtgtggtttacttccctcagggtcatagtgagcaggttgctgccacaactaacagagaaattgatggacacattcccaattaccctagcttgccaccccagttgatttgccaacttcataatgtcacaatgcatgcagatgttgaaacggatgaagtatatgctcaaatgacattgcaaccattgactctgattattgttaaaaactacaaatatgcacaacaaaatgctcctcgctataatgaaatgacatag

SEQ ID NO: 95855 - DNA, 273 bp, Glycine max
  Peptide Sequence Number=SeqID_212633
atggagactaatctgctagtgtgtgtgtgtgtgtgtgtgtgtgtgtgtgtgtgtgtgtgttttctttggaccttcacaagaacaactaagattaagaacctgaatcaaaacatggaggccttaacagtgaaactgtcagaaaaggacccgagagaaatttctgaggcggttcccactggtgatgtagcaggtggtagatactacaatggactggatcacttttcatggaagtatgctaacacacctccaaaagattcaaaaatctcaacctga

SEQ ID NO: 95856 - DNA, 420 bp, Glycine max
  Peptide Sequence Number=SeqID_212634
gtggacgaggcggtggcgcatggcgcacgcgtggagtgcggcggacgcgtaatcgacggcgtcggctgctactaccagccaaccatcctgaccggcctgacaccggataacccggcttactatcaggagtttttcggcccggtggcgcagttatatgtggtggcggacgatcgtgctgccgtggcactggccaacgactcacactacggtttgggcggttccgtgtggacgcgggacattgcgcgcggacgcaacatggcttcgcagattgagaccggcatggtgtttatcaattcgcagagcgataccgcggctgagctgccgttcggcggcgtgaagcgttccggctatggccgtgaactatcggatctcgggctgaaggagtttgctaaccagaaactggtcgtggtagccggttaa

SEQ ID NO: 95857 - DNA, 699 bp, Glycine max
  Peptide Sequence Number=SeqID_212635
atggtcggacacgattcgaatatcgcgtcattgctgagcgcgctgcaggttaagccatacgagctgccgggtaacgacgagaaaaccccgattggcggccaggtagtgtttgaacgctggcacgatgcgaagaacaacaaagacctgctgaaagtggagtatgtctatcagacggcggatcagctgcgtaatgccgatgtgctgagcctgaagaacccaccgaagcgcgttacgctgcagctggcggggtgtgacactgacgccaacggctactgcagctgggatcagttcaccagcgcgctgaacaacgcgctgcagggtacgccgctgcagccagccgcaccggcaccggccgcacagcctcctgccgcgccggcagccagcgatgacgcccaggccaaagcggatcaggccagcgcggataaagcggcagctgacaaagccgcagctgataaagctgcagcgcagaaagccgctgacgccaaagccgctgaggaaaaagtgaaggcggacaaggccgcggcgcaaaaagcggcggacgacaaagccaaagctgagaaggccagcgctcagaaggccgcagaggagaaggcgaaagccgatgccgcagcggcgcagaaagcccaggctgaggcagcgccggcgaagccggaggcggacgctaaacccgcgcaacagccggcagcggccagcaactaa

SEQ ID NO: 95858 - DNA, 222 bp, Glycine max
  Peptide Sequence Number=SeqID_212636
atgagtgtggatgagtttcttgcacaggtggcttggccaggagtccagccttctccatctggaggggaggagcccgtgccagattcagaggatgagcctattcatcctgagccatttatctttgagactgatccaatcgctcaggaggaagcagcaactcaggaacctacatctccaattagagagagattagtgagccatagagtgattgtgaggtgctga

SEQ ID NO: 95859 - DNA, 414 bp, Glycine max
  Peptide Sequence Number=SeqID_212637
atggtgtgtgttagcagcagcggaatcagaaatgagagtggaaaggaaggggcaataaacaataaaggaaagaaaacccatcatgatatgattgataataaagcaaagcaagaagcagtggcaccaacttttccccattcaaccaaaaccattttcgccgttagagttaagagacaccaaaatatgggaagcaagtggaagaaagccaaggtggcgctcggtctcaacctctgcatgttcgttcccagaaccttagacgacgattcgccgccgcacacggtggtttccgagcgcctctccgacgccactctcctctctccggccaactggagcaccagctcttcccgcccaaccacaccggtttcctcttttcacggtttgaaactctccaaaagtagcagcaaatcatccaag

SEQ ID NO: 95860 - DNA, 1563 bp, Glycine max
  Peptide Sequence Number=SeqID_212638
atggggttggtgagcagtttcttggggattcttggtttcgccgttggaatacctcttggcctctttgtggggttctttctctttgtctactcagaaaccaaacatgtcaaggaccctgttgttaggcctataagtgaattaggcccaaatgctttgcaggaacttctgcccgagattcctctctgggtgaagacgcctgattatgaacgagttgattggttgaacaagtttttattggatacgtggcctttcttagatacggcaatttgtaagattattagaagcagggctcaaccaatatttttcgaatacattggcaagtatcagatcaaagcgattgagtttgataagttaagccttggtactcttcctcctactgtctgtggtattaaagttttagaaacaaatggaaaggaattggtcatggaacaagttatcaaatgggctggcaatccagaaatagtgttgtcggtgtatgtggcctctttgaagatcaccgttcagttggtagacttacaaatatttgcagcaccacgagtaactttaagacctttggtgccaacatttccatgttttgcaaatattgtggtatctttgatggagaaggaaacaataaaaaaacaagttgcaaacctctatctctggcctcaaaccctggaaattcctattcttgatgaatcatcggtggcaataaagaagcctgtggggatattacatgtgaatgtggttcgtgcacaaaagcttttaaagatggatttgctgggaacttctgatccttatgttaaactaagcttgacaggagacaaacttccagcaaaaaaaaccactgtcaagagaaagaatttgaatcctgagtggaatgagaagttcaagcttgttgtaaaggatcctcaatctcaagttctccaattacaagtttatgactgggacaaggttggcggacatgacaagctgggaatgcagttagtccctcttaaagtgttaaaggcgtatgagaataaagaatttacacttgatttactcaaggacacaaatctcaatgaaactccacgtaagaagcctagaggtaaaattgtggtggacttgacttttgttcctttcaaagaagatagtagcaagtttggtggaccttcagaaggatatagcaggaaggaaagtggaattgatatcgtatctgatgatgaggtccaagaaggagctggtttgctttcaattgtgatccaagaggctgaagaggttgagggggaccatcacaacaacccatttgcagttctgacctttagaggtgaaaagaaaaggacaaagatgatgaagaaaactcgtcacccgcgttggaatgaagaattccaattcatgctggaggagcctcctcaacatgagaagatacatattgaggttatgagcaagaggaagaactttagttttctgccaaagaaatcattggggcatgtggagattaacctaagagatgtggtgcacaatggtcacattaatgataagtaccatctaataaattcaaggaatggggtgatgcatgttgagataagatggaaggtggtttaa

SEQ ID NO: 95861 - DNA, 189 bp, Glycine max
  Peptide Sequence Number=SeqID_212639
atggaagataatctatactgtaaggatttgcatgagcccatcatctacaaagacaaggtagaagatgccatccatccgagttgtccttgtatcttagccttggggattccttgtatcgaaagtctttctggcggtgagtctaggcagcgtgtctcgcagatgaagcgacggtgcaagtaccacaagtag

SEQ ID NO: 95862 - DNA, 456 bp, Glycine max
  Peptide Sequence Number=SeqID_212640
atggagtctgatagcacaagaccagcagttgctatccatattgtggacatgagaaagaggattggtgaacctttctctagatacaccattggcaacattttgtggccaatgatggtgttttgtgaaaaagtcaatgcagacactagtgttagatatttggttagcattgccagagagaaatttggaaagctttcaagggaattgtttttaatagtgaaaagtgatcctaatatcctagggagcactcagtgtatggatctgcctcaaggtatagaaacaagaagtccaattccaatgacaagttggtgtggtttgaatttcagtggactagattttggttttgggaagcctttgtgggttggtgttagaggaggggatcaggaaactctccctaatgtagctgttatcatggaaacagatgaaggcatggaagcttggttgacaatggaaatgtag

SEQ ID NO: 95863 - DNA, 435 bp, Glycine max
  Peptide Sequence Number=SeqID_212641
atgaggctcaatcctctcaagtgcatttttggagtccgagcaggaaaattcttgggttacatgttgactaaaaaaggaatagaggttctttatttggctgtagcaaatgaagcaattagtgttgctttagttcagaaaaaaggtgaacttcaaagatcgatttattttgtgagcaacacacttcagggggtcgaacttcaaagatcattagagaagtccattcgacaaattcttcaccgacttgatttggcgagaaggatggtttcttgggcaatagaggttggtggaggagttggcgctgaaaaggtaaagcaaggatatgtgtttgcggaaatccatgaggggagctatgatcatcatttggatggaaaagctctagcaaaaaaggcttttcgagaaggatattacttttttcaattgagtcagatgcaatga

SEQ ID NO: 95864 - DNA, 612 bp, Glycine max
  Peptide Sequence Number=SeqID_212642
atggcaaagaagaagaataagaggataaagaccattgggcatagacccacagcccctagaacgaagaaggagaaagaaccaacaaatggtggtccttcaggtagaggaaaatggatttcacattctccctcacctcctactacaccaaaggcaactctttggttttttgaagaacactacgaggctttgtacaagtttagttatccgaagaaggagatgattcaaccaaagttgaagaaactggtggagaagaagggcacctactacattgacctggtaaaatttttctataccacagatcatattgatggtgatactgggtgcttgtgtatagaagtgaaagagcaacgaattgtgatgacacttgaggtttggttagacattactaggttatcatcagaaggtgttatggtgaaccagttaggtctcaaggaagctggatttgttttcaacaaggtcgagaagtacaagtctatgatgaaacatccttctgcctatgttgccattgttacaaaagcaaagagaaaggaacattttggtactggaccgctgatgcttgagcacgggtttttggcttatgtggttgcttggattattactccaagggggtga

SEQ ID NO: 95865 - DNA, 498 bp, Glycine max
  Peptide Sequence Number=SeqID_212643
atgatgcttggcagctacaaaggacctacttcatttgaggatatctggactgttgcgaatatccaatatccaacatatagagaagcatgttttgcaatgggctttctacaagatgacagagaatatgttgaggcaatcaaagaggccaaggactggggcacaactaattatctaaggaaattgtttgtattaattctattaacgggtgccatgagcaaacctgaagaagtttggaatcaatgttggcattggctagctgatgacattgcatatcaatatactaaatcaacaatcaactcatatgaacaaaaaacaatttatcacagaattatccaagctgtcaacaacaatgaaggtggaatgtttttcctatacggatttggaggcacaggaaaaacattcatatggagaacattagcaagttcattgagagcagagaatcaaattgtgattattgttgcttctagcagaatagcctctctattattaataagttga

SEQ ID NO: 95866 - DNA, 582 bp, Glycine max
  Peptide Sequence Number=SeqID_212644
atgactttgttgttcccggaggaacaaaaggtgcagaagactgtgtcagcccctgcatgctatcaagcgttctgtcttacagatggcaaaagaaggggtgcgaataaccgtaaggtatctccgcgtatcatgggtatctccgcgtatcatgggtgcagaatgaccaaacttggtctctgcttgtcatcgggcccgctgcctctggatgacaaaaggggtgcgaataaccataaggtatctccgcgtatcatgggtatctccgcgtatcatgggtgcagaatgaccaaacttggttcctgcgtgccatcggacacgactgtgtctgaatggcaaaggggtgcggataaccgtaaggtatctccgcgtatcatgggtatctccgcgtatcatgggtgcagaatgaccaaacttggtttctgcgtgccatcggacacgactgtgtctgaatggcaaaggggtgtgcgtcacatgacctcaggacttgaaaagtctccatcggaaaatgctgacatctccggaaaaggccagatgaccacattggcctctgctcatcaatcacacttggggtcactgaatgacgag

SEQ ID NO: 95867 - DNA, 426 bp, Glycine max
  Peptide Sequence Number=SeqID_212645
atgctagaacctatagctctaccaatgttggtagtggacaacaaacctgagaaagtccttactcaatggactggattagccccagaagacacctcatgtgaggactggtttgacttaaaggctacctaccaccttgaggacaaggtttggtctgatacgcatgagaatgttaaggcaaaaactaaggagagtttcgttgagtttggtttgttccttgttgttgagggtgtccatagtggacgtggaagcttccacttcttcaatagaaggtctagggacctctcaatgttcgatcagctggaagacgtcttcatgcttcaaggagaaggggaagtgaaactcaactacgttggagatgacacggcaatgattagagggataacaaaagaagctataacaacaatatgcaaagaagagacagaatga

SEQ ID NO: 95868 - DNA, 732 bp, Glycine max
  Peptide Sequence Number=SeqID_212646
atgaagacgcgagatggttcttggcgattttgtgtggactaccaagctctgaatgctatcacgatcaaagaccgctttcttatttcaacggtggttgaatttttggatgagctcggcggtgccaagtggttttcgaaactagacttactacaaggctaccatcagatactaatgaaggatgatgatgtgagcaaaacagcttttcgcatgcaccaaggccattacgagtttcgttttacagaatggagaatttcacctcaggttgttcaaatgttgttttgcttagacccaaatagaatacctgggtcacttggtttcggcaacaggagtagaactagtaccaaaaaaggtgaaggctatccaacaatggccaccaccgcgttcatttcgggccttgcacggttcaagtggccaccagaggcagaccttgcttttcaagctctcaaggatgccatcagtgcggcaccagtcctagccttacccaacttcgccattccattcgtagtcgagacagacgcctcagaagtgggaatgggtgccatgctttcgcaggaaggtcaccccattgccttcttcagtaagcagttttgccccaaattaactggtgcatccacttacatccgagaacttgccgccattaccatggtggtcaagaagtggcgtcaatatctgttaggacactgctttatcgtcctcaccgaacaccaaagtcttaaggaactcatggcatag

SEQ ID NO: 95869 - DNA, 369 bp, Glycine max
  Peptide Sequence Number=SeqID_212647
atggtttcagaattgagcagtggaacaccgggtgaatgcgggagtgttctagcaactggagtttataggcaactttttggattcaatcttccacctgaaatgctgagacttgctggtgtggtctcaatttcaccatcactcaatcacgaatttgaaactccttatccctcctatgtccatctgctaccttcttcatgcaattttgagctttcaacagtttcttgcttagggaagaaaataccaagtctcgatttaggtgcctgtgatgtattgtggggtattaggaggtttgcgaccaaaggcagagctcatgcggagcttcgtgccactcaaggagaacaactcccgttagaatctactaatgaatag

SEQ ID NO: 95870 - DNA, 522 bp, Glycine max
  Peptide Sequence Number=SeqID_212648
atggtgatcaatgagaaaagtgaaactttggtgaaggaagaggaagaaccactcaagaatgacctccaagtggtaaagccttccttgtctgcaggggatgaaagaactgagaaattaagtcgaatgaaagtggctactgttattgaaagttgtgctggtagtggagctacaacccttgagcttagagggaaattagtggatcagatggagtggttgcaggtgtcaattgggaaattatctgatgtcactgaaatggacctatctgaaaacagactcatggctcttccaacaacaattgggggtctcaaggccttaacaatgcttgatcttcactcaaaccaacttataaaccttccccactcatttggtgaattgataaaccttgttgatcttgacctccacgctaacagattgaaatcacttcctgctacatttggaaacttgacaaacatcattgatctagacttgagctcaaacgggttcatggatttaccagaaactattggaaatttgagatcttga

SEQ ID NO: 95871 - DNA, 507 bp, Glycine max
  Peptide Sequence Number=SeqID_212649
atggcagatcaggaaaatgcacatgaagaaataactcatggtcctggctatactccttcatattctcctcttggtatcactccttcaccttctactactcatgctcctttagcaacaccaaatgaatccatagtagcacatgaagtagaagaaacaaccgataatttggaggggacaacagaaaaaagaacaagtaggcttaaaaataatacaaggaaagagcttgcaaagaaaattattatgaatgagtatccactatcaattgtggaacatgttggttttaatagatattcaacatctttacatcctgtctttcaagttccttggagaaacacaatcaaaagagaaatcttcacgatttatcaagaagagagatcaatagctttaaatttattagatagtcctcaaggaagagttgccatcacattagacatgtggactgtgagcaataaaaaaagggctgctcattatatagatagatcttggaccttaaaaagtcaaatttaa

SEQ ID NO: 95872 - DNA, 363 bp, Glycine max
  Peptide Sequence Number=SeqID_212650
atggaggaggaagtcttggagaaatcttctttgtggtggagagacttgtgcagaacttgtggaggaatgaatgaaggggataagtttatgttttggagggacaaatggcttagggatcaattgttggcatataagtatcctagggtttttctaaactctaatcataaggatgacatcattgctaatggagaattagaggaggctaggttgtgcaaggatattactgattcgtggtcttggaggcttaactattttgcatcttactctatcaaaaagggagatgtcttatgccctttatatggaagtgtggaggagtcattgatgcatgggctatttttgtgtcaaagctcagatgaaatctag

SEQ ID NO: 95873 - DNA, 115 bp, Glycine max
  Peptide Sequence Number=SeqID_212651
atggaagctgcttggaaaagtcgactgaggaaaaaggggcacaaagtcttggccttagctttgcaaagtcgtgctagtgaggtttctggtgtggacatttcatccaagtatcctg

SEQ ID NO: 95874 - DNA, 351 bp, Glycine max
  Peptide Sequence Number=SeqID_212652
atggcaatgaaaagacaaaaagttaggaggagctcctccggcggctactcttgccccgtctcaaaatttcacttctcctcaaccattccttctccaggaagcttccacctctacgtaggtctggaatgtccgtgggcacactacaccctcataatacacacgctaaaagggttagaagatgccatgcccgtctcgattgcatcatcagacctcaatgggtcgtgggagttcaagcggccactgtgtgtttcaagagtggatcgaggagatatgatagagagaaagggagtgagagtgattgtttattggtgtgttggtatgaatcccgataagatgaaatgcttcaattaa

SEQ ID NO: 95875 - DNA, 1689 bp, Glycine max
  Peptide Sequence Number=SeqID_212653
atgggttgcaccatgagggaaaagcatatcagagctaatcggagaccccgatcggtgaaaccggactcggattcttgcgacaaagatgccatatccaaatccatagcggagtctggtcttaagcccttcaaataccatctggatctcaacgattcttcccagagtccgaattcaaaccctaatgtagaggaaaccgggtggggttactgtacagaggaacaattggaagagattctgttgaaaaacttggaatttatatacaacgaagctgtgtcgaagcttgttgcgttgggatatgatggggatgttgctgttaaggccatactgcgaaatgggcattgttatggtggcatggatgtgctgacaaatattttgcacaattccttggcttttttgaatactaatagtgatggtgatggtggtggttatagtagtaatggtgggaatttgcatgagtctgagcctgtgttctctgatttgaggcagttggaggagtactctttggcgggtatggtgtgtttgttgcaacaagtgaggcctcatttgagcaaaggggatgccatgtggtgtttgctcatgagtgatcttcatgtcgggagggccagtgctatggagattccggtgccggacaatgggagcactgtgccggctaccggtgagggtggtgccaattcggctggtgttatggcgccggctttgtgtaggtttcatggggggtggggatttggaaatgggggaggcttggaatttcctgtgaacgggatattctcttgtggtgcagagatgaatttgcagctgcaacgagacattgagtttccgaagaggttaaatctttctccttcgatgaagtccttattgaagagaaatgttgctatgtttgctgctggttttagggcgaactccaagcaattgcaggcgcaggtgaaggcctttcccggccggagtactgcacctaatttggattctttggatgtgtccgggacagaagtcctggctgagcagtccggaggagattcagagaatcttgataaccaagatgctgtgaattcggtgctgagtaaatttcgtgatttgaatcttgatgagaatttggacttagttgccgaagatcagaaggatgaggtgatagtctctttatttcatcagattagggatcttgagaaacaggtcaacgagcgaaaagattgggctcatcagaaggcaatgcaggcggcaagaaagctaagcagtgatttgactgagctcaaaatgttgcggatggaaagagaggagactcaaaaattgaagaaagggaaaccagaacttgaggacacaaccatgaagagactctcagagatggagaatgccttgagaaaggccagtggtcaactggaccttgcgaatgcagctgtgaggagattagaaactgagaatgcagaaatgaaagcagagatggaggcttccaaattaagtgcatccgagtcagtgacagcttgcttagaagttgcaaaaagggagaaaaaatgcttaaagaaacttctagcttgggaaaaacagaaagctaagctgcagcaagatatttctgatgaaaaagagaagatattgaagacacaagaaatattggttcagattagacaatgtcaaaaggaagctgagaccaccaaaaagaaaagaaaacgtggttttgagcatttgcctatgtttgcatag

SEQ ID NO: 95876 - DNA, 348 bp, Glycine max
  Peptide Sequence Number=SeqID_212654
atggacgcagttgagtggggtcccaaacttcacacgtcatcctggaaatgtgcctttgacaagaggggagacttgcaaaagaaaggactccgacactcaagggatgttgtagcctttacagataattcccagattatagataatagcctagagcttatagataatgttagagataaacatttgcttatagataaaaggatgccacttgtattttgcaagtcctggatagtacataagcccccaagctctaagccgcttgcaagcgaaagaggttttctagtgccgaaggagtttgtcccatgtcgagggagtctatctgatctccagggcagtagtcttgacaagtag

SEQ ID NO: 95877 - DNA, 474 bp, Glycine max
  Peptide Sequence Number=SeqID_212655
atgactaccctgacccagatagggatgacactgctgctcagcaatgtcttgcttagcggaccacaactccgacctccctctgcctatgtgctagttggtgtatgccatcctgacacggatgagcgttcatgtggcccaagaatggcgcctactgggcaccctttggacccagagaactccaagagggccctggggttcccggctttgatcacatgcctttgccagtactacagagttcatgtcactcctagcaaggacgcgggcgcaccgtcaccacctcggcaggccgattcggctgggccgccgagcacggagcggtatctacagcatttggttcgccagcaggcggccaaccaccgtggacaggtgcagatacatgagtttctctaccggttcagcctcagccaacaggggcagggttctgccctttttgtatgccctaccccggagcagtttggggctgaggtcgcatga

SEQ ID NO: 95878 - DNA, 420 bp, Glycine max
  Peptide Sequence Number=SeqID_212656
atggcgagtggcatgtgtgcacgagcaccctaccaagcctctagtacatgtcacccacgacatatgcgctcgagcatcctattaagcctgcagtgcatgccacccacggtgagtgacatgtcgcacgagcacaataccgcatctccatacgtgtcacccgcagtgaatgacatgtatgcaagagcgtggtacccaaaacccaagtcagacaatcccctggtccatacttcaaaggacttgcaaaacccatggtccgcccttggtgagtcctatcgattcacaccaccatgtctccagtacatgccacccacaatgagtgccatgtatgcaagagcacaacacttacactacacacgagacttatcaaacccaagctccgcgcttgctgatccttataagtccaaggcctgtccttggtaa

SEQ ID NO: 95879 - DNA, 1184 bp, Glycine max
  Peptide Sequence Number=SeqID_212657
gtgttgtccgggctatttttgtcaagttgtctgtgatggacatgttctttggcatgtcaggtaaggcatatgtgatgcacgcgcagtacacttgcgtatgtgtcactcatagagtgggcacatactggagtggtggttcgtacgtactcccctttaccataatgtcttcctttctgtctgattttgccatcggtctaggtgacattgactctaggggatcgattaagcaacccatcatggatcgggaggtcatctcgataggcagttcctcatttgaagatccttgccgatgtgcctccgatatcgagtcgtcctcttcggaaagggagaggtacaacgatgaagatgtaagggcgtctccccgtgtgcgacatagccaaagtgttgggtcactgtcgtccaccctaaccattgtgaagctggtgaaccctgaggactcttgtaagctgtttgaccctactaggttcaagttgtatgacgaggatctactgatacttgtggagaggatcaacaaagctatcatgtctcttcatttggcgagcgatcctctcgctgccttggatggtaaagcgcctaaccttgccctcatttatgccactcgtgaagcaggtcagacctacaagtggaactgtgtcactgtcacccccaacgttccttcctctattttggcaaagaggaagagggacgatgatgtgttttcggttccatcgaccgttaagactcctgccattaatgctactgctcctactactcttgcttcttcacctcctccgttttttgttgttcaggaggttacccatgttacttttgaagctattgtgtctgccactcaggctgacattgttgtggtgttgtcgtccaccttcgcgacaccgattctcccacggggtgcaacttataagctggagcagaagaccccgattggctttgtgtcaacctttgacaagaaccttattaggtcgaatggagtgcagaatgctattggttttgccaaagtttttctccaaaggagtttggaaattttggaggagaatagacaacgacaccaagagattatgcaaatgttggcatccttggaggcagaggttgctaagtggagggctattgctcatactctttggtcaaaccgtgaattgtctttcaaagttggtggtgtattgaccaagttgttgcacactgattag

SEQ ID NO: 95880 - DNA, 123 bp, Glycine max
  Peptide Sequence Number=SeqID_212658
atggcttggagttggaaaagatatttcaaaagatttaaggagaaaattgttcatattacatgggaaaggcaacacattgagtgcaagttttttgactggagaaaaactgcatgggaagaataa

SEQ ID NO: 95881 - DNA, 426 bp, Glycine max
  Peptide Sequence Number=SeqID_212659
atgtgttcgacccacgacgagtggcatgtatgcaagagcacgatgttcaaaacccaggtcagacaattctcgggtcaatcctttgatggttgtgaggagaatacaggcttatcaaaaacccaaggtctgcctttggtacaaaaatacaaggtttgcccttggtgcacacttctacaaaaccaaagtcaagggtccaaaagttccaacaagcgaactaccacgccattatttggtcaagatgacctaccacccgattgcatgacgagaccttcaatcaggtgtagctcacgcttactcctcataaccattagaggaggaaagcagcaggtcaagcgaactatccctatactggttaggaaagaccttcaactaggggcaattcaaacacaacccttcacaaccatcaagggagaagctccacaatag

SEQ ID NO: 95882 - DNA, 771 bp, Glycine max
  Peptide Sequence Number=SeqID_212660
atgaaaaaatctcatgtcatcgtaactgatagtggttgcacaagagagcagcagtggaacaacattggcgacggtggtggtggcacaagggagtggcttgtcatgattgcgagggagcacactggtggctccgtgattgcacaagggagtgacatttgtggctcaacgggcagcggtgaagggtggttgcaaaacgaagaaaaagaagaaaccaaaggaataaaaaatgagagcagggaagaaaatggaaaaggaagcaaaaggaatgagaaaatgaagaaaaatgaagttggaacattggggaaggggaaggaagattttggtgttgggatgatattttttgtttttaactatggtaggtggtgggtgagaggtgctatttccactccacttctttgcaaaaacactccctctttatttttcttttccaagaatacccaagtaaatacactacccttcctaactctccacgacaaaggcttctccatcactgccttcgacaacagcacaagaacaggttcagaggagacgagacggtggcacacggcaccaacaacccttcctggcttggtggttgcggcgatgggaagaagaacgagtcaattaaccaaagcgacagagttttgtgagggttccgactcctccagggcaattccaatagcgtgcgttgaggtcatgttgttgcggtcgcagttacagaacggagaatcatcaacagaagtatcatcgcatctgtttacaatttttttcctcaaataccctagaaattaa

SEQ ID NO: 95883 - DNA, 243 bp, Glycine max
  Peptide Sequence Number=SeqID_212661
atgtctcgcgcctcctccaccaaagattcttccacctttggtgagatcatgctattcagagtcagatctcattcaacaagcaagttgggttacacacgaatgcaagggacaacgtcgaggagaatgacaacgacaatgataatggacacaaggagtttgaggaagacaacgacgaggatcggagaagatggaattgcgagctacttcagcttcagattagggatttggcgactcgctcgatga

SEQ ID NO: 95884 - DNA, 249 bp, Glycine max
  Peptide Sequence Number=SeqID_212662
atggagagtgacgacggaggaaagagaggagcaccgctggcatcaatggccgtgttgtggaagccttgtcaaaggcgaagattgcgtcaaaaagcaaagtcatggcgtgcgctatatgccgatattggtcttgcaatgggtatccaaggtatagaagttgctaaagagagctctgatatcattattttggatgacaattttgcttcagttgtgaaggttagtcctcatttcttatttgggagattttga

SEQ ID NO: 95885 - DNA, 594 bp, Glycine max
  Peptide Sequence Number=SeqID_212663
atggaaatagattgtagtggtaatcaaaaccctaattgggaaggatttgaagaagagatcacctcgcaacaggcaggctatagggctggggcccactgtgagtcgcctcacgactgtgcaagatgtgccttcggctccacgaccaccaagtctccagctactattgccactcctactactcccgctcctccaccttctcctccgactattgttcaagaggctgagtctattatggtgtcatcatccaccgtttcggcccctttactaagtatcaatgtggcaaccactagtactcccatggtgttgccttcttcttcgtcagttctgatgatcctccctattgctgctttgcagaagaccccgactagctttatgtcagccttcgataagaaccttattaggtcagctggggtgcagaatgctattgattttgccaagcaccctaaggtggccaatgccaccattgcttttgctgaggccataagggcaaactcccaactggcttccaaggttagtggtgcactggccaagttgttgcgcgcccagctagatggtgatgacttgtttggatgctgcaaggacttgcaggcttag

SEQ ID NO: 95886 - DNA, 378 bp, Glycine max
  Peptide Sequence Number=SeqID_212664
atggaaggggttggtatgcatacagcagaagagaaaaatcccatagagaattttgatgactatcttgataccttggaggacatacttgctatttctcatactgacgttacaccttttgatcatgtgactcctgctacctctatggataataaaatgaagtgttgcaagaagaagttttcttcttttcttgctgtagacttcctttctttggctaaggggaacattaaagaggtagacaaattgttaactgatctagaggaaaagaaacttaaagtttccagtctcaaaaacgagtacattgaattgaaagacaaagtaacacagagagaggctaaaatggatggattggttttaaacatccaagaaattgatgattaa

SEQ ID NO: 95887 - DNA, 1494 bp, Glycine max
  Peptide Sequence Number=SeqID_212665
atggagatggagatggagatggagatggaggagaataatggattattgaatttacaggcagtggcaccggaaatgtccggcgagggatttccatatgcgccggaaaattggccggaagagggtgacatttggggatggagaactgggcggagaattgtcgcaaatcgttcccgctttcaggatcggtatctgtatctgccaaatcgactaatccgtgccttgaaagaggagaaggagaaggagaacccagggtcaggggctgactcaggcccaagttcaagctcaatccgaaggcaacagcacatctttgctagcaagcttgctgttgaacgctacatcaagacacattttcctgatgcggatattgatgccttttttgcttccttctcctggaagattcccgctctacgatccaatggcaatgcagttcctgtagctgctgtacctcttcaacagatagcacaagaagcatatgactccgactctgagggcgttgtcaagtgtaaagcaagaaataagaagtgcacaagtctggtgttagaagaaatagaaaaatattcaccggccatgccttgtgatatctgctgttctgaacctgggttttgccgtgattgttgttgcattctttgttgcaaaactgtttcttcagcttatggtggctataattatatcaagtgccaagtgaacgtaggtgggggcatctgtggccatgttgctcatatggaatgtgctcttcgatgtctattggctggcaaagttggaggaagtattgggctagatgcccagtaccactgccgacgctgtgatgggaggactgatatgatttcgcatgttaataatcttatacaaacatgtagagctgctgatttggatgctgaaattcggaagaagattttgaatcttggtgcttgtctcttgcgtggttcacagaaacctgttgcaaaggagctgctgtgtcgtattgaattggccatctcaaaggcttatgaccaatttgatagtttatatcagcttaaatgtggaactaatcttgaagatatctggaaggaggattacagttttgtagctcattctgcagataacggcaatgatgtgatggaagttatggtctatgatgacccttttgaagttaggacagggttggaatcttatgattttctacctcgttcattaaaacttgagtctgaagttgatcaggttctccaggctcttagaaagtcacaggagcttgaatataaggtggcagaagaaacacttcaagaccaaaagacttacttaaaaagattgtatcagcaactggaccgtgagaagtatgaattggcttgtcaaaactcatctacctcagatgtctcgtctagtgctgtaagagaaagaaagaaacagataagacgggaggtggcaaaatttgaaatcatgaaaaaagttgccaatggttttggcaggacatccaatgatattgtaaaggaacactttggcttgaaagtgatagactga

SEQ ID NO: 95888 - DNA, 783 bp, Glycine max
  Peptide Sequence Number=SeqID_212666
atgactgtatgccagacgacacagagcgggagcattcaggcgaataatctggaaggagaatgtcagatgctgagtttacgttcggtgaatcaattttacggtcagaaccatattttatgggatgtggatctcgatctgccgccaggcacctgcaccggcgtgctgggcagcccggggatgggcaaaaccacgctggtgaactgtattatgggtcgcctgcccattaatagtggatcaatgacctggcaggaagacggcgcgccgccggaaaacctgctgctgcagcctgctgagcagcgcgcgcgcatgggcatcggctacgtaccacagggacgccacatcttttcccagatgagcgtggaagataacctgctgattgcgctgatggcggcacaggacgatcgcagccgcgccattcccgagatggtgttcgatctgtttccggcgctctactcgctgcgtcatcagcgcagcggcgaactgccgatggatcagcagcagcagctggccctggcgcgcgcgctggtgctgcagccgaaactattgatcctcgatgaacccaccgaaggcatgtcgccgtggctggaggaggagatggggaatctgattcgccgcctgaaccgcgactatggcctgacgattctgctgctggaacagcatgtgtcgttcattcgccgcgtagcggactattttctgctgctgcatcgtggccgcaacgtggcgcagggcagcgtggcgcagctggatgatgtaacggtgagtaagtggttaacggccacctag

SEQ ID NO: 95889 - DNA, 592 bp, Glycine max
  Peptide Sequence Number=SeqID_212667
cgccgcgggattacgcactgctggctacaaaccggtggcctccggctgcgaggtcacgcccgacggcgtacgcaacagcgacgcgctggcgctgcagcgctacagcagcctggcgctgagctatgagcaggtgaacccgctggcgttcatcgaaccgacgtcgccgcatatcgtaagcgcggaagagggcagaccgattgaatttgcgcagctctccgctggcttacgcgcgctggagcagcaggctgaatgggtgctggtggaaggcgcgggcggctggttcacgccgctgtccgcgacgcaaacctatgccgactgggtcgccgccgagcagctgccggtgattctggtggttggcgtgaagctcggctgcatcaaccacgccatgctgacggcggaagcggtgaaggcgcgcgggttgcgcctcgccgggtggattgccaatgacgttcagccgccgggtaagcgacatgcggaatatctggcgacgctgcaacagcgcattgcggccccgttcctcggtgagattccgtggctgagcagcgcggcacagcaggccgactgtggccgttaccttaccctgccacagtaa

SEQ ID NO: 95890 - DNA, 857 bp, Glycine max
  Peptide Sequence Number=SeqID_212668
cggaggtatttacggaagccgtcgtatccctcgcccaatactatgaccagccgttgaggtgtttcacgtttggggacttccaaatggtgccaactattgaggagtttgaagagatattaggatgccctctcggggggagaaaaccgtatcttttctccgactttcttccttccttgagcaaggttgcggctgtgattggagattcagcaaaagagttggatcgcataaagcaaattcggaacggcgtagtgggcctgcctcggaaatacctggaagacaaggcaagggatatggcaagccaagagaagtggggggcgtttgcggatgttttagctttgctgatttttggggttgtcctctttccgaacgttgacggcttggtagacttagccgccattgatgctttcctggcatatcaccatagcaaggaaagtccagtgatggctatcttggcagatttgttcgacacctttgaccggaggaagagtcgtttgggaccaacatttggctgggatagggggcagcacgatcaattggttcctcgttggaaggaaggcaaggaaggaagttcttttctcgtgggagcaccaaccgaagaaagtctctcgcctttccttgtgagggatctaggcgcgcaaggtctcaagggcttaggttggctctccaaattgaaatttgtcgatgaggagaacttcgaagctccggaggaagatgaagaagtccgagctctaaagttagagttagggaaggcgagactcgccaaggagaagttcaaatcagctgctacacacattcggaaggagtgcaccgagttacaagaggaaaacgcggccactgcaagaactcttgaacaataa

SEQ ID NO: 95891 - DNA, 280 bp, Glycine max
  Peptide Sequence Number=SeqID_212669
atggcaatggctgataatgagagtggaagaagtactgggaattggaggaaaaaaatggttgttttggttgaccagctgagggggtttcctagtttggcttgtaagaatatgtggaagatggggcgtgatgatccaagaaggctcatccatgctttcaaagtaggtttctctctcactcttgtgtctttgctctatctcttggagccaagcttccaagggattggagagaatgtcatgtgggctgtcatgaccgtcgtcttagtctttgagttcaccgcag

SEQ ID NO: 95892 - DNA, 648 bp, Glycine max
  Peptide Sequence Number=SeqID_212670
atggaaacaatgtccattatagatgtcagcagtatcgtgttgatttatggtgccatcatatccatgactataagcaaggtcaccatcaagaagattaagaccccattgcaaaatagggaaggtacctacaaaaggggccctaacgctcaaactcaagcattgggatgtcttataaagaaggtccctgactttgacctttttgatcattcgtattcttcatcggaggaggttcctcgcaaggtctctaacagtgggtcctcctattttgagaggttgatggacttcaataatatgggcgagggtagtttcgggctacacgtggggatggaacctcccatggctctgacggaggatcaaccttcccctcttatggcaatcatgcccccaccccctcgggagaatccagtgaccaccgaggctgtggaaagggggaataatggtgaagttagggtttcaccgaggaataggtgtcgccaccatggcaaaacaccttcttctcctctgtgcattattgatttcaagtgggtgagggatgacgttttgaagtttcattcgttgataacattccccttgtgcgttggtgccttatggcatcaacctgagttggcaaaacctggtgacgcccgtaaaatgaccttagttgcttga

SEQ ID NO: 95893 - DNA, 171 bp, Glycine max
  Peptide Sequence Number=SeqID_212671
atgatgaaaaaactgaccggcagtggtgaaagtgatgacatcacaatggtgagagttgtgagtgacaacaatgacaatggtgacaatcgcgagtcacaatggtgggagtgctcaaatgctctggtgaaagggaggtctgggagagtgagcttgaggctctgccgcctttga

SEQ ID NO: 95894 - DNA, 2256 bp, Glycine max
  Peptide Sequence Number=SeqID_212672
atggatgactcgacaacatcctttcatcgatcgaatctgaaggggagccgcattgatagcttagacacccttgttggccgcttcagctctcaatatgcaacaagtcaatcgcaccacatgacttctgctgccctagctagtctatgccaggcagaggatgagccacttcgcaaatttatggacatatttggttggcttgttgttcaaattagagacctcaattctaaggctggacaaaaccacgagaaaggagaaagtagcccaaggattgacccatacaagtatgataagcgacacaagctagataagcgtcagccacttcaaagaggaccaagatatgaacgttatacacccttaacgacaaatcgagccaacattctcaagccagccttcagtgctgaggttcccatacaattacctccccgtacctcccccagacctgacaagattaaagaacttatacaagcaggttacctagcccgactcttgaaaaaacctaataacaataagactggaggactacccggagggtcagggaaaaatgatgaccatcacaagagaagagacaacgaacaagataggagggatgaacctgctcaacagattagaggcatgaacactatcacaagtggattttcccatggaggactatccaagccatctcggaagcgtcatttccatgccatcaaaggtcttgatgtcaactatgtcaacgttaaaccgctgagaagtcttccttttataaccttcacagatagatatttcaaaggcatcaaccccattaacgaagatgaccctatggttgctctatcgcttgaaatgtcacccaccatgattcaaccacactacggaccaaacctaggttttgcaggagagagtagaaaccaaaggttacgtggacttgatgatcaacttccgaaaacattcaatgagcttggagccatagtcacgacaccatacctcaaaatgaagttccctaccttgacaggaaaatttttcactatcaaggcatactggaatcaagtcatgagcattgtcgaagaattcacaataaggaccttgaccctctatgagacgataattggaaatcatagtgacacatttgacgtggaccctcaagatgataccattgacaaaggcccaaaaccaatggaagaactcgtcaaactacagcttgcacctaagtttgggcaatgcacacagctcaacaaagacctcattagccacgagcacagacctatagctgaagccaaaccagtctcacaaaagaaaaggaagatgggagaagaactacacaaagtagccagtggagagattgacaagctgcttaaatcccagttcccggatgcttatttagggtacaacaaaatcaagatgcaccctctagataaggaaaaaattgccttcatcgttgaagacgccgacttctattatagggtcatgccttttggactaaaaaatactagagctacattccaaaggatcatgaaccaggtcttcaaacatcagataggtcagaacgtcaaggagtttgcggatgtcccgcatattcctgctgacaacctccacaacttgggctttccttggccttttgccatgtgggagatggatatactgaggccattgccaaaagctccaggacagaaaagtttacatggaagcatgtcatatgtaggtatggactcccctatgccattgtcactaacactcaaattcaaggcccaaacctatgaagaattcctgtcaaggttaggtgtcaagtacctagtaacctctgtcgagcatcctcagacaaatggccaagctgaggcatcgaacaaggtcatctttaaagccctacgcacgagactcaacaagttcaaaggcttgtggaaggaagaactccctatcatactacgagcctacaagagaaacatgttccttgtcaaatctccagaggcttgtcaaacccaaggtccacccttggtgagtcttgccaaacctaagataaacatgttcttggttaaatctccaaaggctcatcaaacccaaggttcacccatggtgagtcttgcgaaacccaaaatagacgtgttcctagtcgaatctccaaaggctcgtcaaacacaagatccgtccttgttccttaaagaaaaaacggaagcaccaacaggtgagaagctagaaccagtgtgcacccatatccgtaacatgattattgtgtctgagatgagtggtagcatcactgaactctacaacgaaaagaccttcaaatag

SEQ ID NO: 95895 - DNA, 159 bp, Glycine max
  Peptide Sequence Number=SeqID_212673
atgggtgaaggaatcacaaagagagatctacctaggaccttacttgagtcatggtttgatgatggaataccattagacatgaagaccatcaaaaaaatttgcaagcaatggacaacacaccttatagaagttaaaaacatgcggtttagaaaagtttag

SEQ ID NO: 95896 - DNA, 747 bp, Glycine max
  Peptide Sequence Number=SeqID_212674
atggatgactttgcatgtcggcctttagtgaagcatcttggacctattgatggttatgcgccccctccgtcagtcaatgtcaataaaccctcaagaggggagggagatctaattgaatcaattgatgagactagtattgctacaaccaacattttttatcctcttacccctccaccttcatccaccctggtggtttttgcatctcctccaactacaccgggcactttcgctcttgcccctactgtgttggctcctatttcttctatggcactgcggctgcttagtgcagggttgacaatggcaagtgttgtaacaagcatggctccttcttcctttgtcgtgccaccttcagattccactgtcatatattttgggatgcctttttgctcttcatgtccaaacatttcattagaccagcacccaaggctagcaaatgctactattgcctttatcgaggctgtcaagttgaatcagcagctgtcatccagggtagacgatgtttttgccaagttagggagtataagactagacaatgatgaggtctttggacgctataaagatacattaagagcgaatgatgacttggcatgtgagggggagtgctttgctaaggagagggaagcacttgatgccaccatgacagaatccgtaagagtggcaaagaaggagtttaaggaggagctcataatgtttaagaaagaggtcatggagcagtatgagaaggagttcttcaaggctgtcaagtag

SEQ ID NO: 95897 - DNA, 213 bp, Glycine max
  Peptide Sequence Number=SeqID_212675
atggctggagatgttgattctagaaaatcgacatcaggatatctaactacttttgcaggggaagatatacaagatatgttagaggagaagtttttacagctagagaaggttcacagcaatgacaactggttagacatgatgaccaaggtgataccaactcaaaagtttgaagactgttgtcaaggtgttggtgtggtggtgcccccaaattaa

SEQ ID NO: 95898 - DNA, 533 bp, Glycine max
  Peptide Sequence Number=SeqID_212676
gggcaactttatgcaaaggcctcaacagaggattggggacagtgtttgcaggagcactggcatttgttgttaaatatgttgcaaatggatctggccgcgcctttcatgcttttttcattggaactaccgtttgtattgtaggtgctgcaaccagttatatgagattcttcccctacataaagaagaattatgattatggggtccttatatttctcttgaccttcaacttgataactgtttcgagttaccggaccgaaaatctcttcaagatgatataccagcgcttctacaccatagccataggctgtgccatatgccttctgatgagtctattggtatttccaaattggtcaggggaagctctccataactcaacagctttcaagcttgaaggcctagctaaatctatagaagcttgtgtcaacgaatactttaatggagaaatggaagcctctaatgataaaatatcagctgaggatatatacaaaggttacaaggctgttttggattcaaaaaccactgatgaaactctg

SEQ ID NO: 95899 - DNA, 408 bp, Glycine max
  Peptide Sequence Number=SeqID_212677
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgggaggatagatggggcgattcaggtgagatccaatgtagatccaactttctcttcactcgtgggatcccgggcgatccggggggggaccaccacggctcctctctttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 95900 - DNA, 426 bp, Glycine max
  Peptide Sequence Number=SeqID_212678
atgattcctagagttcatgcagacctggaaatggtaatggctagtaatgagagtagaagaatgataactgggaatttgaggaaacatgtgcttgcttttggtgacaagttgaggatgcttcctagtttggcttgggagagtgtgtggaagatggggcgtgatgatccaagaagggtcatccatgcattcaaagtgggtttctctctcatcattattgtgtctttgctctatctgttggagccaatcttcaatgggattggagagaatgttatttgggctgtcatgaccgtcgtggtagtgttccaattcacagcaggtaccataaatcaagtcattaacttatgcgcctctatttatactcataagcttataagccaccaacaaatcattggtccgaataatacggaactcaaaatctttaagtaa

SEQ ID NO: 95901 - DNA, 759 bp, Glycine max
  Peptide Sequence Number=SeqID_212679
gcattacatgcaagttgggagccaagacattcatgtcacaaatttccatggcagcagtatgtaaaagttggaactgttcttcgtcaatttgggtatacagtggtagccctacatggctgtttgaaaacagaaattcagactccaccatcggttcgagtcctgttcaagaacccttgcacaaagcttgcatcagaagtatcaaaagtcctgatagaacttgccaatagcataaggaaccgtcgccgttgctctcaagaaatactctctaataatctccaagaagccctgcaggacctcaacactgccataaagtctcagcctcggcttttcttaggcacctccaacgacagccaagacactgacatattggccatagccgcagcacacgcagcaggactaagaaaccaaggaaatggctcgctatcaagtgttaaaatagacacttcaaccttgcaagagtgcaaagcacaatgcactgaacagccaaaggaagcagcagaacgaaagatgttgagacaccagctgagtataatcgcaataactagccttgagttctctgaagccttgccttttgctgcctttgcatctttgcttgtggagacagtggcaaaattggaccttgttatagaggaagttgaagaactagggaggttagcacgcttcaaagattacagacacgatgataagattgttatcagttgtgaaacaccacgagttgatgtgttagaagaccatatacctactcgtggagcagaataa

SEQ ID NO: 95902 - DNA, 752 bp, Glycine max
  Peptide Sequence Number=SeqID_212680
gcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagat

SEQ ID NO: 95903 - DNA, 360 bp, Glycine max
  Peptide Sequence Number=SeqID_212681
atggtgagaatgtttagaaatgagttccaaacctggtgctcaaatttcacaatgatccaacgctgcccgctgagacgacatcttcgaaatctcccatcaacgtgtgtgcgccctagcagccccttgctctcctgtggcatctcttcttccttttgccatgctctgcgctccgagaggtttgtgcattgtttcatcttctgcctgagctcccatgaggtgttgaaggaaaacaatgttgctgatataacgtggttggccaatttcaccttctgggaaaagcttcacctcagcctcaacaatgtcacttcacttgagtctttgatcgtagcaggcaatttggaacctcagttgttattctaa

SEQ ID NO: 95904 - DNA, 654 bp, Glycine max
  Peptide Sequence Number=SeqID_212682
atggtggacgatgtcttgctagtgtatgcaattgtggcttctgaactatgttctgctgcatttgtggcttctagactatgttctgctgcattgggaactaatagtggaggatgtcttgctagtgaagttgaagaactgggaaggttagcatgcttcaaagaatgcataaccgatgtcaagattattgtgagttgtgagacacaacaagttgatgtgttaaaggaccataataaaccttctcgggatggcaatgagaatgacatgaaagactctaagtttgcagggatagtgtttagtttgtcatctgtggatggcatattgcattccaaactcaccattactccagggttggaaagacaagcccatgttgcttattcggttggaacaataggcaagaatagagctaatgacaaacctcaacttctctgggctacaattgatggattgagtgcaaccaatttccacgaatgctgtgacttcaagggaccatacaatgaaactactaaacccatcattttgcccaaggttggtggaagtgttatgggtggctttgctgggcctgataccaattctggcattggtgacttaagacaagccaagtctagatcgggattgtcttatgccgagaggatgggaaggaattatttttggtga

SEQ ID NO: 95905 - DNA, 834 bp, Glycine max
  Peptide Sequence Number=SeqID_212683
atgagggatcgcaagtacccaaatggatcaagaacaaatagagccaccaaagctgggtattggaaagccactggtaaagacagaaaggtggtgtgccagtctaatccatccactgtagggtaccgcaagaccctggttttctaccttggtagggcacctatgggggatagaactgattgggtcatgcacgaatatcgcctctgcgatgatcttggccaagccacaccatgtttccagggtggttttgctctgtgccgggttattaagaagaatgtgaaggcaagtgtatcacagggagaacacaagggcaaaagggctggaagcagttccatcaatgggagtgacacctcagtgaaattctctagtgagccattcagcaactctggtgatgcttcctctcaagcaagtcacctgaataaagagagccgttattcaagccctataacttctccgtacaatgtggctccaatgggagagtacaaccaagcttctgtggaaaccaatccttcaaacttctggatctctcctgatatgattcttgattcttcaaaggactaccctccattgcaaaatgcggtggctgaatgttttccacggtatgacttaccaagtgtgatggcaccatggcaatctttggagcatccagaaacttcatctagtttgtcctactcaaatttcaatgtggaagttgattttgctgatagtctcagtcaaattggctgcatgtcaccatactctagacaatggaattccatggacttttatggaaatgggaatgttccttatgatggttatgatcaaactaattcaatctcatatcctgaactcttttaa

SEQ ID NO: 95906 - DNA, 157 bp, Glycine max
  Peptide Sequence Number=SeqID_212684
atgggaggggcaacactaccaccaggatttcgtttccacccaactgatgaagaattagtgggatactaccttaagagaaaagtggaggggcttgaaattgagcttgaagttatccccgtgattgatttttacaaatttgatccgtgggaattgccgg

SEQ ID NO: 95907 - DNA, 663 bp, Glycine max
  Peptide Sequence Number=SeqID_212685
atggcaacagacgttagcgggggtgatggtcacacttcacgcaccatcagggatctagagtttgcggctcaaggatggcaaaggagagggaaggggatgctactgggattaagggcatgtttgtccattcactttttctacagggtgcatggaaaaaatggggctgcaggaagagctactgcaacaacaacagcattaatcaatctcacgcgcccttcacactcctccaagcatcgccacttctcttcaaacaatgctcccttttctatccaaccctttcattccggattctaccacaaccgtcgtttaaagccaataatcaccaattgccatggcaagctgaatagctcgggtgggggatacgcgatggatgaagcgggttttgatgagtacgatggagttgaagacgaaagtgatgacgaggacgatgcagagagtagcgtggatttgttgatcagattcttgcagagcatgtttaaaaaagtgtctaagagggcaaagaaagcgtctcgctctgttttgcccactgtaatatcgccccagctcgtttcttttgccgttgatgggactctgctacttgcttcactttctgttgtcaaagcacttcttgaggtattacttctcattactgaatggcttaaatgggaatttatggctagttga

SEQ ID NO: 95908 - DNA, 318 bp, Glycine max
  Peptide Sequence Number=SeqID_212686
atgaatgagaggagaaggcatcaacaagaatttttgagacacactttgtataggcagtcacttctcaagcaacaatatagatccaaatggcttaaagaatgtgattctaactcaaagtttagtgaagaggattggaggaggccatgtcttgatggggtgatgtttaagaggatcacatgtgtagataatattatgttgattggtagctttggtgagatggaaattagacagacaaattgggagtgtggaagtgcaaagagttcgggtcccgacacggttacgtttttagattcattaaaaagttttgggagactttga

SEQ ID NO: 95909 - DNA, 306 bp, Glycine max
  Peptide Sequence Number=SeqID_212687
atgggtggtagtagtagtagtggtagtagtagttctttccctccaagtttctttaaagcacttcttgtggtggggcttgtttgtcttcttgttttgggaagcttaggtagtggtgaaggaacaagacatccaactacacaatggtctcaagaaagggtcaagcatgaacgagtggttggtagagataagcctgtggacagtgcagaattggatttcaactacatgagcaaaagaagagttcccaatggaccagatcctattcacaacagaaattcaagtgtgaaagagaaagaatgtgcaaactaa

SEQ ID NO: 95910 - DNA, 207 bp, Glycine max
  Peptide Sequence Number=SeqID_212688
atggagatgcagaaacggaattattttttgagggaaaacaagtggacaaggaacaattatgacaatcttgtatgttcacactatggacttggctcaaagcatatcaaaaggacttccagtactcttatcaacagtggcagaagctgggacttggccaggcaaaaattcgaagacacatcacatccctgctttggtatcataaattga

SEQ ID NO: 95911 - DNA, 270 bp, Glycine max
  Peptide Sequence Number=SeqID_212689
atggtcgttgagtttgagaggttgttagagggtgtagcgattagaaggcaagtggaggactgttggtgttgggtggaggattcatcaagtatgtatatggtgcgatctacttacacagtattgtacaacttgaggcacaaaaatgctaagctaattattctatttcctcaacaggtcctagggagcaataacaaaatgagtaacagaattaggattctagcagacaaggatcttctccctccaatgacaggttgccagctcagcgcttag

SEQ ID NO: 95912 - DNA, 786 bp, Glycine max
  Peptide Sequence Number=SeqID_212690
atggatgaagtaaaggaggtacaagagcggatgaaggtcaacatggaggccctgaaagagcaaatggccacgatgatggaggccatgatgagcatgaagaagataatggaggtcaatacggctgcaattgtcgcttccagtgtcattgctgaggtggacccgattcccccatttggcctcaaccaaataaatcatcccatcttggatatggtagggcagaaaggcaaagaattaggaagtacgggcggcctctattttgtgcaagttcaaaacaagcatgccttcctgccatatggcttgcctcccaattatacaccacctaatgtggcgcacactcctaatgagaatgtcaataactccactcccatactcattgagaaccaacaacctcaatctgatcatgcacctatccctcaacccatggggggcacacatgaaataccccaccacaatctagccaacttcgagccttgcctcgaatacgccattgaagggcaagtagttggtggtgtacccctaccaaacactttggagggccctcagtttttcccacaaacacaacccttgcattttgcagtgggaagagccctttctgctatgcctgaaaaagaaaagttggatcaaatagaggaaaggctaagggtcgttgaaggaggcaaagattattcccttgctaacatggaagatttttgcctagtacccgacgtggtcattcctctgaagttcaagccggcacctagtacactaatctggaacctttccgagtccattcttggaaggacctaa

SEQ ID NO: 95913 - DNA, 258 bp, Glycine max
  Peptide Sequence Number=SeqID_212691
atgtcgaacacaaccacttcttccggaaagtttccggaagaggtgttccgggagtcttctggaagaagtgttcttccggaagacgtttggttacttccggaagaacacttcttccggaaactttccggaaaaggttctttcgaaacttccggaagaactcctaacgggtcttccggaagactccgccgtcagccattttccccattttttccggcgtctcctgctctcgtcttctaccctaaggttccgctaacctaa

SEQ ID NO: 95914 - DNA, 590 bp, Glycine max
  Peptide Sequence Number=SeqID_212692
atggggaaaatggctgacggcggagtcttccggaagaccctaaccaaacgtcttccggaagaacacttcttccagaagactcccggaacacctcttccggaaactttccggaagaagtggttcttccggaagaattccggaagaactttcaaattttcggaagaactttctggaagaagtgtttcttccggaatgattccggaagaaccacttcttccggaaagtatcatggccagaacacgaggtttaggtcgtgccataggtagagttgtaggcagagatagacctgctgacgaggatgctgccgatgttcccgagaggcgtaggcctactgcctcagtccgtaggctacgcgttcatcagatgactacggagggacgtgatatggctgaggacgtcgctgacatgactgacgatgtccctgagcagcctacggaggcacctgagatgcgtgcagacgcacagggtgctgatagtggtgaggggcagatggtgatgatgctgctgagggattcgctggtggtccacgtgacccgtcagtgctcacataatttgccgagcatgttgcacatgccgtttggagtggacat

SEQ ID NO: 95915 - DNA, 231 bp, Glycine max
  Peptide Sequence Number=SeqID_212693
atgtcaacatttgcagcaaatgtagagcctataatagagacatacctagaggcaattggtttttggaaagctgcacaagagaactatcctgttgttcctttgccagataatccaacagtggctcagattagaaacgggaaggaaagcaaagctagaaatgtacaggcaaaagctagaatattttttgctattgaacaacaaaattcacttggatcagcattgggaatttga

SEQ ID NO: 95916 - DNA, 357 bp, Glycine max
  Peptide Sequence Number=SeqID_212694
atgagtttttggggaacattagaggcaaagactggaggattcagaccaatgtttatggtaatggaagcatcgatattggtagagaggaaagatatggcttatggtttgatcctactgaggatttccatcagtacaatattctttggacaaattctaagatcatgtatgtatgatgcaatctatttgaatcccacatgccatatttggttattacaacactttcaaccacatggggagaaactccagaatattggacacttggctaatacttgtttgaaggatatagaggcaccattaaactttgacaactcaatggtgacagaggatgaatctaatctagtgatgacatttgactag

SEQ ID NO: 95917 - DNA, 393 bp, Glycine max
  Peptide Sequence Number=SeqID_212695
gaagaatttgaggctagactatctcaagctaggtctaatgctacatcaagtgttggtgaatcccaagtcactcccttagaccctactgaagaacaaagacttaggagttggtgttgggttgcagctgtaggaccaaagcataagggacgcctttatggtattggagaccttgttgatacttacaaatgcagaaatgacagcttcatgcagcatacgcaaggatcttccagttgtgctgaagatgctacagagattaaccgcccgagggaagagctgcatcaatcaaaagaggatatgcgcgtttttcagtcagtagtccttcagctcctacctctagaggcacagaacattattcattaccaacaacaatctcaccaacagcatcagcactag

SEQ ID NO: 95918 - DNA, 444 bp, Glycine max
  Peptide Sequence Number=SeqID_212696
atgcagaagacaggtggacaaatgaagacatgtgatgttaaaaatcgcatctttagcagaagacgggttccgtttatgggtctatgcacctacggtgataaaaatcgccattttgttgagataaaaatcaaagctttagtgtgttgttcgaccttctctgcgaaagaaataacatgcaatataagtttaagcaaaggaacatcagaaaggtttgtaggagatcaatataaacgcaaccgtacctctaaaaattcaaaaattgaagctttagtgtgttcttcgagcttctctgtgaaacgaaaatcatgcaagaaaagaaacatcgcagctttagtatgtgcgtccaccttctctgctaaacaaagaacacaagaagcgaaatggcaaaaaacaaaaagaaaaaacgccgaagacgagtgggcaaatgaagagatgtcatgttaa

SEQ ID NO: 95919 - DNA, 201 bp, Glycine max
  Peptide Sequence Number=SeqID_212697
gtagggaggggtaattctaagattgctccattcacacatgacacccacactgtttgcacacactttgagatattaggccctatacccggtgatgcaatcctccctaggaagggaccaatcactagaaccatgaacaagaggctccaagaagattgggctagagctgctgaagaaggccctagggttctcatgaaccttagg

SEQ ID NO: 95920 - DNA, 306 bp, Glycine max
  Peptide Sequence Number=SeqID_212698
cgtcatccatatctgagtcagagtagtcatgctggtgtgcataatccacacccgcctccccgcagcggtccgggcaaagtctttccccggtatgcacaacagctgggcgatggcctcctcgtcaaagccggaggcctagtccctcctttggctgaatttgcaccgatggtcctcctccaagatcagtgggtggcccaagaattggctgagggcatctgtgccaaagggaatccactgaccccttacccacgagcgcatatctcaaactccctcctccgtgggccaggcattagtgtagaactctag

SEQ ID NO: 95921 - DNA, 174 bp, Glycine max
  Peptide Sequence Number=SeqID_212699
atgtgcaatatagtctccaagtgtccttctaggatgttcttctcccgccatttcaggctcctcaaagataggaataggcattgtttcttctacaagttcttcgaatctattgatccaaagggactagatcttcttaagaaactctacctcacatacatggaacaaagcaactaa

SEQ ID NO: 95922 - DNA, 294 bp, Glycine max
  Peptide Sequence Number=SeqID_212700
atgactagagatcaagtacaaaagatgataggtcaagcaatggacttcttttttcaacgacaaaggctagaaaatgaccagtttaggatatcaatgcaaaacaccatcaccacacaattctctaacctcgatggtgttctactccagaatctacaggttcaaatgactatgttaggagttattgctgcccttgcaccccttgctcttgttcaccaaccaccaccccctaaaccaacaccaccatatgttgaaccaacaccaccaccactatctccagcaccacctcaagtttaa

SEQ ID NO: 95923 - DNA, 408 bp, Glycine max
  misc_feature (397)..(397): n is a, c, g, or t
  Peptide Sequence Number=SeqID_212701
atgcaattcgaatcgcaacagaatttaaatttccaaattgggaataaaaggagcaaggaaagagtgatagataaagaaaaccaaaaatcaggatctcaagtaacacaacctttacagactagtttgaaaattgtgacaggcattcaatttaaagcatccaaaaggccaacaaccacaatgcccaatcaaaacacaaaattgaaaatgggaataaaaggaggtattgacagtaggttgagtcctccaggatctagcaaggaaagagtgatagataaagaaaaccaaaaatcaggatctcaagtaacacaacctttacagactagtttgaaaattgtgacaggcattcaatttaaagcatccaaaaggccaacaaccacaatgcccaatcaaaacgcanaattgaaaatg

SEQ ID NO: 95924 - DNA, 342 bp, Glycine max
  Peptide Sequence Number=SeqID_212702
atggcttacacccacattccggtgaaagttgaaaatcctggtgagtcattagagacatctaacaacagctttcaaaattgccccatgtgtggcatctcttgtcaatgtcatgattcaacaagcgattctcctcaaatttcagccagcccgtatcaattagacttcacactttatgcttcgggttcatacaatgctcaatggaatgccccagggctcctccacgataagcacacgttgcgttcgagtcgtatcctcagaaaaatggaggttgaggaaccttggttggggtttatggctaccgttgaattattgagtggatatgggatcaagtttagcatatga

SEQ ID NO: 95925 - DNA, 537 bp, Glycine max
  Peptide Sequence Number=SeqID_212703
atggagtcaaacaacatgccagacttgaacggtgtcgctaagaagactaaaggccgacaaaagatcgaaatgaagaagatgagaaacgagagtaaccttcgggtgacattctcgaagcgtcgcactggggttttcaagaaagccagtgagcttgcaaccctttgtggcgtggatgtcgctgtgattatgttctcacccggtaatcgagtattttcgtttggcagtcccagtgttgattctgttgtccaacgctataagacacagggcccacctcccctccttaccttggacctcaacaaggtgcactccactgcggacgaagttgagctccacacacacctccactgcttgtccaaccaaattgctattgagaagaagcgcacaaaggatttaaatcatttagcgaaggctgcagaggatcagttctggtgggctaggcctattgaaagcatgaccgattcccaacttgacaagtataagaagatgttagaggagtttaagagacaactcaaagaaaaatgtgggaacctcaactga

SEQ ID NO: 95926 - DNA, 297 bp, Glycine max
  Peptide Sequence Number=SeqID_212704
atgaagcctcccgtggggcccacagtcccagataacatctcgcgacgttcgagaaagtcgttagcacgccaaacgctatggtggggacacgtggaaaccgggacgcgcgtggaaggcacggaggaggaggcacgcgtgaagaaggtggggtcacggatttggttagttctagagagaaaaaaatgccaaaaatataaaagagaagaagggtgggaccgggtgtcggaaagagcgtacccgatgctgaaaaactgttctgacatgacaccccaccggtttcccgccaaaacagattaa

SEQ ID NO: 95927 - DNA, 1368 bp, Glycine max
  Peptide Sequence Number=SeqID_212705
atgggtcattttgagaagcccatcatcattaaggtggagcctctggatgaaccaattaaccctacaaaagtcactgaggacactgaagtcgacattgtgagtttgaccaacaagggtgattttgcgtccaacaaagttgaggaccccgacgcaactgactattctagctcattttctggcactacgtctgatgctgaaaatggttctagattgagtgatgctgaagtggagtcagaattcttgggtgataatggcttggcagacacttttgatggttctgcatttccaaagaggaagaggaagttgaccgatcattggaggaactttatacgacctctaatgtggcgttgcaaatggacagaactaagaattagggaaattaactcacaagcattaaaatacagcaaagagcttgcaggatatgacaaggggaaacatacagcacctgatgaatttactttagaagagtttggttcaaagtcattgccatttttgggtgaacagctcagaaagaataagaagtctgatccggatgggtatttggctgatgattttggtaatccagtgatcacagagccgcatgtgaattcaacagacagatttggcattggagaagatcgacctttgctggatttcaatgaaactgatgtttccttcaagcagctgcttttgacaatagacaacacacatactaggatccacaagctgaagagtaatgttgatggaatcgtgtccaaaaaggcttcaaagttttcttcatcagaaaatttgagctttcttcttcatcatggtgatgtgcagcagactagctctgttgaaagtcctacaatctctgcagggaatggagatacggcatctattggggttatttataattcaactcagcatgaacccgactttgatataggagattttgttatgcaggatagtgctatttcaagttatggaggagttccaatgattcctgatataattgagagcactgttggcttattgtctgctgctgatgtcaccctccattcggccttcgttgttgactcgtgtgaagatgtaatggtggacaatgtcttgatacatgaggtagctgaaacagatgagcacacctttgcaagccactatcccatggagaggcttcaggacgtggagaaagacgaagaaggggaagaaagtccgaatcctgttcctatccccttgtcagatattaatacagcaacaacaaaccctgcagtgtctgaagagcaatcaactatcaagtcctgcatgtatagagatgggaacattcccaagaacaaaagaaaacgcggggagcgcaaagcgtgttcaggcggttggagcaagaaatgctcgggggattctgagaacccgtga

SEQ ID NO: 95928 - DNA, 807 bp, Glycine max
  Peptide Sequence Number=SeqID_212706
atgggaatgagagattgtatgaattataatcccatgctggccataagacaactaggctgccctatgagaggtttcaatgaaaccaatgcgaagatacttcagagaatttgtaaagtatggaatatagtggacaggaaagataaggagcttaggggaagtagcaactgcgtcatagacgactatcacaagtggttgaagactagaacacaagagataaattggcccccaaagctaaaaagtctaaatgggaaggaggatgaaattcccgaggaaagtgaagaagtgcaagttttgaaagcggagctcaaaaagacgagagtggtgaaagagaagttgaagatggcagtcgctagggtcagaaaacagtgtgacgagctgaaagacatcaacatgaccatggttgaagcattagagcaagaaacaaaaaggtcccgaaaggaagaatggagtaggaacaagttccgagaggctctatggggcagcagcaacgagctcaagcttagaagggccaaaagggacgagttaaggattgaaaacatggtgttaaaagataagttgaaggcttgtcaaatggcaaagaaaagtttgatggaacagctgagcagaacgaaagagaatatgttgataactattaatcaatataagaagaatgtgaacctagctgctagtcatgggcagaggctggaggatgaacatgcgatggtatcaactttgcaaattgaaatggaagcaagagagagggtgatagaatcattgcacgtggatgctatgaaatggatggataggttcgctctcactctgaaatag

SEQ ID NO: 95929 - DNA, 138 bp, Glycine max
  Peptide Sequence Number=SeqID_212707
atggatgaggtatttctgtcagatctaaaaataacagtggaggatcaaaatgttggtaaggttgcaataatgagaaaaggtgtccacattagtcttcccattgaagtaaagttggttgaagttgtccacattgagtga

SEQ ID NO: 95930 - DNA, 573 bp, Glycine max
  Peptide Sequence Number=SeqID_212708
atggagagacataaggctaggttactggccaaaggttacactcaagtggaagggcaagattacctagacaccttttctccaatagccaagctaaccacagtgtacatgatgcttcctcaaggtatgcaagtacccaagactgagcaagtttgtaagttgcaaaggtccctatatggactgaaacaagccagtagacagtggtatgccaggctgtcttcctttctgatctcacatgggtacaggcagtgtgcttcagatcattctttgtttctcaagcatggattcaacattatcactgctctattagtttatatggatgatattgttttgtcagacaatgatttgattgaaatacaaggtattacacagttgttggacaatgcttttaagataaaggattttggtgacttgagatacttcttaagttttgaagtaggcagaaaacctactggcatcaatctatgtcaaaggaagtacgccttagacattctcaatgatgctggtatgcttggatgtatattaagggagccactgtatctagaagctcatcagaagtcgaatatagagcactag

SEQ ID NO: 95931 - DNA, 912 bp, Glycine max
  Peptide Sequence Number=SeqID_212709
atggaaccggagcattattttccttctccttcactatgcttaaccaggtggtggtcgagggagacggtggcggtggtgaccggaggaaacaagggcatagggtttgcattggtgaagcgtcttgcggagttgggagtgagtgtggtgctaactgctagagataagcaaagaggggaagctgcagtggagaatctccgaaaacaaggccttggtgattatgttcaccttctacttcttgatgtctctgatcccctttctgtgtcaacctttgcatcctccttcagagccaaattcggagccaccttggatattcttgtgaacaatgcgggagtgtcctacaatgagttggacgagaactcagtggagcacgcagaaagcgtcataaagactaacttctatggttccaagtcgctgattgaagctcttctccctctctttcgattctcttcttcttccatcactcgtgttctcaacgttagctcaaggcttggctctctcaataaggtaagaaacgcggagataagagcgatgttagagcgcgaggacttgatggaagaacacatcgacggagtggtgagagcgttcctcggagatgtgagaaacggaacgtggaagagccatggctggccatcgtattggacggaatacgcggtgtcgaagctagcattgaatgcctactcaagaatgttggcaaaaagatactcatacgaaggaagtgggttgagtgtgaattgtttttgccctggtttcactcaaaccgcaatgactaaaggcaagggcacgcacaccgccgatgacgccgccgcactcgccgccacccttgccttgcttccgccgcacctcttgcccaccggaaagttcttttcgcttggaaagaaggcaacattcctcaacgctacttctaaactatga

SEQ ID NO: 95932 - DNA, 618 bp, Glycine max
  Peptide Sequence Number=SeqID_212710
atggacccttgggtactagtaccctcacctttagagacgtcctcgtcatcagagggctgcacgccctcacctttagaggactacacgtcctcgccttcagagggctgcacgccctcacctcagaggactgcatgtcctcgccatcagaggattacaaagggctgcatgccctcaccttcagagggcggcatgtcctcgccttcagaggactacacgttgtccaccttagaggaccaaacatcctcatcttcagaggacttcacgtcctcatcttcaaaggactacacgtcctcaccttcatcgggctacacgccctcaccttttgagggctgcatgtccttgcctttagaggactacacatcctccatttcagagcactacacgtcctcgccttcagagggctacacgctctcatctttagagggcttcacgcccacgccttcaaaggactacacgtcctccacttcagaggactacacattctccacttcaaatgactacatgtcctccacttcagaggactacacgtcctcgccttcagagggctacacactctctctcgccttcagtggactccacatccgcaccttaagagaatttaaggtcctttgcccttaa

SEQ ID NO: 95933 - DNA, 555 bp, Glycine max
  Peptide Sequence Number=SeqID_212711
atgtggggcgggggcgagggtgaggtgttcaatttttctgttgatgaacttcctgtccagatcaatgtcacaatttatgattggtataaatgtcgggaaaatgctgttcttggttcagtgactgttctagttgaaagtgaaggacaaactggtccggtgtggcatactttggatagcccatcagggaagtcattaattaactggactgataggatacattgttgtggaggagccactgtagtccatcaaaagccagggcctcttcaaactatatttgatcttcctccagacgaggtggttattccatttgaagatatagatgagattcaaaggagtgaacttgcattgattaatcctgctataacaattattcttcgcaagggtgctggtggacatggtgtccctccttccagtcctttggcaagtgctgatggtagggtcggatatatgtttgcatcattttgggacaggaataaagcattagagaatcttcagcgtgtatcaaagaatttcaatgaaatgttagaagctgagaaggtcacagctcttgcttaa

SEQ ID NO: 95934 - DNA, 171 bp, Glycine max
  Peptide Sequence Number=SeqID_212712
atgggtgctggtggacatggtgtccctcctttgggaagtcctgatggtagggtcagatatatgtttgcatcattttggaacaggaatcatgcattcagaaatctacagcgtgcagcaaagaatttccatgaaatgttggaagctgagaagaaggttacagctcttgcttaa

SEQ ID NO: 95935 - DNA, 315 bp, Glycine max
  Peptide Sequence Number=SeqID_212713
cagatcaatgtcacaatttatgattgggatataatttggaaaagtgctgttcttggttcagtgactgttccagttgaaagtgaaggtcaaactggtgcagtgtggcatactttggatagcccatcagggcaggtttgtcttcttataaaaacaataaaactatctggaaatgcttccaggataaatggttatgggggagccaaccctcgaagaaggatgcctcccttggaaagacagtggcccactgtagtccatcaaaagccaggccctcttcaaactatatttgatcttcatccagacgaggttactgactga

SEQ ID NO: 95936 - DNA, 462 bp, Glycine max
  Peptide Sequence Number=SeqID_212714
atgaaagcgcggtggcaatcgaagagcataggaaatgacgaaaataaccttgtccttatcgtcggcggcggaactgtcggcgagcgacggatcggcgtatccggtccgtgcggtgaagaagcggtaggcgaggatgacgaagacggaggcggcgacggcgacttcgatctcccacagcgaggggaagagaaacgcgaagagcgcggaatcaacaagggtgacgttcatggtgtggcaacggaaacggagagagtaacaaagaatcagaaattgagcggtgaaggaattgctctagggtttagggaatgcggtgttgaagccatgggaagaagaagaaggaagagtcaaagttggaccgttggaagagaaagaaagagagcgcaaagaagtgtcaaacaaaacaaccgcactcgccttctctacttgccttcttttttttcttgcctgaaacggccaagataa

SEQ ID NO: 95937 - DNA, 225 bp, Glycine max
  Peptide Sequence Number=SeqID_212715
atggggcagtctaaagtggattctcaagccagttcggcgtacctgatcaagttagaactgttggctgccaagaatcttgtcggtgcaaacttaaatggaacatcggatccttatgctataatcacttgtggcaatgaaaagcgattcagctccatggtccctggttcaagaaatccaatgtggggcgaggagttcaatttttctgtagatgaactccctgttcag

SEQ ID NO: 95938 - DNA, 180 bp, Glycine max
  Peptide Sequence Number=SeqID_212716
atggagtttcaagaagaagttgctaggaggcattggacgcaactggcggagcccatgactaaatatgatcctgaaggcgtcatggataagtgctccagagtgtggggccaatggattccctatgacatagatgctatcaaccaattcttagggcatccattgatcttagaagagggatag

SEQ ID NO: 95939 - DNA, 660 bp, Glycine max
  Peptide Sequence Number=SeqID_212717
atgctggccataagacaactaggctaccctatgagaggtgcaccattggaggagatcatcgcgcctttcgtcgcacgaggtttcaatgaagccaatgtgaggatacttcagagaatccataaagcatggaatacagtggaaaggaaagataaggagcttaggggaagtagcaatggcgtcatcagcggctatcacaagtggttgaggtttaggaggcaagggataacttggctcccaaagcttaaaggcccaagtgggaaagaagctgaagtccttgaggaaagtgaagaagtgcaagctttgaaagcggagctcgaaagaatgataatggtcaaggagaagctaaagacgacagtcactagggtcaagaaagagtgtgatgagctgagagatgtcaacatgactatggtcgaagcattaaagcaagaaacaaaaagagcccgaaaggaagaatggagcaggaacaaatttcgaggggctctatggggtagtagcaatgagctcaagcttagaagggccgaaagggacaagtcaagggtggaaaacatggtgttggaggataaattgaaagcttgtcaacggtcgaagagaagtttgaccgaacagttaagcaaaacggaagagaatatgttgacaattattgatcagtataaggaaaag

SEQ ID NO: 95940 - DNA, 342 bp, Glycine max
  Peptide Sequence Number=SeqID_212718
atggaaaaatgcattcacgtgaacagtaaaatggataaatttgatatctttgtccctcatcctttcacaaacatatctttgcttattcaactttcactggaatatgggtacaagccattggtctgtttgctcaagcgacctgcgctcctgagtgttgacttccaagaccgttcaatcagagattacttgtcttgcacgttggtggggaatcaaaccgcttatttcattcttccttgctacaaggttgtgaaaaacaaaacaacgatggttacctcagagccctacactggggcaatgaaaggcaccatgcatgaacctcaagtgaacctaggggcagattag

SEQ ID NO: 95941 - DNA, 137 bp, Glycine max
  Peptide Sequence Number=SeqID_212719
ggtaggttgcgacaagatgacatcaaatttctctggatggaagaaacattgactgcatgcctttttgagcatcgttcagaatcatctatagataaagtctcgtgcgatggtggtgtagattggaagcttgtagcagg

SEQ ID NO: 95942 - DNA, 219 bp, Glycine max
  Peptide Sequence Number=SeqID_212720
atgtctaagcttataggaaaacccttcgcattgtacccttttaattcccgcagaaacccaaaactgtcttgggagaaaaaggaatcgcatgaagacagtacaagtggaggtttcaatctcttctccatctctctgacgtttgggaattctatcggagcagtcggaagaataactgacggaatctcagggaacactagagatgctgttatcgctggctga

SEQ ID NO: 95943 - DNA, 321 bp, Glycine max
  Peptide Sequence Number=SeqID_212721
atggaaagcagaaaagggaagaagcaaaaagggacaggacggacgaacataaacaaagaggacgaacataaacaaagagacagcacacacgtgcacagaagtgagcaatcaacaggacaggtggcaacacacgagaatgaggaaagaagaagcattaaacacgacaatgagcaaaagaaggcctataactggacaggtgtcaacaggacagagaaaaaagacaaattatggtcattccgcaccttttcgccattcggagacgatcgtgtccgatggcacgcagagacaaattatggtcatcctgcgccttttgtcatctag

SEQ ID NO: 95944 - DNA, 576 bp, Glycine max
  Peptide Sequence Number=SeqID_212722
atgcgtgagctttgcttgattctgatttacattgctactgtttatgcccttctgttcgttttgatgcctacaactgtttctattttgttttttttaaacaggtttctattttcgtccaactttttttgtcagattgctcctgtttgccactgtttgcaaaaccaaaaagtgatgtctcgcaaagaaaatctgatatctgaattacacaccagaaaaggaacatggaaaatagctgtgcggatcactgatctttggcaagctcgagagcaaaatagtaaacaaacaattgagatgggttcaaaaattggagctactctctggcaagaactcttcactgaattgcgggacaagttacagtgtggttcttcgtatttgattcagaacctgaggattgttgacaaccaatctgaatacagagtcaacccagctccatatttggtttatttcctaaaaactacatctgtcaaggaaattcaccgtccagaaattccttctaatgtttatctcataactccttttactgatataatctctggcctcgcaccacgccatactttagtgggtgagtttgtttag

SEQ ID NO: 95945 - DNA, 228 bp, Glycine max
  Peptide Sequence Number=SeqID_212723
atggaacttcacggattgcctaatgatgggtgccaagtacctcgaagtggtcaagcgaagggaagtaaagataagacactaatttcgttcgagcagaacatcattcggccggtcaatatccccgccagcggaacctgcaaaaattttgaaaatgatcagcaccgaacgaccaacatcatcctgatactgccaaattcattcctctcggttgacgaaaggcacagatga

SEQ ID NO: 95946 - DNA, 948 bp, Glycine max
  Peptide Sequence Number=SeqID_212724
atgtacttgcatgatcaagccatgatataccctcctggtctgcatatatttagggcaactaatgtcaagatggttgctaatagggtctgctttcatttactagtatgggatgctagcaagaagaagggattcaagttgtattacaaggcacaaatgccctcaaggaccttctggagtcagatagtgtggatagattcccaaaaaacctccacctctggctatgatggcagtgatactattgtgtaccatgacattgttcaagttttacaacatacaaggaagtatcactttgatgatgtctatgtctgcttcataagagatgatgacaactactcctttatccaatgtcttctcatgcttcccatcattcaatatgagggaacctacaagttgaagaagatgacagaagctcaaatgatagcctatgtgactcaactctatgaggctcaacaaaaacagagagctgaagatgctactgctatgattgctaagcaagaagctgctgagaaagaacttacaaaaaatggtgtcatggatgaaactggtaaagcgtccaatgcagctatgattgatgaaattgaactaatcattctagatcctacgtctaagcagccaacaattttaaatgaggccatctctcgagataagggtgaccatgatgctgtaattgtatactcaacaagttttagtcctacccctctcaactacgcacaacctgccaccatcattcatgatcaggttcaagatatgataggacaaaacatccaacaagctcaaatgtcaatggttggagctattgttgtacctgcacctgcacttgtatctcaactaccctccttacttgcctctcttcaacctccaccacaagccttggctccgataccaccacctcctccatcctctcccccaccttcccaacctctacaactacctccctttcaagactaa

SEQ ID NO: 95947 - DNA, 240 bp, Glycine max
  Peptide Sequence Number=SeqID_212725
atggaaaaccatagatttataagcaagtctgattcagcaaaagccaggagcaacaaaaagcgtattagacaacaaaaagtccatcttgatgttcaacatagtgtccatgcaagtttcaatccagcttcatcccatactgaagatgattataaccaaccaaagacaccacctcatagtgttcatgcaactgccaatcgggctccacacgatgctgaagatcattctcatatcagtaaataa

SEQ ID NO: 95948 - DNA, 903 bp, Glycine max
  Peptide Sequence Number=SeqID_212726
atggctagtgtttgcacccatttgacgttgggtatgtgttcttgcaccccaagctttgcttgttcttcatccaccaagaagaggaagctttgcaacaaagccaatgttggttcaagaaataagaagttaaagaatgaagatgatgaggtttggaagatcaagaaagtgttgaaagagagcgatgttgggagcatgagcaggttgatactgacgagagaaatggcagagaagtttgtgctgcctgtgttgggggatgatgctgatcagattgatagtggagtttctgttcagatttgggatgcggacaccaactccatgcactctcttgttttcaagagatgggtctcttcaagaagctatgtcttcattggtaattggattaaagattttgttgcaagaaggggtttaaggaaaggagatgagattggttttcaatggaatccattcaagaatggctttgaattctctgttcttcaagatggtgtattcagtgatgagaattctatgcttgttgcattttctgttaacttggtatctgtcaatctctgcttgtgggttctgagtcccaggaacaaactatactacttgctatcatacaagagctcagagtttctgcatggaatgccaacaattcagattgctgttcctgggaaggtttcactcacttgtggagaagctcattctcatcagactcaaagctttgaaagataccttaggaacttcagggccttgagagtttacaagattttcgacaatcacttcagtggtcctattccgggaagcattttttctccagggaagctagaagttcgtatccttactcagaacaattcaagtggtgatcttcctgaggaaatcaggaattggcaaacccttttctgtgttcaaatctcatcttcttga

SEQ ID NO: 95949 - DNA, 111 bp, Glycine max
  Peptide Sequence Number=SeqID_212727
atgaaatctaaaaagcaagaaaggttgaagttaaagcaaagccataacaaaatggaaggttcagtaaagtgctggttagccaacatatgtgatgtgaggcgtggcaagtaa

SEQ ID NO: 95950 - DNA, 309 bp, Glycine max
  Peptide Sequence Number=SeqID_212728
atggcatcggaatcttggaatttcaacttgctaggtcaacctttagcattaaactttgttgcctctatggctaacagcttagccatggaactaagccagaaggattgtattgagccagtcatgctgattaaagttatatggagtccatccttgtccctcccaccactgaagtcaccaaacctcagtttgcatgcatgggcaatgggtcattcccaattaagctacaaggggtgcaattgtcttccagcaatcagagaaaacttgaggaagtttcagtgtgcaattctagttttcatattccaaccttga

SEQ ID NO: 95951 - DNA, 657 bp, Glycine max
  Peptide Sequence Number=SeqID_212729
atgcctgtcaattatgaagcaattgctcatacatacaacttggtgcttctgtattctagagctaaggttgatcccttccttgatgtgattgacgatcacaagttacaagctgtcagctttgcacccgacaatctgatcgcttatggatcaaaagaagataccgatagggctttagaaacactttcagagttatcgacttttaaccaccaagatcaagaattatttgtttcagaaattgtcaggagcttgcctgaattatcctcaatgagggaagcgctactaaaagaattctcaccagatgatatgtgtccacttggatcccaattaaccatggatataccagaaaaggtttcggacacacctaatgaagctaggaggatttccatatcaattacatatgatatgccttacaaggatatgatgcataactgtgaggagagcaacttttctttgatgagaatattgctatggattcaatcaaaccaacttgttatcctgttccattgctatgtgcaaccattcagaatcatcctcatttgttcaaatttccaggagcaagtccctatgataaatttctcaaagctgctggttgttgatagtgatgagaatcatgaaactgaccaaatacaggctaaaggcccaagtggagaaggatga

SEQ ID NO: 95952 - DNA, 1017 bp, Glycine max
  Peptide Sequence Number=SeqID_212730
atgaggatgttgcggtggatgtgtggtaagactcgacaggataaaattaaaaacgaagctattagagggagagttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatggtgtattgtttggaccacagaagttataataaacatcagtgtacaaaagctgacaagcaagatgtcacagtagttatatgtccactttgtgccaaaggagttcgcctagttcctgatcaagatccaaacataacttgggagaatcatgtcaacaccgagtgcgacccatcgaattatgagaaagtcacaaagaagaaaaaatgccctgtccctgggtgcagagtgatattagtattctcaaacacaattaagtgcagggactgcacagtagagcattgtttaaagcatcggtttggacctgatcataaatgtcctggtcccacaaaggtggaatcaagtttttcattcatgaatcttttgaatgggagtaaaaagcaggagtccaaacccaagtcaagtgcaacctcatggagtacaagctttcttaatgcggcttctaacgttcgagcttcggctgaggctggtgtgtcaaagttaagttcctggcagacagcaaggggtggggttggacagagccatagcagtggtcaagtggagcaatgccctcagtgtggtgctaagttttcctcagttactactttggttgaccatgtgcaaaaagttcatgaaaggagtcgcaaccgatctggagcaaaggttacaattgatgtttgtccaaagtgtagtagaggatttcgagatccggtggccctagtggaacatgttgagagggatcacggtggaagttctagatcatag

SEQ ID NO: 95953 - DNA, 648 bp, Glycine max
  Peptide Sequence Number=SeqID_212731
atgaaactcgttatccaatatgggtttgaagaattagctaaattggttgcttttgattttctcactagtgttggagatccttctacctttcaagaagctatgaacaatcaggagaaagacaaatggatgggtgctatggaggaggagatgaagccttgcaaaagaatcaaacatgataaacaaacttacatggaacaaccaaagggattcagtaaaggtggattcatttgtagtctcgaagacaatggtacaaacagtttgattaatacatgcttcagattgactatagacgatgacttgagtcttgccaagaagattcttgggatggagattcatatggacatgaaatccaaacagttgtggctctcagaacaaagctatgttgagaaggtgttagacaagttcaacattagcaatgaaaagcttgtgagtactccattagcaaaacacttcaagctttatgtagatcaatgttcgaagacaaatgctaaggtggagtacatgtcaatttatgttagtgaaattggttgcttgatgtatgttatggtgtgcactagaccaaatttgacacatgataggctaacaaggaagttgtggttagcagggccagtgaaagagtcgggcattgagcaaggtggagttcaatag

SEQ ID NO: 95954 - DNA, 1881 bp, Glycine max
  Peptide Sequence Number=SeqID_212732
atggttttgcaagccatcttcaacggcgccttcttgacaatgagttcttcttcaacaactctcttcattggcagttctgcaagcactcttgttgtcgtcgattctcgccatcatcagttcccatcattgttgtttcttgtttgtggtgggattgctacttgttcgaaagttactgatgcatatttggttgatttgaggagggtttgtgaagaggctgaaaacatattaaagtctaagaatgttcctttacctactgacaaaaggactccaacaccaccaacattaccaccaaaaagaagaaaatcaagcaatatagagagtgcgtttaatattgaggataagaatcatcttagagcagagatagtaaagattgggtttcttcctcctagttataacgcattgagaactagtcttttacaacaagagaggtctcatattgaaaggttgcttcaacctatcaaatctttgtggagtttaaaaggagttacattggttgcagatggttggatagatgctcaaagaagacctttgataaacttcatggctatatctgaagaaggacctatgtttttaaaggccattgatgggtccaaggagtacaaggacaaacattacatgtttgacttattaaaggatgtaatcaaggagctaggttatttgatagaagctgaatttcctaatattttttggaccccttgtgtggttcatactttgaatcttggagtgaaaaacatttgtgctgcaaagaatgttaatgttaatgagaatgtcttcaatgaatgtggctggattgctgaagtaattggcgatgcttcttttatcaaggttttcatcatgactcattcaatgagattagcaatatttaatgagttttcttctcttaaattgctttcaattgctgaaactcgttttgcctctatgatagtcatgttaaagagattaaaattgttgaaacgttgtttgcaaaatatggtcattagtgatcaatggaatagttatagagaagatgatgtcagaaaagctacacatgtaaaagagttgattttgaatgatatatggtgggataaagttgattacatcctttctttcaaggatcctatatatagcatgattagaatatgtgacaccgatgcttctaatcttcacttagtgtatgaaatgtgggattctatgatagaaaaggtgaagacaaccatctataggcatgatgaagtgctagaaaatgaagtttctagtttctttgaagttattcatgaaatacttaattctaggtactatagtgataattggcttaatgaggttccaaatagtgttcctcctcatagagatgatgaactttctagccaaaggaataaatgtcttaagagatattttccacatgttaatgttaggtcaaaagtttatgaagaattctctaaattctcatcttgtgcgggtgactttgattcatttgattcaattgaggatagatgggcattagatccaaaaacttggtgggtgatgcatggatcctctacacctatactccaaaaggttgctttaaagcttctagtgcagccatgttcttcctcatgctgtgagaggaattggagtacatactcatttattcattctttgaagagaaacaaaatggatccaaagagggctgaagatttggttgttgtgcactttaatcttaggcttttgtctagaaaagaggaagggtataaaaaaggagagacaatattgtgggacattaatggagatgtacatgatccacttgatgataatgctggagttcttgaaatggcaaatttatctcttgatgagccagatttagaagctatgcttttcttagatgatggcaatggaagagaagaaaatgaaacaattagagtttga

SEQ ID NO: 95955 - DNA, 825 bp, Glycine max
  Peptide Sequence Number=SeqID_212733
atgaatttattgcctagtgctgttcatgcatcctccacccaagagtctggagccccgcgaatttattgcctagcgctgttcgccaattctccattctccacttttctccggagccccatgaatttattgcctagcgctgttcatgcatcctccacccacgagtctggagccccgcgaatttattgcctagcgctgttcgccaattctccattctcgtctttttttgcagccccacaaatttattgcctagcgctgttcgccaattctacattccccacttttatccggagccccatgaatttattgcctagcgctgttcatgaatcctccacccacgagcctggagcccagcgaatttattacctagcgctgtttgccaattctccattctccacttttatctggagccccatgaatatattgcctagcgctgttcatgcatcctccacccacgagtctggagccccgcgaatttattgcctagcgctgttcgccaattctccattctccacttttttcggagccccgcgaatttattgcctagcgctgtttgccaattctccattctccacttttatccggagccccgtgaatttattgcctagcgctgttcatgcatcctccacccacgagtctggagccccgcaaatttattgcctagcaccattcgccaattctccattctccacttttatccggagccccatgaatttattgcctagcgctgttcatgcatcctccaaccacgagtctggagccccgcaaatttattgcctagcgctgttagccaattttccattctccacttttttcggagccccatga

SEQ ID NO: 95956 - DNA, 147 bp, Glycine max
  Peptide Sequence Number=SeqID_212734
atgtgttcttcaccgtcaagcgcggagcctccgagaaagaagaaggagagacggagatcgtcatggactaattgcggaaagggcgaaggcggacgaaatcagcgtcttatctttgctttcctcttatctccgataaaaggtaagtaa

SEQ ID NO: 95957 - DNA, 471 bp, Glycine max
  Peptide Sequence Number=SeqID_212735
atgtctggcctacaaaggagggagtctaagatatgcgctcctggggtcagcagtgcgagtttagccaaaggaggagtcagatctctggctttgataaggaggccattgcccagctgttatgcataccgaggtatggcgcctatgagacaccttgtggacttggagaagtccaacaggaccctggggtttcccgctctgatcatggggctctgccagttctacagagtgcctgtcacccccagcaaggcagccaaccataggggtcaagtgcggctgaacgagagtttctatcagtacactctctgccagcagggccaagattccagcccttacgcatggcctactccagagcagtttgaggctgcagtagcatggcctggagattggcccgattttgagacacaggcaggacccgcggggacctctgaaggtggagaagaagcccaggaagatgaggacatggcgacctga

SEQ ID NO: 95958 - DNA, 839 bp, Glycine max
  Peptide Sequence Number=SeqID_212736
atggatgattttactgtttatggatcatcttttgatgctttcattgcctatcaccatagcaaggaaatctcggttgtcgctatcttggccgatctctatgacacgttcgaccgaagatgcgtaaagaacggcacaagaattctttgttgtatgccagctctctatgtgtggctcgtctcacaccttttccgccaagaaagtaggcccacctgtccactgcatcgtcaccgcttatgcaccgagaagggaaaggcaaactgggagcaactcttggctagtgtggtaggggcatccatcaattggttcccccgttggaaggaaggaaaagttggagttttgtcctcatgtgagggattttcaaatgtccccttgatgggaacaaggggttgtattaattataatcatgtcctcaccataagacaacttggctaccccatgagaggagcaccatcgaaggaaagcatcacacctttcatcacacggggagtccgcaaggcatgggatgcggcgcaaaggaaggacaaagagcttaggggaagcagtaatgggatcatcggcggctatcataagtggttgagagtccggacacaagggttggattggctcccaaagctaagggctgcgagaaaggaagaggctgaaactccggaagaaagtgaagaggtacaagccctaaaagcggagcttgaacaagcccgagcagtcaaagagaagttcaagtcaacggccatcaaagtccgaaaggagtacgatgaactaaaagacatcaatatggccaccaccgaagccttggaacaagaaaccaagaaggccctaaaagaagaacacgaccgaaacaa

SEQ ID NO: 95959 - DNA, 162 bp, Glycine max
  Peptide Sequence Number=SeqID_212737
atggggggtatatatagaagggtaggtgacattgagtgtaggtgggtaagtgaggtgaagaagggtagggcaagggcacgaggagaagaaagaaagagaggggttggtggacacaagacacgcacgctttcaaaggatgtttctgtagaggcattttattag

SEQ ID NO: 95960 - DNA, 1167 bp, Glycine max
  Peptide Sequence Number=SeqID_212738
atgggtagtgttgaaatccccaattggctgaaagggttgcccctggctccggaatttcgccctacagacactgaatttgctgacccaattgcttatatttcgaagattgagaaggaagctgccaactttgggatttgtaagattataccaccgttgcccaaaccttcaaaaaaatatgttttttccaatctgaataggtcactcttgaagtgccctgatttgggtccagataatagttcattaggtgtttgtaattcatcgaaaaccggttatggggatggtagtagtgacggggtgtcgcgagccgtgtttactacaaggcatcaagaactggggcggagtcagaatgtgaaaaaagccaaagggacagttcagaatccactgtcaggtgttcataagcaagtatggcaaagtggggaggtttatactctggaacagtttgagtctaaatcgaagtcttttgcgaaaagtgtgctaggttcagtgaaggatgtttctcctctggttatagagtctctgttttggaaggcaactttagagaagcctatatatgtggagtatgccaatgacgttcctgggtctgcttttgaagagtccaagggccaatttcattatagtcatagaaggcaaaggaaaaagacttattataagagtaggttagatagctctgattgtaaacaaactgaaatgggttgcgtaagagatacccaaactgatgagactaaggttgcttctgtccaaagtcatgcaggcacttgtttacagatgaacaaatcagctactactgtgtcaacattttcatcaaatgatgattcacaatcttctaaggaaaagagttcagatgccagcaatgaagtgcaaggcactgctggttggaagctttcaaacagtccttggaacttgcaagttattgcacgctcatctggctcactgacacgttttatgccggatgatattcctggcgtcacgtcacctatggtatacattggtatgcttttcagttggtttgcttggcatgtagaggatcacgagcttcacagcatgaattttcttcacactggctcatcaaagacctggtatgctgttcctggtgattatgcctttgcttttgaggaagtcattcgcactgagggttatagtggtaacattgatcacttaggtatgtga

SEQ ID NO: 95961 - DNA, 3528 bp, Glycine max
  Peptide Sequence Number=SeqID_212739
atggcttcgatagtaaaagaaaaacctcttatctgcccatgggatcttagaaacactctactttttttatccaccctatactgtcttggttttaactgtggggaagctgctaactttggaaccccacaatggcttagagtagctaaggaagctgcagtgcgcagagctgcaatgaactatcttcccatgctttcccatcagcaactgctttacttactgagcatgtcttttatttcaagagtgccaagaacactattacctggcgtgcatagttctcgtctaagagaccgtcagaaagaagagagggagtttttagtaaaacaggcttttatagaagacatgctgcaggaaaacaagctgctatccattcttcttggaaaggaagcaactaaaaaagctgttttatggaatgctgatttgctgcctgattccagcaaagattttcagttgcctgatttaacttctactactggaacctctatggcagatatgtcaaatattatttctgcagaaaagagtagtcattatcttcttgatgaaatgagtttgtatatggagaatttgaccaatttagatcttggtggtgatgatcttccatgtcacttccaaactgattcaggagcattggcttgtgttggttgtggaatccttggttttccatttatgactgtgatacaaccaaccaagaaattgataatggaacttcttcctgataatcatcatctagttcaagtttcctctccggactctactgcttgcgttaatagttccatctcaagtagaaaagttataacttctagagttattatgatgctgctgctggttgaactttttgaggtagtcctttactttgccaatcagatgacacttaatgttgaaatgagttactatgtgatctgttcttcaggggatctttctgtttctgaactctcatcagtaaaggagttgccagatcaatcattaaacaagtgcaataaatgttggaacacctccagtaagtttttgaggcctcggattttctgcctggagcatgctgttcaaatatctgagatgttgcagagcaaaggtggagccaatgtgcttataatatgccattcagactatcagaaaataaaggcacatgccagggcagttgcggaagagatacatagtgcttttgattataatgaggttccattagatactgcatccccagaaaatttgactcttatagatctggcaattgatggtgaagaacatgatgaatgtgaagactggacatctaaactaggcattaacctacgaaattgtgtccatgcaagaaataactctccatctaaacaagttccttggatactagggacactgttatatgatcaatgtcttgcttcaaaatctttagctttaaattggcagtcacggagatctcgatcaaaaaggtcaagttgtttagctcagactaaaccatgtgacaacattgagagaaaggaggatcagttgtatggaagaatagatgatttccctgctgaaaagaagctacttcaatattcaagaaggaagttcaagtcaaagcaaaggtgcttccctgttgcaagcatggtctgtgaattccaagagaagtccaaaaatttgtcagctactttgagtggggatcataataattgtgtttctaaaactgagcttgaaactgagaatttcaggattgattgttcattgttgtgtgtctctgcttctgctgaaatgtctccaatgcatcctgaaatccagattgctgaagtgcctgctagcacgagattaaatgatgctaagtcacaaccttccaattccattcctgatcgtactttaatgattgaagaagttggagcagagattgagaagcaaaacatgcaggaatcagatgtagacagaaataatgatttaacactccgtcattctaagatgcattgcaattccagtgtctcagaaatatgtggcaaggagggccaagattgtctggacaaaaaatgttctagctcacttacaaacacaacagatagacatattgaaatgattagaaattctgaaattacagaagcagttatcattgatagcaagtgtgatagcttaactttgaatggtgaagggcatcaagaatatcagtctacctgcaaaagcaacaatgtggaagcggctttatcacctgcttcattggtaaatcattctacactggcatctgtggttggaagtttcgaaagtccaaataataattatactgcagaaaaaattagcagtcttattttcctagaaaaggcaactgaggaagaaattgattctttaagtgaaagggacaaggaacctctaattgatgacagacaaattagtgaacatactccaaaagaagtttgtgaagttcgaagagagctttatgcttctgcagacttgcatagtaccgtagtcttggatagtgagatgcaacatgaaactcagggtggaaaagatagcagaaaggaaataaatcagtccactcatgtttcagcaattacaagaggggaatatgctgaagggttgaatgatgaagtgattccaaagtctgtggagcagtgtcagtttgaaaatatgaataaaattaccatggaacctgtttctagctatgttgcaaaaggtgaaaataaatgtgtaacttcatcagaattaggaggttctgaagtattagtggaaacttgtcctaaagaagactcttgtattcaattgatttcagataaagaaaaagaaacggaaatccactcagtgagtagaattgatgaggaattttgctctggcactgatacatcaatagatgactcttcatcaatccaggaatgttctaaaattgagcaagagagctgtgttacagaaaacataaatggaatcaaaaccaatttgtcacaagataatagggagctggaaagctgcgagttcagtacagcagttcccagatcaaatgctgggaagaatagaaagagaaaagtgaaacatacaacgaagaacaaatccaattgtgacaactttattagaagtccgtgtgaggggctgaggccaagagctgggaagattgccgctgacaaaagtggggtggaaatcaaccaagttgacaaggaaaatcaggtggctaaaagggcaaggagatcttctgaagctttggttcctcgcaaaaataaaaaggatgatgttaaaaagccccataagtgtgaccttgatggttgccggatgagtttcaagactaaagctgagttacaattgcataaacgaaacctttgcccacatgaggggtgtggtaagaagttcagctcccacaaatatgctttacttcaccagcgtgttcataatgatgataggccccttaagtgcccatggaaaggttgttccatgtcattcaagtgggcttgggcaaggacagagcatatgcgcgtacatactggggagaagccttatcactgcaaggtcgagggatgtggcctttctttcaggtttgtatcagattttagcaggcacagacggaaaacagggcaccatgtgaaacctcctgcttga

SEQ ID NO: 95962 - DNA, 1113 bp, Glycine max
  Peptide Sequence Number=SeqID_212740
atggcatgtggctctgttctttcatcttttcttcacataacgaactccatggccatcaagggtgtcctctccttcgcaccaaatcctcctctgcttcttcgtctccccaaagctgtcacctttctttccttttctgcttccactaaatcccccactaagtcttttcaagtgagatcaattgctggtactacagaagctgcatcggggtttgatgagatggtttctgggactaagaggaagtattacatgctaggtgggaaagggggagtagggaagacaagctgtgctgcttcacttgctgttaaatttgccaataatggacaccctactctcgtggtttccaccgatccagcgcattctttgagtgattcttttgctcaggatttgacagggggtgcattggtgccagtagaaggacctgattatcctctttttgctcttgaaataaaccctgagaagtctagggaagagtttcgaaatgccgcccagaaaaatggtggaactggagtcaaagacttcatggatggcatgggtcttggaatgattgcagaccagggtcacacattacgattattgtccttacccgatttcttggatgcatccattggaaagatactgaagctaagacaaaaaatagcttctgctacctcagcaattaaatccgtgtttgggcaagaagaaacccgacagaatgctgctgacaaattggagaaactcagagagaggatgataaaagtgcgcgaactctttcgtgatactgattcgaccgaatttgtcattgttacaatccccacgtatcaccaaccctaccgagacgaattgaaggattttggctttaaggtgatggcaattagtgagtcatctagattgagtgcttccctgaagaaggaaaatgttcctgtgaagagacttattgtcaaccagattcttccaccatctacatctgattgcaagttttgtgctatgaaaagaaaggatcaaatgcgtgctcttgatatagttcagaacgatccagaactctccagcttattgatgatccaggcaccactcatagatgttgagataagaggtgttccagctctcaaatttctgggtgacattatttggaaatga

SEQ ID NO: 95963 - DNA, 501 bp, Glycine max
  Peptide Sequence Number=SeqID_212741
atggcggcaaggatgttgcagaagcgactcatttcaatcttctcaagacaaactcatcaccccattactcaaggcatgtccttaccttcattatttgccgatttctccgcaaaaaataatgaagcagacaccttaaagtcaagtccaaacccagatgaagttgctacatctattagtgttaatgagacctcttctataaagttttctgccaagtccagtttgaagacatcctcaaggcatgatcttgctatggttttcacctgcaaggtctgtgaaacaagatccattaagacggtttgtcgtgaatcatatgagaaaggtgtggtggtggcaagatgtggggggtgtaataaccttcacctgattgcagatcaccttgggtggtttggtgaaccaggaagcattgaggacttcctggcttctcgtggagaagaagtgaaaagaggttcagttgacacactgaaccttacattggaagatttagcaggaaggaaaccttga

SEQ ID NO: 95964 - DNA, 876 bp, Glycine max
  Peptide Sequence Number=SeqID_212742
atggcaacacatgaaatggatcccgatgttgttcgctggggtcttcatctcctagatgtctgcacactttctcaccatggttcccctagtattgtaactcaatatgatcctgatttaagtcgagttgaatatgttaccgaaggcttttgtcagcatgagtacgtggataatgatgaggctgttgcacgagcatatcaagaagaattatcgcaacttgattccatgggagcttctgggatatccaattttgagaatgaaggaatgcaaggatctgtctatacacaagattggcctcaatcctcaaatggaaattataactttggcaatgagtcttgccagaactctgtagatgagtcctataatatgaaagaagtggagaattatggtccaactccaagtgaaagagaaaatggcatgcatgaaaatgatgtttatggttcgtcttctggatcagtagaggtacctgttattagtgatgacttctgggattcattggaaatatcggatgaatcttctcttgacggtgaagttggcaaaagattaaaccagatggttcccattcctaccagagtaatcaatcatgtgctatcacgccacaatagtggggtggcagagcagagtgccccctccctcctgaggcacttgttgcatagctcctggatgttgtggccatcgttgcagaaaatcactgcaatttgcagctttgcagctgctcctctgtttgcaccatcactggacaggctatgcgacctgtgccatcatcggacagccttttgttctgcgacttttctagaacttccagtgaggcaaattggttgggtgaagaggagagggactgctgatgggaaagaggctaggtttttctttcttgggtga

SEQ ID NO: 95965 - DNA, 2349 bp, Glycine max
  Peptide Sequence Number=SeqID_212743
atggccttacatagttgcagcattattgcaggatgggctccacatctgagaaaagctgctttgagtactttgctactcattatttacaattgttctgaccaagttctaactactagggaaagaagagtggccaaatctagagaagcagcagctagaagtgcaaggaagactgcaaatgcacgccaaagatggcaatttgcaaaagatgccactaagaagggtgcaatggggctgcaagctcagctatcacgcaccttcaagaaggatgtggcaaatctggaaaaagttaaaattttgaatcaagcaacttctgaagcagatattgaattgttgtcacattcaggacctacaacttcaagcatggttgcaagttcatctctggcgccaaaggaaaagggaaaagaacctaatggtcttatgcagataatacatgaaattgaaaatgatccagatattaatgaccaccttcatacagaaatagaaaccagagatacaggtgttagagcaaatgcgccaaagggaaaacaaccacatactcatagccaaatttttaagtatgcatattctcaacttgaaaaagagaaggctgagcaacaagaaaacaagaagcttaccttctcgggggtaattaaaatggctacaaacactgaaaaaaggaaaaggcctttaatggagatttctttcaaggatctgactcttacattgaaagctcaaaacaaacacatattgagatatgttactgggaaaattaaacctggccgcatcactgctgtcatgggtccatcaggggctggcaagacaacatttctttcagctctagccggaaaggcattgggatgctcagtcactggttcaatttttataaatggaaagaatgaatcaatccactcctttaagaaaattactggctttgtgccacaagatgatgtagttcatggaaacctaacagtggaagagaatctctggttcagtgcacagtgcaggctatctgctgacttgtcaaaaccagaaaaagttctggttgttgaaagagttatagaattcttggggcttcaatctgtgcgcaatgccttggttggaactgtggaaaaaagagggatctctggaggccaaaggaagcgtgtaaatgttggattggaaatggttatggaaccttcgctcttgatcttggatgaacccacatctggcttggacagtgcatcatctcagctccttctaagagcactaagacgcgaagctcttgagggagtgaacatttgcatggtggttcaccaacccagctatgctttgttcaagatgtttgatgacctgatacttctgggaaaaggtggtcttactgtctatcatggatctgccaagaaagttgaagaatacttttcaggtctggggatcaatattccggagcggattaatcctcctgattacttcattgacattttggagggcataacaacacctggtggaagctcaggactcagttataaagagctgccagttagatggatgcttcataatggatatccaattcctcttgatatgaggcagaatgcagttcaatttgatatgtcccagagtgtaaattcagctaatgaaatagatcccaatggatctggtcatgtcggtaaaacctttgccggagagttatggcaagatatgagaaacaatgtggaactgaagagggagaagataagactcaatttttttaaatccaaggatttatctaaccggaaaactcctggtgttttcaagcaatataagtactttcttatacgggttgggaagcagcgactacgagaagctaggatccaagccattgattatcttattttgttacttgctggagcctgcttaggatcacttaccaaatcaggtgaccaaacatttggtgcagctgggtacacctatacggtgattgctgtatctcttctgtgcaaaatagcggccttgagatcattttctctggataaattacactactggagggagagtgattctggcatgagcagcttggcttatttcctctccaaagacacaattgatcttttcaatacactgatcaagcctgtggtgtatctttctatgttctatttcttcaccaatccgatatcaacttttgcagataattatgttgtgctgctttgtcttgtatactgtgtcactggcatagcctatgcattgtccatattttttgaacctggcgcagcccagctgtggtcagtacttctgccagttgttttgactctcattgcaacacaaccaaaagatagtaaagtgttgaagaatatagctaatttatgctactctaagtgggctttacaagcattagttgttgcaaatgctgaaaggtaa

SEQ ID NO: 95966 - DNA, 483 bp, Glycine max
  Peptide Sequence Number=SeqID_212744
atgtcttatctttgtctttttgttattgagcattcatctaaatttaagaatttggtctttcttagattgcagttatatgatctgattgaatgcaaggttcaaggagatggtaactgccagttccgttctttatcagatcaactctatcgttctccggaccaccacaaatttgtgcggcagcaaattgttcaacagctcaaatcttaccccgatctatatgctggttatgttcccatggcttatattgactatttgaaaaacatgagcaagagtggcgaatggggtgatcatgtcacgttgcaggctgctgcagattggatttatagtaaaaacaaacttaccccaatgcccgaaggctcctcgctattcaaaggtatgggggagtgtcattgtatgcagccttgcctttacccaaatgcatatgcaaagaggctgtttccggattcaaactttaccgttgtgccagggctcgccctcaaatga

SEQ ID NO: 95967 - DNA, 1068 bp, Glycine max
  Peptide Sequence Number=SeqID_212745
atggtagccgctttccccccccagaaattagaaacagcatcagtagaagagaagaccaagatatttcctgagatcattcctcatgctcgtgccttgatgactgatgtttttggaaattatgttatacaaaaattttttgagcatggtacagatagtcaaagaaaggaattagccagccaacttacaggtcatgttttacctcttagtctgcaaatgtatggttgcagagtgattcaaaaggccttggaggtggttgatgcggatcagcagggtcaactggtgtctgagctcaatggtgcaataatgaaatgtgtacgtgatcaaaatggaaaccatgttattcagaagtgtatagagtgtgtacctcaagataaaattcagtttattgtttcatccttttatgggcaagttgttttactttctactcatccttatgggtgcagagttatccagagggttctagagcattgtgatgatctaaatacacaacaaattatcatggatgaaatcatgcaatctgtcggcactttagcacaggatcaatatggaaattatgttattcagcatattgtggagcatggtaaaccacatgaacggactgctattatcagcaagcttgccgggcagattgttaagatgagccagcaaaagtttgcttcaaatgttatcgagaagtgtttggcttttggtagtcctgaagaacgtcagattttggtgaatgaaatgcttggtacttctgatgagaatgaacccttacaggctatgatgaaggacccttttggaaattatgttgtgcaaaaggttcttgagacttgtgatgatcgaagtcttgagctgatcctttctcgcatcaaggttcacttaaatgcactgaagcggtatacttatggcaaacatatagtttctcgtgtggagaagctcataaccactggaggtgagaaatgcaaagacttgggggtgtttgatttctatttcaaaaactgtttagttttcaaaatacaactaaacaaggctgttcagacagctggtggaaagtattgcaaggaacaaaacaaagtgttgaattga

SEQ ID NO: 95968 - DNA, 1311 bp, Glycine max
  Peptide Sequence Number=SeqID_212746
atgtcacgtccagcgagtcacaatgcatttggtgatattatgggttcaactggcattgttgatcgtgaatcctttgagggcttgcgttcttcagcttctacccctggtttggttggacttcagaaccacagtctaaatctttctcatagttttgcacccgctgtaggtacttctccgtcaagggtgaaaacccctgaagcacaggttattgggagacctgttgcatctgcagcttcccaaatgggtaataaagttttctctgttgagaatatcggtatgggcttgggcacccagcatggccactcttccaatatgactgatcttactgatgtggtgtcttctttagctgggttaaatttgtcaggtgctagacatgcagagcaagatagtcttttgaaatctaagctgcaaatggaagttgacaatcatgctgatgttctattaagcacacaaagcaatgttaatttgcccagacgtaatgatattgcaacaaaccttaacacctttagttcaaatgagcatgtcaatctactgaaaaaaactgcttcttctgctaatcttcgctcaaaattgcattctactggaaatgcatcaagttttccaaatgcagacttcactggccatgttcctagtgcatatcttgtaaactcaaaattgaattctgtttacaataataatcttgagacagctttgaggcttcgcagagatggacaaagtttagatgcacaaggaaatcatgttggtcctgaacttcattcctcaactctgaacccacacttgatccaatgcttgcagcaaagttctgattactcgatgcaagggatgagtagttctggctatcctcttcaaatgagaaatttccctgatgcttcacatggagatttggagggacttaggaaagcatatcttgagacacttcttactcaacaaaagcaacagtatgagctcccacttctgagcaaatctgggcttactaatggcttctatgggagtcagccatatggtcttggcatgccatattctggaaagcagattgcaaattccacacttccttctcttggatctggaaatccactctttgagaatgaacgtatatcacgcttaaattctatgatgagaagttcagtgggaggttctggtggctcatggcatgctgatattggcaataatatagagggaagatttgcttcatccttactagatgagttcaagaacaagaaaaccaggccttttgaacttcccgatatcattgatcatgtggttcaattcacgtatcaatcttgcacctccaatgttttttctagtgatatg

SEQ ID NO: 95969 - DNA, 789 bp, Glycine max
  Peptide Sequence Number=SeqID_212747
atgggtttctcaattttgcttgcagagaggatcggattgcgggtgacttctagtttggatatgcagatgggcggtgggagtaagatagatttgcaaacattagatgagggtatgcagcctttggcaaatgggactattgaagacaccttgcagagtgagctggagaagatactgcaagagcagcgtaatcagcagtttatcaatcgagagagggatttcaatattagtaggagtggaagtgcgcctccgacagtggagggatcgtttagtgcttttgggagcctaaggaactctgattttggatcgatcaatgataggagtaataacaatggacttttgactgaagatgacatccgatcgcatcctgcgtatctttcctattattactcacatgagagtataaatcctaggttgcctccaccgttgttgtcgaaagaagactggcgtgttgcacaaaggtttcatggtggtgggtcttcttcaattgagggatttggggactggaggaagaacgtggccacaaatggtgatagttcatctctattttcaatgcagccaggattttctgtgcaacaggcagagaatgatttgatggaactgaggaaatccagtggatggaatgtctctaggcagggttcaagtcagatgcttgacagacatatggatggtttgacaagaatgtcaggagctggtcttggtgggaggagaactggtttcaatgacattcttcagttttggctaaattctgttcaacattccagaacataccggagatgtctgtgttgttga

SEQ ID NO: 95970 - DNA, 495 bp, Glycine max
  Peptide Sequence Number=SeqID_212748
atggagctcaatgaagatcctggaccaattgataattatgttctttatgatcaagataatcatgtatcttcagcagtttgggttggacttgagcgtggtgtacttagatgccatgaacacacttcaatgcttgatcagtggaagcttacacctaaacagattaagttggttgagaaggctgagtaccaaaggacctgtcgaatggtgaaggttacttggctgaaggagttcttctctaagtgtcctgaagatgcatcacaagaggaaattgaacgatgtactcgtgcttaccttttatacctattaggcagtacaatattttctacaacaacagggaacaaagtccctgttatgtacctttcattgtttgaagactttgacaaggctgggaagtttgctgggggtgcaggagcattggcatttttatatagagaacttggcaattcttctcttgaatctcaaagcactactagtggctgtttaactctagtacag

SEQ ID NO: 95971 - DNA, 750 bp, Glycine max
  Peptide Sequence Number=SeqID_212749
atgtctaaattcaagactacccaaaaactgaaagtgaagataactaaacacgtacacaagagagaaagaagactctcacgcacacaacacaccatgaagctcgtttggtctccagaattagccttgaaatcctacatggacacaattagatcatgtgagaaattcaaggaagcaggagtacctaagttgctatcagcaatggctataggatggaacacaaaattcatattggaatcatggtcttgcggtggctctgtagcggagagtgtaggcctagcaattgtagcttgtaacatgtgggcaagacacgtgtgcctagtccctgatcaaccgtcgacggtgcagtacataacggccttagccaagatgagggtgtcgccacgagtggacactccttcttttaatccagttcctctacctcttcttcctcttcgccttctccctcctctccaccgccgccgtcgtcttcaccgtcgcctccctctggcacctcgcctctgtcatctctgtcctcgagcccttctacggcctcgccgccatgaagaagtcctaccaactcctcaagggcaagctccggtacactgcggtcctcgtctccgcctatttggtcgcctgcgaggttatctccagtgttttcagcgtggttgtggtgcatggtggggaagactatggagttttcaccagaattatggtgggagggttccttgtggagcttttgatgagcgcgttgaggaccatggacctgcatga

SEQ ID NO: 95972 - DNA, 261 bp, Glycine max
  Peptide Sequence Number=SeqID_212750
atgagtctggaggagttgataccatcaaaccatgccaagtcttatctatattccatcttcatcagaacagggttggtactttctaccctggttattggtctctcagttcccttttttggtctggtgatgtcattgattggatcattactcacaatgcttgttgcagcactttgcattacaattatcacagtaggtgttgtatgttctgcttttggatcatactccgcccttgccgagattgtgaagagtttgaggggatga

SEQ ID NO: 95973 - DNA, 945 bp, Glycine max
  Peptide Sequence Number=SeqID_212751
atggcgggtaccctccctgtcccacttgtgattaggtttgagttaggatcagatcttacacaacttgtaaattgtgaggtgcgaataggcataaatgttctttgtggtgttggaatcctttctacaccttatgctgccaaagtaggtggatggcttgggctttctatattggtcatttttgcaattatttcattttatactgggctgcttttgcgttcctgcttggacagtgaacctgagcttgagacataccctgatattggccaagctgcttttggtactactggacgtattgccatttcaatagtattatacgtggaattatatgtaagtacagatgccttcactcagcagtcagcagcgagtattccgtttgtagtctcacctatagcttgttgcattgaatatataattttggagggcgacaatttgtcttccttatttccaagtgcacacttaaatttgggtggaattgaactgaattcacatacattgtttgctgtgattactaccttggctgttcttcctactgtttggctccgtgacctaagtattctaagttacatatctgctggtggagttgttgcatcaattttagtggttctctgcctattatgggttggcatagaggacgtaggctttcatagcaaagggaccacactcaatcttgcaactcttcctgttgctgttggtctttatggttactgctactctggacatgctgtgttcccaaacatttatacatccatggcaaatccaaaccaattccctggagtcctcttagcatgttttggaatttgtaccttgttgtatgctggagctgctgtattgggatacacaatgtttggagaagctattctgtctcagttcactcttaacatgcctaaagaattggtagcaaccaagattgctgtctggactacgtgttacccggtggcactttaa

SEQ ID NO: 95974 - DNA, 714 bp, Glycine max
  Peptide Sequence Number=SeqID_212752
atgaaatttccaaattctcaattgtttcttccattcttgttgttgttgttcttcgcgataactccctttcgcggttcagggcagcaaacggattggaacagcgaagagactcaacatggaaatggggttcgccgcagagttcttctgagtttcaaagagaagccctcaggaagtaacgttacctttgaatgtactccttcgggtccttgtgtgccctgtctctactctgagaaggattacttcaacataaggcatttgaggagattatatatgtttggtgatgagaaatatcgatgcagtgagactggctaccgaattccattcaaatgtttagagattaaagattcaacaaaggatgcaaagaaaacaaagtctcaaaaaggtcggttgtctttggaaatttctgatggtattgcagaatctcataaagtgtcacatgacgctggagagatcaatccttcacaatcacatagaagattagtggacgattcatcgtcttcagataatagttcacaggcttacatcacttacagaagctgtataaccccagttaatgaagagaagttgtcggtgcttaattttgagcatgtgtgtggcattaatcaaaggagggttgaatgcttgaggctctcaccttgtggtgtattgacagggttgatgtatgcagccttatccctgcaagtagtgaggttgtttctaggattgaatctgtga

SEQ ID NO: 95975 - DNA, 437 bp, Glycine max
  Peptide Sequence Number=SeqID_212753
atggatgtagggcaagacatgaaagtttctagtattattgaccccatcaaccattgttgggacattaacactatcagccacatcttatcaccacaagatgtccaagttattgtcagaacacctctcttgcctatggtagaaggagattcacgcatccgggctcttaatcaaaatgtcagtaaacacttctctacagcagcgaatatctatggcgttatggagtatgtggagacgaaggaacggagtgaaccatctcactactcaatggttcagcattctcaagtgctacattggataccacctgagcctggttgcgtaagggatgagcgagggagacaaatgatggcaagagctgagactaaaatgccttgcatggacgcccagctaggagaggcttggggacttttagaagttataaattttcccccagcaaaagg

SEQ ID NO: 95976 - DNA, 294 bp, Glycine max
  Peptide Sequence Number=SeqID_212754
atggagatcaagatagggtttgacacttcagattcagggttacagagtctctcagctttggggtgttatgttccctctctcaggagaaggagcaggataatgggatgccatgtgcaacacgattttatgccgcatatggaaaacagcgcttccaagtgctcgcgtgttttcagttttcactcatcagcaactacggaagatccccactttgataccattttcaacaatgctacaaacgtcaatagagaagaaaaaaagaaaaagattataagtataataaaatttataatatga

SEQ ID NO: 95977 - DNA, 456 bp, Glycine max
  Peptide Sequence Number=SeqID_212755
atgaaaatctttgatttggaattggaagaaatcacttacataagaactcacataaacatattcttgtgtgacatgtttgaccaaggacaattgcaaactgattttgatgaatcaaagtggtctaatattcccctgattttggataccattgatccccaagagcagtctggcttacctaacgaagaactcgattcctttattgaggatgaagatgacgttctatgcaatcaaccccaggaagatgatgaggaagaagatgaacttgtttcaccaataaaaaccgccccaccatactacataccaccacacatgcataattttaaagattctgaatacggccatagcttggattacgaagaagttgaacattcggtgtggactcactttgaagggatgcgttttctaacaaaaaaagaagtacaacatgctttgcagctatatcatgtgagcaaatga

SEQ ID NO: 95978 - DNA, 476 bp, Glycine max
  Peptide Sequence Number=SeqID_212756
gtttgactgaagcaattgccttaccatatctcgggatcaaacctgatgtgctaagtttagatgacaaggcagagatactcttacttgatcagagcatcactactgctgttgtacttggaatcatatatagtgttgccaacactttccaaccacttcctgaagacttcttcaaatatgatttgagggagcctttcaatcttcaaaagggttggcttttgtgggctggagttggacttgctggtgccatacttgccatttcattgaccggagttgctgtgtctttcttcaatggagaaaccccacaaagagagactgatgctcttgttcgcttgcttccgttaattggatcttcaaatctcagccttctatcaatggatttttttttttttttaaagtttccatctaggttctgtatcccagattctcaacactgcctgcttggtgggcatcacaggtgttcttgctccactccttga

SEQ ID NO: 95979 - DNA, 558 bp, Glycine max
  Peptide Sequence Number=SeqID_212757
atgtctattgtttctggcacccacaccactgaaaaatataactatgaaagctttcaagagttttttgaatgttggatgtttgagcaaaaccaacacctgaaggaacttttagctgctgaatcaacccatctaacagatgagcaagtgcaagcactaaatggtagggtgattgagcattatgagcactattatactgctaagttaagttgtgcaaagcaagatgcaagattcgacgaactgattcggggtctaaggacacatgatttgggagacatatcagcatctcaactagctcagcttgatgagacgcaaaggaggaccatcatagaggagagggaagtcacagatttgatggaaactcaccaggaatcattggttgatgctccaatggtggagttgtctcatgtggttgctgagatgattagagccaatgaaactggtgagaataaggaaatagaggacaaggttgaatcaacactttgccaatggtggaagcacaccttggcgtcacgagctatcacttgctgtacaatcatgactacctccatcgacaagtag

SEQ ID NO: 95980 - DNA, 258 bp, Glycine max
  Peptide Sequence Number=SeqID_212758
atggacattgattatgctatcaggaaggaagaaccatcgactattactaagaccatcactccagatgtggttgatctttatgaaaagtgggagaggtctaatcgtctttctgtgactttcataaagaccaacatttctactactatagatgagcaatttgttacatatgataaatcccttgtcagcacccgtataatgcaattctcatccatgaaactcacagggataagaggagtgcatatcacatcatgcacataa

SEQ ID NO: 95981 - DNA, 645 bp, Glycine max
  Peptide Sequence Number=SeqID_212759
atgaagggcaaaaggtttgtatcagtgcctgtgttggcagtgattttgttaatggtttttgtgtattactgttcaatgttcgtcttcctccaagattggctcggtttgcagagttcccctggcactttgaatgcgttcctcttctctctctttgcctctctctccctcttctctttcttctcctgcgttctcactgaccctggccacgtcccttcttcctacgccccagatgttgaattctccaaagattgtgtggcttcttgtgtcccttatgtgaatcaaagatttaagtgttttgcttctacattatctgaagttgctgatgtgtttatgagttatgacagattaagaatgcagaacagaagaaatgtgacaagtgctttgcatacaagcctcccaggacccatcattgtcgagtttgcagaaggtgtaacagtaggtagtggagttgcagagatagatggatgcaacacagggaaaatcgcaagaccatggagactgatggtgctggtacagagactgtgcgacagaaatcctgaagtgggtgcaggacctgaaggatcaattgccttgagacaaaccattccgtattctatcgatactcatcccaattcccaagttcaggatatctatttaattgtttga

SEQ ID NO: 95982 - DNA, 315 bp, Glycine max
  misc_feature (241)..(241): n is a, c, g, or t
  Peptide Sequence Number=SeqID_212760
atgacagttttgcatatacaaacactaagctatagtttaaaaagcttagctactagcctaactaacataaacctaatgatagaagcagaggatgctcaactccttgtttcgaggacaagattcgttggtgcttttggtgttgagcttggatattggcgcgcgaatgcttcccacttcagacttcataatcctgaaggtaatttggttgcttggttgctcgtgtgggcctttctgatatgtngggttctgctgtggggtagggttctgcggggttgggttctgcggggttgggttctgctgtggggtctattataa

SEQ ID NO: 95983 - DNA, 2001 bp, Glycine max
  Peptide Sequence Number=SeqID_212761
atggctactccactgcctaccgttgtggatgtgtatttcacagacaccaaaagaactagattcagcatcaccacgccttgtaggcaaaaaaccaatagaaaattcttcatacactgcgctacttcaaattccactccagaagctcctccaacaccaacttcagacaacaacaacaacaacaagaaaaacacttccttatccgaccaactcgcaccccttgccaacaaaaccctatcttccgccacaagagaccaatcctatgcgttatctaagccaaaatccacatgggtcaaccccaccaaagcaaaacgctctgtgttatcctctgagagacaaaaacgtgctacttactcatacagtccacaattaagagatttgaaacgttttgctcagaaactgaacgagtctggttcctctgaagacgagttcttggcttgtttggaggagattccacgcccaatttcaagagaaaacgccttgttgatactcaacacgttgaagccatggcaaaagaccaatcttttcctgaattggatcaggacccagaacttgcttcccatggaaaccatattctacaatgtcacaatgaagtctctgaggtttgggaagcagtttgggctgatagaagacattgcacaccaaatgattgataatggggttccactggacaacatcacttactccaccatcatttcctgtgccaagaagtgcaacctctatgacaaagcagtgcactggtttgagaggatgtacaagaccggtttgatgcctgatgaggtaacttactctgctattctagatgtttatgctaggttaggcaaggttgaagaagtgataagcttgtatgagagaggtagggcaactgggtggaagcctgaccctattactttctctgtgttggggaagatgtttggggaggctggggactatgatggcattaggtacgtgtttcaggagatggagtctgttggggtgcagcctaatttggttgtgtacaataccttgttggaggcaatgggaaaggctgggaagccggggtttgcgaggggcctgtttgaggaaatgatcgagtcagggattgtgccgaatgagaagactctgactgcggttattaagatatacggcaaggccaggtggtcgcgagatgcgttggagctgtggcagcggatgaaggaaaatggctggcctatggattttatcttgtataatactttgttgaatatgtgtgcggatgttggactggtggaggaagccgaaactttgttcagggacatgaagcagtctgtgcattgcaagccggacagttggagttacacggcaatgctcaacatatatgggagtcagggagatgttgacaaggcgatgaaattgtttgacgagatgtgtaagttgggtgttgaactcaatgtgatggggtttacctgtttgattcagtgcttgggaagggcaatggaatttgatgatttggtgagagtttttgacatttcggttgagagaggaattaagccagatgataggctatgtggttgcttgctatctgttgtgtctctgtctcagggtagcaatgatgaggaaaaagtccttgcctgtttgcagcaagctaacccgaaactggttgcctttattcatttgattgaagatgaaaaaaccagttttgagactgtcaaggaagagttcaagggtatcatgagcaatgctgcggttgaagtgagaagacccttctgtaactgcttgattgacatatgtagaaacaaagatcttctagagagagcccatgagctactctacttgggaaccttgtatggattatacccagctctaactgcactggaagagtggatgtggacactcaccaaaatcgttaagcgggaggagacactgcctgagttattcctagcccaaactggtactggtgctcataagtttgcccaaggactcaacatttcttttgcctctcatttgagaaaactagctgctccatttaagcagagtgaggaaaaa

SEQ ID NO: 95984 - DNA, 222 bp, Glycine max
  Peptide Sequence Number=SeqID_212762
atggtctctaggcattttcagcgagacggagggcaagggggtaggcggagtgcgacgaagtcaaggtggaagcacaggacagagggggcaacaccggtggaggaagaagagagaatgaagggacaaaagcagtggcggcatcaccggaggaagaagagagagggaggagggcggtgcaagaagcaaaaacgggacgtgcagaaaggcatagaccagacataa

SEQ ID NO: 95985 - DNA, 228 bp, Glycine max
  Peptide Sequence Number=SeqID_212763
atgattcctgagaagggatctgcctccgaaggttcagccgtcttttgtggtgaggctcctcagagtccgagaatcccgtttctattccattccccagagcttctattccactggttttgtcaggatgaaaaggattcaaaagaagtaaattacaagtgctttggaggaaaattgatgcaaaaagaaaaagctttgaagaaaaagttgaagatgagacaactcgcttag

SEQ ID NO: 95986 - DNA, 279 bp, Glycine max
  Peptide Sequence Number=SeqID_212764
atgtggacattatataagattgatggtccttctagatggaaccttgcagcacagggatccacgcgaggattgctctattcgagaccatgcggtcaagaaaaaatctcccacaaaaatagggatgaaaaattccctgcagctaattcagggacagggactatgctccccaccccgcaagatccctgtcacccgcggggaaccggagtacgagtatggatacgggacaaaaaatactcccaccatgaaacgagagctggtgtcatgcctaattacagttaa

SEQ ID NO: 95987 - DNA, 1206 bp, Glycine max
  Peptide Sequence Number=SeqID_212765
atggaagagagaaatcatgatggtgagaaactagatgaggttatgctaccgggttttaggtttcatccaactgatgaggagcttgttggattctacctgaagagaaagattcagcagaggccactctctattgagctcatcaagcagctagatatctacaagtacgatccttgggatctttcaaaaatggccaccactggggagaaagagtggtatttcttctgccccagagacagaaagtacaggaacagtgcaaggccaaatagggtaacaggagctgggttctggaaagctacagggactgatcgccctatctattcctcggagggctctaagtgtattggcctcaagaaatctctagtattttacaaaggaagagctgcaaaagggatcaaaactgattggatgatgcacgaatttagactaccttctctcactcacccatcctcagaccccaagaagtacatggacaagactattcctgctaacgaatcctgggcaatctgcaggatcttcaagaaaaccaatgctacagctcaaagagctctatctcactcttgggtctctcccttacctgaaaccacaactacttctgatcatagagatggcaaccaactttgccaagcaaacatgccattcacaaagaaaactagcttagccagccagttttatactttcaatcataatgaatcacaacactcaaccactactagtacaactccttgtcctttagatgttgtagcctcttacaacaaaccacttattaatccattaatgctctacaaaccctcagatcggttacccttttcaaatggagacctaattagcagtggcgtgatattctcatctcttgaaacctcaacaaccagtgctaaatcttcaacggatgcttcttccttgctactgagtacatcatcttctgtgcttggagattttagtaagacctctgagggaacaataaccacaaactttggtgggttacaagagcatggtaatggctaccaaataccattactacgtgacaacatgcaaggaaacttcggcaaccacgatgacaatgcgttggggaagattcctaatgtgaatgtggtacctcgtgttggtgaccaacaattggagacagtgcgatccattgggtttccattcaatattggcgatgcatggaagcctaatatgctttgggatacttcctctttgtccttgtga

SEQ ID NO: 95988 - DNA, 798 bp, Glycine max
  Peptide Sequence Number=SeqID_212766
atggcagatgttgaacctctcgacgccagcctggaccggctcgaggcagccatgaccaatctcgccatagtggactccgatctccatgcatctcaccttcatttagacgcgctccgcacttccatgctcttcaaaatagatctcattagcctgaagctagataccatgatctcccgccaacgccccctgtttccttcttcgatacagcctccaccaccgctgccgccaacgtttcctccttcagcacaaccaccgccgccgccgccgccgccaccgtttcctccttcaccgcaaccaccatcgccaccgccagctcctctgcctcgctctcacgtgcctcctcccatggatggacaacgagatagtcctgtcattggaattgattccagcaccatcgacttccccgtcagcgtgtggcagcaccatcatgccgacctcaaccgccacttcctgtccatccagttgtgtcctctgccgctctgcaccaacactcgcagttaccgcacgatcccctacaacaatgacatcttcctgctaagggacgctgccgtcgcgcaccagattcgtccgcattggatttggattctcttcgctactgagactccgctttgctccgttcgtcaccagcgtcaacgaccgccgccacatccactaccacctccgaagccaccgcctccaccatcatctccgccacggtctttaacacctcccttgattgctccacggcgtgggtcacacacccattcctctccttggccattccattccgtggcacgggtcacacacacgctttactga

SEQ ID NO: 95989 - DNA, 330 bp, Glycine max
  Peptide Sequence Number=SeqID_212767
atgagtactaagaaagaaaaagcttattgggacattaaagcaactaaaggctttatcataacatgcttggaacaagtgtacaaaggagaacgactcaatacaaaaactggttttggatgggacaatgccaaaaatattgttgatgaaaatcctttatatgaaaaattcaggatcaaaggacttccatttgctcaaaagttgattgaactttttaaggatgtagttgctaatggagagttccaatgggttctcttgtttgggatattgcttgctggtgttgaggttgatttgaagatgggtatcattcaagtcttgagggtattggactag

SEQ ID NO: 95990 - DNA, 243 bp, Glycine max
  Peptide Sequence Number=SeqID_212768
atggataacaaatcaccaagcaaggagtccaaggaggagacacgtgagtcgcttatcgctatctctaactctttacctgataaaactctggaatcaaagtctgccttggagagcaagaaatcagatggggttgcgatgcaaaaccgtgatcaagatgacaagtttagctatcgtgcaactctatgtaaatactttcaccggctacatgcttgggtcatatgttgtaacgaccgtgacaactga

SEQ ID NO: 95991 - DNA, 1242 bp, Glycine max
  Peptide Sequence Number=SeqID_212769
atgagcaacacaacaaagctatattccaaaaattccaaaacaaatcccgagaacctggccaacttggttatacgctcaacaaagtatgatttcctagtgtggatagcaaatagagaccaacctgttgaccttaactcagcggttctatcactgaaccactctggtgtgctgaaaatagaatcccaaattgcgaaaccaataatcctttactctccacctcaaaataccaataatactggtcatgtccgagatcccacattgaatggtgatacaacaaaaataaagtatataagtgaaattcaatccttatttaaagaattaggtctaaacccaaagtctaataacattgtgttggacacagtttacacattggatgttactggaaactgggcaagcagcaatgaaggagatattgcaagggctgatatgtgttatggatataacactgatggagggtgtcgaagatgggaggctatatccacttgtaggcaatttggtgatgtatttgagaaaatgatgggttacccaaataatgataatgtgatcattgaatcaaatgtgacttatggtagcagtgattgcatggctagttgttggaccaactgcagctgcacaggattcaaaaatctttatcacaatggaacaggatgtatattttttcttttcaattctatggaaggtgttgctcttgatagcactcaggccattttttacatgttggtaaagaaaacccagcgcaatgaaaagaaaagaaaaagaacagaaacggagatgctagatttagcagtttccaacgaatctttaggcatcaaagatcttgaagaagatttgaagttatttagctatacatcagttgtggtagcggcaaatgacttttctcttgaaaacaagttaggagaaggaggctttggacctgtttataagggtaccctaccaacaggggaagaagttgctataaaaagactttcaaaagggtctggaaaaggaattgttgaatttagaaatgaattaaccctcatatgtgaactccaacacatgaaccttgttcaattaattggttgttgcattcatgaagaagagaggattctaatgtacgagtatatgctaaccaaaagcttggatttctatatatttggtaaggaatatgctaaagtctatttaattatatgtagcatgcaagcacatacgcagggcttcaacataatagaaggaaagtcatttatgcttggtaatgtagcataa

SEQ ID NO: 95992 - DNA, 228 bp, Glycine max
  Peptide Sequence Number=SeqID_212770
atggttgagttcaagcgtcttgttagtcgtctaatttatctcaccacaattcgccctgacattgcttttgcaacccaacaactcagccaattcatggctcatcccacaaagtctcatctaggtgctgcaaggagagtcttaagatacttgaagggttctccaagcaaaggtcttcaattcaagagggatactcctatacatttaattggcttcaacgatgctgattga

SEQ ID NO: 95993 - DNA, 192 bp, Glycine max
  Peptide Sequence Number=SeqID_212771
atgaggtcggagtacaagggttacaagttggagaatatcactggttttgtggtgagcaaggaggagcggaaagagaaaaaaatccctttgttgttatgtcagaaaatgtacaagccatatgagatggttaattgtgttgttttgatatggtctttgggtctgcttcacatgtccaacgtgttaggaacataa

SEQ ID NO: 95994 - DNA, 852 bp, Glycine max
  Peptide Sequence Number=SeqID_212772
atgaccggccctctcgatgagttgatcccttgctttctcataagggtggacccttgggtactagtacctatcgccttaagagggttgcatgccctcaccttcagagggttgcacgtccttgccttaaggaatacacgtcctcaccttcagagggctacatgccctcaccttcagaggactacacgtcctcgcctcgaggactatacgtcctcaccttcagaggactacacatcctcaccttcagaggacaacacgtcctcacctttagagggctacatgccttcaccttcagagggctacacgccctcaccttcagtggactacacagggctacacgccctcaccttcagaggactacacgtcctcgccttgaggaccacacatcttcgtcttgaggactacacgtcctcaccttcagaggactacatatcctcaccttcaaagggctacacgccctcgccttcagagggctgcacgtcctcgccttcggagggctacacgccctcaccttcagaggactacacgtcctcatcttcagagggctacatgccctctccttcagaggattacaaatccttgccttcagaggactacacgtcctcgccttcagaggactgcatgtcctcaccttcagaggactccacgtcctcaccttcagaggactacacgtcctcacctttaaggggctacacggtctcacctttagaggactacacgtcctcgccttcaaagggttgcacgccttcaccatcagaggaatgcatttcctcaccttcagagggctacgcgccctcaccttcagagggctgcacgccctcgcctttagaggactacacgtcctcacctccgtag

SEQ ID NO: 95995 - DNA, 321 bp, Glycine max
  Peptide Sequence Number=SeqID_212773
atgtcaaggggtatgttcccggttgagcaaggggatcttcacaagcgctggaagttggttagtatgaagttgagaaattttcacaagtgtgttgtgcttcccattggcagcttgtctagtgggctttgtaggcatcgggctattctttttaagttgagttacttgagtaagaatattgttgagctgagtaattatattgtcgagtgtgcttgggtgtatgatgagaatcctgaaattggccaaatacaggttaaaggcccaagtggagaagggcgaaggcccaagtggagaaggataaagcccccgagtggagaaggatga

SEQ ID NO: 95996 - DNA, 434 bp, Glycine max
  Peptide Sequence Number=SeqID_212774
gagaagggttatgcggcgatttgggagcttccttttatgtgttgggtgatgcgtatggtaatgtatttatggatgaagatggagaggataaagttgaagatgatgacaatgacaataaggaagatgaggagtcgattgagtataaggtggaagaggattatgattttgatagtattagatgtggaagaagtggtggtttttatgcagaagatgctataactgaatataaagttggtagaggtctgattttgggcaagaggaaacgtcattcaaagaatgtcactagaaaggtcggcattagacctcctcacatgtgtgcttcatttctcaaccttgatggggatatcacaagccttggcgagttaaaatgggagcaaaatcaaaatcagaatggacttagccgagttagtgcagactcggacgagttaacgtag

SEQ ID NO: 95997 - DNA, 444 bp, Glycine max
  Peptide Sequence Number=SeqID_212775
atgaccctgattgttggccatgctttcaacatgaacttgttgccagataccgatgcaagggtaggtggacggtggaggaagtgcctgtgttttggtgttccagctttgctgttggcattgcagaatccatggaaggcggagtcggcatggttcgcacagtttgcagagtcgtggtaccacacaaggctaacaagtggattcgggtactctcaaaatcaatcccaagggattgagctggatgtacataaggaggtgtgtgctgaaatagaagggataatgggttcaacagaggtgattactgatggatggttgtatggagaggatgcaacaggaagaggtggactggtgtggtctggcatggtcagagaagagggacaggcagtcataggaggcaggtcagaccaatttgttagcaacattactaagctactctacgctaactag

SEQ ID NO: 95998 - DNA, 186 bp, Glycine max
  Peptide Sequence Number=SeqID_212776
atgtcacgctctcgtgcgccgtcatcacgctggaccaacctcagtgaggaactggaacaacttcttgcggatgtgcctaaattaacaattgaagagcacagggaatggagggaattggcaaacatgatgcaaaatgtcatggctccactagaggcttttttccagatcgttcacaccagggactag

SEQ ID NO: 95999 - DNA, 372 bp, Glycine max
  Peptide Sequence Number=SeqID_212777
atgacaaaaaattgctacactgttgaaatgagaaaacgagataacaccccttttgaactggaaaatcatgttgcattttctgaatatctagttaacgaagtgggagtggtggcaatccctacaagtgtattttacttgaatccagaagagggaaagaatctagtcagatttactttttgcaaggatgaggaaactattaggtctgctgttgataggggcgcgaagacgggtcacatcaactacacttcttcgagatggaacactgatcacggcaccggtgacctcactatgcgtactcactgcgcgagctcgactgcacacacgttggcgagacaacgaggtttcgagggagcttcagcgagcggtgtttaa

SEQ ID NO: 96000 - DNA, 174 bp, Glycine max
  Peptide Sequence Number=SeqID_212778
atgattataggcaagtttcctaaatttcctgttcatacaccaatagaggtccatagatcttttttccttaagattgctcagatacacttttcaatgtcagtaacccatgtagcaaagaaggttacggaggtttggatgacgccacttccggtgaaggaaaataagtcagggtag

SEQ ID NO: 96001 - DNA, 243 bp, Glycine max
  Peptide Sequence Number=SeqID_212779
atgaaggagattgcaaaggcgtatccaggagccaccataagaaatgcggttgtccccgtgtctgtttacttcaacgacccacaacgtcaaaccatcaaggatgttagtgtcatttctaggctcaacgtgatgcgaattatccatgtgtctaccacgactgcttatgggctcggcaagaagaccagtagttatgctaagaagaacatttttgtttttttcccagtggtgaaattcatggtttga

SEQ ID NO: 96002 - DNA, 450 bp, Glycine max
  Peptide Sequence Number=SeqID_212780
atgatgatggtgagacagtgtgtgagaagtatggtattagcaaagaaaagtggaaccaaatttgttaatgccctagagatccttcatgggagttacaagatccccctggaagagcagtgcgtgcaaggtagctttgtcgcccatggatgtcaggatcaaccacatctagttgaactagatctagctccttctggtgcctttgttagcacaaatggaagctatgttgatccttcgtggcaggacattaacactgatatctcagatagggatgggttgtatgttgattacattcctccttatatggtttccctagggagagtttatgaggggtcatcaaccatacaccatgtgcctttggccaattatatggtgaatgtgggtcttgaagaagttggagatgtcgatgctcgtgtccctgtacccactgaagaggttcagttagtggggtag

SEQ ID NO: 96003 - DNA, 816 bp, Glycine max
  Peptide Sequence Number=SeqID_212781
atggctgtggctatggctgcttgcagtcttggacttcacttgagtgctgacaacaccttgagaccttttgaaaaaaccactatcttgaaggccctctctatctctgatgctactaaaccatgttacatttctcacaaaacaagattatcatcttcatcttcaggaataacaatgatcccacgagcaacaacagttattggtactgtggaggatggaaatcaaggagaggctgataccattccaactccggtagttattattgatcaagactctgatccagatgcaactgtggtcgagataacctttggtgatcgccttggggctcttcttgacactatgaatgcgttaaaaaacttggggctgaatgttgttaaggcaaatgtctttctagattcttctggcaagcacaacaagttttccatcacaaaagctgattctggaagaaaagtggaagatccggagttgttagaggcaatccgtttgacaatattgaataatatgattcagtatcacccggaatcaagcgcccaattagctctgggagcagcttttggacttgtgcctccaaaagagcaggcatttcaggttgacgtggagatagcaacccaaataaccatctctgatgacggcccaaaacgaagtttgttgtatgtggagacagctgatcggcctggattactggtggatcttgtaaagactattacggacattaacattgccgttgaatccggagaatttgacactgaggggctcttggctaaggcaaagtttcatgtcaactacaaggataaagccctcatcaagcctctccagctg

SEQ ID NO: 96004 - DNA, 1188 bp, Glycine max
  Peptide Sequence Number=SeqID_212782
cgacgcctcggcggccgtcggcgccgtactgggcggcgcggcggcctttatgctggcgcgtcggttggcccggcgtctgggcgagcaggccgattatcagccggtggtgctgcagattgggttgccgcctaccgcgatgcgcatgcaggcggaaaattccccgctgatttaaaccgacggccgcgtcatcgccgggttgtgataggcggggatgcggttgtggatcatatgctccagcagcgcgatgaacagatcggcgctgagcagcgaatcgtagttaatcgcgaacagcacatttccctggccgtcgagcaagcggatgccgcgctgcggatggttttccaccgcgcggatctgctcgagcggcacgttgccccgctccgtggtcagcaaggtggcgctcagccgcagcgtttcggtcggcgtgccttgccgcttgccgagcagcagttgccacagccagcgcgcgtcgccctcaacggtgtgaaacgacaccgtctccccttgatagagcgcattcagcgccagcggcccgcgctgctgcagctgttggtcgacgatcacgtctgccagccgccacgaatgggcgacattgctgaaaaccgtacaccagggctgatccacgccggcgcggaacgccgtgacgtcaaacagcccgccaaaagcctggccgccgcgaaagcgatagatatcgccgatcttctcaaacgggatgaagcgctctttgtgatggtggccgtcaaagacccgcacgccgtgctcgtacaggcgataggtcagcgtcggacgcagataatgccgcagcgccagcagcgtacaaccgacaccaacagcgccgcccccgcgctaaacagcagcgccgccgccgccagaatgccccagttgacctttgaaaaatcgtgccggctcagcatttgccctttatcgatcataatgcaccttccaatcaacgtacggagatatgctgttcatgccctttctatccgaggggcggtggtggcgtatatggggtttttcctaaaggaagatggcgccggagtttggcggccacgaatcaccggcaagccttgggttcaggccgtatcgtccgcgttaacatctgttttcacccgccggggcgccctcgattcaggtgcaagacggcctaacccattcactgtcgctttaggtccatgcgggtttctatag

SEQ ID NO: 96005 - DNA, 797 bp, Glycine max
  Peptide Sequence Number=SeqID_212783
gtggccgagcttatcgtgcgcagcgccatggcgcgcaaagagagccgcggcctgcactacacgctggactacccggatctgctgccggaagcgctgccgaccatattgcagccttaaacgctgcgacagggcgcctaatcggcgcccttttcttttcagtagaaaagatagaagtcagcgatcaaatggcggaaatcgtcggtgtagctgccgtcggcctgcttgatcgccagcgcctgctcccgcagcggcgtttcccgccgcgtcagcgccagcagcacccggtgcagcggcgtatcggcccgatcgctgacgttcactttcgccgccgtgtgccagccgctttgctgcgccaggcgttcgaattcggcgccgatatcgtgcggcagcaccacgcagaacgtcccctgttccgtcagcagctgcgccgcacaggccaacagcgcctcgtgcgtcagggtttcggtgtagcgcgcgttgtggcgcgcctggtcgcggcaggccaccgccggctcgaaatacggcggattgctgacgatcagatcatactcagcggcatgccgctgcgcataatggtgaatatcctgcgcatgcacgcggatgcgctgcagccacggcgatgccgccgcgttttcgcgcgcctggccggcggcggcttcgtccagctccaccgcgtcaatggtcacttcgtcgccgctgcgctgcgccagcatcagcgcgatcagcccgctgccgctgccaatgtccagcacccggcgcgcctgccccagcggcgcccaggcgccgagcagcacccc

SEQ ID NO: 96006 - DNA, 867 bp, Glycine max
  Peptide Sequence Number=SeqID_212784
tcgtgccgttgatcgcggtgctggtgtcgctcggctcggtggcggcgtggagcgcgtcacggagcatccagcagtccttctattcgcagcagttgggcgacctcgggtatttcgtcacgagtgcccggcaggccctgcgatcggggagcccggccgtgatcgatgccgaggtgcggcgcttccagcaggtgtacggcatcgaggtgaccgtgttcgatcttgcgggcggagcctgggcgtcgggcgatcacggcggcgcggtgctgtcggaggatgatgcggagcgggtgcggctggcgctctccggccggcgcgccgagcagccggccgcgtcgctgccgtgggtcgtgcccgatgcggcgttggcggagccggtgttcgacgacggcgacgtcatcggtgctgtcctggtcgccggtgacgtcgatggcccgcgcacggccatcctgcagcagaccctgctgctggtcgccatcgtggtggtgctgagtgcgctcggcgtgcttctcgtgagcggcctggcacggtgggtgctgtcaccggtgcgacggctcgacgaggcgatggtcgcgatcgagcgcggcgagatggacgcgcgcgtcgccgaggacaccggccctcctgagctgcggaggatgacccgggtgttcaacggcatggccgatgagatcgagcgcgtgatgacccgccagcaggagttcgcgctgaacgcctcgcatgagctacgcaacccgctcaacgccctgctgctgcgtgtcgagcacctcgcgacgggtctcggtcgggagtgggacggcgccgtggaggagaccagggaggaggggagacgcatgacgcgcatcctggagacgctgctcgggctcgccc

SEQ ID NO: 96007 - DNA, 174 bp, Glycine max
  Peptide Sequence Number=SeqID_212785
atgcaacatctgatgaagcttcttgaacgggatcagtatattcattggcatagattaaaggatgaagatgttatagtacctacaaaacaaacagggatgacattctctgctggttttgcatatttggagggtgaacatgtttcacatcgtcaagaatgtcaaggcaaaatgtaa

SEQ ID NO: 96008 - DNA, 195 bp, Glycine max
  Peptide Sequence Number=SeqID_212786
atggcctttgtggataattgggtggtggggaaggagaaggaatggcagtcacagcatgggtttctccctcattctcaccctcttcacttgccccagttttttttgaatttatcaaagcatgatgatcagatttgcctctttttagacctcacttcgatcatttcgccagcgaagactgaatctcgcaaagcttga

SEQ ID NO: 96009 - DNA, 258 bp, Glycine max
  Peptide Sequence Number=SeqID_212787
atggaggccacaaaggtattgatcaattatcatgttttacttgcctttaatcttggtgcacactacaatgggaagccaaatatctattcttatgagggagcaactgtaaacgatctaaactgtataaagctactacttatggggtcggtggatgatcaaattgacttcataatgggtgatttcttcctcttgacaccaaagttaaagggtttaattataagattgaggaaaaataaaaaagtacctagacgggtgtaa

SEQ ID NO: 96010 - DNA, 144 bp, Glycine max
  Peptide Sequence Number=SeqID_212788
atggggacagtatgtggagcttacttggctcagaattatcaagttcctaacgtcacaaagttagccgacactgccttgttcatggcagaagttgtggaggaaaaataccgcaagcccaagaagagggatgatgatgatgattag

SEQ ID NO: 96011 - DNA, 1900 bp, Glycine max
  Peptide Sequence Number=SeqID_212789
agctaagaccatcccctttgatgcaagtgctcccttgaagctccaaagattctcatacaaagatttaaagcaagccaccaatggctttgacactgccaatgttattggcaaaggtggctctggcactgttttcagaggaatacttaaagatggcaagttgattgccatcaaacgcctggacgcgttgtctttgcagtcagagagagagtttcaaaatgaactgcagattcttggagggttaaggtctccattcttggtgaccctcttgggttactgtgtggaaaagaacagaagagtgttggtgtatgagtatatacccaacagaagcttgcaggagtccctctttggagatgagggtatgagtttgagttgggagagcaggttatgcataatattggatgttgctagagctttggagttcttgcaccttggatgtgatcctccagtgatccatggggatattaagccaagcaatgttctgattgattctgagtggcgtgggaagatctctgactttggcttgtcaaggattaaggtggaggaaactcctgctattggtactccaattgagagtgttagtgaagtagattttgctctagctttgcaagcctcttcttcatctaaaaatagtaggacttgctttaatgtcaaagctttgaacttgaattctttgaattataatgccaatattgctagtgaaactgaaattaggagtgtaaatgcaaagggtaaggaaatttcagctttggatagggatgattggaatggtaagtttttcccttgtgatgatgagctttctagcattgattatagtaaggagttaactgtgagtgcttctcctttggtggatgatgagaaggcaaatgggaaacaatggggaaaggactggtggtggagacaggatggaagtggggagttatgtagtaaagactacgtaatggagtggatagggagtcagatttgtccatcaaacgctgattgggatgatggtaagaacaatgttcacgcgaaagtggagttggaaaattcaagtcccaaggataaagaccatgatgctattgcaccccaatcacaggtgtttgggataggacataatactacagataatggggttgagaaaaaagagtcaaggggaaagaaatatcacaaaaagaagcacaggaagatgcaagagtggtggaaagaagagcatcttgctgaattaagcaagaagaccagtaaacttaaaaatctccataccaagtggaagaaaggcttgaaagtgccccattttgatttgggtagaaggttttatctttgcaggcgtaagaagtttggacaggagggtgagaataagtgtgatcaaaatggggagtttagcttcagaagaggatggaagaagaaaagcactcgttccattggaagtgacatgtggagtggagatcttttcagccgtgagctcagcagcacaacaagcatgagagggacactgtgttatgtggcaccagaatatggaggatgtggattcttaatggagaaagctgacatttatagttttggagttttgattcttgtaattgtgtcaggtaggagaccattgcatgttcttgcatcacccatgaagctagagaaagctaacttaataagctggtgtagacacttggctcaagatggtaacattttagaacttgtggatgagagattgaaagaagattacaacaaggaacaagcaagtctttgtatcaacttggcactcatttgcttacagaaaattccagagctgcggccagatattggggatattgttaagattttgaagggggagatggagcttccaccatttccatttgaattctccccttctccaccttctaaattatacagcagatcaaggagaaaaccgaagggcactacagaatag

SEQ ID NO: 96012 - DNA, 333 bp, Glycine max
  Peptide Sequence Number=SeqID_212790
atggaactttttttcttgtatggaatgataataattacctggccacaaacatcgccgcataaatcatcggtcttcttagggcagaagaaggaaatgaacctctccgccgttgtcgagaacgaaaacctcaccgtgcttgaagggagacatggtgccagtgtcgatgttcaagccacaagctttgagcacgacgcctatgctgcaggtggtgacgcccttgtcgaggccactgatcactccgccactgatgatttaaaaaacctaaggggaaaaaaggcttctctcaatgcaagtctcaacctcttcgattttgaacagagagagagagagtga

SEQ ID NO: 96013 - DNA, 327 bp, Glycine max
  Peptide Sequence Number=SeqID_212791
atggacattcatcaacataaagttgaccacaaagatctaaagataccagctgcgaccatgaaattaagcatataccttataacaacaactttcttgaaatcatcttcaaggcgcgggaacaatcccgttttgacctgctttggccgtcggctgtcgtccatcggccactgtccgccgccgccgccgcctccaaccgccgtcaaattttccggtgaaaccagggttgtgtgcacctcgaggagcgtgacccacccctacaagtcgcgtgagcagcaccaccaccacgtgccgccacgcgccaccacagcaatgcatcatttcgggtga

SEQ ID NO: 96014 - DNA, 363 bp, Glycine max
  Peptide Sequence Number=SeqID_212792
atggaactcgacaagaagaagaaaaaggtacttgacaaacagcttgagtttctattagggcaaaccgagaggtacacaacaatgttggctgaaaattttgtagatccttataaatcagcagagaataattcagtagagcactacatgagtattcaatgcaaagatgtacattatgttattaatgaacctaatgaagctgatgttggtagggtggtggtcgtgtgccgatgtgcatcgctttcgcagggtggtggtcgtgtgctgatgtgtgtcgccttcgcgggggtggtgcatgcgggtcatgctgctgtgttttgtgttgtgcatcctcccgctgcgctttcgtacttcaatttcgggtag

SEQ ID NO: 96015 - DNA, 837 bp, Glycine max
  Peptide Sequence Number=SeqID_212793
atggagattttacaccaagtccattttatgccagggagcagccatagaggctatatagctgttgagagttatgatgaaaaattattgaagacaacagcagcagagttagaaatagaggcttatccattgttggatgaactgacatcaaagatcagtacactaaatttagaacgtgttcgtcggttgaagagcagacttgttgccctaaccaggagggttcagaaggttagagatgaaatagagcagcttatggacgatgatggtgatatggccgaaatgtatcttactgagaagaaaaggcgaatggagttgtcattttatggagatcagtctatggttggatataaatcagttgatggtgcatccatttctgctccggtctctcctgtttcatcacctcccgattctcggaagcttgaaaagagcttcagcattgctaggagtcgacatgagagcatgaggagttctgaaagtactacggaaagtatagaggagcttgagatgttgctggaagcatactttgttgtcattgatagcactctaaacaagttgacatcgttgaaagaatacattgatgacaccgaagatttcatcaacattcaactggataatgtgcgaaatcagcttattcagtttgagcttttactcacaactgcaacatttgtggttgccatctttggagtggtagcaggaatatttgggatgaattttgaaattcaattatttgatgtcccctctgctttccagtgggtccttataataacaggaatttgtggagtctttatattttctgcatttgtgtggttcttcaagtacagaagactcatgcccctatag

SEQ ID NO: 96016 - DNA, 756 bp, Glycine max
  Peptide Sequence Number=SeqID_212794
atgtcgaaatactgtataacaccagatgctacttcgtatagctacatgatttcctgcttttcaaaggaagggaatctttttgactctcttaggctctatgatcagatgaagaaaaggggatggatccctgggatagagatttacaattcattagtatatgttttaactcatgaaaattgcttgaaggaagctctcaggacaatagataagttgaaagaacaaggtttgcaaccaggttctgtcaccttcaactccatgatactctctctttgtgaagctggaaagctagctgaggcaaggataatatttaactcaatggtagaggagaatgttagtccaaccactgagacctatcatgcattttttgagggaacagattatcaaggaacattggaatttctaactaggatgaaagattctggtttgggtcctagtaaggattcctttgtcataattctggcaaaattcttaaagttgaagcaacctgtaaatgcaccaaaattttggacagaaatgaagacatatgatgtgctgcccagttgtgtgcattacagaataatggttgaagggctagtaacatgtaggtggttcataaaggccaggggtttttatgaggagatgatttcaaatggatgttcagctgatccaatgcttaataggctctttcaggaagaagtacttggtagtggtgataaaggaaaacagaatgttaaaaaggctcatagtaataaaagtgtgaaatattctgaaaaatga

SEQ ID NO: 96017 - DNA, 420 bp, Glycine max
  Peptide Sequence Number=SeqID_212795
atggctcctaagttgcaggaagaggagattaagctattagaagtcggaataatgaatcaagaagctgaggaattttttaagaagactattgaaattgattgtcttatagatgtgctcagagaagctaatcctcgtgaacgagaactaatacttgcaagtatgaggatgataagcctactaatccaagatcaagtccaagattctcttaggggtcatgagacattccatgggcccaaaatctaccctaaggccgatgagaaccctagagccttctcttgcatctctggtctaatcttcttggagtcatctatccaatgcctttggagggtaggattgcatcattccctcccccttgaagaggatttgacctcaaatcaagatgttcttgaaactctgggctttttccctcaacacctgtaa

SEQ ID NO: 96018 - DNA, 345 bp, Glycine max
  Peptide Sequence Number=SeqID_212796
atggttcctctttgtttcatgtactcaagccatttcaagttcagaacagacacttgcaaatgcaagcccctccaactccaagactccttaaattgtagatatcctcctcaacagattataatattatttgaatttccaactgcagacaagtatggaatcataactgaggacacaaaagttgagaacaagcacgatctatctcatggctcaagaacacagagaggaaaaggagcatacgggggacaagatgtcaatcacaactctgccacatcatttttaccatgcatatcaactctatctgtagccctccctttaatgcgagtacttcccttctacttgctctaa

SEQ ID NO: 96019 - DNA, 594 bp, Glycine max
  Peptide Sequence Number=SeqID_212797
atgctaaaagtaacatatttcaaatgtggaggggtctcattaggtgttggcatgcaacaccatgtagcagacggagcatctggtcttcactttatcaatgcatggtcagatgttgcccgtggcttggatatttccctccccccattcattgacaggacactactccgtgcccgggatccacctcatcctgtttttgatcacattgaatacaagcccccaccagccatgaagactcccctgcagcagcaactgcaatcctcaaaaccagtaggctctgacagtgctgtggccgtctctactgtcaaattgacccgtgaccaactgagcaccctcaagggtaagtccagagaagatggcaacagaatcagctacagctcttatgagatgttggctggtcatgtatggagaagtgtgtgcaaggcaagagcacttcctgatgaccaagaaaccaaattgtacattgcaactgatggacgggcaaggctgcaacctcccctcacccctggttactttggcaatgtcatcttcaccaccactcctatagcagtggctggtgatctcatgtcaaaaccaacatggtttgctgctagctga

SEQ ID NO: 96020 - DNA, 378 bp, Glycine max
  Peptide Sequence Number=SeqID_212798
atgaaaccccttctcgacttcggaatcgcgttcctcctcctcctacattccttccttacttccgacatcccttaccccaaagcaattttcgatttgaaggatacaattgtgaagggatttgggtttacggcggaaaatgatgttaagcttacggggttcgatccgagagacgccacggtagggcattccgtggagtaccaattcgacctcgaaatcaatcacaaggttattcccttcaagcttctcgaagatgtgaaacactgggattacatggatcttcccattttccaagccgaggccccaatcggtttcgtccagaaacaggcttcggctgacgggcttcccgttttggcttcgttcgttctcgctatgatgtag

SEQ ID NO: 96021 - DNA, 342 bp, Glycine max
  Peptide Sequence Number=SeqID_212799
atggggtttttcttggtgggaaatttggctttaagtgtttttggcctttttcttttttgtttttgtttggcgcgagatattgtctggtccaaagacctttctgtatatttcttcttgtcgcaacgtgcccttcatgggcgagcgagggcgaggctctcgggtgcgctttccaaaggaggaaagatgcgcggagtcgccaccaacgtttatttgggaaaacgtcgggaaaaccgaaggaaactggtcaaaaggaaaattctaagttcgagagttgtatttacgcttgaggaaggtattagcacctctcacgtttgtctccaaggacaacagcctattttttag

SEQ ID NO: 96022 - DNA, 405 bp, Glycine max
  Peptide Sequence Number=SeqID_212800
atgtcaggttaccatctggtcggttcatgtaatgggttgcactgtggggttagcgaaataccagaaggatactgtgtttgtttcttgaacaaggcgacaagggtgatatccagagaatcgccaatgctgtctttttccccgggcattggtcgtagaacaatgtttgggtttggctatgatccgtcaagtgacaaatacaaggttgtagcaattgcgttgactatgctctcacttgacgtatctgaaaagactgagaagaaagtttatggcgcgggtgacagtagttggagaaaccttaaaggttttcctgttctttggactttacctaaagttggtggagtgtatctgagtggaacccttaattgggttgttattatgggaaaagaaaccattcattctgaaatc

SEQ ID NO: 96023 - DNA, 601 bp, Glycine max
  Peptide Sequence Number=SeqID_212801
atgttttttctatacggatttgtaggcacaggaaaaacattcatatggagaacattagcaaattcattgagagcagaaaatcaaattgtgattattgttgcttctagcggaatagcctctctattattaccaggaggcagaactgcacattccagatttaaaattcctataccaatttttgaagactcaacatgtaatattcatcaaggcaccgaattagcagaattattgaaccagacaagcctaataatttgggatgaagcaccaatggcccataaattctgttttgaagcgcttgatcaaagtttaagagatattatcacagataaatcaaagtcaagtcaaatatttggaggcaaagttatagtatttggtggagattttcgccaaatactaccagtcatcccaagaggaacgcgctcagacattgtaaatgcagcaatcaattcatcctatctatgggattcgtgtgaaatattgaccttgaccaaaaacatgcacttacacaacaatctagaatcagttgatgaacaagaaactgccacatttgctaaatggattctagacgttggagatggaattatagatgatgaaaatgatg

SEQ ID NO: 96024 - DNA, 755 bp, Glycine max
  Peptide Sequence Number=SeqID_212802
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgccgcttggccctcccattcagacccctcaggtcgcctgtggacagcctggctcaccctctaagagccttcctgcccgccctgggaacacacaccgcagggtccagggactggcgtcaggggcagagcgaactcagcgccacctgggctccaggccaggctctgctccaggactggcccctccccgattcccatccctgaagccagggccacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 96025 - DNA, 336 bp, Glycine max
  Peptide Sequence Number=SeqID_212803
ccttgcctcggatatgccgctgaagggcaagcagttggtggtatacccatgccaaacactttggagggccctcagtttcgcccacaaccacaacccttgcattttgcggtgggaagagcccctcctgctatggctgaaaagggaaagttggatcatatagaggaaaggctcaaggacattgaaggaggcgatgattatgcctttgctaacctagaggagttgttcctaatgggggcatacacaaaagatgtggaaatactgatgcatttcttccaagaaagttttactgggtatcagtacaattctgatatggcttcagataggatgcaactatag

SEQ ID NO: 96026 - DNA, 872 bp, Glycine max
  Peptide Sequence Number=SeqID_212804
gagactcaggtagcagtggagaagcggtagccggcgccgcgcacggtctgcaccatgttttcggcgttgaacggttccagcgtcttgcgcaggcggcggatgtgcacgtcgatggtgcgctcctccacgtacacgctgccgccccagacatggtccagcagctgggcgcgggtgtagacgcgctcggggtgggtcatgaagaagtgcagcaggcggtattcggtggggccgatcggcaccggctggtcgttggcgaacacgcgatgggcggcaccgtcgatgcggatcgggccgacggccacgctgccgtcctcgtcatcttcgcgggcgcggcgcatcaccgcacggatgcgggccagcagttcgcgcgccgagaacggcttgaccacatagtcgtcgacgccagcttcaaggccaccgacgcgatcgttctcttcgccgcgggcagtcagcatgatgatcggcacttcgcgggtcagggtttccttgcgccagcggcgggccaggtccaggccgctggtgccgggcagcatccagtccagcaggatcaggtcggggacgcggtcggcgatggcggtctgggcctcacgggcgtcgccggcgtggaccggttcgtaatcgcccttgcgcagggcgaaggcgaccatttcacggatcgcgggctcgtcatcgacgatcaggatgcgtttctgcacgaggacaccgtagggctcggttactggagtggtgccagtagactacggtttgatgacatgtgtgtgactggctggccggaaccggcctggattgccatcggccggtcatgcagtgctcagcggcggtccagatccgggtcctgcacgccctggcggcgcagctccagcacggtgggg

SEQ ID NO: 96027 - DNA, 249 bp, Glycine max
  Peptide Sequence Number=SeqID_212805
atgagacctactggtggcgtactgcacactgaatcgttcgatgagggtgtcgaagctatctatggatcttggaaggcgtccaaatgctcgtctggatctgttgtctcatcataccgctcgaggttaagtgatttccaccccaagggtatgtctacctccataatgtggtcgataaaaggatgccaatggacagtctgtgttgttggacgatgcatgagagagactcagatcgtctgcagtgttgcttga

SEQ ID NO: 96028 - DNA, 237 bp, Glycine max
  Peptide Sequence Number=SeqID_212806
atggttaaggaggagtgtaaggaggtaagtgtctcctccaacagtttagctaagaaggaaagtcattttgcaataaagacaaacattaaagaaacttcctctcgtagacaacttcctctcttaaacattaaagaaaaaggtattatgaggcaccaaatccctatgataggtggtatgatgaatatgttgggtggtgcgaccctcttttgtaaaatcaccatgcatccaacatcttaa

SEQ ID NO: 96029 - DNA, 243 bp, Glycine max
  Peptide Sequence Number=SeqID_212807
atggcaggtgagcaacaccaagggatcacccttgaggattattcaagctgctcagtaccacaattctttactagcattacacgtcctgaagtgcaagctcacaacatcaactacccgcattctttaattcgtttaatacatgggaatttattccaaggattacctaatgaagacccctatgcacatttggcaacattcattgaaatatgcaacactgttaagattgccggtgtgctagattga

SEQ ID NO: 96030 - DNA, 342 bp, Glycine max
  Peptide Sequence Number=SeqID_212808
atggaaggtgtgactctagcacatgggaaaggaatatgccacaagaatatgccaaggacatcttatcctgagatgtgtcagaaatcaaaaggaagcaggcttgcgcaatccgtgaaattccgtaatgtggcggaaatcgaaaagagatccttcctccagaaggctgttgcttctggaggaagcatccttgctcgcctgggcgagctgggtggcaagctcctcccctattttgctataaatagggggaggagtgaagaagaaaagggtttagccttcttggcacttctccctctctcgaaattgctgaggaaaattatttccgtgaagaaaatccaagtcgag

SEQ ID NO: 96031 - DNA, 138 bp, Glycine max
  Peptide Sequence Number=SeqID_212809
atggaaatagaatatatgcagttggcagaacaaaagcatgatgagacttcactgtcatcaagcgagttggagacccagcatgaccacaaattgacctccactccttatggctcacatagacccgggtatagggcgtaa

SEQ ID NO: 96032 - DNA, 174 bp, Glycine max
  Peptide Sequence Number=SeqID_212810
atggctcgcttagcacgcataagtggcttttggcttaacgccagtcttctcactcaatacggaggattgcaggtgcaagttgacaatttctacacttcaccaatcttgcctatttcacctgaaattgatacgaaaggatcattaagtgcacaaaattgggatactgagtattga

SEQ ID NO: 96033 - DNA, 792 bp, Glycine max
  Peptide Sequence Number=SeqID_212811
atgaaaaagggactagaaattctgagtaagcaggggctacatagaaaccataaggtggaacctcttcagttttgtgagcactcaaagcaacacaagacgaaattcccaaaggcagtgcacaccacaaaggccatattggactacattcattctaattgtcaggggcctttgagagtttcatccctgggaggagcaaggttgaatagaagtttttggactaaggtaatcagcatagcatgctacttggttaatcaatcccagtccattaccatagatttcaagacccctattgagatatggtctaacaaaccagctaattactcaatgctgaaagtgtttggatgttcagcaaactatcatgtaaatgaaggaaagctcattctgagtataaatgtcacttttgatgagctctctatactacattttaagtttgtgaaaaattcaaacaagataattgatatcactaagcaggtagagtttaagaatcctacaattagaaattttagttatcaggagcactatgaagcacctgatgatactgaacaaaatcatcaaatgcaaccccaacaacatcaatctaaacaagtggatgagtctaaccaaatgagtcagaaccttacgaggaagcctaagactaatgcttttaggaaatctcaaagacaaatcaaagcacttgaaatatatggctttgatgatattgtcttgtatgcactccaggtagcagaagaagttgacttattcgaaccaactacctatcatgaagcaattacttgttctgaagctgataagtga

SEQ ID NO: 96034 - DNA, 894 bp, Glycine max
  Peptide Sequence Number=SeqID_212812
atggctcagttattgtctccagtgtgcatggaggctctgaaaatccacaatccatcactgaatctttgttcaagaagctcatggcggatgctggtgaagggtgcaagtccttgcacctttgtgacacacagtggttggaagagaagagggtgtggcagggtcagagttactgctgaagattcagtttctccctctgagactattgcagatgattattatgaagttcttggactgcttccagatgccacaccagagcagatcaagaaggcatactacaattgcatgaaatcttgccacccggacttgagtggaaacgatcctgagaccacaaatttctgcattttcatcaatgaagtctacacggtgctcagcgatcccgtccaacgcaggatttatgatgaaattcatggctattctttaacttcaattaatcctttcctggatgattcaagcccaagggatcatgcctttgtcgatgaattcagctgcataggctgcaaaaattgtgccaatgtagctcctggtgtgtttgcaattgaggaagactttggaagagccagagcatacaaccaatctgggaaccctgaattagttcaacaggcaattgacagttggcatgttgccctaatgctatcaggaatgggaacagcatcaattgatgttttcagaatggcaaaagcaaaattgagaatgatgagggaagaaggtgctgataagaaaaattcatactgggacaatctttggggcaaacagaaagactaccaaagttcagttgaagaaagagcaaaaagagctgcttcagcagcacgaagatggagagaatactcaaggaggggtgttgataagcctccaacatttaaacttccagaggctagccttggcaaggacaagtga

SEQ ID NO: 96035 - DNA, 747 bp, Glycine max
  Peptide Sequence Number=SeqID_212813
atggatgcagaacaagttttgagattgttggatgccaactggtttgagacaacaattttcaccaacaaaacctctccaccttttcattcagcagtggattcagcttcagagtcccatgtgaaggaagtgtttcctttagattcaaagctcctgagagctccaacacttcaagtgaggtctcttagtgaccaaaacttgagctcaagtgtaggtgttttctctgattttccatcaccaaattctgtcctcacaccacagaggctgaggccaattctttctgggaaggaagtggaagattttccactggcaaaaggtaatggaaaccatgaaaatgaagaggaagaagtagccactaagaaaaagctgagtcatgctcatagaagaagaagaagattcagaaaaggaaaagcaacaaggagtctgtcagaccttgagtttaaggagctaaaagggtttatggatttgggttttgtgttttctgaggaagacaaggactcaaggttggtttctttgataccagggttgcaaaggctaggaaaagaggatgcatcaagagggaactcagaacaaaacattgatgaaactgtggtttgcaggccttatttgtctgaagcttggggtgttttagaccaaaggaaggttgtgaatccattgttgaattggagggtaccagttgtaggcaatgagatagacatgaaggacaatcttaggttctgggctcatacagttgcatccattgtaagataa

SEQ ID NO: 96036 - DNA, 297 bp, Glycine max
  Peptide Sequence Number=SeqID_212814
atgcatatgaggatcaaaaggtctttaaaggttgtaatggggccaaggacaagattaaagcaagaactaggcaatatacagatacatcaagcatggccaaaaatcatatcttccaatgaaacataccccccacacttattcccagcttattccaaaaacaattccaaagctccaaaattccttaagggtaaggaagtatcaacaagaatcaagccaaggctattgtgcaagcaatcaatggggcaaaacacaccaaaagattatgatgatggaaggctcaaattctcacaaaggtaa

SEQ ID NO: 96037 - DNA, 390 bp, Glycine max
  Peptide Sequence Number=SeqID_212815
atgactaagaaatttagaatttcggtcacttacaatactcataggtgtgagatgaaaaacctgttgaatatggtcaaggataaacctaatggatggctacagttgcttgataataatggttcattcgcgattaaatctgcatatgccactattcaggacctaagaatgggaggtatagcggaagaattgttcattcaattgtggaaggtggatgccccccggaaggcactacatatgctttggaggctattatttctcaatagattacctgtgcgggaaaatttattcaagagaaacatccaactatcatcaagtggctcaatgtgtggattctcttatgcaaagtattcttttcactacatggagatggttgattggtctaccctctag

SEQ ID NO: 96038 - DNA, 186 bp, Glycine max
  Peptide Sequence Number=SeqID_212816
atggatatttgtggtgcagagaggactatgacagttgttggagagaagcgagtaataataaagaatgaaaaagagacaaagcaaaggaaactccaatggacaacgattatgatgtttgccaaagcactcttggctggatccaccctctcttttatcccacatctcaccatgtcctttcctagataa

SEQ ID NO: 96039 - DNA, 612 bp, Glycine max
  Peptide Sequence Number=SeqID_212817
atgtcgggtctgtataactccaacttctcaccagtgagggctgcttctcctcagattagaaccaacccagaagtcgacagtcagtaccttacggagttgctggcagagcatcagaagcttggtcccttcatgcaagcccttcccatatgcagtcgtctcttaaatcaagaaatattaagagtttctggaatgctgtccaatcaaggttttggtgactttgacagactgcggcatagaagccctagtcctatggcttcttcaaacctcatgtcaagtgtcactggaacgggattgggtggatggaatagtcttcagcaggagaatgcaaagaaagtcaatcctgttcgtggtaaaagcaaaacatgttggctatatgtgagccaagctaaaccaccacccttgaggctgcaattaaggcagcccctaaagaggccgcaaccacaactaagaggctggctaggggtgattgcaattaaggtggcttttcaacaaaatagattacgcggaactcctggaatggcaatggactggcaagttgcacctgcaagtcctagttcatacacagttaagaggattttgcgcttggaaattccagttgatgcataccccaac

SEQ ID NO: 96040 - DNA, 228 bp, Glycine max
  Peptide Sequence Number=SeqID_212818
atgatgcgtgagagtggagggagagatggagatctttatggcgttttgaatgattggaagtctagaacatgtaaatggcaaaaagaagacacttgctcaagctcaagaatggtaatgagaagaataaagataacgacaacgacaaacttggatgtggcaagaatggaagggcgtgggaatgaaagaagcaaaggtgcgagtgcgagtcaaaaatgttgtattatgtga

SEQ ID NO: 96041 - DNA, 150 bp, Glycine max
  Peptide Sequence Number=SeqID_212819
atggctaccgtgtttgatcagccccgagatgttcattctggtaagcagtcttggaattttaaggcgagtgtaattcaatctcggcacatgtttcctctaaatgatccaaagaagtattatgcctttgagattgttcttctcgactcacat

SEQ ID NO: 96042 - DNA, 1254 bp, Glycine max
  Peptide Sequence Number=SeqID_212820
atgaatgatgggaaagggaggggtgggaattggtggtacgaatcctacgttcaaggaggcatggaggcaccagccactttggctgtggtggtggtcacggcagcaatggcatacaggagaagacacggaatatccagagcttccaccttcaaggaagaggttcatccagattatgatgatgccaatgatccaactcctcttccatctttgtcctcttccttttccttcactccatcttcctctaattcctcatcctcccttgctgctcaggccatcaaagcctctgctgctcgtcgtgatccctctctttcttttactttcgccaaatctgaacaacatgatcaacatcagagatccaagagctttgaggcttacggcgatgtttccaagtctggtgtgtggggcgtccttgctcagaaagccaaagaaattctggaggacgataagtcgtcatccccacaacacaacgacgtcatcaatatcatgccaccagttgtcgacatagacaaactcaaatcgcactcttttaatacctttgctcctcctcctcaggagaataataagacaacaaggccagatcagtcaaatcaaactgcagcagcaggtacgtggaatccatggcagccgcaaccagctgcacaaacaggaggaggagcctctcaaactatccatcaaacacaactcaaggcatctcgcgacgtggcaatggcaacagctgccaaagcaaaattactcctgcgggagctaaagaccgttaaagcagatttggctttttcaaaagcacgttgtgctcaactagaagaagaaaacaaaatgctccgggaccgccagggcaccgacaagggacaaaacgttacccgtgcagacgatgatttgatccggcttcaactagagacacttcttgctgagaagggtcgattagctagtgagaacgaggtatatgctcgggagaatcgttttctacgggaaattgtggagtaccatcagttgaccatgcaagatgtggtgtatcttgatgaaggcatggaagaagtcacagaactttatcccttagatgccactggcactgcggtggttcctcggttatcgccaaagtccccacgctcgcctttaagtcgaggaggctcacagactaaatcatttttttctgtgccacaaatacaagaagaagaaaagaatgttacatcagagtcgtcgttagatgaggctcctcctagtatcatcgattctaaagatcatccgcatgcaaagtga

SEQ ID NO: 96043 - DNA, 603 bp, Glycine max
  Peptide Sequence Number=SeqID_212821
atgggtgttctgtcattgctaagcatgttgatgctagagatgttgagattactgcagagcagcagatgcagattttctgagattgataggcgttgtacctatagatctttgtcccttgaggaggataagtcaatattttcaacagtatatggaaaattgatactgcttgagcatgtaagtgagcatgatattggctacaaagacagcttgatgttgtttgccaaagatttaggacccactgcacaaaatatagctaaaaggaaattacttggatgtgaaattcgtacagtatctacttctgctccatgcagaccagatacttctaatggaagggaaaagggtgtcataaagagttcccaaacaagagtttatgttttgattcatcctattcgcaagcttgtgctgaagattttacttactcagatcaagggtccaaagaaactgatcgagcaacataggttcttacaactgcaacaggattctagtgacaagatgagacccttttctgctccagtgagttatcagggagttttgatccgtaatcctccaactaatttgcacactaccatttgcagtcacaatcagcctaacactagtcattga

SEQ ID NO: 96044 - DNA, 2475 bp, Glycine max
  Peptide Sequence Number=SeqID_212822
atgggacgcgaagcgacgaagaagaagaagatgaataagaatgcaaaatctgggggttttgaatcacttggtctgaatcccaatgtgttcaaaggaatcaagcgcaaagggtacaaagtgcccactccgattcagcggaagaccatgcccctcatcctttctggctccgacgtcgttgccatggctcgcactggctctggcaaaacggcggcgtttcttgtccccatgcttcaccgcctcaaccagcatatccctcagtctggtgtcagagccctcattctatcccctaccagggacttggcccttcagactctcaagttcaccaaagagcttggccacttcacagaccttcgtgttagtttgttagttggtggagatagtatggagattcagtttgaggaattagctcagagtcctgacatcataattgccactcctggtaggctcatgcaccatttgtctgaggttgatgacatgtcattgcgcagcgtcgagtatgttgttttcgacgaggctgattgtttatttggcatgggtttcgccgagcagttgcatcagattcttgctcagctcggggagaaccgtcagaccttgcttttcagtgccacactgcccagtgcccttgctgaatttgccaaggctggtttgagagaccctcagcttgtccgccttgacttagaaactagaattagccctgacttgaagcttgccttcttcactttgaggcaggaggagaagtactccgccttgctctatttggttcgggagcacattggttctgatcagcagacattgatttttgtgtccaccaagcatcatgtggagtttctcaatgttttgtttcgcgaagagggtattgagccatctgtgtgttatggcgacatggaccaagatgctcgcaaaatccatgtatcgaggtttagggctagaaagacaatgttgttgattgtgacagatgttgcggcccggggcattgacattccattacttgataatgttatcaattgggactttccccccaagcctaaaatatttgtccatcgagttggaagggctgcaagggctggtcgaactgggactgcatattcttttgtgactcctgaggatatggcttaccttttggatcttcatttgtttctttcgaaaccaatcaaacctgctcccaccgaagaagagttcttgcaggatatggatggagtaatgtctagatgtgaacaggcaatggcaaatagagaaaccatttatggtcgtttcccacaaaaagtcatcgaccttgtttcagacagagttagggaaattattgatacttctgcggaactggaattattgcagagaacctgtaaaaatgcatttcgtttatattcaaaaacaaaacccttacccgcaaaggagtccattagaagagtaaaggatttgcctcatgaagggctgcatccaatgttcatgaatgtgttggaaacaggggagttaacggcacttgcattttctgagcatttgaaaaagtttaggccaaagcagactattttggaagctgaaggggaagcagctaaatcaaagcatcaacagggcccttctggccaatgggtcgatgtgatgaaaaggaaaagagccattcatgagaatattataaatttggttcgtgaacagcagcagtctaagagtaataaggaaaaggaggaaattcaatcagaaatcagtccttccatggagaaaggaagaaaagtttgtaaagtgaatggttttcatcataaagtattttatacccttgatttaacagcacgtggttctaagaggaagccccaaagtttcaaggatgaggatcactatataagttcaataccaaaaaatcaacatatggaggctggccttacagtaaaagctaatgaagactttgcttctaatagtgactttgaacataccataccatactttctaatggttttagcttttgcttgttcggctttggtcttaatgatgttcaatatttttagattggaagcagctgtccttgatctagtggcagatgatggtactggcattaagaaacaaagatctatgtatcactgggataagaggggtaaaaagtacatcaagttaaacaatggtgaccgtgttgctgcaaatggaaagataaagacagagagtggtgcaaaaacaaaggcaaacaagactggtatatataagaagtggaaagaacgctcacatggtaggatatcacttaaagggacaaataatgatggtgattctcaggaatcaacaagtttggcaggatcttaccaaagaggtcgtaggaattttaaaggcagcaagaagcagcattcaatgcccaatgctcatgtgcgttcagagatcaaagatatggatcaaattcgaaaggagaggcagacaaaagccaacagggtttcttatataaagagcaagtcgacaaagggtaaaaagtttggtaaaaatggtaaaaaaagaaaaggcaaatag

SEQ ID NO: 96045 - DNA, 144 bp, Glycine max
  Peptide Sequence Number=SeqID_212823
atggtggttgtggatatggttgcttctgctacacaacctggaagtgaaagagaagagaaacggcaaagagtattggcgaacaagttcagtgctgatgaagcagtgcgacttctccacagtgacacagccatttcaaacctgtaa

SEQ ID NO: 96046 - DNA, 1938 bp, Glycine max
  Peptide Sequence Number=SeqID_212824
atggctgtgtcactgtggagaagtcgcactgcttcatcagcactgaacttgttcgccaatactctttgccgtttctcttctggttgtgtagcagaagcaaccatatccacaaccaccatctctccccgttttccgtatgcttcatcctctcccaaacccaaacacccacaacacttgctctcccttcttctcagagacccttctcaacgccaacctctccaacaagtccactctcacatcatcacctctggcctcttctacaacccttttcacaacaccctcacttgtttactcctcttcaacaacgtcatccgttgttactcttttggcccttatccccacgaagctcttcacttcttcacatacacccaacattgccacactttcttgacatacccttccctggacaccttctcttttgccttcctctgccatgcttctgccaacccaaattacacccactttgggactcagctccacgcccttgttttcaaggttggttttcagtttcatgtctatgtgaaaactgggctgctgcaaatgtactcaagttcgggccttttagttgaagcagcacaggtgttctacgaaatgcagcacagaaacttagttagttggaatgtttttattactggtttgattaaatggggtgaggttgaacttgcttgttccgtgtttaatcagatgcctgctcggagtgtagtgtcatggactcttgttattgatggatacacacgaaggaatcaacccatcaaagctttaactttgtttaggaaaatgattgaagttgatggcatagaacctactgaagttactcttttgaccatttttccagctattgcaaatatcgggtgtattaagatatgccaatcagttcatgtttatgtagagaaaagaggcttcaatgcctttgatgtacgcattacaaatgcattacttgacttgtatgccaagtgtggatgcatagctagtatgagtagattctttcaggagatacctgatcagaggaggaatttggtatcatggacttcaactatctctggttttgcaatgaatgggatggggagggaagctctagagagttttgaaagcatggagaagactgggctgaggccgaaccatgtgacattccttggtgttttgagtgcctgtagtcatggcgggctggttgaggaggggatcaatttttttgttaaaatggtaaaggattggtgccttgtaccagacatcaagcattatggttgtgtgatagatatgctggggagggctgggaggttagaagaagctgaaaaggttgctttacaggtacctcatgaggttgccaatgctgtgatgtggaggacgctgctgggtgcttgcagtgttcataacaatgttgaaattggtcagagggtgaccaataaaatactggagatggagagaggacatggtggggattatgttcttatgtccaatattctggttggtgttgggagatttaaggacgcagagaggttaagggagcgcatgttcatggtacccgtgagagacattggctctgataatggagttccacaaaagaggattgtgcagtccctcaaaaggagggattgcatcgaacacttggccagcgtcagagagaaagtcaaagtgggcctaaacggctatgagcttggtggccaagaagagcaaactatgcgcagaggtgagaaccaattgagagttaagttggagagcttgttggagagtgagacaatattgaaaaaaagcgctgaaggagtcattaagttcatcattgtgggtgacatgtggacgtgggagcgctcaggggctgcattgagcattaatgaagcttttattactctctcagtcgtagtgctagagatcaaatactttgaaggtggggtttcatgggaatcggaagatctgaagcagaatggaaaggatgagattatgtag

SEQ ID NO: 96047 - DNA, 144 bp, Glycine max
  Peptide Sequence Number=SeqID_212825
atggagttttgtttagccgatagaagtgatgtgccatcaaagcctcaaagacttgttactttggtctcctggcatccttgtgaagatgttgtcaaactcaagactgatggaagctcgtttaggaatcctgatccttcggggtag

SEQ ID NO: 96048 - DNA, 300 bp, Glycine max
  Peptide Sequence Number=SeqID_212826
atggactacaaggattgtgacccaccagacaagttgatgtttttacctattttcgttgttggattaaaagatttggaaaatctttctggaaccaagatcctctatggtctttgcattgggatttccaatgctctttccgactccattttccctgtgacttccttctccaactctcgccagaacacaacacttgagtggcattggcaattccgaaggcctcggagcatattgtcaagaaaacaacccgacacaaactcacaatgtagaaatgaactcgtgaaaaaagttgtttttttttaa

SEQ ID NO: 96049 - DNA, 678 bp, Glycine max
  Peptide Sequence Number=SeqID_212827
atgccgcaaggggattacatagagcgtcacagaagagactatggctaccgtctcgatcacttcgagcggaagcgcaagaaagaggcgcgtcaagttcacaaacgctctgcaattgcccagaaggctctgggtattaagggcaaaatgattgccaagaaaaattatgctgaaaaggcacagatgaagaagacacttgttcttagcaacaccattaagcaaaagaggaaggagaaggcgggaaaatgggatgttcctctacctaaggtacgtccggtggctgaagatgaaatgttcaaagtggtccgtactggtaaaagaaagaccaagcaatggaagaggatggttacaaaagctacatttgttgggcctggttttaccagaaagcctccaaagtacgagcgattcattcgtcctacaggattgcggttcactaaagctcatgtcactcacccagaacttaaatgcacattcaatctagaattaattggagtgaagaaaaaccccaatggccctatgtacacctctcttggtgtcattaccaggggaactataattgaggtgaatgtcagtgaacttggtcttgtcacacctgctgggaaagttgtgtggggtaaatacgctcaggtcacaaataacccagaaaatgatggttgtataaatgctgttttgcttgtttaa

SEQ ID NO: 96050 - DNA, 135 bp, Glycine max
  Peptide Sequence Number=SeqID_212828
atgatttggagtgcggaagaggtgattgatcgctggagtgcaactgagaggtttgtcaaaggagttgcagcacatggtgatgaagatctcatacgctatgagagtgagatcaaaattggagtggttggtgactag

SEQ ID NO: 96051 - DNA, 309 bp, Glycine max
  Peptide Sequence Number=SeqID_212829
atgtcgcgagtcccacccacgaacacaacaagctcaagaaaagcttggcagcttgctgcttgtgtcaatgacgagctcgagacaagcgtggaagccgcgagtaccacgacccacgaggatcccacccacgaacacgatgagctcaagagaagcttggcagcttgttgcttgtgtcaaccacgagctcaagagaagcctggaagccgcgagtaccacgaaccacaaccacgacccacgaggtgtttgctccatctgaaatatctatttcaggatcataccgagaggtttattccctactgtgaaaactga

SEQ ID NO: 96052 - DNA, 489 bp, Glycine max
  Peptide Sequence Number=SeqID_212830
atgaaacaagaacaaattagagaaattgaggagaatgtcatgcttccagcctttgttgaaggcaaatcgaggaaattgaggttggggaggagagggtcgatcggtggtggtgatcacgatattggacaatatcttgaacccaatgttatcaaaatcgagagtctacatagactcgtgagagctccaaagactcgacttgaagagtcgactcagactcatggagcaaacacctcgtgggtcgtggttgtggttcgtgctcatcgtgttcgtgggtgggatcctgaaatagatatttcagatggagcaaacacctcgtgggtcgtggtactcgcggcttccacgcttgtctcgagctcgtcattgacacaagcagcaagctgccaagcttttcttgagcttgttgtgttcgtgggtatagatcccgcgctagcattggtgcacatagttggtgcacgtgttggcgctctcccgcgtcatgatgaccaatag

SEQ ID NO: 96053 - DNA, 693 bp, Glycine max
  Peptide Sequence Number=SeqID_212831
atgaggttcagggttcagggtttagggtttaggattaaggattcatggcttagtggtcaaggatcaggggtcagatcagggtttaagcttttggcttctgtggatctgtgcaaagactcaatgaaagatactcccaccgattgtgtggttcctataactcctgaggctgtcattgagaatggggatttgcaatcccaatcccctctcacactctcagtggtcaggaaacaactcaaacgtgcctgcattgattgcgattctgaccgtatctctgttgataataataatgacaatggcagcccccgaactcctaaggatggtgtttttgacccctttgcacctggtcctgataacatggcgctggcacccaacagcaacaagtatcttgatgagtacaggaccaccgttgcccgccgacttgatttccatccctcctttgatgttgttgctcaagcagttactgatactctttcagatgaggaaatggttgaatctgtgtatgagaatcttttgcaagttattgtttctaagcaagctgagggtgttcttgctcaaatgtcagatgattgtgaaacacctccttcggtgctccacttctctggaattgctgatacttgtcctggtgcacctataaaaccagcggctaaacctaggaacattgatttggggttgtgcaagaagcttgaattctga

SEQ ID NO: 96054 - DNA, 375 bp, Glycine max
  Peptide Sequence Number=SeqID_212832
atgacgaccttgagcttcaaactcgggaaaaccaaagtgggcgttagtgtgaggcagcatgctgccacgtcgaagaggttctcgcgaagctcccaggacttggcctggatgctgaagcggtataggggaagaaaggttttggcatgcgatgaagaggacggagagcgaagcgacgagtttgagatgtgcgttcctatagatgagtcttctgacgtgcaagtgcaggcaggatacaacagcgagagcgatgcaatgcaatggagctcttgcttgcactttattttacagaattggagcaatgtgcttagcgcgccattgcacgctcaacgcgagaagccaaactggaagccagttctattgagcatgggtgcttag

SEQ ID NO: 96055 - DNA, 279 bp, Glycine max
  Peptide Sequence Number=SeqID_212833
atggactgtatggttgagattgagagttccattaatgccaatgccaatttccacataattgcacttgaagctccgccaacatcaacatttgttagtgatagttgtaaggaattctatagagaaggatttattttatctttagtgcttgaagagggaagtgttggttatgagttagagttcatagctctaatacaagatatggatagcggtgtggagcggctgccacagaaaaatgagatagtagatagcgagatgatcgctattctaatattttcataa

SEQ ID NO: 96056 - DNA, 744 bp, Glycine max
  Peptide Sequence Number=SeqID_212834
atggacttcattactcgtctattgccatcgcatggattcaccgttatcctcgtcgtcgttgatcgatattcgaagggagtacattttggtgcattatcgacaagcttctcaaccttcaaggtcacgtctctattcctggacttggtttgcaaacaccatggtttccctcgcagcatcgttttcgatcgagatccgataatcgtgagctccttctggcaggaactgttccggcttagcggcacccgtctgtgtatgagcacagcataccatccgcagaccgacgaccaaaccgaggtaatgaaccacatcttagaacagtacctgcgctccttcgtccattcccatccggtaagctggtttcgttacctggcgttagcggaatggtcatataacacttcccttcattccagcttaaacctcactctgttcaaagtgaaatatggcaaaccacctccagcgatgccccattatcttcaggggatgaccaacaacgaagcagttgattctctgtgtcgcaacccctctgcattctggactcgaagcttgatgcttcaacatctccaccaactcaattggttcttattcaatggatgggacagcctctggaagatacttcctaggagccatggctcgaggtacgcgatgcttaccaccttgaggacaaggtggtgtttggagaggggagtattgatagcaatccttaggaggaacttgaactcacaacagcgagacccacgagggtag

SEQ ID NO: 96057 - DNA, 1233 bp, Glycine max
  Peptide Sequence Number=SeqID_212835
atggcagttggtggagaacaagaacacaccttgcaagattacctcaccccttgtgtgataatcactacacatatacaactcccaaatctgggagatcaaaattgtaagctgaggcatgtgttgatcaacatgattgagagaatacagttccatggtctaccatcagaagatcctatagtccatctaaggatgttctcgagactcatagacacggtgaagagccttgccaatgctcctgactacattagattgactacttttccattctcattaaggggaagggctgaagattggcttagtgatttgtcaaagtcattctctaaagcatgggaacatttcaaggggctgcaaagaaactacctagatgttgtagtaagggagaacctcatgcacaaaatgacaaatgtagaagtggagatcattgaggttgtggcttctaatgcttataatgacacaatattggttgtgacccctactctaatacctacaaccaaagctcaagagatcatccaaacttctcttggaaaaagcagggagatcagaggccaagataaaaaggagagaagaccaaccttccaagacatggtgatggagcacataactaagaatgatgaaaggttcaaatccttggaatccaccatgtcaaatcttgagtggaaagtctatggtagaaccgaagaagaaagaaaaggtcactccaacactaggaaaaaaaggcttactgaggagagtcataagacagaaaaaatgggtgaaaaaaaggttttgacaactctccagaaattgcatgttaacattccttttgatgaggcaattgatgaaatggtaaagtatgccaagtttttaaaggagattatttcaaataaaaagaaattgaaagactttacaatagttagtctcaacaaggaatgttttgctattgttctaaagaaactgcctcctaagcttaaaacccttgtgccattggttggcaaatacattttccctacggactttatgattttggatatagaggagaatgaagacacaccaattattttgggacaactcttcctcaacacaagaggaacattgattgatgtcaaggaaaggaaattgacttggtggctaggtgatgaggaggaagtatttaaggccactaacaagataaaagtaactgtggctaagtctgacctaagtatggggaagaaagaccctcttaggaacaaagttattccaaaagaccctagatga

SEQ ID NO: 96058 - DNA, 429 bp, Glycine max
  Peptide Sequence Number=SeqID_212836
atggcaaacaacaaatatgagtatgtcaagtgttttgaagttgaggatgaagccatgtttcccaatatcatccttgtttggatcaaggctagtaaacttcataaacctcatgattcaaatgccttgaaattgatgaactcttgtgctgttgaagttcttgaagagtatgcagatataatccttgcatacgggttcagtgatgagtatacttttattttcaagaagacctccaagttctacgaaaggcgtgcaagcaaagtgctatccatcattacttcttttttctcatctgtctttaaccatggtcaaccaagaagatcatggtcaatcatgagggccctcgttatttcacaatatctcaagtttcaatgccagtatttcgataacaacaatggtggatatcaccatgaccatagtgagcttaattaa

SEQ ID NO: 96059 - DNA, 1458 bp, Glycine max
  Peptide Sequence Number=SeqID_212837
atggaatgccaaggttgcccttgttcaactagatgcgcccttggaataatatcaggtcattatggatgcgatattcagggtaggttgaaggattggcgcgaacctaggaaagaagagcatttggccgaaactgggcagaatgcgagagagcacgtctacgacggtgttagtggtgccagccttgtactgaatgttgtaatcaaacccgagcaacttagagaggtagtagtattgttatggggtttggataacctacgtcatgagttcccgaaggctcttatggtctgtcataatgcgtggattaatcgaggtccgaagagcttgctgaagaacgctatcagatgcccatgttgcataagcactactctcatggccgtggcggacgcatctgtctcgacgacgaagggttccgcgaaattaggaagggccaaaactggggcacttgtcatttccagtttaagttggtcaaatgcagtgagtcctaggaacatgcgaagatccttggctgaggtcggtgtaggccatcggaccatggcttggaccttggaaggttctggctcaactcccttgccggagaccacatgccctaagtattccaactgtttttgtgcgaacaaacatttggcttgcttcaacgacaaaatggcgcaagaaggggttgagcaggttgtttatggcggcctgaaaggtggagggagcgttacacaacccaaagggcataacgagatactcataatgcccgttgtgtgtcctgaatgccgtctttttgacgtcgagctcacgcataggaatctgatgaaacccctaccggaggccaatggcgagaagttcggaaacttgcttttcgatctcgactttctggaagtgtggataacggtagggtcgtactttcacgggcatagtggcggggagaagattaatgcgatgagctacttctcgcggaggagggagggtaaaaggcacaaatggaacaaggccgaggttgacccggttcgcacaaggcgtttaacttggggtgccaaagcgggttctggcccaatctccacatctgcgtgtaactcaatatcgcggcccaggggtggccttggagtgaaaggtgagtgtttggacacagctggttacaatcgaaaacggagccgttacctactagcactcaatggggagatgtggactgggtgggaaggtggaggaattgcgcggaaggtttctgatgatggaaggccagacaaagcgtggaggttgatatctgccgtgggttcaggcacgccggagtttgcctcttcgctaactgttggaatctctggttctagttggatgatggtggctgaaagttgttggagcggtacgtcgacgatcgtcgatcccacaacttgtcttcttaaagcttcacaagtgcggttgcctgaggaagagaaattggttgaagtgccaagacttcccatcgaatctccggtgtga

SEQ ID NO: 96060 - DNA, 140 bp, Glycine max
  Peptide Sequence Number=SeqID_212838
aggaaacactgggtccaacaaagataggagaaaatcactaaaagtgtatcaatctcacacagggcaaggattgacattctcaccctgggtcaaggtttatgataagttgggattttggctcaaggcttgtagaacggctg

SEQ ID NO: 96061 - DNA, 432 bp, Glycine max
  Peptide Sequence Number=SeqID_212839
atgaagatgttaggtgtacgagtgattttacaaaagagggttgcaccactcaaaacattcatcataccacccattttagggacttggtgcctaataatacctattttgggcaccaacaaagcacaaggatttaagcttgttgcaacatgcccttttgcgggcgagcgaggcgaggctcatgggtgtgctttccaagggaggaaagatgcgcggagtcgccaccaacgtttatttgtgaaaaacgtcaaaaaaatcgaaggaaaccggtcgacaaaagcagggctcttgctcctacgtaccctccaacgaagaggaaatcagacctacgtagttctttttaagggtgaatcaagcgattctttttacttggaaggtgatcatttaaggcgttggaccttaaaaatgatccatttacttggtaaggaaaactga

SEQ ID NO: 96062 - DNA, 144 bp, Glycine max
  Peptide Sequence Number=SeqID_212840
atgacgacgcgagtgagggctttcaaagcagaactcgaacaagaaaaacgtatattagcaagaaaaatttcccatgctgatccctcgcaaaatcatttagcaagagaagatcgaagaattagtgagggaaagttgcctaactaa

SEQ ID NO: 96063 - DNA, 822 bp, Glycine max
  Peptide Sequence Number=SeqID_212841
atgaggatctattggcatcattgtcatgtccttgacttgatgaaggtgacatcgttgtacttagcaaaacaactgttgagctgcaatgcgtcgtcacaaaaggtgaagcaaaggttgtcaagatggggtgaccacgtgcgacacgcaacaagagcacgggtcattgatgaggttgctacgatactcgaagaggtcgtagacggcattggaggaggtggggaaggtgaatttgctgcggttggagaaggcaacgaagttgaccaggaagatgaggaacgagtcaacgtcataagtggctatgattataagagtttgagggacttggttattgatgaccaagcagaccttgtgttgcagctcagcaagcagaagaagaagaggaagagagttaaggattcctcaaaaactgaattgggaggagtatccaaacctcttggtggaagtgattttgttggatatgatgttggtggtggtggtaaacttcctgagatggagaaaagaaaagagatcgagttagagaaagacgaagagcaaggaaaaagaaaaaagaaaagcgactcaagaagtaatcaaagtggtcctactttggttactcaacacaacgatcacaccaataaagccattcttcactaccatcaaggtaaattgcaccgattagatcatgtcttggttgctcagaatattatttcactttggaatgctgagttgactggtccacaattcgttcaatcctttgttttcttgagtcaaaatgaccgggatatgatgaattatgttggaccggtggagagtttggatgcaactgagattttccttggttga

SEQ ID NO: 96064 - DNA, 3519 bp, Glycine max
  Peptide Sequence Number=SeqID_212842
atgatgaaaaacgtatcatggttttggacccggtttggccgtggatcatcctccaatttcagcacagtaagtatagcatccagttcttccaatgactccgtcgacagtagcatccaaaaccaaaactacagatacgatgtatttatcagtttcagaggtcctgacacccgcaacactttcgttgatcatctttatgcccatctcctccgaaagggtattttcgtctttaaggatgacaaaaagctccagaaaggagaatccatatcagcacagcttctacaagcaattcaagattcacgcctttcaatcattgtcttttccaaacaatacgcttcctccacatggtgtttagacgaaatggccgctatagctgattgcaaacaacaatcaaaccaaactgtgttccctgttttctatgatgtagatccatctcatgtaagacatcagaacggggcatacgaggttgcctttgtttcacacagatcgagattcagagaagatccagacaaggttgatcgatgggcgagagctatgacagatctggccaattcagctggttgggatgtcatgaacaagcccgagtttagagagattgaaaatattgttcaagaggtgataaaaacattgggtcataaattctctgggtttgttgatgacctcattgggatacaatcacgtgtacaagaattagaaggtagtttaaaattaagttcaaataatgataatgttcgagttttaggaatttgcgggatgggtggaataggaaagacaactcaggctgttgtcttgtatgatagaatatcttacaagtttgacgcttgttgtttcgttgagaatgtaaacaaaatttacagggatggaggtgcaactgctatacaaaagcaaatagttcgtcaaactttagacgagaaaaatctagaaatatatagtccttttgaaatatcaggaatagtaagaaataggctacacaacataaaagtcctcatatttcttgacaatgttgaccaaatagagcaattgcaggaattggccataaaccctaattttctttttgaagggagtagaatgattattatcactagggatgagcatattctaaaagtgtatggagcacatgtaatacacaaggtttcattaatgaatgataatgatgctcgcaagctgttttattcaaaagctttcaaaagtgaagaccaaagtagtagttgtgtagagttgattcctgaggtactcaaatatgtccagtgtcttccattagcaattaaagtaataggttctttcttgtgtactcgaaatgctacccaatggaaagatgctttggatagatttcagaatagtccagataatggaatcatggatgtacttcaaataagtattgatggactacaatatgaagaaaaagaaatatttttacacattgcttgtttctttaaagaagagatggaggattatgctaagcgaattctgaactgttgtggattacacactcacattggaatcccaagactcattgagaaatcactcataacacttagagatcaagaaattcatatgcatgatatgttgcaagaattgggaaagaaaattgttcgcaatcaatttcctgaacaaccaggatcatggagtagaatatggctttatgaagatttctttcgtgtcatgacaacccaaacgggaacaaataatgtcacagccgtagttctaaataaaaaagatcaagatatgtccgaatgtagcgttgctgaactatcaaaaatgaagaaccttaggttacttatattatatcaaaaaagtttttcaggaagcctcgattttctctccacccagctgcgatatcttttgtggcatgattatccttttacttctttgccatcatgttttgcggcctttgatcttgaggaattgaatatgcctagtagtagcatcaattgtttatgggaaggccgcaagaattttccatgtctgaaaaggatggatttgagcaactccaaatttcttgtagagactccagatttttctggggccccataccttgagcggttggatctttcaggatgcacagatttaacatttgtccatccatcaatgggacgtcttgaaaaccttgttttcttgagtttcagaaattgtaacaatctaataagcatcaaaattggccgtggttttaatctaatttctttgagagttctacatttctctggttgcactaaacttgaaaacaccccagattttacaaggacaacaaatcttgagtaccttgactttgatggatgtacaagtttatcctcggtacatgaatctattggagctcttgcaaaacttacattcttgagttttagagactgcaaaaatcttgttagtatacctaacaacatgaataccatgacatctcttcaaaccctagatttatggggatgcttggaacttatggatttgcccttaggacgagctttcagtccttcatcccatttgaaatctttggtttttctggatatgggcttttgcaatctagttaaagtacctgatgctattggagagttaaggtgtttagaaagactgaatcttcaaggaaacaattttgtttcaataccttatgattccttctgtgggctacattgtctagcgtatttaaacttgtctcattgccataagcttgaagctttgcccgaccttccatcagaaagggcttcattagggggatggtattttaaaacggtatctggatctcgtgaccatacgtcagggttatatgtttttgattgtcccaagctggctcatatgttggtgtcgccaagcagagacttagaacttgcatggttagtgagactgattaaggaaccttgtaattttcggtgtggctttgacattgttgttcctttgggtttggaagttattcttcctcggtggttattaaaccaagggtttaaaggggattcagttatacggataatgcagtttaatgtggatgacaactggattggttttgtcttttgtgttacatttgagcggaacattattcgtcctgcggtttctagtagttctccacattgttcattttcttcgtcacatccgtttcgtctttcttttgaaagtgaatacacagaagaatactttgacatgccacttaatttggagttgaacaagatttatggatcaaaacatctttgggtcatttatatctctcgagaacactgccattttgtgaaaacaggggctcatatcacatttaaagcccactcaagtgttaagatcaatgcatggggcatgaagagtatattcaggcaagatatagatgaccttgaaaggatgcaacaaggagaatctcttccactccatcctaatgatgtagtacaccatgttgactttgatagtgtagaaaaaagtaacaacaactctgggcctaaattccagcttccttacaattggttggttacaaaggaagatgaagttgagaatatgaacacaaaggcaaaagaaactaatctctctaatgcggggttgtcagacgacacaaggtaa

SEQ ID NO: 96065 - DNA, 138 bp, Glycine max
  Peptide Sequence Number=SeqID_212843
atgataggagggtcaacatgtgtttacctgtacctaatgcctgcagtacacttcttaggagcaggtcttgaaagcttaacgagatttgtgggtagaggcgcagatgagaagtacctaaagtggaaatggagagattaa

SEQ ID NO: 96066 - DNA, 258 bp, Glycine max
  Peptide Sequence Number=SeqID_212844
atggcagggtacaagggcgatgacgagtacgattacctcttcaagctggttctgatcggcgattctggtgtggggaagtccaacctgctttcgcgcttcaccaggaacgagttcaatttggagtccaagtccaccataggggttgagttcgccaccaagagcttgaacatcgatgctaaggtcatcaaggctcagatttgggacaccgctggccaggaaagagttgaaactggaggtatgttttttgtgagagtatga

SEQ ID NO: 96067 - DNA, 738 bp, Glycine max
  Peptide Sequence Number=SeqID_212845
atggccatgggtaatgaaggagtgcatgacagtcagattagagtagatgatctcgacgtgatgtacatgaatgatatctcacagaataataatattggcagtggatccttggcattttcttctgaacagtctgcagatgctaatgctactttgtgggactgttgttccacagacgagattttgagtgctggattcaacatgcaacgagcgagtgaccttatttttgggttctcaatatttgctgagccaatgaaaaccgaaatcatcgagcatgcgcgtttagctatggatgagttggtaaagttaggcactgcagggcatcctttatggcagccgcaaccaaaggatagatttgacattttaaatcaaattgaatatttgaggcaatttggtgaggttgatacagcgctaagggagattgttaagttgattgaggttggagagcctcaaaatttaccaagctttgacacatatcaaaccgagcagccagcatcaaaggaaactccgacagtagctctacaaactgaagcttcacgagatatggcgtttattaacatgtcgccaatcagcattgttgaattgctgatggatgtagaacgggtattgcttcttcagtctccgatcttgactctccaacatatacccgtacccatatcggatggattaaaatttgttatcctatccccatacatgtcgggtatcggatattccggtcccgtccccgatttagatttgtaa

SEQ ID NO: 96068 - DNA, 1023 bp, Glycine max
  Peptide Sequence Number=SeqID_212846
atgaataacgccaggaaagaagatattgcatgggtgaataccctgaaaggggtgtgcatattgttagtggtgctgtaccacaccgtattacccggctttgaaggcacggttaaatatctcagcgccggctggatcccggcggaaatatgggtacagtttaatacggtgttatcaccgttgcgtatgcccgcctttttcttcgtctccggcctgcttgccaccaacggcattctcaaccggccgtggaaacagtggtggtcgattgttggcatttcgactgaaatcaccggccagcgtatctcgcagaatctcaacgcggcttacgccggttcgctgctggagttccttaagctgaccttcctggcgatgagcacctcgtggtacctgtacggtctggcgatctacttcctgtgcgccaaaatcttccgtcagcacaaagtggcgctgctggtggcggcggtggtgctgaattatctggcggtggagaagatcattccctactggggaccgcagagcgtggcacagtatttcctgttcttcctgctgggcgcgttctggagcccgctgatgttgcgcctgagtcagctgcgccgcgagaaccttctgccgtgggccgcgctggcggcgctgtccggtatgcacgtgatttttggcctcgataagagcctgttcatgtgcatcatcgcggtgctggtgagcgtggcggcgtgccgctggctcaacgcgcatttcagcatgcgttacttcaactggattggccgcaacacgctgcagatctacgttatccaccgcatttttattgagttcttcggcatgtcagcgattctgtttgcgcagcgccatcatctgtttgagcaggcgtggtttgcgctgctgtgggcgtgcttctatccgctggcgattgttggcatctgttcgctgtgttcggtggcggtgtggtcactgaccaaccgcgggctggggcagtcgctgtttgtgttcccgacgctgattggtttgaaacgcagtaagtcggtggcgtga

SEQ ID NO: 96069 - DNA, 888 bp, Glycine max
  Peptide Sequence Number=SeqID_212847
atggcgataagcgtgatgccccatctcatgcagcatcaccgccgccagagcatcgtcgtttttcgacagggcgaccagcccatcgctgagcaccagcgtgccgtccggcaacataaaggcgttcggcgcaccgggcgccgccatcagcttcaacgacagcggcgtacgctcctggcgcatctcggccggcatcacctgccggaacagctgctgcaacgcctgctgacgctcggccggcaatgcggagggttcaaagccgctttggctcaaaaacgtctgcgtatgttcgcccagcgtctgttccaccgaggtagggatgcgcatggcgatctcgctgctcgcccacggcagcacgacgttaacgtaggctacgaccgccagcagcgtcatcagcagcgccacggcgacgccgcgtttgtggcgctccaggcgatgcacccagcccggcgaacggcgctgatagaaccagcggcggaaggccgcatcgtcatccggcacaaagcgcgcgccgtccttgaaggtcagcgtcagcggaatattgcccagcgccgcagagacggtgatgtccgccaaggggatgtaacgttgctcatcctgccgctgcagcgtcacgccctcgccgctttcgttcaccagcaggcgagccgcctcacgcgcggcccgccccggcaactgataggcgccctcgaggatcatcggcgcctcagaagctgccgcccagatccagcgcctgcaacgcttcttcggccaccgcgctgttggcggtttcctgatgcgccgcgatgtccagcaatgccagatcgccttcgaccgccgtgcactccgccagataacgggcgtggcgcacttccgccaccggcacggcgaaaccgagcgagaacagggtga

SEQ ID NO: 96070 - DNA, 729 bp, Glycine max
  Peptide Sequence Number=SeqID_212848
atgacgctgctggcggtcgtagcctacgttaacgtcgtgctgccgtgggcgagcagcgagatcgccatgcgcatccctacctcggtggaacagacgctgggcgaacatacgcagacgtttttgagccaaagcggctttgaaccctccgcattgccggccgagcgtcagcaggcgttgcagcagctgttccggcaggtgatgccggccgagatgcgccaggagcgtacgccgctgtcgttgaagctgatggcggcgcccggtgcgccgaacgcctttatgttgccggacggcacgctggtgctcagcgatgggctggtcgccctgtcgaaaaacgacgatgctctggcggcggtgatgctgcatgagatggggcatcacgcttatcgccatccgatgcgcatgctggtgcgttcgtcactggtggcgttgacgctgatgtggatgaccggcgacgtcagcggcatcggcgacacgctgctgcagtctgcgtccttcgtgaatgagatgcagttttcccgcggcatggagcgtgaggcggatgcgtttgcgatagcggaaatgcagcgccaggggcgttcgctggcgcaaatggcggcgatctaccgcgcgttggcgcaggcgcctgaacgcgaaacggctgacggctgggcgctgccggcctggctcagcacccatccggcgatgcaggaacggctggacgcggtgaacgaggcgatggcgcagcagtaa

SEQ ID NO: 96071 - DNA, 618 bp, Glycine max
  Peptide Sequence Number=SeqID_212849
atggcggcagctacgccgaccatgccggcgtggcgctggagagcgagttcttgccggacagcccgcaccatcccgagtggccgcagccggactgctggctgcagccggggagccgctatcgcagcgccacgcattatcagttttatcctatctgacccgccacgcccctcgcccgcgcactacactcaggctaccgtgataagcacaacgccttgtgcaacgtcacctttttcggccaatggcggccaatcaatagctgaaggaacacctatgcgtctgattactgcacttccattgctggcgggcttaatgctgagcaccaatctgatggcggccgacgcgacgacggcgacgaaaacgccttcgccggcgcaggcggctcaacagaaacgcatgaccgactgcaaccagcaggcatccaccaaatcgctgaaaggcgccgatcgttccaccttcatgagcacctgtctgaaatccgaaggctccgccgcgacgggcaaaaccctgacgccgcagcagcagaaaatgaagaactgcaacgccgacgccaagaccaaagatctgaagggcgacgcgcgtaaaaccttcatgagcaactgcctgaaaaaatcggcctga

SEQ ID NO: 96072 - DNA, 153 bp, Glycine max
  Peptide Sequence Number=SeqID_212850
atgtgggagatattacatgatggtttgaagtacaagattgaaatacactgccagaacatatcggccattcgagctgttattgaggaaaactcccatggaatcctagaaattgaggataggaaagttaaaggagtggaaagtgggccaagataa

SEQ ID NO: 96073 - DNA, 672 bp, Glycine max
  Peptide Sequence Number=SeqID_212851
atgactaagggccaaggaaacttttaccattatccctggcttgttcagtttccatcaccagcaactttaagagtggccactagagtttcctcctctgccttcaccggaatggccactagagtttcctcctctgccttcaccagagattccaatatcttgccttcatctacctatgcgtacaaagatgtgcacaagaaggcacaggccatccagaagcagaatactaccccccacgtagtgtctcgtgggggttatgattatttggagcagaagctcctgtctgagaagacggagaagaagctggaggaagttgcacagtcagaaagcgttgatggcgtcatcgaccctccatccccggtcagacgccacgtgaagtggaagatggcccgcacgaagaaaacaggggagataacgactgaggtcgcaaaggaaatcactgagaagattgattcctttgaggagcaggccacacagggatccttcgtcccccatggacgtcaggatgttctccccgctgctattggacgtccaaagaaacttggacgtgtccgtgctattggagccggtgtcaccatcaagcaatactttggatcggctccacgaacgtcccgcagcgattcctccctgcctcctaacgaattgcagcagctgacccagctaatcagggactag

SEQ ID NO: 96074 - DNA, 807 bp, Glycine max
  Peptide Sequence Number=SeqID_212852
atggggtacgaagtttttatgcctattgaaccagatgttgtagcttggggttcgtttttgtcttcgtgtagggttcataaatatgttgatttggctaaagtggctgctgaaaaattgcttcttattgatcccaataatagtggggcttactcagcgcttgctaatacactttcagcctgtggtaaatgggaggatgctgctaaggttaggaagtcaatgaaggacaaagcagtaaagaaagaacaaggattcagttgggttcaaatcaagaacaatgtccatatttttggggttgaggatgctcttcacccgcaaagagatgcaatctaccctcgggcagggaacttgagtagagtgaaagagataattcaaaactattctaattatgagacaaaagatttgttggcaaagcagaacctagagggggagacccctctttatgttgcttcagcgaacggacatgctttggttattcgtgagatactgaagtacttggacctgcaaactgtttctattgcagccaaaaatggctatgatccattccatattgctgcaaagcagggccatcttgaggtgctgagagaactactgcactcctttcccaacttggccatgaccacagatttgtccaactcaactgctttacacacagctgcgactcaaggtcatattgatgtggttaatcttcttctggaatcagattctaaccttgctaaaatagccaggaataatggtaaaactgtcctccactctgcagctagaatggggcatttggaagttgtgaaagctttactaaacaaggattga

SEQ ID NO: 96075 - DNA, 4779 bp, Glycine max
  Peptide Sequence Number=SeqID_212853
atggctagtggagcacgtgcggggcatgagagcaaggatgatgagtcacgcatagtggaaggcatgaataacaaacttccggatgatgcggaattgggacgtggaaagagattagttatcatcaataaagtgcaactttcccttgtccattttactgttacattcattacattggtgctttcatctcatcatggcagacaacacacgcatgaaagagatctatgcagaattgaaaaaaatgctgatgccattacgcgtgtcagtgaggacttccatcgtcagatcgagcgtttggaaggtgctaaccacgctcatatggaaaggatggaagcgattcagatagcaaatgagtcacagattacacagctcaattctgctatgacgcaaatcctgcaacgactacaatccattccggtgtcttcccatggtgcatcgaactcaaacaaagaacaaacgaggactccttttcagtttttcgattactatgctactcctgatgctgatagattactcatagcgtctgtgcacttagatcatgatgtggtaccttggtatcaaatgatgcaaaaaactgatccattgctgtcatggcaagctcttactcgagctctagaacttgattttggcccatccgcttatgactgtcctcgagctaccttgttcaaactagctcagtctgcatctgtgaatgaattttatatacaatttactgcgttaatgaatagagtcgatggtttaagcccagcagctattcttgattgctttattagtggcttgcaagatgaaattagaagggatgtgaaagccatggaacctaggaccctgagcaaagcagtggccttagccaaattatttgaagaaaaatatatagccaacaaaaaacctaaccaaatgaccaacttagccagaaattatagccaaaacacttcattcaaccacaaaaacaaccaaaattcccaaaaatttgatcacaccactaagcccaaccttccacctctcttacccactcctcagatcaaaccttttaaccctagaaaccaaaacatcaaaaaaatctctccagcagaaatccagctgagaagggagaaaaacttgtgctatttctgtgatgaaaagttttctccagctcacaaatgtcccaacagacaagtcatgttgctccagcttgaggatgatgaagagctacagtcagatcaaaaccaggcaactatagaggaaggtgaagaaggaagtaatgaaactgaaactcaccacctgtcactcaatgctatgaaagggtctaatggagttggcaccattagatttacaggccaggtgggtagtataagggtcaagattttagtggatggaggcagctcggataacttcattcaaccaagagtagctcaagtgttgaagcttccaattgagccagctcccaacctcagagtattggttggcaatggtcagacgttacaggcagagggtatgattcagcaattacccttacatattcagggtcaagaagttaaagtacctgtgtatctattacaaatttctggtgcggatgtgatcttaggatcaacttggttagcaacattgggccctcatgttgctgattatgcagcattgactcttaaattctttcaaaatggtcatttcattaccctgcaaggggaaggtactatggaacccagtccagcccaatttcatcatttcagaagattgcataacactgatgcaatagaagaatgttttgcaattcaatggttacaaaatgaagtacctggagatacattgctggagttacctacagatatggaccctgaaattgccatattactacacacttatgctcaagtgttcaaagtgccttcttcactaccacccccaagagaacaggatcatgccattccactgaagcaaggatcagagcctgttaaggtgagaccttacagatatccacacacacagaaagaacaaatagaaaaaatggttcaagaaatgcttgatcaaggcatcatacaaccaagtaccagccctttctcttcaccaattctgttggtcaaaaagaaagatgggagttggagattttgtactgactatagggctctcaatgccattactgtgaaagacagttttcccatgccaacagtggatgaattacttgatgagttatatggagcccaatatttttctaagctggatttgaggtcaggttaccatcagattatggtaaaacctgaggacagagccaaaactgccttcagaacccaccatggccattatgaatggttggtaatgccatttgggctcactaatgcaccagccactttccaatctctgatgaataaggtatttcagtctgccttaaggaagtttgtgttagtattctttgatgatattttggtatttagctcttcttggcatgatcatctcaaacacttagaggcagtgttacaaatattacaacaacatcaattgtatgccagattgtcaaaatgttcttttggagcttcagaggttgattacttgggacaccaggtatcaggcaagggtgtgtccatggaaagcactaaagtccaggcagttttggagtggcctcctcctaccaatgtcaaacaattgagagggtttcttggcttgacaggatactatagaagattcatcaaagcctatgcccacattgctgcacctttaacagatttgttaaagaaagataattttgtgtggaattctgaagcagaagcagctttccttaagctcaaaaatgccatgactatagcaccagtgctagccttacctgattttacacaaccattcattttggagactgatgcatcgggaattggagtaggagcagtgttgggtcagaatggtcatcctatagcatatttttcaaaaaaattagcacctcgaatgcaaaagcaatctgcttacaccagggaattgctagccattacagaagcattggctaagttcagacactacttattaggcaataagtttatcattagaacagatcagagaagcttgaaaagcttgatggatcagtctcttcaaacccctgaacaacaagcatggttacacaaatttttggggtatgatttcaaaattgaatacaagcctggtagagataatcaagcagctgatgccttatccagaatgttcctgttagcctggtctgagccccattcgctgttcctagaagagctaagaagtaaactaactgcaaatcctcacctcaagcagttaatggaggattacaggtcctctaatgaagccagtcattatgcagtaagagaagggttattgtattggaaagacagactagtcattccagtggaagaagagatggttcaaagaattttgcaagagtaccatagttcacccattggtggccatgcggggattacaagaacactagcaagattgaaggctcaattttactggcccaagatgcaggaacatgtcaaagagtatgtacagaattgtgtgatttgtcaacaagcaaaagtgagtaacacactgccctcaggactactgcagcctttgcccattccacagcaagtttgggaagatgtagctatggattttatcacaggtttgcctagtgttaatggttattctgtcattatggtggtagtggatagactcactaaatatgctcacttcctacctctaaaagctgattacagtagtaagtcagttgctgaaactttcatgaacaatatagtgaagctgcacggcattccaaaatccatcgtgtctgatagagatagagttttcactagttcttttaggcagaatttattcaaattacaaggcactacactagctatgtcatcagcatatcacccacaaacagatgggcaatctgaaattctgaacaaatgcctggagatgtatcttaggtgttttacttatgagaatcccaaaggatgggtcaaagctctaccatggtcagaattctggtataacactgcattccacactagcttgggattgactccgttcaaagcattatatggaagagagcctcctacacttaccagacagccttgtactactttagatccggtggagttaagagaacaattgatcaacagagataacttgttagctaagctcaagaacaatctggccagagcacaacaagtcatgaagacgcaagctgacaagaagagacaagaagtatctatgaaggtgggtgatcacgtattggttaagctgcaaccatatagacagcattctgctgtgttgagaaagaatcagaagctagctatgaaatattttggtcctttcaaaatcatagccaaaataggcacagttgcttataaactggagttgccagacacagcaagaattcatccagtttttcatgtgtctcagctcaagttgttcaaaggaaattcttcagaaccttacctgccattgcccttgacagttactgaaatggggccagtaatgcaaccagtgcagatacttgcaaatcgcaaattattaaggggcacaactcaaattgatcagatactggtgcagtgggagaacggggtgcaggaagaagcaacctgggaagacattgaggacattaaggcaagctatcctactttcaaccttgaggacaaggttgattttaaaggggaaggtaatgtaacggctagtggagcacgtgcggggcatgagagcaaggatgatgagtcacgcatagtggaaggcatgaataacaaacttccggatgatgcggaattgggacgtggaaagagagtgaggaggccaagctggaagctaacagaatga

SEQ ID NO: 96076 - DNA, 1086 bp, Glycine max
  Peptide Sequence Number=SeqID_212854
atgccccttaagacctccttctcatggaactccattctctccgcgcatgccaaggctggcaacttggactccgcgcgacgagtgtttaatgaaattccccaaccagattctgtgtcctggaccaccatgatagtggggtataaccacttgggtcttttcaaaagcgctgttcacgcgtttctccgaatggtttcctctggaatttcgccgacccagttaacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaagttttgtcaatttgaccttgcacttgcactctttgatcaaatgactgacccagatattgtctcttggaattccatcatcactgggtactgtcatcaggggtatgacatcaaagccttggaaacattttcttttatgctcaagagttcgtctttgaagccggataagttcaccttgggaagtgttctgtcagcttgtgccaatcgtgaaagcttgaaacttgggaaacaaatccatgcacatattgtaagagccgatgttgacatcgctggggcagtggggaatgccctgatctcaatgtatgcgaaattgggtgctgttgaagttgctcataggattgtagaaataaccagtactccaagtcttaatgttatagcattcacgtcactgttggatggctatttcaaaattggggatatagaccctgcaagagcgatatttgattcattgaagcaccgtgatgtagttgcctggattgccgtgattgttggttatgcacagaatggcttaattagtgatgctttggtgctgtttaggttaatgattagagaaggtccaaagccaaacaactataccctggcagcgatattaagtgtcatttcaagtttggcttctctggatcatggtaagcagcttcatgcagttgccattagattggaagaaagtaaagtacaagaagaaattgcaggaaaagaagtatcagagtag

SEQ ID NO: 96077 - DNA, 1014 bp, Glycine max
  Peptide Sequence Number=SeqID_212855
atggaaaaataccccaaattgtacctaatttcagaccaacagaacaagaatattcaggagatgggtcagcagacggacaatgggtgggagtggaactttaaatggagaagacacttgtttgacagagagcttgaaatggcagattgcttccttaatgatgttgctggcagctgtattcagatccacaaaaaagatgagtggatctggaaaacagaacctagtggacaatattcggtaagaagcgcctataatatgctcaaaggagtggatgttgaggaggataatgtgtggatgtttgaggagttatggaagatacgagtcccaactaaaattactatttttgcatggaggttattaaaggagagactacaaacaaagacaagcttgaggaggagaagggtggcaattagtgacacattatgcccattctgtgggaattcagaggagaacgaagcacatgtattttttatatgtgatagaatacttcctttatggtggaaatctatgacatgggtcaacattcatggagcttttccgcagaaaccgtggcagcacttttcccagcacgcgttctgtttgcctaacagaattcgtgttaacagatggagaagttggtggttggccctcacatggacagtgtggcaacaccggaataaaatcatcttctcaaatgaaacttttgatggtaacaagttaatggaggatgctatttttacactgtggacatggctgaagagctttgagaaggactttgctttcacctacagctattggtcgtctaacatagcatcaggatttgtcttttcagggggaagcaaatttgatgagtttcaatgtggtctcaacaatcataagcataggaataaggttattttcatgaatgctccattcaatggcagtaagttgctggaagatgcactgtttttggcatggacatggttcagagcaatggagcaaaactttacaatccatttcaactattggtctagcaatctaccagctggttttctgtaa

SEQ ID NO: 96078 - DNA, 156 bp, Glycine max
  Peptide Sequence Number=SeqID_212856
atgttcttacttactaaatttgaaatccgtgggctacgcatactgtgtccgtgtaggttggattttgcaaagcagcataaatgtcaaactccaaaatgtagagtgcagtcaacaatggattattggcaccatctgtctcccaataaccagacctaa

SEQ ID NO: 96079 - DNA, 147 bp, Glycine max
  Peptide Sequence Number=SeqID_212857
atgagggatgacagtggaagcttaatgaagccacgagaaaagcccactacccgcttcccttcatggatcaaatgcttgagagacttgcagggcaatctttctactggtttttggatggatactcggattacaatcagattgcaatag

SEQ ID NO: 96080 - DNA, 235 bp, Glycine max
  Peptide Sequence Number=SeqID_212858
atggcggcgcaagttccaggggtggatcacgcttttcgaggcgatccgaatcctggtaaaacttcgtaccccattgcccggaggctcttcgctatgcgaagaacactaggccaaggtgatgctcttacaagtgcagatcaaggtgcaacatcaacagatacttcaggctgcacaaggcacccacttcagtggcagtttggacagtacagccccaagcatggtagccatggccaag

SEQ ID NO: 96081 - DNA, 882 bp, Glycine max
  Peptide Sequence Number=SeqID_212859
atggagtcagaggatgatatgcacgacgccaacgacatcgagtccctcgacgacgatttctacagtggcgagaccgaggacgctcctttggactactacagcgacgacgacgccgacgattacttcgacgacgccgagaggatcgagtctcgccgccctgaggaatccgatatccgactaagacaggaagatgacgtcgctagagtagcaacggttctttccatatcaagggtttctgcaagcttactactccgtcaccacaattggagcgtcagtagagtgcatgatacatggtttgctgatgaagaacgagttcgaaaagcagttggcttgttggagaagccaattgtccagcatcctaatgctagagagtgtcctatattttggacattagccatgttgggcttacttgcggtatctgttttgaaaattatcctcgtgctaggattgaaatggcttcctgtgggcatccctattgtatctcatgctgggaagaagaggaaggggggctatatcagcacatccattaatgatggtccgggatgtttgatgctgagatgtcctgatcccacttgtggtgctgctattggtcaagatatgattaatcttttagtgtctgatgaagataagcagaaatatgcacgttaccttcttagatcttatattgaagacaataagaagtccaagtggtgtcctgctccaggttgtgaatatgcagttacttttgatgctggtagtgctggaaattatgatgtctcttgcttctgttcatatggcttttgttggaattgcactgaggaggctcatcgcccagtggactgtggcactgtggcaaagtggattttgaagaacagtgctgagtctgaaaacatgaattggtag

SEQ ID NO: 96082 - DNA, 743 bp, Glycine max
  Peptide Sequence Number=SeqID_212860
accatggtgaaaggactggtggtttttatgcttgcaatcgttatgaagcagctaaacaagaaggagtgtcaaggcaaaaagctcttgcagatctacagcagatgcaaactgttcatattgagaagcttagtgacatacagtgtcagcctgagtctcagcttaagttcataactgaagcctggctacaaataattgagtgtagaagagtgctgaaatggacatatgcatatgggttttatttgccggagcatgagcatgcaaaaaaacagttctttgagtacttacaaggtgaagcagaatctggtctggagagacttcatcaatgtgcggaaaaggaactacagccgttcctaagtgctgatgatccatctagagaattcaatgactttcgtacaaagctagctggattgactagtgtgactagaaactactttgagaatttagtaagggcattagagaatggtctatctgatgtgggaagtaatggagctgccttcagcaaagcaacgagctcaaaaaatgctgctggtagcagtaagggtagagctggaagaggaaagggaacttttcgaactagcttgtccagcaaattgaatgatgatagtcattgcacttgtctcctgcccaaggcctctgcaccaaaagctgagatggagacattcctgatgaaaggagtaaggcatggaagaaaggcatttgtaactcaatatcataacacaacagatgttggagaatggagatga

SEQ ID NO: 96083 - DNA, 387 bp, Glycine max
  Peptide Sequence Number=SeqID_212861
gcagatattgatggaaacggcaccctcaattatgaggagttcatcacaatgagtgttcatctgagaaagatagagagtgatgagcatctctctgaagcgttccgttactttgacaagaaccagagtggatatgttgagtttgaggagttgaaagatgcactatcagatgatgactcggaagccagtgacgaccaagtggtcaaagacattctaaacgatgttgatttggataaggatggtcgaatcagttttgaggagtttaaggcaatgatgaatacaggaggagattggaaaatggcctctcgccagtattcaagagcattgttgaatgcattaagcttcaaaatgttcaaagacacatctagcaattctgttaagtgtaactaa

SEQ ID NO: 96084 - DNA, 1242 bp, Glycine max
  Peptide Sequence Number=SeqID_212862
atgggaagctgcatatcaacgcaagccgtgaggacacgcaagaggtcgaggagcccgaatcacaagccctccacgccaagagggcgcgggcatgaggtggcacgaaggtcgagcgtggcggcgcgtaggtcgagcgtgacggcgcgtccgctgaacgtggtgtcggggccgagtcctgggaatatatttgacaagtaccagttcgggaaggagctggggcgtggcgagttcggtgtaacgcaccgtgtcgtcgatgtcgagagtggcgaggcgtttgcgtgcaagaagatatcgaagacgaagctgaggacggagattgacgtgcaggacgtgaggagagaggtacagatcatgaggcacttgcctcagcaccctaacattgttgcattcaaggaggcttatgaggacaaagacgctgtttaccttgtcatggagttgtgtgaaggtggtgaattatttgataggattgttgctaagggacattacaccgaacgtgctgctgctaatgttgtcaaaaccatacttgaagtttgcaaggtgtgtcatgagcacggagttatacacagggacttgaaacctgaaaatttcttatttgcagatacaagcgagagtgctccattgaagtcaattgattttggcctttccaccttctatgagtccggagaaagattcagtgaaattgttggaagtccttattacatggctccagaggttttaagacgtaactatggacaagaaattgatgtttggagcacaggagttattctttatattttactttgtggagttccacccttttgggcagaatccgaggaagggattgcacaagccatcatcaggggcaaagtagatttcacaagagatccgtggcctaaagtttctgatgaagcaaaacatctagttaagcgcatgcttgatccaaatccattcacccggataacagttcaagaagttcttgataattcctggatacaaaatagggagcatggtcgaactatttctcttggagatcaagtgagaatgaggatcaagctgttctccttgatgaacagattcaaaaggaaggttcttagagtggtggccgataacctgtcagatgagcaaattgatgtgtttaagcaaatgttcaatatgatggataaggacaagaatggaaacttgtcatttgaagagctcagagatggcctttcaatgattggacacgccattcctgatcctgatgttgaaatgttaatggatgct

SEQ ID NO: 96085 - DNA, 690 bp, Glycine max
  Peptide Sequence Number=SeqID_212863
atggtccgcgttgacgactccgccaggcaggaccagcgcctcgaactgatccgccgtcgcctcggccgcgtgcatgtcgacggcctgctcgtgcccgttcttgcccgtgatcgccgcgccgtcgggggccaccatcgtcgcgctcgcgccctgagcggtcaccgcctcccacgggctggtcaattcgctgtcctcgaacccgtcggtcgccaggaaagccactcgggtgccggtgagagtcatcattcgtcctttcggggagtcgtcggccgctcactgcggatctctcgaccctctcccggggggatccgtgcgtccagggggtggcagatcacaggagccggtggtacgcgatgccgtcggcccggagtgctctgcgctgatctctgcgccgcggcagtagcatccagacatgcgccttcgtcctgccctcgtcctccttccggcgctcgtgctcctcgccggctgtgccccggagcctgcaccgagcccctccccgtcggcgacctcgacgcctgctcccaccacgcccgcaccgacccccacggacgcggagacccccaccccggcaccgtcggcgtcggagttcacgacagcgcagctcgtggcgctgtgcaccgagaagacccggagcctcgcaccggacgcaacctacttcgccgacatggccaccaccgagcggctggatga

SEQ ID NO: 96086 - DNA, 249 bp, Glycine max
  Peptide Sequence Number=SeqID_212864
gtcgactctagaggatcccacacccctataatccgcgggtcgtgggttcgagccccacggggcccaccagttaggcactgggatcgtctcaggactcgccctcgccgccgcccgccaggagttcgtcgcggatctcggcgacaccgtccggcagggactccccgtgcagctcgaacaccgggtcctcgggggtcccgccgatcccgcacacggcgacggtgtcctggccgtccgcagtccgcgggatga

SEQ ID NO: 96087 - DNA, 489 bp, Glycine max
  Peptide Sequence Number=SeqID_212865
atgaatgaagtaacaggagggaatgtggatacatttgagatttatcttcttatattaagtgctttacaggttgatataaaagaaatcaatacgtatgatctcaatgcattttatataaaaagcgaagaattgttcctggagtacaaaccggttattatttttgacaatattcaccagcttttcgacgagatcaaaaaccaggggaagaccatcaatattttaagtaataccggctttataaaagggaaaacgcttagaaagtttttaatagaagagaatctggacgattatatcgatttccatatctattcagatgagatcaattgttcaaaacccaatccgattgcttttcaggaagtgaaaagtaaaatcaaaaaccaggagctggaacttcgtcagattttgcatatcggtgataatgcgattgccgattttaatggagcgaaaagctttggtttcaatgcacatttacttaaacattcaatataa

SEQ ID NO: 96088 - DNA, 156 bp, Glycine max
  Peptide Sequence Number=SeqID_212866
atgattagaaaaagtattgttcaatgtaacaggtccacaaaccttagacccaacaaggtattctcgcctcccctctactggatacttacactcccaaggcttcgacaagaatcaccaaacaggagactcttcgacataggagatcgtttgacataa

SEQ ID NO: 96089 - DNA, 105 bp, Glycine max
  Peptide Sequence Number=SeqID_212867
atgacgattgaagtacctcggtcacttagcatgcaattgtttctactcgtgaagacaattcaagatgtccctctccttgttgtgtacttcagttttgctacatag

SEQ ID NO: 96090 - DNA, 153 bp, Glycine max
  Peptide Sequence Number=SeqID_212868
atggatcatgttattggtgggaagtttaaactgggaaggaaaatcgggagtgggtcttttggggagctttatatagctgttaatatacaaactggagaggaggtggctgtcaagctggttatgagagttccattaaggatacgtgacacttga

SEQ ID NO: 96091 - DNA, 275 bp, Glycine max
  Peptide Sequence Number=SeqID_212869
gatgttacaacgtgcactaagcgcacgagcacgaacaaggccacctatttaagcctgaaatcagatttgcaaagggagtttggagtttttcttgaagaagcctctgtgtgcacgagagtctggccctggcttgaagcttttgcatgtttcgatcctagaggtgaaggagacatcctcaccactggtgtttttgcagtctttcatcttgttcttctctttgttgtaaaggaggtttccgaactatggaaagctaaatcctctgttggatcttccct

SEQ ID NO: 96092 - DNA, 156 bp, Glycine max
  Peptide Sequence Number=SeqID_212870
atggttccagccaaatttcaagtagaacttgagtggtgcatggctgttgatggaggaaaatatggctatgggcgaaggagattgagagacgttgagagaagaggagatgggagtgcaatgtgttggctttggaagagagaggtcgtgttgggttaa

SEQ ID NO: 96093 - DNA, 341 bp, Glycine max
  Peptide Sequence Number=SeqID_212871
atggataactatatggatttaggcggcttgaaattcaaacccaagcttaaaaagattttgacccaaaaagagagggttttgcttgctcatcccttttggttgctagactgtgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 96094 - DNA, 399 bp, Glycine max
  Peptide Sequence Number=SeqID_212872
atggcagtcaccagggtcaggaaagaatgtgatgagctaagggatgtcaacatgaccacagccgaagcgttagagcgagaaacaaagagagctcgaaaagaggaatggggccaaaacaagttccgaagggctttatggggcaacaacaacaaactcaagcttcaaagggccaaaaaagatgagtcaagggtggaaagtatgatattagaggataagttgagggcttgccaaaggtcgaagagaagtttgaccgaacagctaagtagtacggaagagaatatgttgacaatcatcgaccagtataaagagaagctaaacctagctgctagccataggcagagacttaaggatgagcatgcaaaggtatcgactctgcaagtggaaagggaagcgagatag

SEQ ID NO: 96095 - DNA, 501 bp, Glycine max
  Peptide Sequence Number=SeqID_212873
atgccttatgcatgcgataccagactagatgtgcccaatcaatttgtcagccggtatgaaaggcccacattactattagatcttcttcagaaacatgtgcaaggtttgaagatctggggagtaagatacagacaattagataatggaggatgcagctttcaggaaccaatgaaccggcaaacagccttccgatcatatccgcttggttggtgcaaaccaaccgacgggcatcatgcacagaaaatcaaacttccaatcatcatccagtgcaccttcaaatggtacaccgtcactagacaattaggtcaaatcataaaagagggattggtcaatgaccatctttatcccatagaccttagaaatcaagaaaagaaatccatatctatgaacttagggtcaatgatagaacgagaggagaagaggttagtgtatcgtgtacgttgttcttccgatgagaacaatgaggaggaggaaatggaggaaggaattggagtatcctga

SEQ ID NO: 96096 - DNA, 120 bp, Glycine max
  Peptide Sequence Number=SeqID_212874
atgcctgagagtgaagattttagaattcggcttccaaaccaagtggttttcaaggattgtaggaactggtttcactccaaagttaatctcgggtcaaaatctatgtttttgaggccttaa

SEQ ID NO: 96097 - DNA, 1879 bp, Glycine max
  Peptide Sequence Number=SeqID_212875
tttagaagaggcctatgaggccctaagagtttttgagattcttgggattgggaataagcctgatgtgagcacaaccacttgcaagaaagtagcagaaaaccttgagttgtcatcgcctgtgaaggatttgttctattcgttaaaggttaatggcatattaaaatgcaaggttgatggggatgttttcacggatattgctttgagacttaaagccactgtcaatgatgcaagtactttggtggacatgtactattcaataggaagtctggttcttataaaggaccaggcttctgatgttgatgtgcttcttactgatgctgatgggactttccattcaatcaaggctctgagtcaaagtgatggaagatggcgttatagttctgataatccagaatctagtacctatgctgctggattagcacttgaagcactggctggagtgatctcattagcatcttctgaaattgatcagtctagggtgaatacagtgaaaaatgatatattgaagctttttgacagcattgagaaatatgatgatggaaccttctattttgatgagaaatttgttggtggaagtgagcatcagggttctctttccacaacttcttctgttgttcaaggggttacagcatttgctgctgtaacttctggaaaaataaatcttccaggggataaaatattgggtttggcaaattttttcctgggaattggaatcccaggagatgccaaggacttcttcaatcaagttgaatcattagctcttctagagaacaacaggcaaggtttccatcccattggtactgtcacttcctgcaacggtttattcattatccaaaaaagatcagctcaagtttttctggttctcacttacacttgggaaaacatgacaaatttctatttcaaaatgaatcaggttagggtgaacactgtacttggttcagctgcaccacctttaacagttaagcttgtgcgagctttccgctctgatgctaaagattcagctattattgagagcaaggagctccaatatgatcaaaataatggaattcatgtcttggaagctttcccaaacaatgtggatgtgggaacttatgcgtttgtttttgagattgcacttcatgattctgctggtgaaaaagtttatgctactggaggccaaattcatgtaccaatatatgtcactggcattatcaaagtcagcaatgcggaaattgctgttcttgacagtgatcttggaagtgttgaaacccaaaaaacgctagatttggctggaaatgatgttgtttcactctcagctaaccacttgcaaaagttgcgcttttctttccaattgacaacacctcatgatcatgcttttaagcctcttcaggcatttttcaagttgaagcatgagacaaagcatgaacacatctttgtggttggaaatactggcaagaagtttgagattattcttgattttcttggtttggtggagaaattttattacctctcagggagatatgacattgagctgactgtcggggatgctgtcatggagaactctttcttatggctgcttggtcaagttgatttagatcttcctgaagcacctgagaaggcagcccgtcttcctccactccctgttgatccttactcaagatatgggcccaaagccgagatagcccacttattcagggctccagaaaagcgaccaccccaggaactctctcttactttcttgggtttgacccttctgccatttattggctttttggttgggagctctgatctgggagcttgggaacagttaatggtgacgaaggcgaacgcgataatggagacacccatggaagccatggagaaggcgatagaggagaattgcgaagtggtggaggcgtga

SEQ ID NO: 96098 - DNA, 228 bp, Glycine max
  Peptide Sequence Number=SeqID_212876
atggccccgaggaagcttgcctcaaagagatctaggaaggataaagtggctgaaggacccagttccgctcccgaatttgacagtcaccgttttaggagcgctgagcaccagcagcgcttcgaggccatcaaggaatggtcatttctccgggagcgacgcgtccagctcagggacgacgagtataccgacttccaggaggagatagttcgccggcgttgggcatcactg

SEQ ID NO: 96099 - DNA, 363 bp, Glycine max
  Peptide Sequence Number=SeqID_212877
atgggccatcgggtccataaccaatacctgaatgaaaggcccattctcgttgaaacaaaacacttgtgtagtagaccagaggatctgaaaaccttaaacccttttctcgcctccatcgcaggtttctacctatattgctgttctttgcttcgattaggatcagtcaccatgtatcttcagttttacataaacgataacggtgacaaagtttacaccactaagaaagattcgccgctagggctacctacacaatctgctcatccagcccggttttcacctgatgataaatattcaaggcagagagttcttctgaagaagcgttttggattgttaccgacccagcagccacctccaaagtattga

SEQ ID NO: 96100 - DNA, 117 bp, Glycine max
  Peptide Sequence Number=SeqID_212878
atggaagctgcctttattcctgaggtcaatgatgagttagatactcaaaattttgaaaagtttgaagagtctgacagtcaatctcattcatcgtcaagaattggtccatggaggaag

SEQ ID NO: 96101 - DNA, 1110 bp, Glycine max
  Peptide Sequence Number=SeqID_212879
atggattctgcaaggagttggttacagaaatttcaaccacgtgataaattgagggcttctacaaggaagaatgatgatactaatggtgaagatgaaattccaaatatgtctatggatgaagcaactctttccaatatcacaaaacaaaaggttgcagctgctaaacaatacattgagaaccactacaaggaacaaatgaaaagccttcaagagaggaaggagcgtcgaaccatcttggaaaagaagttggctgacgctgatgtctctgaggaagatcaaaataacctacttaaatttttagagaaaaaggaaactgaatatatgcgtcttcaaaggcacaaaatgggtgtcgacgattttgagttattaactatgattggaaaaggtgcatttggggaggttagagtctgtagggaaaagactacagatcatgtatatgcaatgaaaaagttaaagaaatcagaaatgcttcgtagaggccaggtagaacatgttagagctgaaaggaatcttctggcagaggttgacaacaattgcatagttaaactttattgttcttttcaagatgacgaatatttgtatcttattatggaatatctaccgggtggggatatgatgactctactcatgagaaaggatatcttgactgaagatgaaacccgattttatgtgggggaaacagttttagctattgaatctatacataaacacaattatatacatagggatattaagcctgacaacttgttacttgatagatatggacacttaagactgtcagattttggactatgtaaaccattagattgtagtacacttgaagaagcagatttttctacgagtcaaaatgctaatggatctacacgaaatgatgaacatgcaactccaaaacgcacacaacaagaacaattgcaaaattggcagaaaaatagaaggacactcgcgtattctacggttggtacaccggattatattgctccagaagttctaatgaaaaaaggttatgggatggaatgtgattggtggtcacttggagctattatgtatgaaatgttagtgggatatccacctttttattctgatgatccaatgtcaacatgtaggaagtaa

SEQ ID NO: 96102 - DNA, 1211 bp, Glycine max
  Peptide Sequence Number=SeqID_212880
tcggcgaattcggcgcggcagccgccactgacccagatcgcgccattgcgcacaccccaggtgcggccttcgttgcaggggctgccggacagctggcggaccagccgggcattgcgccagcctaccggacagctgcgctcgcggttgttctggctctcgcagcggatggtttcgccgggccggccgttgttgcctccccagccaccgccattgccgccgccccagccaccgcgggcctcgacgaattcggcacggcagccattggtgacccagatgctgccattgcggctgccccaggtgcggccttcgtcgcaggcgctgccggacagctggcggaccagctgcgcattgcgccagccggtgttgcagacccgttcgcggttgttctggctctcgcagcggatcaccccgtcctgcgcggcggccggggcggagggcagggcgagcgtggcgatggtgcccaggctcagggtcacggccaggctggccagggacagcggtttcatggcggcatcccatacggtggcagccggtgtgactggccggatttgccccggccggggcctcggccgcagaatacgaggctttccggcccccatccggtgccggcgttctccagcggagcttcccccatgcgtacccacttctgcggcctggtcgacgagaccctgattggccagactgtcaccctcgccggttggaccgacgtggcccgtaaccagggcggcgtctgcttcatcgatctccgcgatcatgaaggcatcgtgcaggtgaccgtggaggtcgacaacgccgaagtgttcgccgtggcggcttcgctgggctacgaggacgtgctgcaggtggagggcgtcgtgcgcgcccgccacgcggtgaacgacaagatgcgcaccggcaaggtggaagtgatcgtcaccgccatcaccgtgctgaacaaggctgcaccgctgccgttccacgcccacgagaacccgggcgaggaaatccgcctgaagtaccgctacctggacctgcgccgtccggaaatgcagcgcatgcagcgcacccgcatcaagctggtgcaggccctgcgccgccacctggacgagaagggcttccaggacatcgagaccccgatcctgaccaaggccatcccggaaggcgcgcgcgacttcctggtgccggcgcgcatgcacccgggcgagttctacgccctgccgcagagcccgtag

SEQ ID NO: 96103 - DNA, 204 bp, Glycine max
  Peptide Sequence Number=SeqID_212881
atgtctcgaaacttcacgtattgtgcaacaaagggtgccaagtacctcgaagcgctcaatgtttgtggcaaagtacatttgaagacaaagcttcaagaaattgcttatcctgatctagactctatgtgtcctcctccagaaaaggttacaatagacaagtggatgaataatacagatatgggatatctcattgctttacgatag

SEQ ID NO: 96104 - DNA, 904 bp, Glycine max
  Peptide Sequence Number=SeqID_212882
atgaggggcaccgtgcatgagcctcaagcgagcataagggcagatcaaaaggtggacccttgggtactagtaccctctccttcagaggactgcacattctcaccttcagaggactacacgtcctcaccttcagagggctgcacgccctcgccacccttgggtactagtaccctctccttcaaagaactgcacatcctcaccatcagaggactacacgtcctcaccttcagagggctgcatgccctcgccatcagaaggtcgcgtgccctcaccttcaaagggctgcacgccctagccatcagaaggccgcgtgccctcaccttcagaggactacacgtcctcgccttcagaggactgcacgtcctcgccttcagaggactgcacgtcctcaccttcagaggactgcacatcctcaccttcagaggaccacacgtcctcgccttcggagggctacaagccctcaccttcagaggactacacatcctcaccttcagaggactacacgtcctcgccttcagaggactgcacgtcctcgccttcagaggactgcacgtcctcgccttcagaggactgcacgtcctcaccttcagaggaccacacgtcctcgccttcagagggctaccagcccttaccttcagagggctacacgacctcaccttcaaaggactacacatcctcaccatcaaaggactacacgtcctcgccatcagagggctgcacgccctcacctttagtggactagacgtcctcgccttcaaaggactagtaccctctcctttagaggaccacatgtccttaccttcagaggacaagacgtcctcgccttcagaggactacgcgtcctcgccatcagagggctgcacgctcgcacctttacaggactacacgtcctcgccattagagg

SEQ ID NO: 96105 - DNA, 172 bp, Glycine max
  Peptide Sequence Number=SeqID_212883
gggaatgcaccacaggctgcagatgcccgtgatcaatgctggaaaccctagggccctgttagacttatccgggtctagagggtgcctgcgctttggggcatcccgtggactgagcgaaagggctcaggctattattgattgcacatggttgaaagcacaaagtgaggactaa

SEQ ID NO: 96106 - DNA, 540 bp, Glycine max
  Peptide Sequence Number=SeqID_212884
atgtggttcatagtactttatgatcatgtattcagtattggttttcttcttacttccaaaaacttattcagagctgtcaatctggtcggcttaaggtttactggttgctatcggtcacatgcttacaatgatttgaagaagcatgtgagatgtcttaagcatatccaccattggattagccataccacgatgcctgaacaaacattaggttgtcaggtgggtaatttggtggccactaactcagaaggtgagaaaataatgggttttcgcatagcaggtattgttaggcggacttcgttttatacaacccaagcagcctccaagagggtggacgtaccaaaaggctatgctgcagtctatgttggagataagatgagacggttcacaattccagtatcatacttgaacgaaccttcatttcaagaattactcagtcaagcagaagaagaattcggatacgatcatccaatgggtggtctaacaataccatgcaaggaagaggagttcctaaacgttaccgctcacttgaatgagctgtaa

SEQ ID NO: 96107 - DNA, 301 bp, Glycine max
  Peptide Sequence Number=SeqID_212885
gtgagggcttgtagccctctcaaggcgaggacgtatagtcctctggaggtgaaggcgtgcagccctctgatggtgagggcgtgtagccctctcaaggcgaggacgtatagtcctctggaggtgagggcgtgcagccctctgatggtgaggacgcgtagtcctctcaaggcgaggacgtgtagtcctctaacggtgagggcgaggacgtatagtcctctggaggtgaaggcgtgcagccccctgatggtgaggacgcgtaatcctctcaaggcgaggacgtgtattcctctcaacggtgagg

SEQ ID NO: 96108 - DNA, 175 bp, Glycine max
  Peptide Sequence Number=SeqID_212886
atggacaaatttggagcttgtcagcgatggggtggtccaagtacattgtcatcttcatttgcaagggatgacgagtccattccaagtacctgcaatttttttgactgggataagggtcctgtgaatgttataggagcaaatgttgatggaaggcaaatggctgttgctgatccaa

SEQ ID NO: 96109 - DNA, 1008 bp, Glycine max
  Peptide Sequence Number=SeqID_212887
atgccttcagaggatagcacgtcctcgccttcagaggactgcatgtccacgactttagagggctacacgccctcgccttcgaagcactacatgccctcgccttcagaagactactcatcctcacctttagaggactacaggtcctcgccaatagagggctacacaccctcgctttcagagggctacacgtcctcgccttcagaggacttgcacgccctcgccttcagaagactacacgtcctcgccttcagaggactgcacgtcctcaccttcataggactacatcacatcctagccttcagaggactgcacgtcctcgtctttagagggctacacgccctcgccttcagaggactacaagtccttgccttcagagggcttcacgtcctctccatcagaggactacaagttcttgctttcagagggcttcacgccctcgccttaagaggactgcatgtccatgtctttatagggctacacgcccacgccttcagaggactacacgccctccccttcagaggactacacatccttacatttagaggactacaggtcctcgccatcagagggctacacgcctacgctttcagagggctacacgccttcgctttcagagggctacacgccctcgctttccgagggctacacgccatcgccttcacaggactacacggcctcaccttcagaaggctgcacgccctcgccttcagacgactacacgtcctcgccatcggaggactatatgtcctcgccattagagggctgcatggcctcaccatcagaggactacacgtcctcgcctttagagggctacacgccctcgcctttagaggacttcacgtcctcgccttcatagtactacatgttcttgccttcagtggaaagcacgccctcgcattcataggactgcacgtcctcatctttagagagctacgcgccctagccttcagaggattacgcgtcctcgccttaagagggctgcacggcctggccttgagaaggctgtaa

SEQ ID NO: 96110 - DNA, 1401 bp, Glycine max
  Peptide Sequence Number=SeqID_212888
aacaacattattacttggcgaagctcttggggtatgattaccagatcaagttcaagcgcggacattcaaatgttgtcactgatgctctttcccgtgtccaaccacccctagaggccacgtgtttgatcctccacgtccctcagctcgattttatgcaccaattgcgccaatcattgagggccagcacaaaatttcaggagaagcttcgtgccatacaaactagccccactgactaccctgattttcttatccataatgaattaatcttctataaagggagcatttggattactgatgacaacccctttataccctctctgctcaatgaattcccctcaaccccattgggtggtcatttcggtgttctgaaaaccacccaccgcttacaagccaatttcacttggcccaacatccgtcgtgatgaccttttgatggatttcatcacccatctacccaactcccagaatcacacagtagtcatggtgttcgtagaccgtttctctaagggagtccactttggcgctttacactctaacttcacggcttacaaggtagccaatctcttcctcgacatcatctgcaaacttcatgggttccctaaaagtattgtttcatatcgcaatcccatcttcgtcaaccaattctggcgtgaattatttcgcttaagtggcaccactctgcacctcagtacaacatatcatcctcaatcggatggtcaaacagaagtcatcaacagagtccttgagcagtatcttcgcgcattcatccacgataggcctgctgaatgggtcaagtaccttcctctagctgaatggtcatacaacacctccctgcactccagcatcgagttcaccccatttgaagttatatatggcgaaccaccaccatctatacccgactccctgttatcctcttccaacaacgaagctgcaaagtcccttctgcgtgatcgtacttcagtgcaccaaaagctccaaaattgtttactcaaggcgcaaagtactatgaaacactttgctgacatgaagcgctggccagaatccttcgaccgcttctttggaccattcgaaatcacaaagcgaattggtctagttgcttatcgcctgaatttaccagcggcctcaaagatacaccctgtctttcattgttcgttactccaacgatactatggacccattcccccggccactcataaccttccccctacagctcatggcaatctgcccatcctcgaaccactggctattttggcacataaggatgacaacaccacctccccatcaactcctttggttctggtgcagtggaagggtttgctgccagaggagacatcatgggagccattgtcagctatctcggacaagttacaccttgaggacaaggtgcctttgccagcaggag

SEQ ID NO: 96111 - DNA, 572 bp, Glycine max
  Peptide Sequence Number=SeqID_212889
gtgttgaggaagatagcttggtatttggagaggatgtgtgtaatttcgggaatggtgtgggtagtgatgggttccagaggctgagaagtgaacttcatatggagggtggtgtggtcagtaatgacgagcccaaattgcttaagccaatctatacccaatacaatgtcagctccgcttatagggagccaaagaggtggaatgtcgtcggggctgtcaacccagaaagggcgttgaagctaatgtggggggtggggtcatcagggggaggttcaggggtgtctgtggtcgggtgggtcgtcgggttctgcgatgagaaggaggattcgaccgcgacacttgttggatgggctccacttgtcgtcgcagttatagcacaaacccttctctcgtcggagggccatgtcttctggagagcaatggataaagggttgacggggtggtacgggaggggtttgtgggggttgggaaagggaatgagtgatcgagggagagggtgggttgggtcgggcagtggcctgagggagggagataggttggagtgcgagtacctcccgacggatttccggcgataa

SEQ ID NO: 96112 - DNA, 159 bp, Glycine max
  Peptide Sequence Number=SeqID_212890
atggcgtataggaggccctacctgcatgaggtgtttccagtggtcccagcatgttcattcctcacacgacaaaaggccaaggaaagctcagactatggagattgtcagcagggatgcatgaaatgtctgcaaactcttggcatcgtctacactttttag

SEQ ID NO: 96113 - DNA, 402 bp, Glycine max
  Peptide Sequence Number=SeqID_212891
atggctgagcatggtactcgcaagaccaccaccgatcgtttagaagaagctttagcccgccttaccctccaccacgagtccttggctgcccaacactccgaccttgcttccaaagtcgccatcttcctcaacaaattcagtcacccacaacccacccccgcgctacctccacctgcatcacctaaaccacatatcaaattagaagtacccagatttgatggtcgagacccactgggatggatctttaagatctctcagttttttgattatcagtcaaccccagaagaagagcgaattaccttggcttcgttttacctcgatggtccagcactcagttggttccagtggtcttaccgcaatggcttcatcacctcttggtctggctttctgcaggctctctag

SEQ ID NO: 96114 - DNA, 189 bp, Glycine max
  Peptide Sequence Number=SeqID_212892
atggattctaggcggcgtagtaaaaaagcagctatgcaacgcaagttgcaacaacttcgatcggtgaacaaagcctcaattattgtggatgccaccagatacatagaggagctgaagcaaaaagttgatgggttgaactcagagcttggaactgctgaatcatccatctcccaagacgaacttcccatg

SEQ ID NO: 96115 - DNA, 270 bp, Glycine max
  Peptide Sequence Number=SeqID_212893
atgggaatagagattctggagcctaacacgtgcattaggggttgctgcaccagcccctctattccccttcatctccctccctcttcttatacccttctctctcctattgcccgagggtctgagagtgttgtttatgaagggactttggatggcacgagggttgctgtgaagaaacccatcttgtcaacttcagaagacattaataagtttcataaagaattgcaattgttgtggtctctctctctatctactgcctctcttttaatgtag

SEQ ID NO: 96116 - DNA, 162 bp, Glycine max
  Peptide Sequence Number=SeqID_212894
atgaagatagacacgacgcaacacgggaattatagtgcagcagaagagtgcgtatgcgatggaaatttcgtgtcgctggatgttatgttactcgagttttggccgtttcatgcggacgttcctggcagctgcggagcacaaaagaaatggaccccgccttga

SEQ ID NO: 96117 - DNA, 414 bp, Glycine max
  Peptide Sequence Number=SeqID_212895
atgactagctttaaggttgcatgtgtggttgcgatgatgtgcatggttgtggccatgagtgttacacccatggcacaggccgcaatcacgtgcgggcaggtcgccggcgacgtgtctccgtgcctcagttatcttcgaagcggcggaaaaccatcggacgcctgctgcaacggagtgaagtcactcagcggtgcggcaaagaccaccgccgaccgccaggcagcgtgcaattgcctgaaaaaccttgccaataatatgggacagagtttgaatgccggcaacgcagcctctctccctggcaaatgtggcgtcaacatcccttacaagatcagcacctccaccaactgcgccacaaatcaccttatgtattgtacatactttaatattagtttcgctaaaatacctaaagagtaa

SEQ ID NO: 96118 - DNA, 366 bp, Glycine max
  Peptide Sequence Number=SeqID_212896
atggatgttagcatttcgtttctaaatgaccatttagaggaagcactgggttcaacaaaaatacaagaaaatcactcaaagtgtatcaatctcacacagtgtgaggcgaacaagtcaccgacgcacaggatttcggtttgcaatcaaagggagagggccactttaggtcgtggtgtcgcaaactacccttcggagggagggcgacgcgtgactcgcggggatgcgtcttccaagaaaggaatacgcgcggagtcgccaccaacgtttattggaggaaaatgttggaaaaaccaaaaaagacgtggtctacgaattttaagcaaaaaggttcgggagttgtatttacgcacggggaaaggtgtttag

SEQ ID NO: 96119 - DNA, 1713 bp, Glycine max
  Peptide Sequence Number=SeqID_212897
atgggctcatgggttatgaacccaacattgaaatggggagggaaagaggagaatgtctatcatgacttggatatgggcacatggtcattccttgaagttgttgacctgatacatgatcttgagtattttgttattgatgggcttaaaatgtggtggaaagggtttgatgttaataatgaaaccttaagggatttgtccaatgatcaagactctatggatttggcaagggagagtgattatgaagaagttactgaggatgaagttaggggtgaacttactgagggtgaagagttgttcaaagaccaacaaattttagtgtttgaccatggtgtagatgatttgtttgattgggatagtgttatggcatttgatgacaacgatgagccatccaggaagcaaaatgagcttagagtgaaaagcaaagtcagcaacaaaggaaaacaaaaggattctggatatgaagatccttttgttgaaaatcctagtcagtgtgatgaagacccaaattggatggatgacgatagtatgactaacccaccacatgaggaacctaatacaaattttaaagagatgcatgatttggagactggtaatgaaactgaggagttgtatagtgatgttgaatctaaggatgacactacaaagcctggaaaaaggtttccaatgtttagggggaaaaaactgtctaaggctttcaagtggacactaggaatgcaattcacatgtttgcaagattttaaggaaggaatgatggagtattttgtcttgaatggttatcaggtttgtttcccaaaaaatgaccattcaagggttaagcctgtatgtaagataaaggagtgtccatttacaacatatgtatctagggttggtgagaccattaccttccaactaaaaacactggaattgacccacacatgtgctagagttttttacaataaaaatgtcaaatcaaaatgggttacaaaggtgctacttgacaagtttagaacacctgaaaggttcaaatttccacaaatcatgcaggagatgaaatccacttatgttgtgggaataaccagatcttgtgcaatttttgctaggaaactaacactatgtcaaattgaagcatttgttgttgttgagactgagaacaaagagagttggaaatggttcttaaatgagttgttggctggcattggagattttgaaacgcacaaatgggttttcatttctgacaggaaaaagggacttgtaaaggcattccatgagacggatgatagaattgaacacagattatgtgtaaggcatatgagctctgctaagagacgtagtaatggttgcttcaaagcaacttatttggaggcatatgaagagaaaatgaatcagatcaaagagatcaacaacaagggtaagataatgccaagacctatgaaaaggttagaatgggagactgaaaaatcaaaacattggtttgttgaatatgctggaaacatgttgtatgagagatgccttcaatatggacacaacactcaaacctgcaaagagcgacctatggcagctggtgaatctaaggcgcaagttattggatctaaaattccagcaacaggaaatactgttgaagctagtggatttgaggcacaagctgttggatctaaaattccaacagtaggaaacacttttgaagatggtggatttgaggcacaagttactggatctgaaattccaacagcatga

SEQ ID NO: 96120 - DNA, 654 bp, Glycine max
  Peptide Sequence Number=SeqID_212898
atgaggggcatcgtgcatgagcctcaaggtggacccttgggtactagtaccctcgtcttcagagggctacttgccctctccattagagggctacacgccctcgccttcgtagggctacacgccctcaccttccgaggactacatgtcctcaccttcagagtactacacgtgctcgccttcagaggacaacatgtcctcgccttcgccttcgtagggctacacgccctcacctttagagtactacacatcctcgccttcaaaggactacacgtcctccacttcagagaactacacgtcctcgccttaagaggattgcacgtcctcaccttcagaggaccaaacatcctcatcttcagaggattacacgtcctcatcttcaggggactacacgtcctcatcttcatagggctacacgccctcatcttcagaggactacacgtcctcgcctttagagggctacacgtccttgccttcagaggactacacgtcctcgccttcagaggactacatgtcctcgccatcagagggctgcatgccctcgccattagaggactacacgtcctcgtcatcaaagggctacacaccctcgtctttagaggactacacgtcctcgccattagaggactacacgtcctcgccttcagagggcttcac

SEQ ID NO: 96121 - DNA, 354 bp, Glycine max
  Peptide Sequence Number=SeqID_212899
atgcagtttcagcaggagactagagccttgattcagagtttaacaaatcagatggggcagatggccacccagctgaaccaagctcaatcacaaaactttgataagctgccttctcaatctgtccagaatcccaaaaatgtgagtgccattacattgaggtcgggaaagcagtatcaaggacctcaaccagtagcatcttcctcatccgcaaatgaacctgcccaacttcactctactccagaaaaagatgatgacaaaaatttaaagacaacatatccctcttccattccctccaagagcaatttccaacaaaaaaatggaagaggcaaagaaggagatcttggaaacatttag

SEQ ID NO: 96122 - DNA, 863 bp, Glycine max
  Peptide Sequence Number=SeqID_212900
tggtatcaagagctaggttaagagaaagggaacagtccaagggagtgagagagacagtagtccaaaagtcaccaagtgatgacgtagctcttacagaggcacaacaaaaagagtatgaagtgatgaaattgaaagacttaaaagccaaaaattatttgtttcaagccattgatcgttctagccttgaaactattctttgcaaagatacttccaaggacatttgggattcaatgaagaaaaaatatcaaggctcctcacaagtgaaaagtgctcaacttcaagcgttgagaagagactttgaagtccttcaaatgaaagaaagtgagtcagtaactgattattgttcaagaaccatgggtattgctaacaacatgcgatttcatggtgaggaaatgactgacacagccattgtagaaaaaattctacgctcattaacaccaaaatttgattatgtttgcatgaacaaaagatcagcaatggaggagcacgcattgaaggcttctaccaatactcattcgaacaactctagaggaaggggtagaggtagaggtagaggaagagggcgtggagatcgaggaaatagagatttcagtaataattctaaagacaataatgatcaatctcaaggcaatggtagaggaagagatcatgataaattaaaggtacaatgttatagatgtcaaaaatttggtcattatgcctctaattgttatactagattgcctaatcttaaggaaaagggggaaagttcaaattttatcaaggagaaagaagtggaaaccttattgatggttgttgaagatgcaaaagacggcgaggcagaaatctggtatgtagacactggttgtagtaatcacatgagt

SEQ ID NO: 96123 - DNA, 211 bp, Glycine max
  Peptide Sequence Number=SeqID_212901
atgcctcaaggcttttcatctctggtaatcgattacacagccttgttaatcgattaccagaggccgaactcgaattacacaacttcagaacatgaaaacctgcaatatgcactgtgtaatcgattacacataactggtaatcgattaccagtggcctgttactctgtgatgcaatcctaccccgcaagggcattggatagaaaaactccaa

SEQ ID NO: 96124 - DNA, 541 bp, Glycine max
  Peptide Sequence Number=SeqID_212902
acagcagaaagtttatacggataaccactcgggtattttcggccgtcagcgtgactcaaaagtcagtatgacagatcttatgagcgcggaagataacgcttttcggcttacagacagcaaaacgtttatacgaataaccactcagggcgcagaagacgacgttagtctctgcgtgctatcaggcttttcgtcttacagaatgcaaaaagtttatacggataaccactcgggtatttccggccgtcagcgtgactcaaaagtcagtatgacagatcttgtgagcgcggaagatgacgtcgcagaagacgacgttagtctctgcgtgctatcaggcttttcgtcttacagacagcaaaaagtttatacggataaccactcgggtatttccggccgtcagcgtgactcaaaagtcagtatgacagatcttgtgagcgcggaagatgacgcttttcatcttacagacagcaaaaagtttatacggataaccactcgggtatttccggctcgtcagcgtgactcaaaagtcagtatgacagatctt

SEQ ID NO: 96125 - DNA, 300 bp, Glycine max
  Peptide Sequence Number=SeqID_212903
atggataaaggtaaaaccttttctgtgcggcttcagcagctttggcatgtgcttcttcagagcaaccaaagcaaagacccatctttggtgtttctctctaccaaactgcaaaacaaaccgaaatggactcaaaagttagacagaaagcaggggatttattttccaaaaatttacaaccaaaagaaagaccaaaccaaaattgatgcctatgtgcgaaataagaggacacaacaaggaaccacaaaacatgaatgcaagcatgcaacaaaagaaatggaaaaacaaaggagaagaacctga

SEQ ID NO: 96126 - DNA, 507 bp, Glycine max
  Peptide Sequence Number=SeqID_212904
atgccacgcttcgcgtccgttgaatcttcatctcccattttagccagccctggatgtttgcataaaggaagaagtgttggagacttcaattgtcacgagaggaggccaagaaagggtgtcgcttcggtgccccctttgggttcagttattgaactcaatgattccgacacggacgaagacgaggaccatgatttggacaatgcaatcgccaacgcagtgaacggtgcttcttcttcggtagagagtccgtccaagaagcaatggacgagcgaggctgaagaagtggttttgccagttgtatttgtcacccctctccctccgacgccggtgcctcctcccactttaatgttgtccttgctggcgatggaatatgcatctaattcggcggcatcgcgcaccaacgcgagtaagagtttgagtctgaatagctccaagcagttctggaaggctggggattacgatggcgctcctctcggaggctctacagctgtagctggagcctcttaa

SEQ ID NO: 96127 - DNA, 249 bp, Glycine max
  Peptide Sequence Number=SeqID_212905
atgcaattcaagtatgggattcctgaggcaatgatttcaacaattttggcatactggattcccgatattggtcaactgatatttattacatgtggttggtgccctggaacatggaaaggtttcttttttatcattcaaagatctttgcttgttgccaagctttccatttcatccgatgccatgttatgtattaacatcaatggatgggaaatgatgatagcatttggtttcatggctgcagcaagttga

SEQ ID NO: 96128 - DNA, 411 bp, Glycine max
  Peptide Sequence Number=SeqID_212906
atggctagcctcaaggttgcatgtgtggttgctgtgatgtgcatggttgtggtggccatgagtgctgcacccatggcacaggccgcaatcacgtgcgggcaggtcgccggcgacatgtctccgtgcttcagttatcttcgaagcggcggaaaaccgtcgcaggcctgctgcaacggagtgaagtccctcagcagcgcggcgaagaccaccgcggaccgccagggggcgtgcagttgcctgaaaaaccttgccaataatatgggacagagtttgaatgccggcaacgcagcctctctccctggcaaatgtggcgtcaacatcccttacaagatcagcacctccaccaactgcgccacggcaatgagggatccaccagtgcgagtctcttcttggtattgccgtgtcccttag

SEQ ID NO: 96129 - DNA, 315 bp, Glycine max
  Peptide Sequence Number=SeqID_212907
atggcgaaggcctcttgctttagaaactattactccctctccggtaccgccacggcgacgcagtcactgattccatcaccattctctccgacgtcaaactccgttcaaatccaaacaaagcatgctgttggagagctcgttgccagcaggctcgttgccggagagggtgagggactagatgtgctgccaggtgccatactcgggagggatctggccggagaagaagttgccgccgaggtgaaggtggtggaggaggggcatgacggcaacggagagaggaatttccaaattcactcccttgaagatagaatttaa

SEQ ID NO: 96130 - DNA, 1578 bp, Glycine max
  Peptide Sequence Number=SeqID_212908
atggagtttgttctaaattacctaaatgccactgccattggagttctttctataaccctcttctttttgtttttgtataatcccttcaaatttgcattaggtaaaaaagaggctcccaaagttgcaggtgcatggccaatacttggtcacctaccactattgagtggttcagagacacctgatagggttttgggtgctttggctgataagtatggacccatattcaccatcaactatggtgtcaaaaaggctttggtaatcagcaactgggaaattgctaaggaatgcttcaccaaaaacgacatcgtcgtttcgtctcgccccaagcttcttgccattgaactcatgtgctacaaccaagccatgtttgggtttgcaccctatggtccttattggcgcgagcaaagaaagattacaacgttagagatccttacatctcgcagagtggagcaactacagcatgttcgtgtctccgaagttcaaagttcgatcaaagagctcttcaatgtttggtcaagcaacaagaataatgagtctggctatgcgttgctggagctgaagcaatggttttctcaattgacatacaacatggttcttcgaatggtcgtcggaaagcgacttttcggtgctagaactatggatgatgagaaggctcagagatgtgtggaggctgtgaaggagttcatgcgtctgatgggggtgttcacggtggcagatgctattcctttcttgagatggtttgattttggtggctatgagaaggccatgaaggaaactgccaaggatttggatgagatttttggtgagtggttagaggagcacaaacaaaatagggcttttggtgagaacaacgttgatggaattcaagacttcgtggacgccatgctttccttgtttgatggaaaaacaattcatggcatagatgcggataccatcatcaaatccaatttactgacagtaatttcaggaggaactgaatcaatcactaatactcttacatgggcagtatgtttgatattgagaaatcctattgtattggaaaaagttatagcagaacttgacttccaagttggaaaagagagatgtataactgagtctgatataagtaagttaacataccttcaagctgtggtcaaagaaactttaagattatacccttcagttcctctctcatcacctcgtgaattcatagaggattgcactttaggtggctacaatgtcaaaaaaggaactcgtctaattacaaatatttggaagatccacacagatcttagtgtttggtcaaatccattagagttcaaaccagaaaggtttctaaccacccataaagacattgatgttaggggacatcattttgagctattaccatttggtggtggtagaagagtgtgtcctggaatatcctttagccttcaaatggttcatttgattcttgccagtctttttcattctttttcattcttaaatccatcaaatgaacctattgatatgactgaaaccgttggattaggcaagactaaagctactccacttgagattttaattaagccacgattatcttctaattgttatctatga

SEQ ID NO: 96131 - DNA, 354 bp, Glycine max
  Peptide Sequence Number=SeqID_212909
atggctagttttactaagttggcatgggtggttctggtgtgcatggttgtgatgggtgcacacaacactgtccaaggcatcacatgtgggcaagttcagggtaacctagcaccgtgcctagggtttctccataatggtggggctgttaccagaggatgctgcaacggggtcaggagtattgtgagcaatgctaggaccactgctgatcgccgtggtgtgtgcaactgcttgatggttgctgctggtgctgttccatcaggtgaaggacaaaaagatttggatagatttggccgcgatgaactatgcatatggtactacgtatacgtgctaggaaagagaaataaaggaagatga

SEQ ID NO: 96132 - DNA, 702 bp, Glycine max
  Peptide Sequence Number=SeqID_212910
atgaggcacctccgctgccaattaccttctgaagacctcaacgctcttgtctccatcacctccgacgaggatctcgcaaaacctcatcgaggaatacgatcgcgtttcatcgccgaaattatacatttcaagcatctgatttctcaccacagacgtgatgcagttagggctgagaatgctttgactcttctttatggcaatgagccaattggcatgcaaagagactggaatgaagagctgcagtcttgtagagaatttcctcatacatctcctcaggagaggattttgcgggatagggcactttataaagtgacatcatactttgttgatgcagctattaatggtgctattggagtgatcagtggttgcattcctccgataaacccgactgaccctgaatgctttcacatctgtcaaagaaacttgtggatgctaattcaaaatcttggagctccagctctttgcaaagttcttctgataaagattccattccagttcatggagaaagtcagttcagaagatcttaatggcacaaaaattactcaagatgtttctccagaagctcagctggctgagaatgagcaagccacatatgcttctgcaaacaatgatttgaagggcacaaaggcttaccaagaagctgatgttcctggactttataatcttgctatggctataattgactacaagggtcatagagtg

SEQ ID NO: 96133 - DNA, 2043 bp, Glycine max
  Peptide Sequence Number=SeqID_212911
atggatggtaccaagccacaaactcatgtgagtttgcttgaaagaagtgcctttgaatctatggaacgaggaaagctcaaacccattttcttttcttctccacactacgtgacaactgaaacaaagctgcaaagtgattatgttccgcgtcgacgtggttcttcttcctcgttgatagttttgcaagccatcttcaacagcgccttcttctcaacgactggttcttcttcaacagctctcttcattggcagttctgcaagcactcttgttgccgtcgattctcgtcatcatcggttcccatcattgttgtttcttgtttgtgggtgtgtttgttgtgctgtgaaagatgtcccgctgtggagttgtaatttttgtgaaaaagttgtcaaaagttcatactctagggttaaagcacatttgctcagaatttgtggtaatggaatagctacttgtccgaaagttactgatgcatattttgttgatttgaggagggtttgtgaagagactaaaaacatattaaagtctaagaatgttcctttacctactgacaaaaggactccaacaccaccaacatttccaccaaaaagaagaaaatcaagcaatatagagagtgcatttaatattgaggataggaatcatcttagagcagagatagcaaggatgttttattctgccagcttgtcattccatcttgctagaaatccatattttgttagttcttattcatttgctgctaactataatctaagtgggtttcttcctcctagagttacattggttgcagatggttggacagatgctcaaagaagacctttgataaacttcatggctatatctgaagaaggacctatgtttttaaaggccattgatgggtccaaggagtacaaggacaaacattacatgattgacttattaaaggatgtaatcaaggaggtagggccacaaaatgtagtccaagtcataactgataatgctcttgtttgtaaggcagctgggctattgatagaagctgaatttcctcatattttttggaccccttgtgtggttcatactttgaatcttggagtgaaaaacatttgtgctccaaagaatgttgatggtaatgagaatgtcttcaatgaatgtgggtggattgctaaagtaattggtgatgcttcttttatcaaggtgaagacaaccatctataggcatgatgaagtgctagaaaatgaagtttctagtttctttgaagttattcatgaaatacttaattctaggtggagtaagagttgtaatccacttcattgcttagctcattctctaaatccaaggtactatagtgataattggcttaatgaggttccaaataaggttcctcctcatagagatgatgaactttctagccaaaggaataaatgtcttaagagatattttccacatgttaatgttaggacaaaagtttatgaagaattctctaaattctcatcttgtgcgggtgattcaattgaggatagatgggcattagatccaaaaacttggtgggttatgcatggatcctctacacctatactccaaaaggttgctttaaagcttctagtgcagccatgttcttcctcatgctgtgagaggaattggagctttttgtctagaaaagaggaagggtataaaaaaggagagataagattgtgggacattaatggagatgtacatgatccacttgatgatagtgttggtgttcttgaaatggcagatttatctcttgatgagccagatttagaagctatgcttttcttaaatgatggcaatggaggagaagaaaatgaaacaattagagaagacgcccttaatggagcttgtcctacagaagagaagagtgattgcttggaagcaggtccaactatgaattctaagttaaaagaattaataccacatgaaggtatcattttctggtcagacatagaagatgtaaccaacatagcattggatcctttatttatgtttgttttccatttgggtgttaatggtgcagctattgctcatgttataaaccttaggttttcttga

SEQ ID NO: 96134 - DNA, 579 bp, Glycine max
  Peptide Sequence Number=SeqID_212912
atgtgtttgattttaaaaaacccatatgtgttggaaaaagttaaagctgaatttgacatccaagttgggaaagagaattgcataagcgagtctgatataagtaagttaacataccttcaagccatggtcaaagaaactttaagattgtaccctccaggtcctctctcgggacctcgtgaattcactgagaattgcactttaagtggctacaatatcgaaaagggaactcgcctaattacaaatctttggaagattcacacagatcttaatgtttggtcagatccattagagtttaaaccagaaaggtttcttaccactcacaaagacattgacattaggggtcatcattttgagctactaccatttggaagtggtagaagaatttgtcctggaatatcctttggccttcgaatgcttcatttccctcttgctagttttttgcattcctttgaaatattaaatccgtctactgaacctcttgatatgactgaaagctttggattagtcaacgctaaagccactccacttgagatttttattaaaccacgtttatctccaagttgttatgaaagcaagtga

SEQ ID NO: 96135 - DNA, 489 bp, Glycine max
  Peptide Sequence Number=SeqID_212913
atgagtgacttaccaggcattcttcaaggggacaagtcagactctctctcttgtacggctctgttgacaatggaaagaaaatttgctggattttcattccaaggtgtcagaggctgccaaaaatgccttcatttgaaggaacatttagtccttgatggatctggaaatcttttcaaattagctgcaccagtggaatgcaagggcattgttggtcgtgatgatcgacattatcttcttgatttgttgagagtaactcctcgtgatgccaactatactggacctggttcccgattttgtatcttgagactagaattaattactgtctattgccaggcccaagtagcagagacattgaaatctaaggagaagaattttcaagaggcagacaatttggccattgaatctcaaaatgggcagaacttttcaatgctgaaaaagtgtttctttgccattggaaagcttatccaaatgggcagtatctttagttga

SEQ ID NO: 96136 - DNA, 957 bp, Glycine max
  Peptide Sequence Number=SeqID_212914
atggattttattctcaattacctaaatgtcactgccattggatttgtttctctaatcctcttctgtttgtttctgtataatcccctcaaacttgcccaacgtaaaaaagaggctcctacagtttcaggtgcatggccaatacttggtcacctcttactattgagtagttcaaaggcaccccatagagttttgggtgctttggctgacaagtatggacccatattcaccatcaagcttggtgccaaaaaggctttggttatcagcaactgggaaatagctaaggaatgcttcaccacaaacgacatcgtcgtttcgtctcgccccaggcttgttgctgctgaaaatatgggctacaaccatgccatcttagggttttcaccctatggtccttattggcgcgagctaagaaagattacaacgttagagatccttacatctcgcagagtggagcaactacagcatgttcgtgtctccgaagttcaaagttcgatcaaagaactctttgatgtttggcgtagcaaaaagaatgagtcgggctacgcgttggtggatctgaagcaatggttttctcgcttgacattcaacatggttcttcgaatggtcgttgggaagcgatattttggtgctacaactgttgatgatgatgatgttgagaaggcacaaagatgtgtaaatgctatcaaggatttcatgcgtttgtttggggtattccctgtggcagatgctattccttatttgagatgctttgattttggtggccatgagaaggccatgaaagaaactgccaaggatttggatagtatcataagtgagtggttagaggagcacagacaaaacagggctttggatgaaaacgttgatcgagttcaagacttcatggacgtgatgatttccttgcttgatggaaaaacaattgatgggatcgatgccgacaccatgatcaaatccacagtactg

SEQ ID NO: 96137 - DNA, 750 bp, Glycine max
  Peptide Sequence Number=SeqID_212915
ggatgtgatgcatcagtgttactgaaagacacagcaaatttcacgggtgaacaaagtgtcattcccgatgttgattctacaaatggtacggatatcatactcatagagaagataaaagctagactggagaaactgtgtcctgatgttgtctcttgcgctgacattatagctgttgctgcaaaagattctgtcgttgcgctcggtggacctacttggaatgttctcttgggtagaagagactcaacaactgccaatctaagtgctgttttaacagattttcccactacttttatgaatcttactgaacttcttgctacgttcgggaaaaaaaatttcacagcccaagaaatggttgcttttacaggtgctcacactacaggtagaatcaaatgtttattctttcgaacaaggatttacaacgaaagcaatataaatccctcgtatgcaagatcgttgcaagctaagtgtccattcgtaggtggtgatgacaacttagctcctttagatcgaaccactccaatcctttttgacaatgcttattacaagaatttgctgaagcaaaagggtcttttacactctgatcaacagctctataacaatggttccacggacacgattgttgaattttatgcaaagaaccctttggggtttagaacagatttcgctaaagtaatgactaagatgggtaaccttagtccacttaccggcaccaacgggcagattagaaagcaatgcagcaaagtcaattga

SEQ ID NO: 96138 - DNA, 354 bp, Glycine max
  Peptide Sequence Number=SeqID_212916
atggtgtttcacaccaactacaatgtgaagccaagaatcactcggtgttttgatcaagaatacaaaaggataccaaggaaggggcaaaatagtcttttcttgacttttctggaccctagctcgcccaggctagcatctggctcgcctgggccaccaaatagcttcatggtgaagaaaccaactcgccttggtgagctcactgcttcagggttaagtttcagcttgcctgggcgagctctagctcgcctaggagagctgcaactaccccaaagtgaccatttgcctataaataggcgtcctaggggtgttttaaggggttccaaggttcagaagttaagggaattgagagaatag

SEQ ID NO: 96139 - DNA, 558 bp, Glycine max
  Peptide Sequence Number=SeqID_212917
atggctgaatcaactcggtccaaatccaattgggatcgccttgaagaagtcatagtcaaattggcctctaaccagatccacgttattgagaaacttgatgaccttatgcatcccatcactgtcctcgaaaacacttcacccctagtagcctcacctttctcgtcctcagccatacctaaaccacctacccacttaaccaatccaccaaaaatgaaactagatgtcccacgattcgacggcttaggcccttctggttgggttttcaaaattacgcaattctttgaatactattccacccctaaatcagagcgtctcaccatcgcctccttttatatagagggtccggccttagcctggctcttcagcctctcaccttggttcacgccgccagtttggcctgccttcaagaagaaacacttgcagaacatcgttgtggctctcgcggtaggactttcaatggacccagtttctcttcactgtgacccccttctaccactctctcacccccaaacctaccattattaccatctccagcaaaaccccctccctaacccttaa

SEQ ID NO: 96140 - DNA, 528 bp, Glycine max
  Peptide Sequence Number=SeqID_212918
atgcccaatcatggggagccacgtggtccttcctcttcacctcaatcgcctcctacctcttcctctcaatcctcctccacctttctctttctctcctcttttgccaccgtcaaatccctcttgggccactccctgccgtccacaacctctccatgtctctcatctctgccacgatcttcgccggcatcctcctctccgtcgccgttgagatccgcagaacgtagtggttctggcggcactcccaaacacccttacagtggctcctctgcggggggacagctgaggctgcgggagcttcgggaggaagaggaggaggaggagggggaagaggatttggagtgcgagggagaacaggaccaagaaaaggagcacgagcggcaggaggaacgggagtcggagggggaagaggaaccagaggaggaacttgaaatggaaccggagggggagccacgaccttgcccaggtttcgccatagttgtagcagagagaaaggaacgaatgaaaccctctgataaacctaaggagtga

SEQ ID NO: 96141 - DNA, 570 bp, Glycine max
  Peptide Sequence Number=SeqID_212919
atgaagttgtctaagtttcttggcacatatgattttgatagcttgccttttgattggggagaaaattacaagcttccaaatatttctgagaaagatcttgttatatatgagatgaatgtctgggcatttacaagtgatgaatctagtggtttggatagcaacattcgtggcagctacctcagtatgattgaaaagattccacaccttctaaagcttggaatcaatgcagtagagttgttgcctgtctttgagtttgatgagttggaattccagaagcttccaaatcccatagatcacatgaacaaagctaaggataatgattctgatcataatgtggattttgctgctgggaatgtgaaacttattaccaccaaagaagcgtgggaccaatatttggaagaagcaaggagggctggcaaaatttttagaggaggcagtgaaagtaatggcattagaagaggggaaggtgaagatcgagaagttcgatggcagagatttcagcttttggaagatgcagatagaggattatctatattagaagaagctgtatcagcccttatcaggggttaa

SEQ ID NO: 96142 - DNA, 225 bp, Glycine max
  Peptide Sequence Number=SeqID_212920
atgaataagaagggtttgccaaagggattagttattgggagctccagcattcttgagattgctggtcaaggagcacttgtgccattgtaccagagattacaatccagcgttattgccaaggactctgaatcttcaaattccaataaaattatttgggtcatacgccaggagaagacaaagcagaattttgaaatggcactggaaagcataagacagctcatttaa

SEQ ID NO: 96143 - DNA, 345 bp, Glycine max
  Peptide Sequence Number=SeqID_212921
atgtctgcaacttttcctgaattcaaactcaggatttgtttgctcttatgtataattgggacaggttttgctgattctgctaatgatttacgcccagacttttataagtcacaatgtccccaagcacttgaagccattaaggcagaaataacctctgctggatgtgatgcatcatacttgttaaaagacacagcaaatttcacgggcgaacaaagtgccattcctagtcttgattctagaaatggtactgatatcatagagaagataagagctagagtggagaaactgtgccctggtgttgtctcttgcgctaacatagtagcttttgctgcagagattccgttg

SEQ ID NO: 96144 - DNA, 1950 bp, Glycine max
  Peptide Sequence Number=SeqID_212922
atgcccactatcgacgagctgttagatgatttggggcatgcatcatggtactccaagcttgatttgcaacagggctttcaccaaatcctcatggctgccaacgacattcctaaaacggctttcaggactcaccagggacattacgagtatcgtgtcatgccgccctgctacaaggccaattttatctcaaacgacccaagtgttcttttgctcaacgaaggctcgaatacttgggccacatcatctcggaacgtgggcgtttctcagcctcacgggattctaccggaagttcatccaaggctacgccataatcgcctctcccctgaccgccctttatgcaaaaatgctttttcctggaccgctgaatcacagtcagcatttgagaaactgaaaaccgcaatgacccatgctccagtgttggccttacccaactttgattgcccctttgttctggaaatagatgcctcaggcacaacaatgggcactgagttacatgctatcgtcacggcggtgcgtaaatggtgccagtatttattaggccacccattcaccatcctcactgaccataagagcttgaaggacctcctatctcaagtcatacagactcctgagcaacaacattacttatccaaattgttgggatatgaatatactatccaatataaggctggtgcttcgaataccttcaaggatagcccggagtttcgcactcaattcgctagagtagaagctcacccatcagcacacacagactttaccatttctaatgggttattgttttttcagggatgcatttggtttactcccgacaacccattcatcacttcattaatcaccgagttccattcaacacctctgggcagacatctgggaatcgtgaaaaccactcatcgcgtcaacgccaatttctattggaccaccctctgccaggacgttaagcaattcgtctgcaactgtgtcacttgccagcaatccaaatcgcccactacacgtccggcgggtcttttacaaccaatacccatcccatccggcgtctgggaggatctatcacttgacttcatcacccacttgtcgtgctcgcatagtttcattgcaattctggtcgtggtcgatcgtttctccaaaagagtccacttcgacgctctccctaccaatttcacaacttatcgcgtggcggtcttgttccatgacatgggaactattcaaactcagtggtacgcgcctgcgtatgagcaccgcctaccatcctcaacagacggtcagacggaggtcttgaatcacgttctggagcaatatttgcgctccttcgtcagctcttgcccatctgactggtccaaattcctagccttggcggagtggtcttataatacgtcagtgcactccggcactagcttcactccttacgagattatctacggcaagcctccgccgtcaatccctcatacattctgggatcctccaacaacgaagctgctggcacaaaccatcatgaagcaacacgctgatgctcaccagcgagacgtgaactatgaagtgggtcaatgggtttatgtcaaagtctgcccgttccatcaacgctctgttactggttcagtccatcccaaattgtccaaaaggtttttcggcccatttcagatcacagagaaaattggacctgtcgcttatcgtttgcagttacccgataacgccaaactccatctcgtctttcattgctcccttctccgccctcaccacggtccaaccccgacagcccctgaagactccacatgggaaacatgggcagacatgaaggacaaataccaccttgaggacaaggtggatttggaggaggggggtattgatagcaacacccacacaaccaggggtactactagtaatacccacgcacacacctccaagcccaacaggaacacacagccacctcactatttgaaggattatattacatga

SEQ ID NO: 96145 - DNA, 618 bp, Glycine max
  Peptide Sequence Number=SeqID_212923
atggaggaggggacacagcttgttttcgagtgttcaaaaatccggtggctacactttgtgactagggcttacaaggacatgttacaaggacaaactggatcggttttccgacgagctcgtgaaactatttgccatcgacatgcaagctcagatggcaagagatcagaggagacattgcttaaggttaggagaatacttagggttgttgagaaaacgtgcttcgaccctggggaggcaattgaaaacacgctgttaatgtttttgacgtggatttctgtctttgctgtgaagctaataagggcaatttctgctttgagatggatttttccaacgctaatacgggagcagcattcggaggtgactgaaatcgttagtgtgtcctggctaaaaatcctgggcagaatcaaaactgggatgttgtccccaaatacattgtacggggcataccttgtgtttaaagaaagcaatgatggtgcctacgggttcaagaacatgaccgttgaggtgtccattggggttatcggagaggttacagattcaagaattatgaacttggtagtaggaagctcagagtccagtatccgagggagagtgacgatggtagtggatggatgttga

SEQ ID NO: 96146 - DNA, 402 bp, Glycine max
  Peptide Sequence Number=SeqID_212924
atgtggttcaccttgacgctttccgagacctcgctcagagtggtggttatgcttgtggagttgtcgcgctggaccatcggacagcttgcggggtacttgatgctactacaatgctggatctatgagcacttccctagtgtgcacctgtgcgtaacagatgatacataccaggagacgtccccacgtgcttcccggtggttgacatcgaaggcgcacatgaagggaatcacaggagcaccttacagggcacgttgtgatggtttgaccgtcacagatgtgtcctggttgccgtacatggagaatcggggggttagggcctttcaggagatttcatcattccagggtcagcttagatggggtcctatggtggtcacagctcgaccagagagggtggtacgctag

SEQ ID NO: 96147 - DNA, 138 bp, Glycine max
  Peptide Sequence Number=SeqID_212925
atgtccgaagttgtgacttacatgcagatggttgacaaactggatggtgggcgtgaccttcaggctgttggaaaagctctcatcgcagcacatgtacaaggccaactcaagagtaagattatgtctaaccctgaatag

SEQ ID NO: 96148 - DNA, 267 bp, Glycine max
  Peptide Sequence Number=SeqID_212926
atgcaagtcgcaggaggcattggcgcgtttcgtgatgacgtgacacctggcactggtgtcgccagtgctgttagcatgttgcaggaggttggactcgccagtcaaactggcgaattgagggtaggggagttccgagggtgcaggccaacagaggccatttctgagggttgcagtctgcaacgcgcagaggttgcaggatgtcgccaggttcaatggcgatttggttgggcaaaagcgccagcacgagcagcgatttgcgttgcttga

SEQ ID NO: 96149 - DNA, 285 bp, Glycine max
  Peptide Sequence Number=SeqID_212927
atggccgatccagacatgggtgactcagacaaatacgagttgtacatcaaagaaaatccttcctgcctggttgccataggaagagtttatgagggatccatagtggttcacaacatccctttgttgcatggccaagtgaaggttggtgttgaagaggttaaagatgcaaatgctcttgttccaatacctactgatgagacagctgtgtctaccgcaaaacttgcagataggacggatcatgaggtcgatgatcccctatatttgatgacattgaccatcccatag

SEQ ID NO: 96150 - DNA, 222 bp, Glycine max
  Peptide Sequence Number=SeqID_212928
atgacgaagaacgaacgaaagatggcggaaaatcttcacggaatcacccacggaaatgtttcggacccgtcacggaagagaaggcaccgccttctggaggaacatcctggaaggcccaagtgggccagaacttcacgtattatgcaaaaatgggtgccaagtacctcgaagcggtcaagcaaaggttgcatgccatcaacaatggtccccgaacaaaattag

SEQ ID NO: 96151 - DNA, 315 bp, Glycine max
  Peptide Sequence Number=SeqID_212929
atggccatgaatatgatatcatcagatcctcttgttatagggaaggtgatcggagatgtagtggatcatttcactccaactgtgaaaatcactgtctcctacaacaataataagcaggtctataatggtcatgagtttttcccttcctcagtaaccactaagcctaaggttcagattcatggaggtgatatgagatccttcttcactctggtcatgacagatccagacgttcctggccctagtgatccatacctgagggaacacttacactggtatttatatgatactatatactatacaatttacatgatatga

SEQ ID NO: 96152 - DNA, 207 bp, Glycine max
  Peptide Sequence Number=SeqID_212930
atggagttcgtgtttgccacttatcgattgaggtcgaagaaaactaggaaaggaaaaagtcccagaaagggtgggaagcgattttggaagtccattgtggttggctttaagactcccagggaagccatcgaaggtgatttgttcgtcttctttagtcgctgtcaaggttcgttgttgcttgtgttctgtgtgctgctaagtcattag

SEQ ID NO: 96153 - DNA, 507 bp, Glycine max
  Peptide Sequence Number=SeqID_212931
atggagcaaaaaggaggtgtgcttatgcaacgatatgaactggggagattattaggccaaggaacctttgggaaagtctaccatgctaggaacatcataactggcatgagtgtggccattaagattactgacaaggagaagattctgaaagttgggatgattgatcagattaaacgcgaaagttcaaattgcaccagatgtacgcaggttgctgtcgaaaatcttggattcaaacccaaagacaaggatatcaatggccaaaatcatggaaagttcttggttcaaaaggacaaattggaccggttttccgacgagctcgagaaactatttgccatcgacatgcaagctcagatggcaagagatcagaaggagaccttgcttaaagttaggagaatacttagggttgttgagaaaacgtgcttcgaccctggggaggcaattgacaacacgttgttaatgtttttgacgtggatttctgtctttgttgtgaagctaattgatacgtaa

SEQ ID NO: 96154 - DNA, 981 bp, Glycine max
  Peptide Sequence Number=SeqID_212932
atggtagcatggactaaaactagcaagagaagtcggggtcaagaacctacgatgctacacagactcgcaacttgtttaggggcatgttgccaacagataccagaccaaggaaacaatgttgctcaagcacctcaagactatcatctaggagacgctccaaactcccaccatagacactggagaagttatggctggagaagaggaggaaccagactagatgaccccctacaagaatttcctaattcagggggtattgctatcagacgagaacgaagtctaacatctgaaatagaagcccggctactacgttatctagtcaatggggtggagaagttcacttggaaacacctcatatgcaagtacggcctcccacatgccatcatcattgacaacgacccgcaattcaaagatcatgcttatgaagacttcctgacgaggctaggcatcaagcgccttgtcacctttgtcgaacatcctcagaccaacgatcaagtagaagtagccaacagagttatcctcaaggccctgcgcactagactcaacaaggcctaccgttgttcaccccagacctcgaccaatgaaactccttatcgactcacatatggcacaaacaccatgattcccgttgaagtcggggaaccgccaaaaaggagattgttgttccagcaacaacaaaaagaagaaaacatgaggcaagaagatataatacaaaggttcaaccctgagcatttcaactcggcgacttcgtgtggcgagttcgaggcgaagccaaaaaagatccccaagcgggaaagcttggtcccaattgggaagaccaaggctcattcagggacaggtacatccctggtcgcagctccacaggctcatcaaactcaacgtttgtccttggtgagtctcaccaaaatccaagacgaacacattgctggtcagttctccaaaggctcgcaaaacccaaggtatgcccttggtgagtctctctaa

SEQ ID NO: 96155 - DNA, 372 bp, Glycine max
  Peptide Sequence Number=SeqID_212933
atggagtgtaatgctacctctgggttgagattatggatttggacaacaatgcatccaaacttatccatgaatttttggagagattcatcatctgtttgtcacaggctggccaaagtgcttgacaagagtgtcgaagctattgatggaccttggagggagtctactgtaccaggtcaagaaagtatccaaatgatcatctggattggtggtcccatcataccacttcagggtgtaattccctttgagtgcgctcaggcaatgtatgagcagagtgctcgtcaccctaggggcgtcagaaatgagcctcccgctgatcgtggtcagcctttagctttcttagctcctcctcatggcgtcactccgcctccataa

SEQ ID NO: 96156 - DNA, 522 bp, Glycine max
  Peptide Sequence Number=SeqID_212934
atgaccaagagcaagggcaaggatccacttgaaggacttggaggacctatgacaagggctagagcaaggaaagccaaggaagcttttcaacaagtgttgtccatactatttgaatacaagcccaagtttcaaggagaaaagtccaaggttgtcccaattggcaacctaggcatcaaccttttgggagaccaaatggtggttggcttgatggttgttgggggcgagccagaggctaaccagggcgagccagggctgaaggagtctgagttatgggtggctagggagagggagaccattaaagagcttgaagaggagctgataatgtacgagaaagaggttgcggagcagaatgaaaagggctttaacaaggccgtcagggaggccgggttcttcaccaaggaccttgacttgggtctttttgaccctttcaaggacgtgaatgatggtgttttgcttgaggacgaagacattgctgctgaggaggaggctggcgaggagcaaggcgatgatgccaatgtttag

SEQ ID NO: 96157 - DNA, 1023 bp, Glycine max
  Peptide Sequence Number=SeqID_212935
atgaagttccctaccttgactcgagagattgtgactgttaaggctgatcaaaagcaacacgacagtgctggtacatcctttgtggtacaagtagagggtacatctacttgggttgttgtaactgagaacaagagagggtacatctcttgtggatcagttcaagtggagggtacatccacttggttgttcaaagagaacaagggaggatacattctttatggatctctgcttgtaaaggtttttacaaggttgaaaagaaatctcaaggaccgcaggtcgcttggggactggatgtatcacagaagaagaagaagaatatgggacaagaacaatgcaaagcagtcagaagaagtggacaagctcctcaaggccaattttattagagaagttagatattccacctggctcaccaacgtcgtcatggatgcataccttctacccaacatcgacggcctagttgatggagcttccgagtcccaagtactaagcttcctaaatgcctactccggatacaaccagatccagatgcatgctttaaacgaggagataatgacattcatcactgaagataccaacttttgctacaaggtctatgtcaacaacatagtggtcaaatcccatagcataacccaacatgtgatagacctggaagaggaagtccagaagcttaatggtagactagcatccttgtccaggttcctccccaagctcgccaaaaaggtgaagccactttacaaaatgcttaagaaaattgagtcattcctatgggacgagacctgcaaacaagacttcttagtcttcaagaagaccattgccacaatgccagtcctgagtcgacctaggccaggagtactcctactcctacatcttttagtagttgtcgaagtcgttagctcagccctcatacaagaggaagggaagcaccaactccctatcgactgcaccagccgcatactccatgacattgagaagcgctaccaaatgatagaaaaggtggcgctagcactcatcacctcagcctga

SEQ ID NO: 96158 - DNA, 252 bp, Glycine max
  Peptide Sequence Number=SeqID_212936
atgttgtcaggtagtgttcctcatatggaattgttggacaaggagggtttcactactgacaaactgctacctcagttggagaatgttgtgcaagtgttaatgcaaaggacaatgccgaaatgcatgaaaagatcatcatctcataacagactctttcacatacgaccgaccacctcaactgcaatggcatattttgggaagaagatagaagctggttttcaaggaccagggcctccacggagagaagaatga

SEQ ID NO: 96159 - DNA, 1008 bp, Glycine max
  Peptide Sequence Number=SeqID_212937
atggcttcccgcaagtatttctctattgttatctatgcttttatacttggagcttttgcaaatacggcattctcatcattgtctcgtgattactatgactactcgtgccctaatgctttgagcaccattagaagtgttgtggaggctgcggtgcagaaagagcgccgtatgggcgcatccttgctacgcacacacttccgtgattgttttgttaatggttgtgatggttcaattctactagacccttcaccaacaattgacagcgaaaagagtgcagttcctgattttcaatccgacaaagcatttaaattggtggatgagatcaaagaggctgtggaccaagcatgtggaaaaccagttgtttcttgcgctgacatattgactgttgccgctcgtgactctgtcgttgcgttcaatttttataccattcggctaccatggcaaatagagcaagaactgctagggggaccaacatgggaggtgagactggggagaagagactccaccatagcaagccgtgatgcagcaaatgcaaacattccatcaccatttttcagcctttctgagctcataagcaacttcaagagccatggactaaacgagaaggaccttgttgctctttctggaggccacacaattggaaatgcacgttgtgctacctttagggaccatatctacaatgactctaatatcaatccacattttgcaaaagagctcaaatacatttgtcctagagaaggaggtgactccaacattgctcctttggaccgcacagcagcgcaatttgattcagcctattttcgtgacttggttcacaagaaagggcttcttcgctccgatcaggaactgttcaatggtggttctactgatgcattggtaaaaaaatatagccacaataccaaggttttccgccaggacttcgcaaaatctatgattaagatgggaaacataaagcctcttaccgggaatagaggtgaaattcgtttgaactgcaggagagtgaactaa

SEQ ID NO: 96160 - DNA, 606 bp, Glycine max
  Peptide Sequence Number=SeqID_212938
atgaggcaggccaataacacgattagccaagtgttcaaactcggtcaacttaaagagagcccccttcggatcatcgtaaaaggaaggagcgaatcaagattccaacgcttgcaagaagccagaccaggaggcgatgaactcgttgcggaacatccattggtggagacgattgagaatcgaatccactttgctggaaagttcagagtacttatcgacaaggcaccctggtcttgtggttatccttctgggcctttctgtattggactcttgatgaggtatgttgctaacaaccactgtggtcactcccatctccatgatagtcatcactcacactgccatgacagtctttcctcccacttccatgatgcatggttgctacaattactgacatatgcatctttgttgctgccgtcaccactcaccgctgttaatgtggctgctatggatagtgatggtgacaatagaactggtgacgatcatcatcgtggggcaacaacaatcatggaagtagaagtagcaacaaccatgacgataggggaaaattgtagatactgccaactggtaactaagactggaaatagtaggaaccaaccaagggatggatga

SEQ ID NO: 96161 - DNA, 1425 bp, Glycine max
  Peptide Sequence Number=SeqID_212939
atggcatcacatgggtatttctctgttcttgtccatgcctttgtgtttgcaagtcttgcaacctcagctttctcacaactgtcacctaattactatgattatgcgtgccctaatgctttgagcacaatcaaaagtgtcgtagaggctgcggtgcagaaagagtaccgtatgggggcttctttgctacgcttgcacttccatgattgttttgttaacggttgtgatggttcaattctactagacccttcacccaccattgacagcgaaaagaatgcatttgctaattttcagtctgttagaggatttgaagtggttgatgacatcaagcaagctgtggacgaagcatgtggaacaccagttgtttcttgcgcagatatattggctgttgccgctcgtgactccgtggttgcgttaggtgggccaacatgggaggtgcaactggggagaagagactccaccacagcaagcaaagaagcagcagatgcaaacattccagcaccatttttcagcctctctcaacttatcaccaacttcaagaaccatggtcttgatgagaaggaccttgttgttctttctggaggccacacaattggatatgcacgttgtgttacatttaaggaccatatttacaatgactcaaacattgatcccaactttgcacaataccttaagtacatttgcccaagaaatggtggtgacctcaaccttgctcctttggactcaacagcagcgaactttgacctaaactattactctaatttggttcaaaagaatggccttcttcactctgatcaggaactgtttaatggtggttctactgatgaactggttaaacagtacagctacgataccgaagctttctatgtggagttcgcgaattcgatggttaaaatgggaaatatccagccccttactggggatcaagttgcactggtttctgttgatgcttgctcccttgaagctgttattaggtctcgtagtcttgcaggtacctggtcttgtggttatccttttgggcttttctgtactggactcttgatgaggtatgttgctaacaatatccccgtcctcaaacaccaccttgtcctcaaggtggtatgtgtcacaaagctcctgccaaggctcccatgtcatgtcctccgagggttgccccaaccactgggggccatgcatccaagggagaaggaagtggttcgtgatatgcgcgcaagagggagcagtgaaaaacggggtggatgcgtgtattgtctgtccggtgacaaagcgctggcggaaggggcggagcttaacataaacccattgaccaatgttcgcgcttggtgtctgcctgtttcttcatggcagcctgttccttactcaacctgcattgaagtgcctcgtgaatcgcttggcaggaggatatcagtgaatcaacaacttcgttag

SEQ ID NO: 96162 - DNA, 1215 bp, Glycine max
  Peptide Sequence Number=SeqID_212940
atgtatttggccactggtaatcgattacatcctctgggtcgcccagttgaactccatgcagatgtagccattgggactgaatcggtttctgcaccacaggttaagcgtttgattcataccgggttaacttcggccttattccacctatgcctcacacctgcaaatccacccgacccatcacatcatcttcctcacgcaattcccgccattgaagccctgctcacccaattccaacacttccaaacaccaaccaatcttccccctccgcaacaagtggttcactgtataaaccttcttccgtccactactccggtgaacgtacggccatatcactacccacactttcagaagtccaaaatagagaaacaagtctctgaactactctccactggccttatccaaccaagtacgagtccatattcttccttgatcctcttggtaaagaagaaggatggtacctggcgaatgtgcgtcaattatcacgcattgaattcggtcaccgtccgtgattgttttccgattctgacgattgatgagttgctcgatgagctaaggcacgcctcctggttctccaaggcactaggaatatcgcgtaatgccattcggcttatgcattgtgccctccacctttcaggccgccatgaacaacctggccagatctatcttaagcgtgccaaatgcttgtttgcacaaatccagttggaatatttggggcacatcgtttctgacaaaggagttgaacttgagccatccaagattcgtgccatggtacaatggcccactctgacttcggccaaggaacttagggcatttctcggtctcaccagattctaccgcaagtttattaaaaactatgcatctattgtagcccctctcacatcactattatgtaaggatgcattcttatggaccctaatgtctcaaatcgcctttgatcaactcaagtcaacaatgaccagtgctcctgtcttggccctaccaaattttgcagtgtcgttcatcatcgaaactgacgcctctggcacaaccatgagggttgttctaatgcaacagggtcaccccattgcattcttcaacaaaccctttcaacctcgactgctccatgcttccacgtacgtacaagagcttcatgccatcgtcacagctatacgcaaatggtgccaatacctgttagggcattcgttcaccatcttgactgatcataagagcctctag

SEQ ID NO: 96163 - DNA, 960 bp, Glycine max
  Peptide Sequence Number=SeqID_212941
atggcatcacgtgggtatttctttgttgttctccatgccttagtgtttgcatctattgcaacctcagctttctcacaattgtcaccaaattactatgattattcgtgccccagtgctttgagcaccatcaaaagtgttgtggaggcttctgtgcagaaagagcgtcgtattggtgcttcattgctacgcttgcacttccatgattgttttgttaatggttgtgatggttcaattcttctagactccacatcctccattgacagcgaaaagaatgcagctgctaatttgcaatctgctagaggatttgaagtggtggatgacataaagaaagctgtggacgaagcatgtggaaaaccagttgtttcttgcgcagacatattggctgttgcagctcgtgattcagttgttgcgttaggtgggccatcatggaaggtgagacttggcagaagagactctactactgcaagccgtgaagcagcagatgcaagcattccagcaccatttttcagcctatctgaactcatcaccaacttcaagaaccatggtcttgatgagaaggaccttgttgttctttctggaggccacagcattggatttgcacgttgtgttacatttaaggaccatatctacaatgactccaacatcgatcccaactttgcacaacaacttagatacatttgccctacaaacggtggtgattccaacctttctcctttggactcaacagcggctaaatttgacataaactattactctaatttggttcaaaagaaagggcttcttcactctgatcaagaactcttcaatggtggttctactgatgaactggtcaaagaatacagcgacgataccgaagatttctacgaggactttgcgaactcgatgattaagatgggaaatattcagcccctcaccgggaatcaaggtgaaattcgggttaactgcaggaatgtgaactaa

SEQ ID NO: 96164 - DNA, 246 bp, Glycine max
  Peptide Sequence Number=SeqID_212942
atggcctggcacaagaggacactacatgggagccgttggatacactactccgggagggtgatgatagcaattcagatatcttggaatgggaagagcataagagcagcaaggaattggaccatagcaggcccagaagaaataccagaaaacccacacgcttcaatgactgtgtttgaggttgttaagcaagtactaaaatctactttgttatgcccattacctatttccactatccctcccatttag

SEQ ID NO: 96165 - DNA, 3489 bp, Glycine max
  Peptide Sequence Number=SeqID_212943
atggcgtttcgcagggaaagaggcttgtgctacaactgtgacgacaaatggagctcaggtcaccgttgcaagggaaggatcttactcttcgttgctgacgatgtcacacaagattccggcgaaccaggtatcactaataataccattgactttgacgataatctgagcaaccctgaccctacatcagactctagttccccccatattagccttcacgccatggcagggtcaccttcactggaaacttttcgagtttacggcaccattcgaagcgcacgaatcacggtcctaatcgatagtgggagtacccacaattttcttcaacctcgagtcgcaagcttcctccatcttgccactgaaagcactcaacctttacgagtcctcgtgggcaatggttccactctagattgtgataagcgttgtcctgacacgccgttgactattcagggccattcgtttccggtaactttccatctcctgcacatcagtggcgcggatgccgttctgggcgttgactggttacggcaattcggccccatcaccacaaactatgctgacttcatgatgcgattcacacaccaggggcaggaaatctccttgcaagccgatgtcgccaccaaacccgaaccagcatcagcaaaccaagtaaaacgtatgcttcacacaggttcgacttctgctttattccacttatgcattctcgactctaatcccacagattcaactaccaaccttctctcccctataatcaaacccatcaccgaacttcttctccgatacgaccaactcttccaaccaccgaaacacttacccccatcacgagaagtgaaccatcgcattcctctccttccgtccaccgccccagttaatgtacggacttacagatacccacattttcagaaggcggaaatcgagcgacaagttgcagagctattatccgatgggttaatcaggccaagcacaagcccgtattcatctccggtcctcttggtgaagaagaaggacggaacatggcggctgtgtgtagactatcggtcccttaactcagaaaccgtacgcaacaggtttcaaatacctaccatcgaggaactactggacgaattaggccacgcttcatggttcactaaacttgatctcaggcaaggatttcatcaaatccttatgaacgaagccgacatcgagaaaactgcgtttagaacgcaccatgggcactatgaatacatggtgatgccctttgggttatgtaatgcgccttcaacttttcaggcagcaatgaaccaccttctcgcaccatttctacggcgtttcgcagcggtgttttttgacgatattctcgtctacagcgaatcactctcctctcacgtccaacaccttgatctcatctttcaggcactactacgaggtgagttctacctaaagcgcactaaatgtttcttcgctcagagggaattagagtacctcggccatatagtttccggtaagggagtaactccagaaccatctaaagtcagggccatcacacagtggccaattcccgcaaccgccagggacctccaggccttcctcgggttaaccgggttttatcggaaattcgtacgcaactatgccgccatcacagcccccctaacgagtcttctgtgtaaggatgcattcgaatggtccattgaatcccaagaagccttcaacaagctcaaatccgcaatgtccgatactccggtattagctcttcccgacttcagcaaaccattcgtggtcgagactgacgcttcaggtacagccatgggggccgttctcacccaagcaggtcacccactggcattcttcagtaagaacttcgcccctaagctactaactgcgtcgacatatgtgagagagctacacgctatcacttctgcggtacgcaaatggaggcaatacctccttggaagcaccttcaccattcttactgatcacaaaagcctccgagagcttatgacacaggtgattcaaacacctgaacaacactattacctatctaaattgctgggtttcaactacactatacagtataaaacaggagcctccaacgtagtcgcagacgcgctctcccgccgaccaccagagcccagtcagcttttcgtgctatcagtccccaacctggacttcttaagtgatattcagcaaacccttgccatcaatcctgaattccaagccctacggtccaacgttcaaaccaacccttcagcctatccccattatcgtgtccataatggttgtctcctgttcaacaatcgaatctggatcaacaacaccaatccccatatcccgtctcttctatccgaatttcattctacacctctgggtggccatttcggggtaaccaaaacactacgacgacttgaggccagcttcttctggcagggtatgaaggccgatgtccaaaggtttatcaaggaatgcacagtctgccagcaaaacaaatccagcacctggcgtccggcgggcctcctgcaaccccttccaccaccaacaggtgtatgggaggacatttcaatggacttcgttactcacctacccccttcgaatgggttcaccgtgatattcgttgtagtcgacaggttctccaagggagtacatcttggcgcccttcccactgggttctcagccttcaaagtcgccatgcttttcatcgaaatcgtttgtaagcttcacggtttccccaaaagcatcgtgtcggacagggatcccgtattttttagtaccttctggagagagctttttaggctaagtggaacccaactccgcctaagcacggcgtaccacccccaatctgacggccagaccgaggtggtcaaccgtgtccttgaacagtacctccggtgcttcgtcaactctcagccatcatcatggtaccgctatctctcgcttacggaatggtgctataatacctcactgcattcgacttcaggcatgacaccatttgaagttgtgtacggcaagcccctgccctcgatacctcagtatctcccaggcctaacgagaaacgaagctgtggaatccttggttgagtctcgacaactcatgcatgctaagctccaaaaacgactgaagaaggcccaaaccacgatgaagaagtacgccgatatgaaacgcgacgacatcaccttctctgtgaatcagtgggtctatgtaaagcttcgcccctcacgccagcgttcggtcactggaaataaccatcccaagctttccaaacgctacttcggccccttcaggatcagtgctaaggtaggtaacatagcatacagactcgagcttcccccggagtctcgaatccaccccgtctttcacagctcattattgcgacttcaccacggaccccctccttcgtcatcggagccatggaacttggagatcgtgggtcagaagcccctacaacgcccactttgtctcttggatagtaagctcgatacctctactactcctccaacccgcctcgttctcacccaatgg

SEQ ID NO: 96166 - DNA, 1056 bp, Glycine max
  Peptide Sequence Number=SeqID_212944
atgaccaccattcctctttctcctccttcctcttcaatactagcttcaccatcctctccgcggccccatatgaaactggacgtgccacgttttgatggacatgatcccattggttggatcttcaaagcttcgcagttctttgactaccaagggatcccagaccatgaacgccttacagtcccctctttttacatggagggcccgacgttgtgctggtaccaatggatgtcgaggaatggtttcctcacatcttggacaggcatgctcgaagctcttgagtcacgctttgccccagcatattacgatgatccttcaagcaccttgttcaaactacaacagcaaggctccgtcaatgattaccttacaaagttcaaacaccttgccaatagaatttttggccttgccccatcctttcttttaagttgtttcatctccggtttgaccctgggcttacgtcgcgaggatattgatcccttcgcatcaagtcccgatgccccttccttaccctcagacaacttcgaccctccagatccagaccccgaccctgacccagttcctcaaatcagcctgcatgctatggatggggacaccctacgcgttatggtcggtgatgactacatgttggattgcaccactacttcctggcaagtgacctcgtacatccaaggtcacacatttgtccctgacctcttccatttacccattagcgatgcagacattgtcttgggcgttcaatggttaaaacaattagggcccaccaccaaaaactataaggcgttggcgatgtcatttcctttcgtgtccgccaacaacacttatcgtgaatgttctttggacacaacattcatttcagcccaacaattaaatcgatgcactcaaacacaaagcctttctgccctttttgccctcaccgcatcactatcccggtacagtacgtcctcttccccgtcacacccccaccagacaccaacacctccccagataacctccatcatcatccaatgtccagaaatcttctatgaaccaacccacctaccaccctcttgcacaatctaa

SEQ ID NO: 96167 - DNA, 603 bp, Glycine max
  Peptide Sequence Number=SeqID_212945
atgaatgaacctagttgtgaacaagaattaattatgtgcatatgctccatgcagttagggggaccatcatggaaggtgagacttggcagaagagactctactacagcaagtcgtgaagcagcagatgcaagcattccagcaccatttttcagcttatctgaactcatcaccaacttcaagaaccatggtcttgatgagaaggaccttgttgttctttctggaggccacagcattggatttgcacgttgtgttacatttaaggaccatatctacaatgactccaacatcgatcccaactttgcacaacaacttagatacatttgccctacaaacggtggtgattccaacctttctcctttggactcaacagcggcaaaatttgacataaactattactctaatttggttcaaaagaaagggcttcttcactctgatcaagaactcttcaatggtggttctactgatgaactggtcaaagaatacagcgacgataccgaagatttctacgaggactttgcgaactcgatgattaagatgggaaatattcagcccctcaccgggaatcaaggtgaaattcgggttaactgcaggaatgtgaactaa

SEQ ID NO: 96168 - DNA, 519 bp, Glycine max
  Peptide Sequence Number=SeqID_212946
atggatggcagtggtgaccgagagagagatgtattcaaaatgcagagagttttgcggtgcggtgtgcatataatactcggaattgatttagtcgaaaaggatgtatcccatgcatctttgtcacaattgtcacctaattactatgattattcgtgccctaaagctttgagcaccatcaaaagtgttgtggaggcttctgtgcagaaagagcgtcgtatgggtgcttcattgctacgcttgcacttccatgattgttttgttaatggttgtgatggttccattcttctagactccacatcctccattgacagcgaaaagaatgcagctgctaatttgcaatctgctagaggatttgaagtggtggatgacataaagaaagctgtggacgaagcatgtggaaaaccagttgtttcttgcgcagacatattggctgttgcagctcgtgattcagtcgttgcggtgagtaataatactataatgttgcttcaaaattgtaatgctagaatatgttggaaataa

SEQ ID NO: 96169 - DNA, 731 bp, Glycine max
  Peptide Sequence Number=SeqID_212947
tgcctatgtttgtcttcttggatcaactctgggatactcttctaaaagacacccaatacacaacactgttggacaaggtccatcgaaatcctaccaaacatcctgacctcaaggagtttcactcttccccaattagaggacacataggtgtcactaagaatttccgccgcctgcagcaaaactttgattggccccgcatccttgaagatgttcccatttgggaagatgtttctttggacttcatcaccgggctaccaccgtctcacgactttaccattattctggttgtcatggaccaattttcaaaagaagcccatttcggggcactatcgccacacaataccgcttataagactgccttcttatttcttgacatatggaaccaagcttcggatgagcactgcctatcactcacagatggacaatcaaacagaggccatcccaatggtatcacttctaagattgaccccaagtttcatatctcactatcgaaactccatcacagaccgtcacccacatatcctaccgttcttcctccgactatcattaagaaccatccagtcattgagcctcttcatattttggattggaaatgggattcctcatcttgtccaccaactaagcttgttctagtccaatgggatggcttgtcacaagaggacagtacatgggagtcgttggatacactacgccccgtcttacaaccttggggacaaggttggtttggttga

SEQ ID NO: 96170 - DNA, 111 bp, Glycine max
  Peptide Sequence Number=SeqID_212948
atggacgataatggtggccgagagggagatgaattcaaaatgcagagagaattttgcggtgcagagcggtgcagagggagttttgccaaggaggaacctattgggaattaa

SEQ ID NO: 96171 - DNA, 1476 bp, Glycine max
  Peptide Sequence Number=SeqID_212949
atggtgtgtaacccgcaaacatatgtggaggatctctacaatttcgttgtgaattgcttgctaaagaaggcaatgggcctcccctattgcataagaattgctcccattgtggtgccggaagcatctgtctccagaatgaaagggaccaagaagtcaggagcagttaagaccgagaagggtagtgagaggttcgatgcctttgttggaaatgatatgacccaaatattccaatttgtgttgggcgaaaagacacttagagcacttaagaaagaatttaccctacagcaatatgctgtagacgagagtgttgctcaaaccaaaaggcatgatgtgatactcataatgcccatggaggctttgccaagatcgtccaataattcatcaattgtcagcattggaaaacggtctaggatggtttatgtggtggactatttgtcggggtggggaaaggtttgtgggtgtgaggaagatgagcgtaaatctagaaatcaaagcttggatttcaggtatagggcagagtgggtaggaagactagtttgggttgggcccaaaatcaacatcaacgctaagttccacaaaatggcccaggtggtgaaacttcatggaaagagtggtgtagtcggtaactacggagcccaattgcttcagccaatcaatgcccaacatgacgtcaacccaataggccaagaacttcaccacgcgaggctgtatgaagttgtaggtactaccactgtcaatgagtaccgtgaggcgagtttgttggaggaaatcgtagagacgaaaggtggtgtcgggtgggtcgacggggccatttcctctggtgtgtggcgaacgaaggtgtgggaaggattggggttggggttggggttggtgactggggaaaatgatgggttagtgtggtggctgggtggtggtttatacgtcctacggcggtccaatattttgccttcttgcaatttcactaaggctgtagtttggggaagcgaaatgggctgcagggcttggacctcgcagtggatctctggagagaggccggagatgaagcaactaaggaggaatgagggaggaagcccgattatgtgtatgtcggggcgaaccgtgtctccagagcctgaaggaatgccggccaggagagatcttaaagatccatcccagtgggtcgtggccgtcgaatcacaggacatcgagtttgatgggagggcgagggaggaatggggtgacgggttggtgttgggggcactgcagggggttgttaagcgcgtcctcgagtctatcggtggtggttttacacgtgccatggcaggtcggaccaagatgataggagcagaggggaaattagcaggaaaaggccttgaattcgaggataaggagcctcctactgcaaagcaaagtcatcttggttggtttcgtgtatgctggcttgttgattgctatcatcctctcacgatttcatggaggatattgttgttcaactga

SEQ ID NO: 96172 - DNA, 1593 bp, Glycine max
  Peptide Sequence Number=SeqID_212950
ttagggggaccatcatggaaggtgagacttggcagaagagactctactacagcaagtcgtgaagcagcagatgcaagcattccagcaccatttttcagcctatctgaactcatcaccaacttcaagaatcatggtcttgatgagaaggaccttgttgttctttctggaggccacagcattggatttgcacgttgtgttacatttaaggaccatatctacaatgactccaacatcgatccccactttgcacaacaacttaaatacatttgccctacaaacggtggtgactccaacctttctcctttggactcaacagcggcaaaatttgacataaattattactctaatttggttcaaaagaaagggcttcttcactctgatcaagaactcttcaatggtggttctactgatgaactggtcaaagagtacagcgatgataccgaagatttctacgaggactttgcgaactcgatgattaagatgggaaatattcagtccctcactgggaatcaagacaccacgaacgctaagtttgattctattctcgaacgtttagctgctacaaccatcgttcctttttctcctccttcctctccaatagcagcttcaccatcctcttcgtggccctatatgaaactgaacgtcccttgttttgatggatgcgatcccatcggtttgatcttcaaagcttcgcagttcttcaactaccaagggatcccagaccacgaactccttacggacgcctctttttacatggagggcatgctcaaagctcttgagtcgcgctttgcccctgcatattacgatgatccttccagcaccttgttcaaactacaacagcaaggcttcgtcaatgattaccttacggagttcgaacgccttgcctatagaattctagcccttcaaccctcttcgttgacacaagccgcagccctggccaagctccaggaaaccaaactccttggccaccatcaaaactattactccccaccatcacctcgttaccaagcacccccaaaccccaactctccttttctcaaaccaaacacaaccctagccccaaaaatccccttcgaacgtctcacctccggagaaatggctcttcggcgtgaccatggccgcttttatcattgtgatgacaaatggatacctgggcatcattgtaaacctcgattgcaccttctaattgccgatgaggatatcgaacccttcgcatcacgtcttgacgccccttccttaccctcggacaacttcgaccctctagatctagacctcgaccgttacccaattccacaaattagcttgcatgctatagatggcactgtaacgcctgacacctttcgccaatatgatctccctcaccagcatcacctcgttattctagtggacgagggtagtactcacaattttatccagtctcacgttactcactttctttactttcttgcgtctccttcagacaccctgcgtgttatggtcgatgacgactacatcttggactgcaccactagttcccagcaattgcccttgtcactgacctcttccaattgcccattagtggtgcagacattgtcttgggcgttcaatggttaa

SEQ ID NO: 96173 - DNA, 294 bp, Glycine max
  Peptide Sequence Number=SeqID_212951
atgatctttgatcgttatggctttcaaggccctgtaatcgacacagcagcgccaactgccgtctttctgcttgacaacattgagcatcgaggcaacttgtgtttcgatttcaattttttggaaatatgggtaacggtagggtttgacgttgactgggttggtgttaggggtgagatttctggaaattgggtgatgatggaggttatctggggaggtgttggtgtctggtgggggtgtgatggggaagaggagatattgggctgggatagtgatgtggtgagggcaaaagagtag

SEQ ID NO: 96174 - DNA, 222 bp, Glycine max
  Peptide Sequence Number=SeqID_212952
atggcgaggggttctaggattggattgttgttgatagcatgtggagggagcgcattggaattcaagtcgtcgtttcagtttctcatgaatcattgttctggtggtgagcttggagtcaacaacttcgttggtggaagtgccaagaacatactccagtatggacgatggcggtttgccgtagactatctcgtatggggtcattccggtgctggagtggattga

SEQ ID NO: 96175 - DNA, 1404 bp, Glycine max
  Peptide Sequence Number=SeqID_212953
atggtggattccgatatctataagacaggcttcaaaactcaccatggccactatgaattcaaggcttatgccgtgctcgttgctccacttacttcattgcttcgtaaggacaagttccaatggtttgacaaagcccaaacaaccttcgaaaagttgaaacggaagatgaaggaggcccctgttctggtttcaccggacttttctgccccttttactataaagacagacggctcatcacgagctataagcacagtccttcaacagaattctcacccaattgcttattgtagcaaaatgctttgctcgcatttgcatgttgcctcagcttattacaagtcaagatctcagaatatcgtggctgatgcattatcccgaattgcggcaccggatgaagcacaattttactccctatcagtgcctatgtttgtcttcttggatcaattccgggatactcttttaaaagacacccaatacacaacactattggatgaggttcgtcaaaatcccgccaaacatcctgaactcaaggagtttcactcttccccaattagaggacatatggcaaaatataacactaagaagccgacaggtctcctccagctcttgcctattcctttagtcatctgggaagatgttcagaccgagattcattgtttatcaacaaattttggaggagctttttcgcctcaatggaaccaagcttcggatgagcactgcctatcacccacaaacggacagtcaaacaaagaatggtcatataatacatccacccattctggaacaggcatctctccttacgaggaaatatacggcaaaccaccgccgtcaatcccacattacatcttgggtgatacaatcgaagttgtagattctttgctagcaacacgcaccgcgatcctcgttgttcaccaccgtcacctgctcaaagcccaaactaccatgaaaactatggcggatgctcatcgccaattcgccgtaggcgactgggtgtatgtgtgcttaagaccgtatcgccaaacatcaatagcgccagcttacacaaagttgaacaaaagattttacggtcctttcctggaacgcgtgggccatgtcgccactgagaaccatccagtcattgagcctcttcatattttggattggaaatgggattcctcatcttgtccaccaactaagcttgttctagtccaatgggatggcctggcacaagaggacactatacaggaaccattggatacactacgccagtcttacaaccttggggacaaggttggtttggttgaggggggtgatgatagcaattcagatatccaagaacaggaagactacaagagcaacaaggaattggacaatagcaagtccaaaaggaataccagaaaacccacacgcttcaatgactgtgtttga

SEQ ID NO: 96176 - DNA, 144 bp, Glycine max
  Peptide Sequence Number=SeqID_212954
atggcagaagggggtggtattaatagcaatcaacaaactagcatacatgaacccaaccaagatgactctgctgcaacaaaggcccaagaaggaaggcctaaaagaagcacaaatcgacctgcatatcttacagactacgaataa

SEQ ID NO: 96177 - DNA, 960 bp, Glycine max
  Peptide Sequence Number=SeqID_212955
atggcatcacgtgggtatttctttgttgttctccatgccttagtgtttgcatctattgcaacctcagctttctcacaattgtcacctaattactatgattattcgtgccccaaagctttgagcaccatcaaaagtgttgtggaggcttcagtactgaaagagcgtcgtatgggtgcttcattgctacgcttgcacttccatgattgctttgttaatggttgtgatggttcaattcttctagactccacatcctccattgacagcgaaaagaatgcagctgctaatttgcaatctgctagaggatttgaagtggtggatgacataaagaaagctgtggacgaagcatgtggaaaaccagttgtttcttgcgcagacatattggctgttgcagctcgtgattcagttgttgcgttaggtgggccatcatggaaggtgagacttggtagaagagattctactacagcaagtcgtgaagcagcagatgcaagcattccagcaccatttttcagcctatctgaactcatcaccaacttcaagaaccatggtcttgatgagaaggaccttgttgttctttctggaggccacagcattggatttgcacgttgtgttacatttaaggaccatatctacaatgactccaacatcgatcccaactttgcacaacaacttaaatacatttgccctacaaacggtggtgactccaacctttctcctttggactcaacagcggcaaaatttgacataaactattactctaatttggttcaaaagaaagggcttcttcactctgatcaagaactcttcaatggtggttctactgatgaactggtcaaagaatacagcgacgataccgaagatttctacgaggactttgcgaactcgatgattaagatgggaaatattcagcccctcactgggaatcaaggtgaaattcgggttaactgcaggaatgtgaactaa

SEQ ID NO: 96178 - DNA, 293 bp, Glycine max
  Peptide Sequence Number=SeqID_212956
atgcggttttaccttatggttatctacacctttcgtaaactaggggcaaacgagcccgtttacgcccggagactaaaatcgtcttctgcatcttttgtcgtcctgacccgtgaatcaggtgacatgcggggttaccttatggttatccacacctttggtcaaccaggggcaaacgagcctggttaccttatggttacccgcacctttggtcaaccaggggcaaacgagcccgatgacgcaaggagagtaacatcgtcttctgcaccttttgtcgtcctgactcgtgaagtcag

SEQ ID NO: 96179 - DNA, 183 bp, Glycine max
  Peptide Sequence Number=SeqID_212957
atggagaattggcgaacagcgctaagcaataactttgcggggctccagactccgctaggcaatgacattcatcgggctccgaaaaatagtggagaatggagaattggcgaacagcgctacgcaataacttcgcggggctccagactcgaaggtggaggacacatgaacagggctaggcaatga

SEQ ID NO: 96180 - DNA, 177 bp, Glycine max
  Peptide Sequence Number=SeqID_212958
atgggtgtcaagtacctcgaagcgctcaagcgaaggtcgcatcccaccaaacagatggtcccctggatgaaaataacaagcggaaatttaaaagccaacaagcccattgacacgcggagatttacgtcatctttccgcgtagacaatttctgtcatactgacactggagtcacgtga

SEQ ID NO: 96181 - DNA, 168 bp, Glycine max
  Peptide Sequence Number=SeqID_212959
atggtgagcaaagtttggagctttgatggaggcttcaatggtgaggaagaagaagggaatagcaacctatgccacatgtctccttttgagtggagcaaaaaggggcccactttttctcttgatgtgactcatactcagccacaagaagagaaaaatctaaccttttga

SEQ ID NO: 96182 - DNA, 195 bp, Glycine max
  Peptide Sequence Number=SeqID_212960
atgatggcacatctgtctgctaaagctggaggtggggctgaagtagaagatgtagagatgccagctattggtgcaaaggaagagggaacatcagctgctctgagcttggaggtaagagcatcagatccaactcccctcaatctacacaaggttgtgattaaagttgggaagcctaagcgagaagagttagactga

SEQ ID NO: 96183 - DNA, 720 bp, Glycine max
  Peptide Sequence Number=SeqID_212961
atggtcacttcaaactcatctactgttgaaatcattccttccaaagagataatgaccatccacactgacaatgagccttcaatacatgttgaaaattgttttggtattcaagaactcgagaagagaatctacctagaacttatcagaacgttctggataaatgctaagtttgccaacaagaaattcattgtacccaaggttctgggaaccaaggtggtactctcaagcgactcaattgctaaggcaactgggtgccttcatgaaggaagcgcctatcaagatagatgggagaagaactatgactctcatgttgtaagggcactttacaaggagaatgctgacaaagatcaaggcgtatatcacgtctttgataagatggacgatgattctaagcacacccttatagccaagagttcagttgttgctaaacaacaaaaaattagcatgactaacctaaaatctatgaatgttgctttagaacaaaacttaaaggaagctcctcaagtggacctagacgccataaatacgatgaagcagaagaggcttgccaaggctatcaccttcgaagacagaggtcacaacagctttggcattgccaagaaaatacagaagattatgcttgagcaagagaaaaagaagaagaaagaaacaatctctgagagaggaggaggaagaagaagagattattgcaagggagcacaagacaaagaagaaacatga

SEQ ID NO: 96184 - DNA, 726 bp, Glycine max
  Peptide Sequence Number=SeqID_212962
atggacatgtccaatgcagtcgcaagtcataaagatgcaaccacattgtcttgtacctggcacccaacgagttcatttgtccaccaaggttacaccaacaatagcatggagaaaccttcagagaaaaataggagggacccttggcaagaaatggaaccacccaagagtgaattccaaaagaaggtgaatcttcagatgtcatttacaaaacttttactcatgcatccaatagatctcaacttgtctcatgaagactactcctctcttggaaacctccatgcacaagatgatgctaaaaagaaaaaggttcaagttatactacacggaagagatgccctcaagaagcttgttcgtgttctagatgcttatgatacgagaatcttttggaatcagatcgtgtggacatacactttgaagacttccacctctagttatgatggaagcaacaatgttgttcaccacaacattatccaagaaaaaatgcctctatccaagcttaagcatctgccaaagtttgtggatgataccattatacatgggatctttactgatcttactaacctagtatcatggacaaaactccatagaatgaagcttaagcaacaaaaagaggaaaagatgcctatgctaagagctattccatcaccaccatccattgctccaacacctttgtccccaccatcttcaccttcacctactcaaccaccaccgccactgccagcttaa

SEQ ID NO: 96185 - DNA, 828 bp, Glycine max
  Peptide Sequence Number=SeqID_212963
atgggatctcaaggtaatgggcaacagtctcatttacagccttcatctttgtccaggcaaggttcatggtatagtctcactcttgatgaggtcaattgtcaattaggagacatggggaagccattgggtagcatgaaccttgatgagcttcttcaaaatgtgtggactgctgaagcaagcaagtctttggtgataggcgcggagagtgagaacatgtcgtcgtcttcctcgcttcaacggcaggccagcctgacgctggctcgcgcattgagtgggaagacggtggatgatgtgtggagggaaattcagcaaggtcagaagaaaaggtatggagaggatgtgaaaagtcaggagggagaaatgactcttggtgagaccaccttagaggatttcttggtgcaagcagggctttttgctgaggcttctatcagtccagctgtggggttggatacaatggattcctccgctgcacaaggtttccaacagaaaacaggcctgttgtcctccccttcaattggcagtttatcggacacaagaccgggccggaaaagggatgctcccgatgcgtatgagaaaacattagaaaggaggctgaggagaaaaatcaagaatagggaatctgctgctcgatctcgagcccgaaaacaggcttaccacaatgaactggttagcaaggtttcccgtctagaagaagaaaatgtaaagctcaagaaagagaaggtgtttgtattaccttttattagaaatttattgtgcgttatttgtggtttgtatgccattgatttctctttcttgatcaaaaagtttaggatgtgttctgtggattga

SEQ ID NO: 96186 - DNA, 150 bp, Glycine max
  Peptide Sequence Number=SeqID_212964
atgctaacaacgcctaccttacctagtttcagcctttttgatatggagcatactctcctactagagcaaatgcaaagcagtagcaacagcaatgagcaatgcaatgatgcaatcctggacatgtccccatcaaatcaagaacacgaatga

SEQ ID NO: 96187 - DNA, 795 bp, Glycine max
  Peptide Sequence Number=SeqID_212965
atgattaaaagaggcaaagcaatacttcctccaccccccccccccccccccccctccattttggtgaatttccaacaatggcttgatcatgcacttctcatgcagtctactggtgcatataaggcagcatctcgtttggcaattgccactccacctcctgcttatgtgttgagtcgaggcatcggttggcagggaattggtatcttacttgacggtctctatggaacagggacgggttcgactgtttctgtggaaaatgcgggactccttggcctaacccgagttggaagtcgccgagttgttcaaatttctgctggttttatgatattcttctctactttaggaaagtttggagctgtgtttgcatccatacccttcccaatatttgctgcattgtactgtgttctctttggccttgttgctgcagttggcatatcatttcttcagttcacaaacatgaactctatgagaaaccttattatcacagggctcacactgttccttggaatatctgttcctcaatttttcagtcaatattggaccagttcacatcatggtcctgttcatactaatgctggatggttcaatgctttcttgaacaccatattctcatcgccggcaacagtaggtttgattgtggcagtgttccttgacaacactctggaggtcgaaaggtcaaaaaaagaccgagggatgccatggtgggtgaagtttagaacatttagaggagataacagaaatgaagaattctatactttgccgttcaatctcaacaggttcttcccacctacttga

SEQ ID NO: 96188 - DNA, 645 bp, Glycine max
  Peptide Sequence Number=SeqID_212966
atgcgagctatacaaggagctctaatcgtagcctcaagcattcagatagtcctgggttacagccaagtatggggtctcttctcaagatttttcagtcctcttggcatggcacctgtagttggattggttggattagggttaattcaacaaggatttcctgcgttggggaactgtgtagaaattggcataccaatgctgttgttggttgttgggttgtcacaatatctaaagcatgtgagaccgtttagagacactcctatctttgaacgtttcccagttttgatttgtgtcacaatcgtttggatatactctgtcattttgactgccagtggagcttatcggcatagacccaccataacacagaacagttgtcgcacagacagagctaatctaatatctactgccccatggttcatgttcccataccctctccaatggggtccaccaacattttctgctggtcattcatttgcaatgatgtctgcagttattgtatcaatggtggaggtatctgttgttcccttcccacttctcactagtctagcaagacaactgttattggggttttgttctggctcaacttcagaactttattatattcacctgtatattatttttagactaaattacactagccacccctga

SEQ ID NO: 96189 - DNA, 129 bp, Glycine max
  Peptide Sequence Number=SeqID_212967
atggctgacattactcatccacctatggaacagcttcaggaccttgagtactgcatagactcgaatcctccatgggttcttctggttcttggtgctggtatgctatcagttctctgtctaaagaactga

SEQ ID NO: 96190 - DNA, 489 bp, Glycine max
  Peptide Sequence Number=SeqID_212968
atgcctagtagtgtggtgaggagggttgtgtccatgcaaaggaactttttgttgggtggtgaagagggaaaaaagaaagtggcttggctatcatgggaaaatgggtgtaaaccaaagagtttgggtgggttggacattaaaaatattggtttgtttaactttgctcttctagcaaagtggaggtgggagttttgtagggaaggagatggattatggaagagggttttaatatcaaatatgatggtcagagggggcttgggggcattggaggggataagaagtcttcaatccatttggtggagggatttagttaaggtgtgtggaggcagcaaaatgataccaagtggtttgacaaattgtagaatggaaggtgggaggtgggggttccataaggaggaggtggatgtgtggctttggaagagtggtacgtgttgggactatataacgaaagggcgggatacacatgtctacttggatccatgttggtga

SEQ ID NO: 96191 - DNA, 408 bp, Glycine max
  Peptide Sequence Number=SeqID_212969
atggagaaggagaagggaacacaagggctggaactatcaagctatcaataccgaaaacagggactgaaatgtgcccagaaggagactacaaagctgttaaaactgggactggccgacgaagtgactggaggtggggtgggtcgcgcacctcgaggcgcacacaaccctggtttcgccggaaaatttgacgacggcagacagcggccggaggtggcagcggcggcggcggacagcggacggaggacgacggctggcggccagagcaggctcgttgccaagggcttttaccaacagctaggatatgactacaatgaaaccttttcccctgccattagacctgtcacaatcaggctgagtcctccaacaaacagcttgtgtgaagacttcacaaagccattaatggcttaa

SEQ ID NO: 96192 - DNA, 435 bp, Glycine max
  Peptide Sequence Number=SeqID_212970
atgcatcagttgaaatatgggagggagaaagaaaatttgaggaaatgtttctcaactgggacaaggaaaaatgaagaaatgagctctctatatataggaatagctccttcaaggggtgcttgcgcagggttactatgtatttgggataccttaaagttccaagtacataggcactttgtaggagatagattcattttgttggaaggaacttggctagagaatggtgtaatagttgctaatgcttatttactgtgcaaattgcggaacaaaaagaaactatgggatgaacttagaggtagaagagccttgttgggagttggtgtttggttggagactttaattgcgttagaagggtggaggaaagtgttggaaatgatgatggcgttaacgttggtggcttgggggaaaagtttaacaatttcattgagcatatga

SEQ ID NO: 96193 - DNA, 204 bp, Glycine max
  Peptide Sequence Number=SeqID_212971
atggataaatctgaaaggttgacatatggaggtgatgagaggaaaatggtagacaaaattaataaaatggagcatagagacaccgttgagataaaggagattcaggagaggtttttctggaggggatgcagaagttgggttatgaagattctctcatataaacgtgaaaggattggggggaggagtaaaaggaaaatttgttag

SEQ ID NO: 96194 - DNA, 978 bp, Glycine max
  Peptide Sequence Number=SeqID_212972
atggcatcgcgtgtgtatttgtctgttcttctccatgcctttgtgtctacagctcttgcaacgtttattcatgccacaattttctcaccactgtcacctaattactatgaattttcgtgccctaatgctttgactgccatccaaattatagtagaagctgcggtgcagaaagagcctcgtatgggggcttctttactacgcttgcacttccatgattgctttgttaacggttgtgatggttcaattctactagactcttcacccaccattgacagcgaaaaagatgcacttcctaatattaattctgttagaggatttgaagtggtggatgatataaagaaggctgtggacgaagcatgtggacaaccaattgtttcttgcgctgacatattggcggttgcagctcgtgactccgtggttacattaggtgggccaacatgggaagttcaattggggagaagagattccaccacagcaagcaaagaagcagcaaatgcaaaccttccagcaccaagtttcgacctctctgaactcatcaacaacttcaacaaccatagtcttgatgtgaaggacctagttgttctttcaggggcccacaccattggattttcattttgtaaattttttaaggaccgtgtctacaatgacaccaacattaaccccatctatgcacaacaacttagaaacatttgccctatagatggtagtggtgacttcaaccttggtcctttggaccaaacctcaccacttttatttaacctacaatatttctctgatttgttccaatacaaaggacttcttcactctgatcaagaactcttcaacgggggttgtactgatgcaatggttgaacgttacagctatgattacatagctttcttccaggactttgccaattcgatgattaagatgggaaatattcagcccctcactgggactcaaggagaaattcgtgttaactgcagggtagtgaactag

SEQ ID NO: 96195 - DNA, 261 bp, Glycine max
  Peptide Sequence Number=SeqID_212973
atgccacataacattttcatatgtctcaattctcatatctcaacccctaagtttcgactttcaattattattaagaaggcatccaaagcacaaaatgctaaagctaaccctggtattggtctaacccctgagttgagaaagacatcttcttttgacaagacacaggaacataccgtggcaaaatctgtagcttatgaatttgttgcaccagatgaagcatccaacaataaaccaaaagattccaaaggtgctattgtttga

SEQ ID NO: 96196 - DNA, 1413 bp, Glycine max
  Peptide Sequence Number=SeqID_212974
atgggttggatagaagcaatttacacgcttttaaccaaatcattcaccgtcctttcctggcctccagtcagttttctttgtccattgtttgtttctgttcgggtaatgaagagtgattcccggtccagcaaccagcgatgtctcgctttttgggttttgtattccttgtgtatgatcatggaaggggaactttcagtgctatttaactgcctcccatggtggcctcatgtgaaatccatagcaactatcttgctgttgataccttatgttggtgcagcaccatatgtctataaattcttaattagacactactttacttggagcctatttacaaggacatcaaacatcttcagtgagaagagcacacatttggaatcagatgaggatagtaaacttgttgatgtctctgaccagatgacaagtcaaatacaagaaaagaaacttgaagcatatcaagtattggtttcaagtttataccgcagtattttcatgcctttacagcaaattactgacaacttcagtgagaagagcagaaatttggaatcagatgaggatagtaaactttttaacgtctctgaccagacaataacgacaagtcaaatagaagaaaagaaacttgaagcatatcaggagacagatgatatcgctggttgtgacaagacagaaagcagttacacaaggctaactattaaaaatctagtccagaaggaatggagttgtgcattatgtcagattagtacaaccagtgaaaattgcttaagggcacatcttaaagggaggaaacacaaggataaggaaaatgagcttagagttgagttttcctctactcagaaaagaatcaaagggatggttctactaaggaatctcaaccaaattgcaagcattctcaatccagtttccagatccataagatggtgtgaatggacaaagccagagtttggatggacaaaattaaatactgatggttctattcatagtaacactgttagttttggtgggctgcttcgagattacaggggtgaaccaatatgtgcttttgtctccaaagctcctcaaggagatgttttcttggctgagctgtgggccatatggagaggccttgttctttccttgggtcttgggattaaagcaatatgggtggaatcagactccatgagtgttgtgaggacggttaatagaaagcaactttgtccaaaagctgttggctatttgaaccagatatggaaactgttaaagaagtttgataaatatcaaatttctcactcgtggcgcgaaactaatagggcagcagatcatcttgctaagatggatcttttggcaaatgatgtggttttgtcgccagttgattttccacctagcctttccagaatcattgaagatgatgccaaaggaacgaaatatcgtagacgatga

SEQ ID NO: 96197 - DNA, 666 bp, Glycine max
  Peptide Sequence Number=SeqID_212975
atggccgccaaacacgacatcatccttgaccggctatccgctctcatacccactccattttctcccaactcattcccaacaggcgcaccaccacctgtggagaccttaacaatagagccactgaatacagaaattgacctctcgatttctctccctctcgttcctgtgacggccaaaggatcgttcgtagtcacggtctccctctttgtctctgttggactccttcttggacctgccgttcttgtcatcgtttgcgtcgtcatccctcaacctcctgctctgcccatcatcgacgtcaacgtccgtcgccacacccgccaccatgcaccactgcctccaccatcatctccgccacctgtttttaacgctttccttggttgctccgcagcgcggatcacaaacaccatcctctccttggcagtttcgtgccatgggtcacacacactacctgctcatttaaacattatcattgttaggcccaaaccagcccacaaacaaacaccgaaggacccaattgttagtgtgaacgaggcatttctagctgacccttttccccacaagatcaatctaggaataggaacttacaggggtgatgatggcaaacctttcgttcctcaaagcgtacgtgatgcagagacgaagattcagagatgtaaattggagtga

SEQ ID NO: 96198 - DNA, 148 bp, Glycine max
  Peptide Sequence Number=SeqID_212976
atggctaaagcatttatgaaatcgtcacagcaaatttttatatataatgatttgtaccgatcactagaactatctgatggttgtgtaaagctatcatcgaattacgtgtctatggactggaaattgtggaatttagttggtgcaacag

SEQ ID NO: 96199 - DNA, 774 bp, Glycine max
  Peptide Sequence Number=SeqID_212977
atgggattttacatcggctttttgccaaatttcaaaggcatttctatcctgattctcaaatgtatctaccagatccaacctggtccaagtagtcaccacaatatatggagacaagctgaaattccagtcaaaaccttccactactatcatccagatacaaagggtttagattttgctgcactcctaaatgatgtcaagaatagacaatatgctttgtctttcattggatgcttcttgtcttgtctctcagacaaatctaatacgctatattatcatgaatgcaccagattgttcttcttgcttcatccttgtgcacacaatccaactggtgttgatccttctgaggaaaaatggagagaaatatcactccagttcaaggccaaaaatcattttcccttctttgacatggcttatcaaggattttcaagtggggatcttgacaaggatgtcatagcacttcgaattttccttgaagatggacatttgataggttgtgctcaatcatttgctaagaacatgggattatctgaacataaagctggttgtcttagttaccaaatgcttgaagaatcatattatatcatgagcacacagttttacactttgatgcatattcaaatgcaggttaaacagctggagaagctgttccatatatacatgacccctgatggaagaatgagcatgtccggtgtgacctctagcaatgtggattacttggcaaatgcaatacatcaggtgaccagaatcgatgaagaagccctaagatcatgttaa

SEQ ID NO: 96200 - DNA, 360 bp, Glycine max
  Peptide Sequence Number=SeqID_212978
atggtgaattgcagtcatcctccacaagagtcaaagaggaaggagtttcttgaaagtttggagggcggcaaggagtcgcagcgacgaagatctgaatttaaaatttctccatccaaacacacatataaatctataatatttaccttacaacaacgatgggtttcgacaattagtagtgtctctgatgaggacaacaaacataatgccgaagacatcttgagaatggtggcggtggaggaagttccatcagaggcagtgaggtcgtcgacatcaacaaggggttcctccaacgatggtgcacaacaagagaagcacacacaaggattagagaagatgagatctgttggaatatggatctga

SEQ ID NO: 96201 - DNA, 294 bp, Glycine max
  Peptide Sequence Number=SeqID_212979
atgatccatctccacaaaacttgcaaccttcgtgattataagcgactcgctaacaagtttggttgtggaggtctagttgaggagcctatggctgtcgtggagagtacaactggcaaccaagaaagcgttgagaattgtgaagccatcgaagtcgttggtggtgtcttgtgttgttctaccaatgaaggtggggaccttgccatcaaaggaggatatcatcgaggtttcgatggaggggagaggaacaagcttgttgttgttgttcaaatccctaatgtgttttttatttggtga

SEQ ID NO: 96202 - DNA, 234 bp, Glycine max
  Peptide Sequence Number=SeqID_212980
actaggccacgaagctgacttgaagttatcaactgtgtttcagagctattatcatatccttgttgacacatgggcaaatgatgaaaatgtgcggaaggcccttcatgtaagagagggaactaaagaggaattcctgagatgcaacagaaccatggcatacaccacaactcggctaaacacagtagaattttatcggaatctcactaatgccaatctcgaagctctcgtttactg

SEQ ID NO: 96203 - DNA, 411 bp, Glycine max
  Peptide Sequence Number=SeqID_212981
atgcagtggtttattgatcatccaaagtttagctcaaatcctttttacattggtggtggctcatattcaggaatgatcactggtcctcttgttcaacaaggttatgtactcgcgagcccagctgttgacgggtttcgagagcagaacatgaaagttttatatgcataccaaaggagtcttataccagaagcgctctacaagtcaatgaaagaaaattgtaacggggattatataaacattgatccagaaaacacaaagtgtgtctcagattatagtgtttatgttgagcttgttcgttacataaacgaacaacaaattatggaacctctttgtattactacgcctggcgtgaatcgagaaatcctacaagaagttcaagatcctccaacattttggtgtagagttgagtaa

SEQ ID NO: 96204 - DNA, 297 bp, Glycine max
  Peptide Sequence Number=SeqID_212982
atgaaaaatgagcttgtgtttccgcaacaccaccgaacgaatgctgacttgcagaagtatcagtgtgatgaccctgaaaaggatactgatacatctgtgtcggatactgagcaaatgtttgtggcgtgtaatacattccatggccacgctccgccatttgttgggaatattcttccgcttcaacagcctcccttcgtctgtctataccctgagtttcaacacttgactgaagcatgtgaaactattgtgcgggaaattgacgctctgatgcaggaccatgtgacactggctcaatga

SEQ ID NO: 96205 - DNA, 2013 bp, Glycine max
  Peptide Sequence Number=SeqID_212983
atggtgcagaggaaggaagagaccaagagaaggatagtgaaacctgtgattacgtgtagcagggggacccaggtcgaatacttgggacacatagtctcccagcgcggagttgaacctatagcttcgaagatatctgtgattcagcaatggccgacaccgagaaccaccaaagctttgcgcaatttcctcggccacgcagggttctatcgtagatttatccggggatacgctacaattgtggcacctctagtaaaggccacaatgagtgaacctcttcagtggtcctcatcagctcagattgcttttgactgtcttaaggaagctctgtccacggcgccggtcctggccttgccagacttcaccaaaccttttacactggagacggacgcctccggcgtcggtatgggcgctgtgctctctcaacagggccatcccttggctttctttagtaagccatttacgcagaaactcttgcgttcttcgacgtacgtccaggaactctgtgcaattaccacggcggtgaggaagtggcgtcaatacttactcggacaccacttcacgattatcacagaccaccgcagtctcaaggaattgtttggtcaatatcgttctggcacgtgtaatcaagccgcggattccttgtcacgcttaccagatcacaacgcttccctgacgatgcttctctctgtcccttgcttatcattcctcaaggagttacgaacccagctaagtgctaatgatgactacaataaccttcgccagaatattctcctgcaccctcataattattcagattactctgtcatgcaggaccttgttctttataagtctcgtatatggcttccccgggaattgccactcattcagacccttcttcaggaattccactctacccccacaggtggtcacgccgacgttacgaaaaccatagcacgtcttctggaaaatttttattggcccaagctccgagaagatgtggtgtgttttgtagctcattgtcaggattttcaaatcacgaaatatgagtccaagaagactgcagggctcgtatgccctctacccacaccatatcgaccatgggacgacttgtccatggattttattgtcggccttccggtgtacaaagggaacaccgtaattcttgttatcgtagacagattctcgaagggcattcatttggggatgttacccaccgcgcacaccgctcacatggtagctacactctttatgaacatcgtggttaagcttcacggtttccctcggagtatagtttctgatcgggatccgttgttcataagccacttttggagagaccttttccgtctaagtgggacgttattacgactaagctcagcctaccatcctcagagtgatggtcagaccgaggttcttaatcgtgttattaaacaatacctgagagcctttgtacacgagaggcaaggagcttgggggaaatacctttcttgggtcgaatggtctcacaattcagcttggtctgctatcacgggttcaaccccttacgagatcatgtatggtcgaaagcccttcacctttcccgaataccttgcgggcacttctaaaaatgatgtcgtggatgagttattagtggacagggagacaaaatttcactccattcgaaagaagcttctcaaagctcaagaaactatgaagaggtatgctgatgctaagcgcagggatgtagtctaccaacccaatgattggctccaccctacccctgcaattcaaagaaggactctcggatcctcccccatagcttgggaagtcctcgttcagtgggaaggcttatcacctgacgaggcatcgtgggagaactggcatcaactgtgtcacgattaccaccttgaggacaaggtggattttcaaggggccaaggatgttacgcatgaactaaggatgccatacacacaggaaacaccaacatccatggtgcagaggaatgaagagaccaagagaaggatagtgaaacctgcttacctggctgattacgtgtag

SEQ ID NO: 96206 - DNA, 483 bp, Glycine max
  Peptide Sequence Number=SeqID_212984
atgggcctcaccccgtttgaggttatgttgggcaagccacctcctcgttttcctccttatagctcgggagacattccagtgaaggtcgtggactctatcttgtccactcgcaagccaatgtatgcattgttacaaaaacgccttgctaaggctcaggctgacatgaagtggtacactgatgctaggtgtcgtaacctatccttcatgagacaatcctcccttgttggatcttacagcaagctagccaaacgcttctttggcccgttccagatcacagaacgcattggcgctgtggcttatcgtttgttgcttcctctttcctctaaaatccatgacgtgttccatgtctctctattgaaggggcattatggtccttctccttctctttctgtcgacctgcctccgtcgtcagttgaccatcatcccttggtcaagcctttggccatcctggtgtccaaggttgatacatccactacccactaa

SEQ ID NO: 96207 - DNA, 372 bp, Glycine max
  Peptide Sequence Number=SeqID_212985
atgcatcaccatcgtcgccactaccactactatgattgccgccatgaccatggtcatcgccaccaacataactattgctgctatcaccaccaactcgatgcctttggcgatcctgaagttgtaattggtgccctttgcaaccctacctttggtgtccttgaagttgtaatttgtgtctttagtggccctgatgcagaaattggtgtctttggtggccccgaagttgtaattggtacccttggcgacccttcctttggccttgaagttgtaactgatgcctttggtggtcctgtctttggaggccctcaagtggaaattggtgcctttggtatccccgaagttgtagttggtgtccttaacagtcttcgatga

SEQ ID NO: 96208 - DNA, 486 bp, Glycine max
  Peptide Sequence Number=SeqID_212986
atgtgcttgacagttaagaattccttcaccgaggctaatgagttcgtgcctccatctgagctatccttgttcaaccttgatgacattggatgtttagtccactgtccatatctgttttttgctcgggcgactgaggtgccaagaaatctcagccattgtgcaatatccaaacacaacgattgtgaagacgtgtttctagaaatggagcaaaaaggaggtgtgcttatgcaacgatatgaactggggagattattaggccaaggaacctttgcaaaagtctaccatgctaggaacatcataactggcatgagtgtggccattaagattactgacaaggacaagattctgaaagttgggatgagtgatgaggctaatcaggcatccacatgtggtggtgagctcttcaacaaggtatccaaaggaaagctcaagcaggatgatgctaggagatattttcagcaattgatcagcgctgttgactactaa

SEQ ID NO: 96209 - DNA, 366 bp, Glycine max
  Peptide Sequence Number=SeqID_212987
atggcttggtgcagcggtaaagttatgtcttggcgacttgttggtcatgaatttgaatccggaaacagcctctttgcatatgcaaggcttgatcgtgcccaccattaccttaccttgtgccctccatctcgtgccctctctctcgtgccatccctggtgcccaccattaaggtttttgcttctttctgttacctagcctccgccattgtgcccttcttcgtttcctccactgtgccttccggtaacatctccgttctaagctgtggatccaagtttggtgaggagttccttatgtttgatgatctctcatttgggttggtttttatggattcgttcttgctatttagagttgacctcgaactttag

SEQ ID NO: 96210 - DNA, 321 bp, Glycine max
  Peptide Sequence Number=SeqID_212988
atgcatttaaaattccaccaacatgcccatgataagtcttgtataggaaaaggtcatggtttaacctggtacctagacagtggccgctcaagacatatgacgggggaaaagtccatgctcctcaacctaaagccaattgaaggaggaataacttcctttggaggcatgggcaaagggaagatcattggtatagcaaatgtgttatttcattctaaggtacttaggatgatgcttagaaaggttcagagaactgttgtcaaagttaagaactcagaagatcttttgaagcccatcagaatgatgaagtctaattccttttga

SEQ ID NO: 96211 - DNA, 441 bp, Glycine max
  Peptide Sequence Number=SeqID_212989
atggcaaagctcagagattcgtgggagatcgaggcgacggttgccattaaaacgtgccatcgtgttgccattccagggaaactgttagaagaaggaaaaaatgtcaacttctcatcttccttcgatctcgaatcgaagcagacattttttgggggcaatttgttagcccatatttttgatgagctaaaaatatgctctaagttcgagtttggtcagaacctgttcgaatcgaaaagagagaagagtcgtttgaaagggattcccaggttcaaggaagtatttgcgaagtacaaggctaggacaagaaagagggcttcgaatcattgggcgattcgaactggtgtatactctagtcgaagtcgaggcagccagatttctggacttagcgcaatttctgacaaaacttcacaaaatcagttcgacttcgagcaatgtggataa

SEQ ID NO: 96212 - DNA, 183 bp, Glycine max
  Peptide Sequence Number=SeqID_212990
atgtcttcagtcatttacgctagccaatctggaaatgtcaagacaagagaggaaagcgtgaaaggaggagacttgtctagcgagacggtgatcgaaaagaaaagggatggtggtggcggtgtgagcgatgacgatgctagtcaatctgaaaatggtggtagagagaaacaagattttgaataa

SEQ ID NO: 96213 - DNA, 309 bp, Glycine max
  Peptide Sequence Number=SeqID_212991
atgatgcatgatgatacatatattataccaaatccacctgtgttgcccattcactcagcatctattccacaaccaccttcacttgtagttgttgatgcagacatgcctcgacatgcagtggccacttgccaaaagatagccgaaattttggaacacatgatcaacataaggatggtcactggtggaattgatgcatacactctgattgagcactatctaagattagccaagggtgttactgagcaaggaaatgtttatgttcgatctagacaaaggagggatacacatgacaaagatggtgatgaatga

SEQ ID NO: 96214 - DNA, 951 bp, Glycine max
  Peptide Sequence Number=SeqID_212992
atggttgcaaaacttaataatagacagctcattgaagcctcggtgtacgatgctatgttggatgcagccaagcatggaattgttgagttcatagaggctatgagggaggctaaccatgagctcttatgggccttggacagccataagagaggcgtattttcatatgcggttcttaatcgcaaacaagacgtgttccaactcatacatactgtcaatggaaggagggatataatcaaatctcgtaaagacaggtttggaaataaccttttgcatctagcaggacatttagggccttcctctgagcttagtcaaacgcccggggctgctctgcaaatgcaaagagaatataaatggtttgaggcggtggagaaaattgtgcatcccaagtgtagggaagaaaaaaatggtgatgataagaagcctcatgagctatttactgaaacgcacaaggagcttgtgatagatggagagaaatgggcaaaacagtcagctaagtcattttcaattgtgggtactctgatgactactatcttgttcgctgcggccttcacaatcccaggtggaaacgatgaaaaaactggagtgcccattttctcaaacaacatggcatttactgtgtttatcatagcagattcaatatctgtcttcacttctgccacttcagtgatgatattcatttggatcctcacatcgcgtttcgctgaaagagactttcggctatggttgccgttgaagttacttttaggccttgtcttccttctcttctctgtggtatccatgatggttgccttttgtgctgcacttgctataatactcaaggcatatagggcatacaggtacctcattataggagctgcaatatgtgggagcatgccaattacggtactcgtaatatcacaggtcaatctcatacgtgacattttaaaatctacaataagtcccatcggttga

SEQ ID NO: 96215 - DNA, 1272 bp, Glycine max
  Peptide Sequence Number=SeqID_212993
atgatcacgatttgtcctagcggtgttgtccatgctcttcaactctcaaaagccctcaaggagaagtctagtggtaacgtccttatgggtaacgatgcttcttgtaagttagtcaatgtgggttctgtacaaattaggatgcatgatggtgttcaagcaaggctaacttggaaatcacaaggtggaaccactttagtctatgagaagcggcatcagacgaagttcccaaaggttgtgcacacaacaaaggtcattttggactacatccattatgactattgggggccttcgagagttccatcactaggaggggcaaggtatttcctctccatcatcgatgattactctaggatgacatgggcagccagcacaacatgctatctcatgaatcactcaccatccaatgccataggcttcaaaacccctattaaggtatggcctaacaaaccaactaaatactcaatgttgaaggtgtttggatctttggcatactatcacgtaagtgaagctggagagtggatgagggctatgaatgaagatggaatccctcagaagaaccaaacttgggatttagttgagctacctaaaggcagacaagtaatggggtgcaagtggcacttcaagaagaaaattggatcatccattgaagaagtcatcagttataaatcatgtctggtagctaagagctacatgagaactctagacatggagttagagcaactcgatgtcaaaactgtgcttctccatggaagactagaggaagatattttgatgcaacaacttgaaggttttaaggtggaggatggttcccacatctatttactactaaatgtggaagacatgctcataacatctcaaaatttgttggcaattcaaaagctgaagtcactactcagtaatgaatttgagatgaaagacattggtgctgctaaaaagatttggggcatggagatcaagagggatcgagtccaaaagaagttttttctatgtcagaaggaatacattcagaaagaatacacgtcttgtgttccttatgcaagtgttgtaagtagtctcttgtatgctatggtatgcaccaaaacggacctagcacaagtagccagtgttgtgaataggtaccttaagggtacaactaatattgaacttgtttaccatagagacacgttttttgctcttgttggttactcggattctgactatgctacaaatttgggcgtaaagagatctatgactaggtacgcattcatgattagcaactctcttatcagttga

SEQ ID NO: 96216 - DNA, 237 bp, Glycine max
  Peptide Sequence Number=SeqID_212994
atggctgttgagaaaattgtgcatccaaagttgaaggaagacaaaaatgcagctggtaagaagccccgtgagatattcagtgaaagccatgaggagatagtgaaagctggtgagaaatgggcaaaagacacagctagttcttttactcttgtttatcatagcagatgcattatctctctttacatcttccacttcagtcatgatctttattgggatcctcacgtcacgttatgctga

SEQ ID NO: 96217 - DNA, 525 bp, Glycine max
  Peptide Sequence Number=SeqID_212995
atggaaccaataattgaattgaaggttgtagcaagagtgatgatagattgggaagcacataatatccccaaaccaaaaaagaatgcaaaagagagtgtgctatgggcggctgaaattgagggtttctgtgtttgtttctatgaaaggtgtattgccattttgaactcatcatcactttccaatttcatagcagatcaccatgagagcgctagtgatgatgtcgacaccggagtccctgacatctttggtgaagaaagggtttgtgagaacatagacctcgcgcacttgacgaaaaggcagtggaagtggaggagggagtggatggcaatagtggtgagcatgaggatcgggcatgctaggggggctatgaagaggttccatcattcagtagtgaaggaaattgagagaaataagagaaaggaagaagaaagaagaggaactgaagccgaggcgctgccgaatcgcgactgtgatcaatctctacatcgttctttgttcggtgttcttcatgcgaccgtcggctag

SEQ ID NO: 96218 - DNA, 321 bp, Glycine max
  Peptide Sequence Number=SeqID_212996
atgatgcataccatcggggatggaggcgaatgtgacatgtggtcacgaagatggcgtgggtcatgtgggatgtctgaccatattatttactttgtgagagtgttgtctcgtaaccacattgatccatgggacaatcctggtgggggtgttgttggggaatccatcctcagagcaaggatgaccatagagttgatggaagctcacccatacaaccaacatttttcagatggaaccggtgatgtggttcaacggaaaggctacaacaatgccaatgatgaggatgtacgagaaggaccttctgaggaggcctctcagtcttag

SEQ ID NO: 96219 - DNA, 771 bp, Glycine max
  Peptide Sequence Number=SeqID_212997
atgcaaggcttcaagacagcacagccaagttcacaacaactctattgtcactcttccttcttgcttaggggaaatgaccccaaccaaaacccagcgcggttctctgatcttggggagcatcaccatttctctgctgtttttcatcaagaagatgctgctgatttaagttcaagttctatgtttagtgtgaagtcaagcaatgttgttgggggcagtaacatgcagtatgggacgctgaacacggtggtttttcttcctcttactttctgccttcgttgttgtaggaagatgaatgttgggcatgcagagattggttcaagtgggggagggtgcatggatacaagacagcaactgatgtaccacaaaggagtgactatggcagccttgcctttggggaatggtcaagttgagaattgggctgattcaggcaaagcagataatagccaacagactgatgatacatccacagatattgatactgatgatataatcccatgcaatagagttaagaatgggacacgaatggttgttcactccaaggatgagacaaaggtcaaacctggagatcaaaagacccttcgtagactggctcagaatcgggaggctgcaaggaaaagtcgattaaggaaaaaggcgtatgtacaacagttggagagcagccgagtaaagcttgtgcaattagagcaagagcttcaacgagcacgtcagcagggtatatttattgcgactccaggggatcaaggtcatttggctgttggaaatggtacttaa

SEQ ID NO: 96220 - DNA, 219 bp, Glycine max
  Peptide Sequence Number=SeqID_212998
atgggtcttttccagcagtgtatagaaatgccgctaaattttttaccaaccctggataagctgccgatggtcaactcaaggagcctagttaaagcagcaacacagaggtgcaacaagcaactagcaaggagcctagtaaagacagtaacaaaggggggtgcagctagaagcaaaggcaaagagaacgtggctgagctgacactaggaggaaatctgtag

SEQ ID NO: 96221 - DNA, 303 bp, Glycine max
  Peptide Sequence Number=SeqID_212999
atgtcaatccttaccctcggaagcggaaagaatagaaggggaatttccaatcaaagaaagggaaagaaggaagatttccaatcaaagagaaagcaaaaaagggaaagaaggaagatttccaatagaagagaaagcaaaaaaagaaaagaaggaaaattccccaatcaaagagtgggagaaagcaaaaagaaaagaaaggaaattcccaatcaaagaatgggagaaagaaataatttgcaaagccaagtcatgacatatctatggtccggaattaggatgaaacacttacctgtgcgagattga

SEQ ID NO: 96222 - DNA, 159 bp, Glycine max
  Peptide Sequence Number=SeqID_213000
atggggaacaaaaagaaacagaacatagacaacgtcaatgggagggatgaaatgatccaaaaggattgtgatatgctggaacaaatagttgccaaaatgctgaggattgtgatatgctggaacaaaaagaaactcacctcgagggaaagaagcaagtga

SEQ ID NO: 96223 - DNA, 111 bp, Glycine max
  Peptide Sequence Number=SeqID_213001
gtacggcctcaatcaaatttggcgccgttgtcggggagcagtggtccaaagtgttctgtttcgcatttcagtcgtgtcctctatttagcgcttccctgtttcagttgctga

SEQ ID NO: 96224 - DNA, 2586 bp, Glycine max
  Peptide Sequence Number=SeqID_213002
atggggtgtcctcctttgggcacaagtgtgtttgttcatccaatacagaaaagtcttgcaaatgggagcaatgaacaacattctacagaaaataattgtctgcctatatataattgcaaggaattgtatcttcagttggttccttctaagaatgggctgccattgaaatttaataactttccctcatcgggcatgtctaaggtgaaatcccatgtccaatctgagaatgatatcattgcatctcctgcaacgccttcgaatggatcaaagttttctaatgctattgggatgtcttctccactatttgatgattcagcgtctagtgtgccaaatctgaatagtcaatcgttgaattcatttgatgttagcttagcattacgggatgaaagttctaaagaaatactactgacgggtgcaaaaccatggttatattctcgctctttacttctagggaatcttgtcaatgtcccaatgctatcagagttgtgctttttccaagtgataggagctaagaagcagccagttaccaaatctgatcattgtccatcaaatggaaacagtgatttatatcctgaggattctgatatagcagagagtgtaaatcaggctttcactgttaacgatgaaacaaaggtgtttttatctctgccatcaaatgcagcatccgaagagccaattcaaagggatataccttgtgtgaaactagaacacaaagttgctaatgctagtttacatgataaaatctctaaattgggtggtctatccaaagaatatacacttctaaaagatataatttcttcatctgtgagcgatgctttatcaagttttggtttaagaaccacaagaggtgtccttcttcatggtccacctggtacaggaaagacttccctggctcaattatgtgctcatgatgttggggtcaaatttttcccaataaatggacctgagattgttacccaatattatggggaaagtgagcaacaattgcatgaactttttgattcagccattcaagctgcacctgccgtggtattcattgatgaattagatgcaattgcccctgcaaggaaagatggaggtgaagagctatctcaaagattggttgcaactttattaaatctggtggatggaattagtagaagtgaagggttacttgtaattgctgccactaaccggcctgaccatattgagccagctctcagacgaccgggaagatttgacaaggaaattgaaattggtgtgccatcacccaaccaacgttcggatattttgctcactcttctcagtgaaatggatcactctctcgcggagttgcaaattgaaaaccttgccaccgtcactcatggttttgtgggtgctgatctagctgcactttgcaatgaggcagccttgatttgcctacggcgttatgctaattttaagaagacttatgattcttgttctgattatataacagagcaacctgctctgatgaatggtgcaacaaactcaatagatcattcaggtgatgcaacttcatctgtttcagatatgtcagtggcctccagtcgtgtattaccttcctgcatgattggaatgacttctgaagctatggaaataattcctgatagtggcgaagaagagcagattttgaaagtaagctttgaagattttcagaaggctaggatgaaaataagacctagtgccatgagagaggtaatccttgaggttccaaaggttaattgggaagatgttggtggtcaaaaggaggtcaaagctcaattgatggaagcggttgaatggccacaaaaacaccatgatgcattcaatcgtattgggactcgccctcctaccggtgtattgatgtttgggcctccaggttgtagtaaaaccctcatggcacgtgcagttgcttctgaagcagggctgaactttctagcagtcaagggtcctgaactcttcagcaaatgggttggtgaatctgagaaggctgtcagatcattatttgcaaaagcaagggccaatgccccatcaatagtattttttgatgaaatagatagtcttgctgtaactcgtgggaaggaaagtgatggtgtttcagtatcagatagggtcatgagtcaacttcttgttgagttggatggtctgcatcaaagagttaatgtcaccgtcatagctgctacaaataggccagacaagattgaccctgcccttttaaggccaggacgctttgaccgtctgctatatgttggacctccaaatgaggtggacagggaagagatatttcgcatacatctgcgtaaaatcccgtgtggttctgatgttagccttaaagaactagctcgactcacagatggttgtacaggggctgacatatcattgatatgtcgggaggcagctgttgcagcaattgaggagagccttgatgcttcagttataacaatggagcatttaaagatggcaatcaaacagatccagccatcagaagttcactcctaccaaaagctgtcaacaaaatttcaaagagccgtccgctgctgtgatataaaggatgaattcaatgatatgccgtgcgacagtagatctactcagttcagcatttggtaa

SEQ ID NO: 96225 - DNA, 1068 bp, Glycine max
  Peptide Sequence Number=SeqID_213003
atgagggaagaggattccaattggttttcgcgatgggaagaggagtttccgtctccagaagaactcatgcctctatcgcaaaccctaattactcccgatctagccatggccttcgacatccgaaaccctcacaccaccaacaccgctcagcaacaacaccaccaacaccaacaacaaccgcaacaacaacaacaaccttcgaacccttcctcgctccccaacccgctacagcaacaacaacaacaacaacaacctacctccgccgagttcgccgactccggcgaactcggctctggcaccgccggcgaggagccggcgcgtaccctaaaacggccccgcctcgtgtggaccccacagctccacaagcgcttcgttgacgccgtcgcgcacctcggcatcaaaaacgccgttcccaagaccataatgcagctcatgagcgtcgatggtttgacccgcgaaaacgtcgctagtcacttgcagaagtaccgtctctacctgaaacgcatgcaggggatttccgccgccggacccggtggtccaggcggcggcgcctccggcgccgtggccgaccccgccaccgaccacttgttcgccagctccccggttccggcgcatttcttgcacccggccgcgaggccgaattcggatcacttcctgccgttcgtgccggcgctccacccccatcagcagcagcagcagatggcggcggcggcgcagtaccaccggcaggtggggcatttcgggtccccgccgaacgggcacttcgagaacccgttcatgtctaggccgaatcttcagagaatgggaggtggtggtggtggaggtcctgtgcacaacaaccaccaccctgtgagtggttatgtggaggacatggagtctgctaatgctgcctctggaggttttgtgtcggtattcatggaaggagtggctaaagccaccaatttggtacttgtgtctgcaggtggtaataaacgtgggttacagttggtagaaactaatggaggcgtatctgattggcatgaggtgagttgtacattgtttgattctataggagactttaatgcctga

SEQ ID NO: 96226 - DNA, 882 bp, Glycine max
  Peptide Sequence Number=SeqID_213004
attggagttgtagatggggaatgttctcaagttacattggataggaacatcttagatcattgtgtgattattattagagactctaatgttgattgggatcctaagctttttaggacattagattgttggttccatgacaagaccttttgtggagtttgtgaaaaatctttggagaagtttggatgttcaaggttgggcagttatgtcttcaaagagaaattgaaggcattgaagaacggtcttaaaggcgatagtaactctaaattctttcatgagtgtgaattggagaaggaggaaaaacttgttgagggggggagttcatttccaaatatttctcaagacgaatatggtaattttgaggaggatgagataaagaaggctatttgggagtgtgggagttcaaagagtctagggccagatggattcaactttgggaaaaggtgtgtagcgcaaaaaggatggagggccaaggtgttagacacctacgttggttcaatgagtgtcttcttgctgagtggagttgggcgttgttcaatgatcatgactccttatggaggcaaatcattgtttctaagtatgatggggatgtgcaaaaagtgtgtggatatgtggttccataagctgagagtgtggaagattggaaatggccacatcacaaggttttgggaggatagttggttggagggtaaatgtgagtgggcttttagttggagaaggagttggtttgtatgggaaagtcttatggtggatccttttatgggtaagttacaaaattgtaacttcgttcaaggtgtgcctaatgtgtggggtttgagatttggaaattccaccaaaggctcagttcatggtgtggaggctaatattgggtcgactcctgactaa

SEQ ID NO: 96227 - DNA, 499 bp, Glycine max
  Peptide Sequence Number=SeqID_213005
ttcctgggccaccccctgatattggaggagggccaactgtgcgagcacaactagagagggaggctatcacacagctactatgcataccggtgcaagatttcacccgtgccgctgcaaagagacgagtgtggatcatgcacaccaacatgaacagggtcgcgcccacaagacacccagtggacccagaaaagtcgaatagggccctggggtttttagctctggttacggggatcgtgcccgcaagacacccaatggacccaaagaagtcaaacagggtcctggggtttcctgctctgattacgggcctctgtcaattctacggagtgcccgtcacccccaacaaggtcatcaggccccctactaatcgagctttcatcaagaggtactgcgcccctaggcaggcgcaagacgaaacaccacaacagcctggggatggccagcaacaggcaacaaatgcatcgccgccacctccagagcccctcaactcatccacaaaaag

SEQ ID NO: 96228 - DNA, 609 bp, Glycine max
  Peptide Sequence Number=SeqID_213006
atgatgaggttgaggcaaaatgggtcatcgagaaaggatttgaaaggatgtttgtcggcatccttgtcagccaccatgggtttgaacaacaatgctttcttggaaaacagacctgtggtggcggctcgtgtggctaatggagcaaatatggtggtgcaatgggttctggaagatctttgtggtggtggcggatcttttggtagcgataatggtccactacctcctccatccagcgtcgtcgatcactgccacaagtggaacgaggaggaagttcagcacggtgaagttcaacggctttctattgtcgccacacttctttgtgaaggagaggatggtggcgttggagggagagtacggtgcatgggagcagatcgagatgacgtcagattaggagtcgcgggtgaggatcatggagctgaagttgttcatggcgtgggtggtggtttgaaggagcgtggtgatgagcttgtcgaagggggcgttggggacgacaagaatggagagggaggggcgatccctggcaaggggcgtgatggaagtgaggagggaggtaaattaggagagctcttgcacgatggagaggaaggtggtgagattgttaatgtttga

SEQ ID NO: 96229 - DNA, 1107 bp, Glycine max
  Peptide Sequence Number=SeqID_213007
atggcttctgaagatgctaaaaatttggttaatcaagagaagtcttttgcttgtgccgaaattgaaagtgctagagctgtggtgctgagaattggggaggctcttgaagaacaagaaaaagcttcccaagcttctaaaccacagtacgtaaagtgtactccatctgttgttcttcactgtcaggatgtggatggactagtcgaagaggttcaagagtctagaagaatcaaattgttgcatcacccaagcaaggtgatggccatggaatatgaactacgtgctcttagggatcaaattcgagagaaatctatattttcaattaagcttcagaaagagctttgggttcatatctgcgagtccagccttgctcagatgaagtgccacaggtttcgaaatgttcatttcagtggtaccgcttgtcttctgaaggcagctggagggaagttatttcagcctctttgcatatgcaagggtaaggctgcgtacaatatccctcccccataccttcgcatagcgaagagcctctgggcaatgggagggctagggagggggtcaaatggccagcaattagaagaacgatcatctaagagcaggtttttgcatttaggatgggatagtgccaacaaatcaatatatgctcctgacccctctgatgttgggagaatcttacaagtagatattgtctcaaatgggaaaaagctcaccctaacaactaatcccattcaaactgtttcaggacttggaagccatgtggagacacttctacgaaaatctaatactgattttaatgtagttatttctcaaatgaatggaaaagatcactcatcccattctactcattcatttaatgtggggagaatgaggataaagctatgcagaggttggattacaaaagctagagagatttactccccatcaatgcagctatgtggcgttagaagtgatgtcgcgaatgcagcgaaggtgttgttttggcaagcaagaaagggcctctcatttgtattaacctttgaatcagagagagaccgaaattcagccattatggttgccaggaaatatgctcttgattgcaatgtcgtgcttgccgggccagatgatctagtgtag

SEQ ID NO: 96230 - DNA, 886 bp, Glycine max
  Peptide Sequence Number=SeqID_213008
gagttttggtgccaaactacttgccactgtgcaagcaccagcagctgctgaaaacaacatgaaacaagcatgtgctaatgtggctggagctcctcctgttgctaaaggagttgcgctggccaaaagagcggtggcccccaaaccgggtcagaagaaagtgactgtaaaacctaagtctgaggaagatcagattcttgacatcgatgcttctgatgttgacaatgaacttgctgctgtggagtatattgatgacatttacaagttctataagcttgttgagaacgagagccacccccgtgacaacatagactcacaacctgagataactgagaggatgagagctatactagttgattggctgatacaagtccaaaccaagtttgaactttcacttgagaccctttacttgacaatcaatatagttgattggttcctggcggttaagaatgttccaaagagggaactgcaattggttggcatcagtgctgtgcagatggcaaccaagtatgaagaaatctatccccctcaggttcataactttgtcttcctctcaggtagggcttacactcatgaacagatactgattatggagaaaatcatactggccaagctggactggactttgactgtgccaatacctttggttttcctacttcgttttatcaaggcatcagtcccagatcaggagttggaaaacatggctcattttctgtctgagttgggattgatgaattatgcgactgaaatgtattggccatcaatggttgctgcctcagcagtctttgcagctagatgcactctgaataaggctcccctttggaatgagacacttaagctgcagacaggttactcacaagaacaacttatgtatgtgaatctaaattga

SEQ ID NO: 96231 - DNA, 558 bp, Glycine max
  Peptide Sequence Number=SeqID_213009
atcactcttttgtctgaggaagaggataagatacttgaggcacatgaagatgctcccccttctcagccacaatttgaacatcaacagtttaatatactacagcaaagtgtggagactcaaggcttagcgcgacgttgggaaactgttgatgcagcaacatatagtttgtctccgatgccagaacgacaacatgaaatgtattacacactgtcgacattcacccaagaaccgtctcagatgccgccgatgtattcatacccacatgattttcaaccagggtatagttttgcaggcatatttgggtcctctcctccatttacccaaagtggtcaagtatcgaccccaaatgcctcacttgctggtccgtggaatgtacctggagatatatccgacatggacgactttttagggtttgatttacgtcatgatttctctgccgaggttgaccaagtggatgaaagggcgaatcctagaagaagaaatcctgatagggcagctagaaattgggaccggccatgtgggacttcgtcgcggcatcacatacatagtgatgattga

SEQ ID NO: 96232 - DNA, 786 bp, Glycine max
  Peptide Sequence Number=SeqID_213010
atgatgctatccactgccaaaggtgcacagtcttacagtgacattagaacagtcaacggtctggtatatcctacatttagggaagcatgttttgcaaaaggcttcctaggtagtggtcaagaatttattagtgctttacaggaagctaataattggggtactgcacactacctaagaaaattatttgtcaagcttttatttatgaacaccatggacaaatcagaatatgtttggcaacagacatggcaatggatggcagatgatatcatattcaatcatagaaaacaaggtattcgccttgctgaaaaggaaacaattcatttatgcttaactgagattgagaatatgctacaagtgaacataagaagcttgcgagattttccatccatgccatacccaataggatatgcaccaaaccaacatcataataatctgatccataatgaaatggcatatgacaaagaaatgttagcagaacaatactacacggcataccaattgctgacagatgagcaaaaaactattgtcaataccattatgtctgtggttaacactcaatcagctgcagtttactttctctatggatatggtggaactggcaaaacatttgtttggacaaccttatcatctggtatacgctccaatggtggaattgtttgtacaattgcttcattactattgcctggtggtcggattgcacattccaaatttgctataccagtccctgcaacagaaaattcaacatgcaatattcatcaaggcagtgagttagctgaattattaaag

SEQ ID NO: 96233 - DNA, 640 bp, Glycine max
  Peptide Sequence Number=SeqID_213011
atggcacactgtgctttgggcagcgtcggcggttttgcgttacagctcaatcagcggataaacgccggacagcagcggccggcagagaattttgtagccgtcatggtcgaagccgtgacgcgcccgctgcagctgacgcgcttcctgctcactgctgaccgatcccagccagaaccagtgatcgatgacgtgaatctgcgtcatctccgtcccgcgctccaccatacccaccgggccctgccacggccagcacaccacgcgcagctgctccagccctgccagcaggcgctcctgatgcgccgccagcgccgcgccccggctgcaggcgctctaatcccagcaggccgtggcacaggcgcagctcgtcggcgaggcttttcagcttctctaaggcggcaaagcggctgcggaatagcccgtacaggtcaggcgcttattgaacagcggctgctgcgttttgatcatctgcgcttcgagcagctgtgcgcccacgtccccggcggtggggatccagctgacgcgccgcgcctggcgcagcatgctggcttcatccgccgtgcgaaaatgggccatcacccggctgcgcaggttgatgctcttgccgatgtacagcggcaggttgtcgttatcaccgtggaaa

SEQ ID NO: 96234 - DNA, 1029 bp, Glycine max
  Peptide Sequence Number=SeqID_213012
atgtgttgccccctgtgtcagaaaggagtgaacatgcaggactttttacagcaaaccctgtcaggcaggccgcccgcgcagcggcagggcagtaacgcccacctgcactggcagtggcatgatgagggcatactatccctgacaccgcatacgtccacgcagcaggcgctggttctctccgccgggattcacggcaacgagaccgccccggtggagatcctcaatctgttgctgacgccgctgctgcagggggaaaaaccgctggccgtgcgcctgctggtgatactcggcaacccggcagcgctgcgcagcggcaaacgctaccagcattatgatattaaccggctgttcggtggacgctggcaacaggtggccgacgtaccggaggcgcagcgcgcgctccagctggagcaggcgctggagaacttctggtgcgagtgcctcgatcacgaaattcgctggcatctcgatttgcacaccgcgattcgcggttcgtggcatacgcgctttggcgtgatgccgctcaacatccagccgtggcctgcggattttttacactggctggcagcggccgaactggaagcgctggtgttccatcgtgcgccgggcggcaccttcacccacttcagctgtgaacactacgcagcagccagctgtacgctggagctgggaaaggcgctgccgtttggcgagaacgatctcactcagttcagcggcgtgcagcgtgcgctggcggcgctgctgtacggtgaggcgctgccgccggtgcgcgagacgccgcgccattatcgcgtggcacagcaaatcacccggcacggcgagcagtttgttctgcacatgggcccggaaactctcaacttcacggctttcccgcagggcacgctgctggcggaagagggtgagcggcgctattacgtgcagcaggcgcgtgaatatgtgctgttccccaatcccaacgtggcaccgggcctgcgcgccgggctgatgctggtggaggagagtgagcagacccaggcgctggagttgtaa

SEQ ID NO: 96235 - DNA, 630 bp, Glycine max
  Peptide Sequence Number=SeqID_213013
atggatggcttactgattcattctgaaccgctatgggatcgcgccgagctggaggtgtttgccagcctgaatgtggatattagccgccgccacgagctgccggatacgctcggcctgcgcatcgatcaaaccgtgcgcatgtggtacgaagcgctgccgtggaacgggccggatcaggccgaagtcactcagcgcattattgcccgcgcgctggcgctggttgaagagacgcggccgctgttgcctggcgtagagcaggcgctgcagctgtgtcagcaacagggcctggcgattgcgctggcctcggcgtctccgctggcgatgctggaacgcgtgctggagatgttcaatctgcgtcactactttagcgccctcgcttcggctgaagcgctgccttacagcaaaccgcatccgcaggtgtatctggatgctgcggcaaagctgggggttgatccgctcaactgcgtggcgctggaagactcgttcaacggcatgatcgccagcaaagccgcgcgcatgcgttccattgtggtgcctgccgccgaacatcgccacgatgcgcgctgggcactggccaatgtgcaactggaaaacctgacgcagctgcaggcggaacatctgtttaactga

SEQ ID NO: 96236 - DNA, 165 bp, Glycine max
  Peptide Sequence Number=SeqID_213014
atgacgtatcaacaggctggccgcatcgccatcctcaagcgagtggctggctgggtgatttttattccggcgctgttatccacccttatctccatcttaggcttcatgtttaaacacagcgaaaagcagcccggcattgacgccgtgatgcttgacttcgtgcat

SEQ ID NO: 96237 - DNA, 213 bp, Glycine max
  Peptide Sequence Number=SeqID_213015
gcaaagtttgatatcgcagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggag

SEQ ID NO: 96238 - DNA, 246 bp, Glycine max
  Peptide Sequence Number=SeqID_213016
atggctcattttctgtctgagttgggattgatgaattatgcgactgaaatgtattggccatcaatggttgctgcctcagcagtctttgcagctagatgcactctgaataaggctcccctttggaatgagacacttaagctgcagacagtgtgttctttaaaacttattgctaaaacttcttcagattactataacgtgtttagtgaaggcccttttgaaagtggcactgaaatttcattaacctag

SEQ ID NO: 96239 - DNA, 1179 bp, Glycine max
  Peptide Sequence Number=SeqID_213017
atggcatcaagaggtgaagcagtagtatggggaggaaaacagcagaagaagaagaagggtatagcggttggaaggaaccgcaagatattaggtgatattgggaatttagtcaaccgccccatcacaaggagtttttctgctcaaattcttgccaaagtacaagcagcagccaagaataacaagaaacaggcttctgtcaaggtaaaaccaaaggctgaggaagtgattgacattgaagctggtccagacaaggaggtccagaaaaacaagaacaaggaatcacgcgcttctacttcagttctcacagctcgaagcaacgcagcatgtgacataacaaacaaaccaagggagcagattattgacattgacgcttctgattctgacaatgagcttgctgctgtggagtatattgatgacatttgcaagttctataagctagttgagaacgagaaccaccctcatgactacatagactcacaacctgagatagatcagaggtcgagagctattctagttaattggctgatagatgtccacaccaaccttgacctttcacttgagaccatttacctgaccatcaacataattgatcggttcctagctgttaagacagttccaaggttggaaatgcaattggttggcatcagtgccatgctgatggcatccaaatatgaagaaatttggactcttgaggttgatgaattagtccgcctcacagattatactcatgaacaggttctggtcatggagaaaaccatattgaataagctggaatggaatttgactgtgccaacaacttttgttttcctggttcgtttcatcaaggcatcagtcccagatcaggagttagaaaacatggcacattttctgtctgagttgggaatgatgcactatgccaccttaaagtacttcccatcaatggttgctgcctcagcagtgtttgcagctagatgcactctgaataaggctcccctttggactgagacacttaagctgcacactggttattcacaaggacaacttatggattgtgctagattattggtgagcttccactccatggctgggaatggagaggagaaggttgtgtacataaagtattctgatcctgagaaaggagctgttgctatgcttccaccagctaaaaatcttatgcctgaaggttctgactctcagtag

SEQ ID NO: 96240 - DNA, 237 bp, Glycine max
  Peptide Sequence Number=SeqID_213018
atggtagtggtctgtggcggtggcgcgcgctgcacgcttcgtcctattctccctccaccgctcgggtcgctgtcgtccggtgtctctccgaaaggtagaagaataggaaaagaatgtgttgatgccacggtgggttcttacagggtgttgtcaaaggagtctatagggtgttgtgaatgggggcatgatgctggttggttcttacagaacttttatcagacatttggtgagcactag

SEQ ID NO: 96241 - DNA, 1935 bp, Glycine max
  Peptide Sequence Number=SeqID_213019
atgcatccagagatgtatggtcatatctcctatcagccaaagttgttattgaatgtgcctcaggaagatttctttggtgggctacagaagatgctatctgagatgcaagaagtaacagaattgcaccctgtgcctgatgctcatgtccctgtggtgaaattcaagtttaatggagtttctgttgatctcctgtatgcaagattagcgttgtgggttattcctgaagatttagatatatcacaggaatcaatattacaaagtgttgacgaacaaactgttcttagtcttaatggttgtagagtaactgaccaggtcctgcgattggttccaaatattcagacctttcgcacgacattgagatgcatgaggttttgggccaagcgtcgtggtgtttattcaaatgttgcaggttttcttggtggtataaacctagcattgcttgttgctcgaatatgccagttatatcctaatgcacttcctgatatgttagtgtctcgattctttagggtatatactcaatggcgatggccaaatccagtcatgctttgtgctattgaagaaggatctcttggactaccagtttgggatcctagaagaaatcccaaggatagatatcatctaatgcctataattactcctgtttatccctgcatgaactccacttacaatgtgacatcaagtacattgcgtgttatgtcagatgagtttcggaggggaagtgaaatatgtgaggctatggaggctagcaaggctgattgggataccctttttgagccttatcccttttttgaatcatacaagaattatctacagatagacataacagcagagaatgcagatgaccttagacaatggaaaggctgggttgggtctcgtctccggcagttgacattgaagattgagaggcacacttatggtatgcttcaatgtcatccacatcctggtgaattctcagacaattctagaccttttcaccactgttactttatgggtctgcagcgtaagcaaggagttccagtgaatgaaggtgaacagtttgatataaggttaactgttgaagaatttaaacattctgtcaacgcttacactctatggaaacctggaatggatatccatgtgtcccatgtgaaacgcagtaacattcctaactacatatttcctggtggtgtgcgacctaccttcccatcaaaagtaactgccgagaataaacagagttccaaatcaagggcttctggccatggtcaaacagaaaagcctcaaggaggtaaagctgttgcagttggagcagatgatgtgaggaagagaaagagatcagaggacaacatggataataacccaaggaattccaggtcccctgtatctttacctccccccagcagggaagttcatgaagatatatctcctattagtgcttcaagttcttgttctatgaaatttgatgaatcagaagtgaatagtattggtggacaaaagagcgagaaactttgtctgaaatctccaggtgagattccttctggggatagtgggaccaatggatcagtgacaagcaaccaacaagtgaaccctgtacttgcagctgctgatacatctaattctaaagaagaagaaaagctagccattgaaaagattatgtccggtctgtatgatgcacatcaagcctttcaagaagaacccaaagagcttgaagataatactcaatataaaaatcaagacaaagattctagtgcgaacatgaaaaacaacatggaatctttagactcaaagcctgcagtgccagaagagccagttatttctaaggaaattacttgttcaactcatttatgctccaatgagagcttggaggagcttgagatatcagacttccctaaactgcttgctattgtctgtgctgtgctaaagttgctcaaaactcagtccaatctgcataggagctga

SEQ ID NO: 96242 - DNA, 675 bp, Glycine max
  Peptide Sequence Number=SeqID_213020
atgaataaatttggtgctgtacttgatgactttggacttgaaacaatgcttgacaagcttatggaaggttttatccgtcccttatctagagtcttctttgcagaagttggcgggtcaaccctggattctcatcatggttttgttgtagaatatggtaaagatagagatgttgacttaggtttccatgtggatgactcagaagtaaccttaaatgtttgcttgggtaagcaattttctggaggggaattgttttttcggggtgtacgatgtgagaaacatgtaaatactggaagtcattcagagcaaaaagcattgactccttctgtgcctcaaatagctagttgtcctccgtgctttagggaaatttatggaccattgctttttgctatttctcataggtggttgtacacttttgaaagcaggagatctttgattattctcatgtccctggacgagctgtccttcatcgtggtcgtcatcgccatggtgctagagctacaacatctggtaatcggttctgtctttagagagatgaaactgtatcaaaaagatttctccagctggtgtggcgagtgcaatcgtgagaaaaaggaaaggcagcgctccacagttgctgctaccaaattgaaaagtaccggggtactaagaatacaggagtatgactgtgtgggatga

SEQ ID NO: 96243 - DNA, 1017 bp, Glycine max
  Peptide Sequence Number=SeqID_213021
atggctagtgttgtgacagagaaagtgaagcttcttgtggcattgcttaccctgcagttgtgctttgcaggatatcacattgtgtctagacttgcactaaatattggagtcagccaagtcatttaccccgtttaccgaaatttgattgccttgcttttgttgagcccatttgcttatgtgttagagaagatcaccgcaaaccaagggttttacttgttgggattatactatgcttctccaacttttgcttctgccttgcaaaactcggttcctgcaattacttttatcttggccttggctttaaggcttgaagaagtcaacatcacaaggagagatggattggcaaaagttcttggaaccattgccagtgtggggggtgccacagtaataactctatacaaaggtcctcctcttcttcacctgcagatggaccagatacaaggagacactttagaagtagatcagtcaacaaaagttcaaaattggacttggggttgcatatacttgcttggacattgtttatcatgggcttgctggatagtttttcaggctcctgtggtgaagaagtatccagcaaaactaaccctcacctcttttacatgcttctttggattgatccaattcttgatcatagcagcctttgcagaaaatgacttggaaaattggaagatacaatcactagaggagctttttatcattctatatgctggaattatagcatccggcgttgtcatatctctccaaacatggtgtattcaaaagggtggtcctgtgtttgttgctgtcttccagccagtgcaaactattctagttgctgtcatggcagcactaattcttggtgatcagctatactctggagggcttattggtgcaattctcattgtgcttggtctatacttggtcctttggggcaaaaacaatgaaaaaaaagtgactgagccatcactaacaaaccccttgcttaaggcagaggaagagaataaagaaacggtttctgttccaaaagacataccatga

SEQ ID NO: 96244 - DNA, 366 bp, Glycine max
  Peptide Sequence Number=SeqID_213022
atggttcctttacgccattaccatcggtacccgttcaacaagattcgacctttggcttcttggatgcaacagcattctccttgctctctgaatcagcagcttcgcgcttctagcgccagcggaaacggcaccgtggcggcggcgtcgacggcgagcctgaggctgcggctgaaccctaacaaggagcacaagcccgatggctacgaggacatgcaattggatttcagccctaacattttcagctcgctggagaggtacctccctccgagcatgctcaacgtgacgcgtgacgagaaggccaagttcatgcgcgagattctcctcaagtatctgcccctcggggaacgcaacagagtgtgtttctga

SEQ ID NO: 96245 - DNA, 1161 bp, Glycine max
  Peptide Sequence Number=SeqID_213023
atgtcttggagaaaatcattgactatgagacggccaaagaagcatgggatgtgttggctacaacttacaccgatgaaatcaaacgagatggtggtgcaatttgtaaataggttggtgattcttacaaaccaaatgaagagttatggtgaggtggtgaccgattcgatgaaggtggaaaaggtactcaccgatttaacaccaaactatgatcatgttgtttttgctattgaacaatcaaaggacctagaaacgttgaaattggagcaattactaggttctttggaagcacacgagttaaagatgaagaatagagaaggtatcaagaaagaggagaaggattccaagaaagctctatttgctcaaaatcaaaagaaagatggtggtgattcttggaagaataagaaagggaaaggcaactggaagtataacaaacaagaaagcagtggttctaaaagtgagaatcaaaagaaagaaggagaaaacaatggaaagggaaagaagaaatcaaaggagtacattcaatgctataactatcaaaagtatggccattatgcatatgagtgtagtaatcctaaagtgcttaggaagagaagtgaagaagcacaatttgcgcgtgactctgatgatgaagaagcagtgctgttaatggctattgttaacagtgaaacaggcattgaggaatggtggtatttggacactggttgttcaaatcacatgacaggacacaaagattggttctgtgaaattgatgaaacagtgagaagaagcattagatttagtgatggcaggtcagtgatggctaaaggaattggcaaggtggccataagaagagtagatggaagcaaggtgactatcagtgatgtcttatatgttcctaacatggaaagcaatctgctaagtttgggacaattgctagagaaaggattctcaatgcatatggaaggtgaacacatggaagtatctgattctaacgggaaatgtgtcttgaaagctcctgtgtctaagaatagaacattcaaggtgggagtgagcaccattgagcagaagtgtttgactgctcaaagcaatgacagtgtgtattgtctagggttcttcttcacgctgggtgagttctctttcgcgctgagcgggtcgcctcgcttagtgaatcttgcgcactga

SEQ ID NO: 96246 - DNA, 927 bp, Glycine max
  Peptide Sequence Number=SeqID_213024
atgcacgcaaagacagactcagaggtaacaagcctcgccgcgtcttcccccacgcgctcccctccacgccgtcctctctactatgttcagtctccctcacgagactctcacgacggcgagaaaaccgcaacgacgtcgtttcactcaacgcccgttctcagcccctctgcctctcctcctcactcgcgccactcctcctccacgcgcttctccaagaaagaccatagccacagcctcaagccgtggaagcaaatcgatgttattgaagaagaagggcttcttcaaggggatgatcaccataacgggcttccacgtcggtgctactttctcgcgttcgttgttgggtttttggttctcttctccttcttctcgcttatcctttggggggctagtaggcccatgaagcccaagatcaacatcaagagcataaagtttgatcatgttagggtccaagcaggttcggatgcaacaggggtagccaccgatatgattacattgaattccactttgaaattcgcataccgcaacacaggcacattttttggggtccatgtcacatccacacccgtggaactgtcctattcagacattgtaattgcttcgggaaatatgaagaagttttatcaatctaggaggagccaaaggttggtgagtgtagcagtgatgggtaacaagatccctctatatggaagtggtgctagcctaagtagcacaacgggtgtgcccactgtgcctgtgctattgaacctcaactttgtgctacgatctagggcttatgtgcttgggaaattggaaagaaatggtacagccagagagcagtgtgccaaggacgcgtttttgggactgcttgggctgcccaaattgcctcaaattgcggtaaggtccatggtgagagtgcatgttcaggatcaggtcaacgggtcatga

SEQ ID NO: 96247 - DNA, 681 bp, Glycine max
  Peptide Sequence Number=SeqID_213025
atgtcacatcttaaacttcaatatctggctaaaccccacgatgaggtagaatgcaagagagagagacgagagagacagggcgcgagagagagagagagagcaatagagtcagcaagggagagagacgagggatgggtgagagtcgcctcaaaaagcagaggcggaacgagaaacaattccagagacaggaaggacccacagcggagctacgcctgcagtagcttccatggatcttggaatacccaaacacaatggaaggacaggtcgaacactacaagcttctacttcaccagattcctagaaaatgtgaacgagatggacctatggggcatctttggagagaacaaagaaggaagaaggtacggcttcgagagatttagcggggtgatcgccgtaaacaggctagagcggcaacttgacaaccttgtgatcggaggcctgaagctacacatcaacgtaccaaagtacgaacgtcagaacgagtcacgaccacaattaagactagggctcgaaacgaggagaggcggtggaacacagtggcaaggctcagctagcgcgaggcttacccacggcgagtcgcattcttcagtccaccttgacattccggcgggagccaaacattggttctccgatgcgtgggttggccaactgaagctcatgaagacactcgaagaagcttaa

SEQ ID NO: 96248 - DNA, 270 bp, Glycine max
  Peptide Sequence Number=SeqID_213026
atggggacagagccaccacatgggaagaataaagaaatggaaatggttgagattgagaacttattgatgtgcttgctttggtttgtgatgctactacctatcgtgaacacaaatgtgattcttgaaggtctacctagggattttgattcaatgattgctctaattgagagttgtctaccactcatcactgttgaagaagctgaagcttctggtggtcgtaatgcccacgatgaaggtggtttcaaccgtggtggtggccatggtggttag

SEQ ID NO: 96249 - DNA, 2925 bp, Glycine max
  Peptide Sequence Number=SeqID_213027
atgggtacagagatgctttacgcaaataaggaaaaaggtggagagatattagacgtatgtgggggatgcatcaaaaggcagagcagggcagatatggagtctggattagacaacgacaactacatgcagagcataaatgcacaagtcaacataggaccctgtgggccagccttggacatatctaacgagtcacatgccctacacataggtagcactgaaaattcaaatctttgtggtaacttaaacaaggatatcgctaacgatcacactgtcggtgctaatgggccactactattgggcctcaccacccacacaacagaaaatgagcatccttcgagcccaaataccatcaaagctgaagctaccaccccggtttctcggaaggtgtactcaaagagcacatggcgcaaaaagcaacaggcctgccaccaaccaaatgaacaagctaagcactcagacaaggatcaaaccaaattgggccttgtgaccaacagcattctcaataccgggagcttaacacccatgtccgccgcatcgaccttcattgttggtacctccaacaccctgcaggaggcaaaacacctttggaatatggcaaagcaaatggggccatggaacttagagacagaaaagaggcagagaagttgggaaatagaaaagtgccccatgaacattttaacatataatgttagagggctagggagggggatcaagtggactgccatcaagaggttagtgacgaaacacaaggttgatttgctatgtcttcaggagatgaagaaacaacatattgaaatcaaactgtgccagtccatgtggggtgatactgatgtaacctgggaaatattgcttgccacaaatacaactggtggtctactatgcttgtggagcgagaagagttttaatgtggaaagaaggctaaaggatctgaaccgaaggggcctatggtgcctgctgggagattttaatagtgtcagaaatgcatcggaaagggttggagtatcacaaagaggggggggggggggtgatccactcatcaatgaattcaatgactggctagatgatgttgaagttcttgaaccaccatgcatagggagcaaatacacttggtacagaccaaatgggacagctagaagcaaactcgatagagtattcatctcctcagattggctttctaaatggccagccagcacacagcatatcctagacaaaaacttctcagatcattgtccaatgctcgttaaatctaaaaatgctgattggggacccaaatcatttagattacttgattgttggctcaaagataaatcatttgggaaggtggtcaaggacagctggacacagacacaacaaacaggctggagcggctatgttctcaaagaaaaaatcaaatgcctcaaggaaagaatcaagctatggaacaaggagcagaatggagacaccttcaagaagtttcaaaacatagaagctgagttaaacaagctggaaaatgacatagctaaaagacaaatgactccccaagaaagtctgaataggaagaggctgcagcaagacctatggagagcagccctatcacacaaatcactaatgagacaaaaggccaggtccaggtggatcaaagaaggtgattgcaattcccgtaactggagtgtcaatggctcgtgggtggaggaaccaaaccgagtgaaagaagaagtccaccggttttttcagcaaagatttcaagaaccattgcaaaccagaccaactttgaatggtatcagctttaatagcattgggcaccaaccaaatcaattgctggtgggcaccttcagtgaggaagaaacaaagtcagcagtttgggaatacggtagtgaaaagagcccaggcccagatgggcttaattttaagttcatcaagcagttttggcagaccttgaaacctgtaatcttgcgctttcttggtgaattccatgctcatggcactttcccaaggggaggcaatgcctcatttattgctttgatacctaaggtgaccgatccacaatgcctaaacaacttcaggcctatttccctcaaaggcagcgtctacaagatagtggccaaggtgctagccaatagattgaagagagttatgccaaccatcattgatgaaagacaatcagcctttatagctggtagacatctactacatagtgtagtcattgctaatgaagtagtggaggaagcaaggtgggggaaaaagccatgtttgatatttaaggtggactttgaaagggcatacgattcagtcttgtgggatttcctcttctacattctaaggagattgaggttcagtgacaaatggatccaatggatggatggctgcctcaaatctgcctcagtgtcggtgttggtaaatggcagccccacatcagaatttgtcccacaaagaggactcagacaaggagacccactagcacccctcctattcaacatcgcagtggaagctttaactggactcatgagagaagccataaaaaagctgtccactgaatttctagtgggcgcaaataaggcagctgaatacttgaattgcagaatcctgtctatgccattcacatatttgggtattccaattgggactaacccaaggcatagtgagctgattcccaataaagtggcggtcaagctggtccaaattcagcgaaggttcctatggggtggagggccggatcaaaagaaagttgcgtggatcaaatgggagacaatctgtctcccaaaggaaaaggggggcttgggaataaaagaaatcaggatattcaacaaggcattgctagcgaagtggagatggaacatgctgcagcaaaattcagaattgtgggctagaatattggagtcgaaatatggtgggtggcgagcattagctgaaggcaaacgagccaacaatgaatcaatatggtggtag

SEQ ID NO: 96250 - DNA, 129 bp, Glycine max
  Peptide Sequence Number=SeqID_213028
atgatggggacaatgtcctacccgagacagatgaagataatcaagaagaatcatgcctatagtctcccaaaggacaaagagatgatcttccatacaccatcccaacccttaatggagtggcagatttaa

SEQ ID NO: 96251 - DNA, 324 bp, Glycine max
  Peptide Sequence Number=SeqID_213029
atgtccccccgcgctcgaccaacccgcttctgcttgaccgtgcaaacaaaaaagcgcggccccgatgttccggaggccgcgccaggagagagaatgccgtggaaggggcgggtgtcagaacacgaagctgacgccggccaccgggcccttgaattcctgcttcaggccgatggtgccgtcgctgcccttcttgtccgcgtccagcttgaaccagtcatagccggcgaacacgccgaagttcttcgtgaagcggtaatcgacgatggcgttggcgcggctcaggtcgcccttgtagtcatcaaagctgccccagcgcgtgttgag

SEQ ID NO: 96252 - DNA, 393 bp, Glycine max
  Peptide Sequence Number=SeqID_213030
atgcccgggcttttcatttggaacggcgcaggcgccttacttcttcttcggcatgtacagatcggtgatcgtgccgtcgtagatttccgaggccattgccaccgattcgctcagtgtcgggtgcgcatggatggtgtggccgatgtcttcggcttcggcacccatctcgatggccaggccgatctcggccagcaggtcaccggcatgcacgccaacgatcgcaccaccgatgatgcggtgggtctcttcgtcgaagatcagcttggtgaagccctcggtacggccgatgccgatcgcgcggccactggcggcccacgggaacttggccacgcccaccttcaggcccttggccttggcttcggtctcggtcacgccgacccaggcgatttccgg

SEQ ID NO: 96253 - DNA, 204 bp, Glycine max
  Peptide Sequence Number=SeqID_213031
atggaagctaaaaatgcatgggtggtcgctaaaatccgtctctacttgatttctactactactctgttttgccgcaagcaaaagtggtcgctaagtccgttgcaaaacccttttcagagcaaaacacccaaaactgaaataggggaagcgcttaataggaaaactgaaacagaacacacactaaacaaaataccaggacactaa

SEQ ID NO: 96254 - DNA, 273 bp, Glycine max
  Peptide Sequence Number=SeqID_213032
atgggtggtggtgcatggccgttcttagttggtggagcgatttgtctggttaattccgttaacgaacgagacctcagcctgctaaatagctatgtggaggaattcctagtaagcgcgagtcatcagctcgcgttgactacgtccctgccctttgtacacaccgcccgtcgctcctaccgattgaatggtccggtgaaagtgttcggattgcggcgacgtgagcggttcgctgcccgcgacgttgtgagaagtccactgaaccttatcatttag

SEQ ID NO: 96255 - DNA, 330 bp, Glycine max
  Peptide Sequence Number=SeqID_213033
atggctatgatgagcataaggaagataatgaaagcgaatgcggttacaattgccgctaccagcactgttgctaaggtgaacccgatgcccccatctggcctcaaccaaatgaatcatccaaccttagatatggtaggcaaagatttgggaagtaggggcggcccccatgatgtgcaaattcaaaacgagcacgccttcccgccatatggtttgcctctcaactatacgccacccaatgtggcgtacactcccaataagaatgtcaataactccactcctatacccattgagagccaacaaccccaaactgatcatgcacatgtctcttaa

SEQ ID NO: 96256 - DNA, 1344 bp, Glycine max
  Peptide Sequence Number=SeqID_213034
atgggtgatcggattgaagctctggagacacagatgggaaatgtcacaacgacattgcaagagcttgctctgcaaatgtcacaacacgctcagcagatgcaacagcagagtttggttttaactgagctcagtaaacaaatcggtcagaagggagcaacgcaagaaggtgaggcttctgtgggtgattcatcacagaacgagtctcgtctcgccggaaagaaggtgaaactacccctcttcgaaggtgaggatccagtggcgtggatcacacgtgctgagatctactttgacgtgcagaatacaccggaggagatgcgtgtgaagctgtcacgattgagcatggaaggatccacaatccattggttcaatttgctaatggaaacagaggacgatctttcatgggagaagctgaagaaggcactaattgcgcggtacggtggccggcgattagagaatccgtttgaagagttatctatgttgagacaaacgggaagtgtggaggagtttgtcgaggcgtttgagctgttgtcgtctcaggtgggacgtttacctgaggagcaatacttgggttactttatgagtgggttgaaagcacccatacgacggagggtaaggactctcaaccctaccaatcgtatgcagatgatgagaattgcgaaggatgtggaggaagagcttcgcgaggaagacgatgatgaaaacagaacctctatgaagaagaatgtgggtcgtagtgaatatgggcctggatctaaattccggactgggtccaacctggcccagaaggaaataacccgtttctcaaaatcgggttggtctaacccatctcgcaaaactgtttctattggatccacttccaatacgacgtcgtcgttgagttcaacaggaaggaaacacgaaggggatcgtcgtggtggtacgaacgatcggtggagagggattagcagtgaggaaatggaggaaagacgagctaagggcttatgcttcaagtgtgggggtaagtactaccccactcaacacaaatgccctgaacgttcactgcgtgtgcttattttgggtgatggtgagtctttgaatgatgacggtgagattgtagccatggagggtgaagagtcggaggaggaagagatgacggaggcggagtgtaagttgattggagttctggggaagatgggggagtctcaaacaatgaaaattgaagggaagttggagcatgttaatgtgggtgtgctcatcgatagtggagcaagccatagtttcatctctccagagttggtcactgctttgggtttgaaggttactccaaccactgtgaagaggatcaagttaggggatggtcacaag

SEQ ID NO: 96257 - DNA, 139 bp, Glycine max
  Peptide Sequence Number=SeqID_213035
gaatgctgatgagctagtgggcattgatgagggcccaagacctaaggtatggagagtctaccaaagaaagaataagaagggtattatggggaacgttggtaacagaaagaatgattacgtggaagggaatattgtgtga

SEQ ID NO: 96258 - DNA, 192 bp, Glycine max
  Peptide Sequence Number=SeqID_213036
atggcctctgtggagacctctgccatggctaggtcccagatcttactaaatgtgtatggcacagatgcattttatgaatatgggagcccgggagattgtccccttcttagatacaacattcgggcagcatggtgcccgatgtatgcatttaagaaggcgacacggaccctccatcagttcgtgacaaagtga

SEQ ID NO: 96259 - DNA, 1323 bp, Glycine max
  Peptide Sequence Number=SeqID_213037
atgacggctgcggcgcgccaggtcgatgacgtagtcgatgacgaacggcgcgcgcttctggtaggcctggatcacgaagccgatgccattccagccttccagctcgggcgtgaagcacagcgcctccagcagatccagcgagatttccaggcggtcggcttcttcggcatcgatgttcaggccgatgtcgtagctgcgcgccaggatggtcagcgccttcacgcgcggcagcagctcggccatgacgcgttcgcgctgggcgcgcgaatagcgcgggtgcagcgccgacagcttgatggagatgccggggccttcatagatgccgcggccggcggcggccttgccgatggcgtggatggcctgctcgtacgaagcgtaatagcgctcggcgtcctcggccgtggtggccgcttcgcccagcatgtcgtacgaatagcggaagccgcggccttccatcttgcggttgttggccagcgcctcggaaatggtctggcccgacacgaactgctcgcccatcatgcgcatggcgatgttcacgctcttgcgcaccagcggctcgccgcccttgccgatcaggcgcgtcagcgccttggacagcgactgctcgctgctcacggccaccagcttgccggtgatcatcaggccccaggtggcggcgttgacgaacagcgactgcgaaccgcccatgtgcgatttccagtcgccgcgcgagaccttgtcgcggatcagcgcatcgcgcgtggcgcggtcgggaatgcgcagcagcgcctcggccaggcacatcagcgccacgccctcctggctggacagcgagaattcctggatcagtccctcgacgccgccgccgctgcgcttgccgcgcagcttcttgaccagatcgctggccatggcatgcactttttccaggttcggcatgcgagcctggcccagcaacagcggcacgcactcgggctcgggccggcgataggccgccgtgatggccgcgcgcagcaccgattgcggctgcacgtcctggccgaactcgtagaacggcggcgtggcggcggcctggtgctcaccgccgtcttcatcgcctccctcgtcgccgcccaggtgggacatctcggccggcaggtggccacgctcgatcttgtccaggtaggcgagaatcgcctgcttgtgcagccagtgcggcgtgcaattgagtttttgcgcggcggccttcaggcggtcgcgcagcgcgtcatcgaccttgacgccgagggtggtgctggccataagagattgcttcctgtcgcatggcagaggtcacaccgggcacgcaaaggggcccggcatcggtag

SEQ ID NO: 96260 - DNA, 940 bp, Glycine max
  Peptide Sequence Number=SeqID_213038
atgtcgaagcttgaatatcttgatttgagttatgcaaacctatccaaagcatttcattggctacacactctccaatctcttccttctttgacccacctatctttgtcacactgcacactccctcactataatgaaccatccttgctcaacttctcatctctgcaaactctccatctttccgctactagttattcccctgccatttcttttgtccccaagtggatattcaaattgaagaaacttgtttctcttcaattacagggtaatgaaattcatggtccgattcctggtggtattcgaaacctcacacttcttcaaaatcttgacttgtctttcaattcattctcatcttctatacctgattgcttatacggttttcatcgtctcaagtctttggacctaagttccagcaacttgcatgggactatttctgatgccctgggaaatttgacttctcttgttgaacttgatttgtcatataatcaacttgaaggaaccattccaacttctttgggaaatttgacttctcttgttggactttatttgtcatataatcaacttgaaggaaccattccaacttctttgggaaatttgacttctcttgttgaacttgatttatcacgtaatcaacttgaaggaacaattccgacttttttgggtaatctccgcaacttatgggagatagatttaaaatatctctatctctctattaataaattcagcggaaatccatttgaaagtcttggatcactctctaaattgtcaacgcttcttattgatggcaataattttcaaggagttgtcaacgaagatgatcttgcaaatcttacaagcttgaaggagtttgatgcatcagggaacaatttcactttaaaagtgggtcctaattggattcctaattttcaacttacctatttggatgtgacatcatggcatatag

SEQ ID NO: 96261 - DNA, 295 bp, Glycine max
  Peptide Sequence Number=SeqID_213039
atgggagatcacttggaggacatgattcgtgaccttggacaagagtcttttcaggaagcacatgcccctgtgtatgaaggattgcagagtgattcaaagaagcctttgtatacgaggtgcaagaattccttaactctgttgtctgtggtgttaagtctggttaatgtgaaggccaagtatgggtggagtgaccaaagtttcacctcactgcttgaggtagtgcacaatctgcttccagaggacaacacgctacctaaaacttactataaggcgaaaaagatactgtgtcccatgg

SEQ ID NO: 96262 - DNA, 303 bp, Glycine max
  Peptide Sequence Number=SeqID_213040
atgcaaaagcccggagcagttgttggtctctccggtatcttatcggagcaggtccagtacattattgaaagatattcaccattcttagaaggcatagaagtgtccaaaatggatgactgggcctgtaggtttggtagttcgcagccaatccctcactgcagcttgatgccacccagtaaattttgtgtggggcagcttctaacctgccacttgacaatgcattttggaatggtcaatgttgtctttggttgtaattcatttgccaagcagaaaattagactgaaggggcaatgcagagcataa

SEQ ID NO: 96263 - DNA, 603 bp, Glycine max
  Peptide Sequence Number=SeqID_213041
atggatgaacacgatcattgcagcacacttgtgttgtgcatagcacaactgccaggaggtgcccaaatattcttcaagtcatcctttttaggctactttcctacttgttccattcttgttgcattgttaactaaaaacgcgcttcaattgttgctaaagactaaagtggatttgaaggccaagaatttggagaactcaacagcactagatgtagtaactagcgcagagataaggaatgcattagttaaggctggtgcaaaacaaggttcatcagttactaatgctcccacccttgcagataaactaagatggaacatcacactcatgggaaaaataactatatttgtacttcgcattagaagcgacataacagaggaccaacgccaagcttttctcatagttgctgctcttattgcaaccgcaacttatcaatcagcactaagtccccctggtggagtttttcaggctaatgctggaaacaataataataataatgttaatatcacttccctcaattctactactattgctacccaaggaattaatgttgggacttctgtcatttctgaagaaaatgaagtctcagaagatgaagggttgtga

SEQ ID NO: 96264 - DNA, 379 bp, Glycine max
  Peptide Sequence Number=SeqID_213042
atggtgatcgtggcacgcacgtgtgtgaacatggtgcaccttttgcacgtgtggctactgttcaagttggcatacgtgtcgcgggagtcgcttgtgatgggggataagaaggtaggtgaaaagcttcaggtggaagagaacgacagcaaggataagaaggtaggtgaaaagcttcaggtggaagagaaccacaacgagggttttgacaacatcgttttgccaaagcttcttgcagaggtgaaagggtttgtgaggttcgacggtaagggtgcggaagcagctagcggtgatgtgctggttggattagaggttgtggccatggaggcggagggtggaggagtctttgtggaagtcgtggcacgtgactttgatgtcgagg

SEQ ID NO: 96265 - DNA, 465 bp, Glycine max
  Peptide Sequence Number=SeqID_213043
atgcctcacgcgtcgtgcaattctggataccatcatgtgcgctcatcgaaacctcactcgccgcctcacacgtcgctgcaactacacatacattcgcttcactcaccttcttgcagaatgcgggttgacagaatcaacgggatccgattcatcttcagcggaggggctttaggtgagaacctcaaaggagagttttctaacgctgcgaatgagagtttttttgccaccgcggtagaggtagacggttccgatgtcgccgacgccgatgtggcggaggaggtggaagtcgcggaaggagagggcgaccttgtggaggaaggtggcagagcggatggcggagtaggcgaagttggaggagtagtgaggcttgatggagagactctccggcgaaggaggcacgatgatgacgaattgaggagcagaggagttgtcacatggcagaggtttctttggagcattgcttaa

SEQ ID NO: 96266 - DNA, 564 bp, Glycine max
  Peptide Sequence Number=SeqID_213044
atggagagggagtcccaatctaaatcgattgatgtacaaatgggagatcgcttaaaggaaatgattcgtgacttggacaagaatcttttcagcaagcagatgcccctatggtgcaagaagtctttaacgttgttgtcagcggtgttaagtctggttaatgtcaaggctagatatgggtggaatgaaaaaatcttcacttcacttcttcaggtggtgcatgatatgtttctagaggaaaacacattgcctaaaagtttctatcaggcgaagaagatattgtgtccgatgggtatgcagtaccaaaagattcatgtatgccccaatgattgcatattgtacagaaatgagtttgaagaattgcacaattgtcccaagtgtggggtattacggtacaaggtgaaggatgatgacaagtgtagcagtgatgaaagcaccaagaaaggccccccgatgaaggtgttatggtatctttcgatcattctaaagcgtttgtttgctaatgcagacgatgcaaaagaccttacatggtacgcagatgggagaaattgcaatgaaatgctttga

SEQ ID NO: 96267 - DNA, 210 bp, Glycine max
  Peptide Sequence Number=SeqID_213045
atggaacatggcgatgacggcatcgtagaacaaacgtcccaaacacatactgtgatgcaatcctaccccgcaagggcattgaatagaagactccaagaagattgggccagagatgcaagagaaggccctagggttctcatgagccttagggtaaggtaccctagaagtgtaggatttttcagcccttatattttaggacacctagactaa

SEQ ID NO: 96268 - DNA, 291 bp, Glycine max
  Peptide Sequence Number=SeqID_213046
atggaagctataaaaaggaagaatgaaaaagcatggttatatttagacaagtggccctgtgaatcatggaccaaagcttacttcgatgaaaattgcaaagttgacagattaccaacaatgatttcaaggccagaaaaggagaaacttgaatccaacaagtggactgcaaactgggttgatgatcctgatggaactagatttgaggtatgccatcatgaaacaagaattgatgtcgatctatgttcgcggttggcaagtgcaccagatcgcacaagtagtataaaacggtaa

SEQ ID NO: 96269 - DNA, 792 bp, Glycine max
  Peptide Sequence Number=SeqID_213047
atgctgatccagagaggaggtcctgttagtgacattgggctagtgattgaagtacatgcaatgcctataaattgcagtgcagaaaacgtggttgaggctgttgctgaagagtgtactcataatgatattgaagatatggatgttgatgttgctaaagaaactgaagttgttgaaatagaacttgaagttgttggagttgaaactgaagtgaacaatgatgcagatgatgatgaagttaaagaacatgatgggcatgctgagttttctaattattttgaatgtgacccagactacgtatatgtgtctctagaagatgatggacaatcaactgcacattggcagatagttaccagtctggagaatttcaatccctttccaacaatgatgatgaagagatctgaaatggatgcatgcaagaaaggattcaaggctggctacagaccttttattggtcttaatggctgtttcctgaaagggtactatggcggtcatttgcttgcagcagtgggacaagatgcaaacaatgttttttttgtgattgcgtatgaaatagtaaatgctaaagataaagataactggaagtggtttgtcactttgttacatgaagacataggagactacaagcaatatggctggaatttcatgttagacatccaaaagggtttgtatcgtgcaatgcatgaagttatgccaagtgtgaaacacgggtattgtgttatgcacttatggaggaatttctcaaagcagtggaaagacaaaaagttaagaggcctagggtggaagtgtgcatga

SEQ ID NO: 96270 - DNA, 310 bp, Glycine max
  Peptide Sequence Number=SeqID_213048
atgactatgcaaaacatgcagtttcaacaagagaccagagcctccattcagagcttaactaatcagatgggacaattggctacacagttaaatcaacaacaatcccataattctaatagattaccttctcaatctgtccagcatcccaaaaatgtgagtgccattgcattgaggttgggaaagcagtgtcaaggacctcaaccagcaacatcttcctcatccgcaaatgaaactgcccaacttcactctactccagaaaaagatgatgacaaaaatttaaagagtaagttacctaacaatttctatgcag

SEQ ID NO: 96271 - DNA, 351 bp, Glycine max
  Peptide Sequence Number=SeqID_213049
atgagagaaaagagagaacaagagaaagaaaatagtgaggcaccacagaggaataggataaagaagactgatacacttgagggaaagagtgatacacataagagaaagagtgatacacatgagagaaaatttaattgtttcgcagaggaatttaaagatgtctttcctaaggagatttctcatggactgccaccttcaagaggcatagaacatcaagttgatctcctgatgagaatcctgaaactgaccaaatacaggctaaaggcccaggtggagaagggcgaaggcccaagtggagaaggacaaagcccccgagtggagaatgatgaaggcccaagtggagaaggatga

SEQ ID NO: 96272 - DNA, 1083 bp, Glycine max
  Peptide Sequence Number=SeqID_213050
atgcagagggggtctcaaactgaatcggttgatgtagaaatgggagatcaattagaggatatgattcaagatcttggacaaaagttttttcagcaatcacatgcccctatgtatgatacattggaaagtgattcggaaaagcctttgtattcgaggtgcaagaagtctttaacgttgttttcagcggtgttaagtatggttagtgttaaggccaaatatgggtggagtgacaaaagcttcacttcactacttcaggtactgcatgatatgcttccagaggaaaacatgttgcccaaaagttactatgaggcaaagaatatattgtatccgatgggtatggagtatcagaaaattcatgcatgccctaatgattgcatactgtacagacatgagtttgaagaaatgcagaaatgcccaagcatgcctccttggttgtgtatgaaacgaaaatacatgatgttgtctatgatgatatcgggcccaagacagcctagaaatgacatcaatgtttatcttagccccttggttgaggacttgacaaagttgtgggacgaggggtttaccgtgtttgatgggtatcgaaatgagacattcaagtcgatattgtttgatcttccatattggtctgatctagatgttagacattgtatcgatgttatacatgtggagaaaaatatgtgtgatagtgtcatcggcacactccttaacattcaaggcaagacaaatgatgctaaacaagagtgttatgttgaagatccttgtgatgaaaggtggtcagtggttctacacggaaaaaccattggtcttaatcttgaagatgatgattcaacccttgatacttgtctgactcctttctccacacaaatgcctaatgtcaaaggagaggaagaagttgatgacatccatgcaaatccaccttcgtcgtcttcgttgaagaagactagaaaagcaacatggctcagatcactggctgctaggcccgtcaggatggagagaccagtggttcatgtggatcctgccactagaaaagttgattgtccccacaaaaagcaattaaggacgtatttggggattgttgcttga

SEQ ID NO: 96273 - DNA, 1779 bp, Glycine max
  Peptide Sequence Number=SeqID_213051
atggtgcttttgcagctccaatcaggtcctccacttgatgaaatgtcaattgcttgcattctacgtgatttgcttcatgcaattgattacctacataatgaaggaaaaattcatagagacattaaagctgcaaacattttattgactgataatggtgatgtaaaggttgcagattttggtgtttctgcacagttaacaagaactatatcaaggagaaagacctttgtaggaacaccattttggatggctcctgaggttattcaaaactcagaaggatataatgtgaaggcagatatatggtctctgggcattactgcaatagagatggcaaaaggggagcctccacttgctgatcttcatccaatgagagtgcttttcatcataccccgagagaatccaccacaaaggccaagtgctaaggagcttcttagacatcgtttcattcggaatgctaggaagagtccaaagctattagagagaataagggagcgtccaaagtaccaaataaaggaagatcagatgacacctagaaatgccccaagggggatgggggaggcatctgatactattaaggttgccaaagatttaaggggtgacgaaactaatcagcctagtaaattttctgatggacaatttctaaattgcagtggccaaggtaaatccctgagaagttctggatgggacttcagcattggtggatctcaaggtactggaacctttcgtagtgtctcacggccaccacagtttagagataagaaaattgaactttcaaatcatcagcttaaccaaagaaaaagtccagagagtggctatcaagtgggatctgacaataaaagtgcacataatgagtcgctagaaacttattttggaaaagatcttggagttgcctaccatgatgaacatcctgataatcaccttgaagatgatgaattttctgggaatggatcaggaactgttgttattcggtctccaaaaggaccccagccatcactgtttcgtgaccaaagttcccggtctagcagcagctatgcttcttttgaagatgtttctaccagtggaactgttgttttgcgtagccagtacaatgattctgattctccacagacaccaaggtcccgactgggacttaatagcagaaattcaaatgcctcactggaagatagtgctacaaatcttgctgaggctaaggttgctatccaaggtggattaaggaaagtgaatatccgagagagatttgcattgggaaaactcaacaatgatgtacaggatagcaggagaggtcaaatatcaagcagctctgattcttccagaccatctcgtgaatactttgatgcacaaaagggattttcaagatcacactatgctattgatgatgaagaaagtgccaaaataatctcatcctctgcgccgctatccgttttgcttattccttcattaaaagaggccattgctgatgatccagacgggtcaatagtgcaaattgttatcgatgctcttgtaaacatggagagtacaaagccccaatcctgtgatgttcttgtcaaaaagttgcttcagcagttggcaagttcaaaggaatcttcattgaaggacctgcaagaactggctggccaaatattcagcaagaccaaatcagctgaagaaaaccgaaatgcagagtctgataacaagaagaaacaaaacaaggaagttcattcaaatagcaatttaagccctcttgcaagatttcttctctcaagatggcaaggccaaacctcgcgggatctaaatccagcttga

SEQ ID NO: 96274 - DNA, 2514 bp, Glycine max
  Peptide Sequence Number=SeqID_213052
atgccttttggattgatgaatgctccagcaacatttcaggcaacaatgaatgatatattcagaccctttcttagacagtttgtgctggtgttttttgatgacattcttgtttatagcaagaatgaacaggaccatttgaaccatgtaaaactagtgctggaagttttggtgaagcattgttttgtggcaaacaagaagaagtgcagttttggttgttcacaagtggattatttaggccatatcatctctgctgctggtgtgtctgttgatcctagtaaagtgaagtgcataatggagtggcctgagcctaagactgtaaaaggggtgaggggtttcttaggtctcactggttactataggaagtttgttaaagactatggtaaaattgctagaccactcacagatttaacaaaaaaagacaacttcttatggaatgagtctgctagggaagcttttcagaagctgaagacagtcatgaccacatctcctgtcctagcattaccaaactttgatgtggcttttgaagtggagtgtgatgcagctggtaggggcattggagctgttcttatgcaaaacagacaaccaattgcctatttcagcaaagccttgtctgaaaataacttggctaagtctgtttatgaaaaagaattaatggcattggttctttcaatccaacactggagacactacttgttagggaaggaatttgtagtgtatacagaccataagagcctgaagcatttcctacaacaaaagatttcttcaccagaccagcaatgttggttggctaagctgttaggctaccaatttgaagtaaagtataaaccgggtttggaaaacaaagctgcagatgcattgtccagatgctatgatgattgtgagttagcagttatggcttattcacctgtgtggataggtaggcagcaactgctgaaagatgtggaaaatgatgtgtcggttcaggaattgctaaagaaagtggtggaaaatcctgacaagtaccctggttttgtgatacatcaaggggtattgttgtatcaggatcgtttggtgataggtaagaattcatcaatgattcctcagctgttaaaagaatgtcatgaaacaccaatgggaggtcattctggatttttgagaacttacaagagagtagctgagaacttgtattggataggtatgcagaaaacagtcagggactatgttagagcatgtgatgtgtgccaacgacagaaatatgctactacaactcctggagggttactacaacctctacccatacctaatgccatatgggaggacttgtctattgatttcataactggattgcctaagtctaggggttatgaggcaatattggttgttgtggataggctctctaaatacagtcatttcattttgttaaaacatccctacacagctaagaccatagcagagatttttgtgaaggaagtgataaggctacatggcattcctatgtcaattgtgagtgacagagaccctctgttcattagtcatttttggagagaaatttttaagctacaggggacaagtctgaaaatgagttcatcttaccatccagagacagatggacaaacagaggttataaaccgatgtttagagagctatcttaggtgttttgtggctgaacaacctaaaacctggtcttattgggtgtcatgggcagagtattggtacaatactacctaccatgagtcaattggaaaaaccccttttgaggtagtgtatggcagacaacctcccaagttaattcgattccttagtaatgaaactaaggtagctgcagtggctttggaattacaggagagggatgaggctttgagtcaattgaaagctcatcttttgagggctcaacaacagatgaagacttatgctgacaagaagagaagagatgtggagtttgaagtgggagagtgggtgttcttgaaactgaggcctcataggcagcagtctgttgtgaagagaattaaccagaagctagcagccagattttatggacctttcaaaatcattaaaaaaattggtgcagtggcctataaactgcaactgcctgatcagtccaaaatccaccctatatttcatgtttcattgcttaagaaggctgtaggggaatatcatgtgcagaatgaattgcctaaagatcttgaagtaatcatggatgaggaaatttatcctgttagagtgctgggtactagaatcattatgaagaatggcagttcagttcctcagagtcttattcaatggaaagacaagtctattgatgatgtgacatgggaagatgatgttgttattaggggacagtttccgaaatttaaccttgaggacaaggttcttattgaagagggtggtattgataggaatgctgatgagctagtgggcattgatgagggcccaagacctaaggtatggagagtctaccaaagaaagaataagaagggtattatggggaacgttggtaacagaaagaatgattacgtggaagggaatattgtgtga

SEQ ID NO: 96275 - DNA, 177 bp, Glycine max
  Peptide Sequence Number=SeqID_213053
atggcgagggtagtgcgttcccctaagggtttgagggatgcgaagtctccttcgtggtcgaaggattctgtttctgagagcgagcaatcgaagaagagatcttcttcttctccgaggccctccaaagatggtaactccatcaagtctaagtccaagagttcaagagtgttgaggtga

SEQ ID NO: 96276 - DNA, 369 bp, Glycine max
  Peptide Sequence Number=SeqID_213054
atggaatcatcgtcagctagtgtcttcgtcgtcaacaaacagttgttttggggtttcgacgatgactgtaacgacgttgttgtcattatgtttttcgtggtggtcatcgtccatctggcctctatcgtcaaacctcttatcttgatgtatgatgaaatgagtcttattttgcaccacaatggtaaatttatacaaaatgaaaatggggcactggagtatatcggtagtgaattctgtgtctgggaagaagttgaaacaaatttggttaatgtgtggacaccccaagaattgtgcaaagcttgccgcaactatgtgaactttgtttcagtatgctatttggtgtctggtattggtttacaaaggctttag

SEQ ID NO: 96277 - DNA, 750 bp, Glycine max
  Peptide Sequence Number=SeqID_213055
atggctggtgtttgcttttggatcttagcaccattgagatatgccactgtctatggatgctcagaagcaacaatagttctaggagtgcccaagaagacatggacgacgaagaatccaaaagcaatcccatttgtgtgtttgcatatgagaagggagggctatcaaactaaggtgtgcataaaggttattggtgagaagagtgcgaagatggtgaccgacgaaggtgcaatatatgttattgcaaacagaggttacaactggagggctattgtccaggaaactgtgtcagctactcttaacagtatgaaggtgctgccagggaaggtgggaaaggacccagtatatgggatactttcgctcataaatacccaggtgctgcaagggaaggtggaaaaggaccaagtatatgagatactttcactcataaatacccaggaaccaaatcaaccaatggtgttcaagcaaaagaaaatgtcagttgagcagattatatgcagcagaaaaacaatgcagaatgagcatttttctgtttttgttaattggtatgtttacaaggtacacgttactaatagcaaggtagttcataggttcataccagattatgcattatctgtagcttgtattaacatcaatggatgggaaatgatgatagcgcttggtttcatggctgcaacaagttctaaatttgcagtgttagagtggcaaatgaacttggaagaggaaactcacaagctgcaaagttctctatag

SEQ ID NO: 96278 - DNA, 288 bp, Glycine max
  Peptide Sequence Number=SeqID_213056
atgcaagaccagacgatgcgccgcgagtcccacccacaaacacgacgagctcaagagaagtttggcagcttgctggttgtgtcaacgacgagctcgagagaagcttggaagccgcgagtaccacgagccatgacccacgaggtccacgacaagcttgagagaagccgcgagtccagttgttgtgatgcatttgctttggtggctttgcctaaagcttgggttaagtggtggctggacagaaatatagaaatggcaataacggaagctacagagctccaaatgaggtga

SEQ ID NO: 96279 - DNA, 225 bp, Glycine max
  Peptide Sequence Number=SeqID_213057
atggttcattttcatgttgggctggaggagtccccatttggaaagagaaggaaatacagactaattagggcttctcttgttgatttggacaggtccttcggtacatacttttgtgactacactaagtacatacttgtgatggttgcacacgacgccgatgcaccacgaaggctgtacgcaatgtcgacccaccacggatttcgtaaaatgcacttacctagatga

SEQ ID NO: 96280 - DNA, 345 bp, Glycine max
  Peptide Sequence Number=SeqID_213058
atgacatctgaggcaacatgcgaaattgtagataggattatgcaaccccagggatctgtattgcctcctgagcccaaggttggtccttctgtttctcgtgttagtacaaagggaagctgtgtcgatccctcgggggataaacaaggagtcgagggatccaaaaaacctgtagataggccagaacctgatgacgatcccctaggccagatgacattgacgatctcggggcttttcctcatgcctatgcaagtgtcgtgggattcaactgtgtttggggattcaatgatattcaaggaagtaaatccaaggctactgctaaatggattccagttaaagtttggctaa

SEQ ID NO: 96281 - DNA, 600 bp, Glycine max
  Peptide Sequence Number=SeqID_213059
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaaacaacaagggactgggtcaattattcaatcaaatga

SEQ ID NO: 96282 - DNA, 618 bp, Glycine max
  Peptide Sequence Number=SeqID_213060
atggctctagacgacagtcataagcacaaacacacgcagtcacgaccaatggcaacaagcgacaaccataactttaacgagcatggcggcggcggtggcggcagcggaagcaacaatgacaggagaggccttttgacgccaacacagagctttggacacaagacattagctcactccctaagggatcaaatatggtgcatctcatgtcttcaaaatgcaaggcacataaaacatctgattttcgacatctcgagggagaagattttgagcctaggtgatcatggtgaagggggttttgagctcgagggacttggtcttgccaatgctgggctggccggtcaagaggattgtgcggtcggcgattttgtcgtcttagatcatctggaggatcacgccagcggcctttacgcgactccagagaggatttcaggccaaggccgtgaatatggaaatgcgtgcccacgcgctctatgtgggtcagatcgcaactctcaaagttttagctccgccattgtagaaacaacaaagatggtgggagggagaaagagggttttgagggtttggtatttggagagtgagaatatgtattcccactttagagtgcggggcagtggttag

SEQ ID NO: 96283 - DNA, 1106 bp, Glycine max
  Peptide Sequence Number=SeqID_213061
tagccgctcaagaaggagatataaaccttctctacacagtaattgaggaggatccacaagttttggaacacaacgatttaatatcatttgttgagacacctttgcatattgcttcatcatgtggtaatattgggtttgcaactgagattatgaggctaaaaccatcattagcttggaagttaaatcaacaaggattcacacctatccatcttgctatgcaacacagccataagagaatggtgcatcgcttagtagacatcaacaaagaattggttcgagccaaaggaagggaaggtctcactcctttgcattttgcaagtcaaattggagaaattgaccttttggctaactttctcttggcttgtccagattccattgaagatgtgactattagaggtgagactgcacttcatattgcagtgagatatcgacagtatgaggctcttcaactcttggttggatggctcaagggaacatgccagaagaatgccatgcagatagaaaaaacaatactgaactggaaggacgaggaaggcaacaccattttgcacgtttctgcactcatgaatgactcaaaggtgcttcaattgttgctaaagactaaagtggatttgaaggtcaagaatttggagaactcaacagcactagacgtagcagctagtgcggagataaagaatgcgttagttagggctggtgcaaaacatggttcatcagttactaatgctcccacccttgcagataaactaagatggaacatcacactcatgggaaaaataattatatttgtacttcgcattagaagggacataacagaggatcaacgccaagcttttctcgtagttgctgctcttattgcaaccgcaacttatcaatcagcactaagtccccctggtggagtttttcaggctaatgctggaaacaacgataataataatgttaatatcacttcccccaattctacgactattgctacgcaaggaattaatgctgggacttctgtcatttctgaagggtggacattttccgtagtgtgcaagagacttaagattcatgaaaagatgagggatattggaacaaggaatagtacaggaagaaatatatggtag

SEQ ID NO: 96284 - DNA, 258 bp, Glycine max
  Peptide Sequence Number=SeqID_213062
atgcagcatgtgatcttctctacaataattacaagtgcatctgtgtcaaggcgtgaagaaggtgtgaagaagggtccacattggtctcgttggtgctactggcgggatgcccagtcagcacctgtctcgctggtgctactggcgggttgccctataatgctgttggtgctggcggcacccagccacgtcagcaccattctcgccagagctagtggcgacatcaatggagtcgctgatgcagctggcggcatcaaatga

SEQ ID NO: 96285 - DNA, 255 bp, Glycine max
  Peptide Sequence Number=SeqID_213063
atgtacgaaaaagcatggttggaaaagaaaaaggttattgaaaacatctacaacaattgggaaatattgtaccacgatttatcgagattattgcaagctatgcaacactttcatcctggtatggtcgtggaaaaggaaacactgtcaatgccaccacaaggaggtaagtacaaggggaccctccctgtggcagttgcacaagatgacaccaataaaattcttccaatagccttttctattttcaagagtgaataa

SEQ ID NO: 96286 - DNA, 459 bp, Glycine max
  Peptide Sequence Number=SeqID_213064
atggaagaagaacttcaccaattcactataaatgatgtctggacacatgttcctaaccttgaaaacaagagcatttttggaacaagatgtatttttagaaacaaattggatgaacaagctactaataaatctctatgcaaggacttttctaatatgatgaaaagtgagtttgaaatgagcatgatgggagaacttaagttttttctagggcttccagtcaagcaagacagtaaaggaatacatattcataaacaaaaatacactaaggaacttcggaaaacgtttaagatgaaagactatgtagaagatggagtggaacaaaaaagcgcgagtggtggatgtcactatgttgtaccttctatgatatcttgggccaacaagaagcaaaactctatcgctctatcaacaacaaaagctgagtatgtgtctactgcaagttactgctcacaactgttatag

SEQ ID NO: 96287 - DNA, 330 bp, Glycine max
  Peptide Sequence Number=SeqID_213065
atggctgaagacattgaagtctttgaaattgagtatcatacgctaagcgaggcagcagcgcgcttagcgagtaaaaggaatcttgaagggaatctgtcacaccagcacacgctcaatgtgtcattagctcgctcagcgagaagcttgtctcttctggtgcttagcgcacttggctcgctgagccaaagttcactttctcgcactaagtgcgaaaatggcgctaagtgcgtcttcgaggttcctagaggtggaggagatatccctactactgtgtatctgtcaattgctcttaaatccctcttcctacttgtaaaaggtgcttccttgtga

SEQ ID NO: 96288 - DNA, 279 bp, Glycine max
  Peptide Sequence Number=SeqID_213066
atgcaagtatatccattggtggtcaggcgacctattgattataatccttccttagctgctaccctaggcccaaggcaacctaacccaaacctgaatcagggtgttgttagcttaacacctgggttggccactggacttcatgccagcctcatttctcaaactcgtgcagtttcttcagatgagctcaaaaatgatgaagaatatgatgagatacttgatgatatgagacaggagtgctcaaaatttgggaatgcattcaaagacggttattacgaataa

SEQ ID NO: 96289 - DNA, 201 bp, Glycine max
  Peptide Sequence Number=SeqID_213067
atggagaagatggatgtgcacataataacaagggggacccctaaggcctctccctcaacctccctaggacacctatttataggaaaatgggcacttggggcaaaggtagctcgcccaagcgagctgaaacttagtgttgaagcaattagcttgcccaggcgagctggagctcgcccatgcgagttggtttcttctccatga

SEQ ID NO: 96290 - DNA, 306 bp, Glycine max
  Peptide Sequence Number=SeqID_213068
atgggcccgaaatctaccctaaggctcatgagaaccctagggccttatcttgcatctctagtccaatcatcttggagtcttctatccaatgcccttagggggggtaacctcatgttagaaccccttgttgatgccattaagatcattgaagagatgtgctccaacctctataacaacttaggggatatgagggttatgaagaaaggcgtcaaccaagtggagaaggatgatttcctaactaaattgggaaaacatatgcaagctctgacactaaatattgagatacttatgagagctcaagcctag

SEQ ID NO: 96291 - DNA, 231 bp, Glycine max
  Peptide Sequence Number=SeqID_213069
atgttgtcaggtagtgttcctcatatggaattgtcggacaaggagagtttcacaagtgacaaactgctacctcagttggagaatgttgtgcaagtgttaatgcaaaagacaatgccgaaatgcatgaaaagatcatcatctcataccagactctttcacatacgatcgaccacctcaactgcaatggcatattttggtgaacgaaattgttctgactcacgtagattcaag

SEQ ID NO: 96292 - DNA, 276 bp, Glycine max
  Peptide Sequence Number=SeqID_213070
atgtcttcgtcaaacttgtggtgcttcgtctgcctcttcacaacaaaaacaactcctccgccattgctcacccaaccctattccatttccctcactccttcactccttcactcagtccctatcaaaatgcacagtgcaacgcacgccgaagcagagcgtcttctcagcatgcaatcccatattcgcgaccttggcttggactcctccttggagctgcacacagtctcggaggacatggtcgggcaaatcacaatctcaccggcccctttgatttag

SEQ ID NO: 96293 - DNA, 578 bp, Glycine max
  Peptide Sequence Number=SeqID_213071
atggaggattcaatcgggaaaataacaaagatcacatttcccagtcaagagggtccgctcttgacggtgaagaacacattggagaatggaggatccaatcgggaaataacaaagatcacatttcccagtcaagagggtccgctcttgacggtgaagaacacttatcaaaacggacgacctcgagggggggcccggtaccagcttttgttccctttaatgagggttaatttcgagcttggcgtaatcatggtcatagctgttaccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 96294 - DNA, 183 bp, Glycine max
  Peptide Sequence Number=SeqID_213072
atggcaataactgaagctacaggggctccaaatgaggtgattccaaaacgagaggtggattttctggaattgtggtttgaaagaacaagggtgaagatgaaaggaaggaaagaatcactctttccagcgagggcaacacacaaaggttgtgaaagtcctttgatacagccagggtgttcttga

SEQ ID NO: 96295 - DNA, 294 bp, Glycine max
  Peptide Sequence Number=SeqID_213073
atgaaactgcatgaccttgtacccatcggtgatgcaccacgcattctcctcaccgtcattgccctcagtgagcatcgcggtggcccgtgccttcactaccttgcgaaactcctcgaaccgcagcacgatgcgcgcttgatgtttgggggtggtggtgatgactttgttgtgattggggttgttgtggttttgggcatggtggttcatgcttcgaatttaggtttcaagtggggttgtgactacggttgttgtggttttgggggcagtggtgatgactttgttggtgacgattaa

SEQ ID NO: 96296 - DNA, 393 bp, Glycine max
  Peptide Sequence Number=SeqID_213074
atgatttgcattagttcaatatttcatgaagttgaggatataaatgtgagcatttcacatgcagctgattctattggtttgaaggagataccaagatatgaagttaaaattgatgacgaggaggactggatgaaaagatctcaggaatcacttcatccagttcaagttactgaagggctatgggtggtgcccaagtggtgtactccaccggatgttcaagcaacaaatataattgtcaatcctggactagcctttggaacgggggaacatgccactaccaaactctgtctattactcttacatggttgtataaaaggaggggagcacattctggactatggaacgggaactggaattcttgcaattgcggctcttaaggtaatcaactgttga

SEQ ID NO: 96297 - DNA, 633 bp, Glycine max
  Peptide Sequence Number=SeqID_213075
atgacagcctggaatttcctcaaacagttaacgtgcaccgttggcgctcattctcccaccctctcccgtcgcctcatacactactcattacttgttccctctctctccgctcatcacaaaattgttaggtaccaatggcttccccatttccgtgtcaatctttatgccgcagttccaaatgcaaagttttcaacagcttcttcttcccaaactctatcagacacgtctttggctccacgtgctccttatacttccgttttgattcactgtcctaaagacactgcagatgtgcttgcagaagctcttttatgctttggtgcaagttctgttagcatggatcaagatgatgtctctcaaagtacagatgaggttatcaagaaaatatcttctgattgtctagttattgaagaatatcatattaccactgatgaagaagcaataaccaaaggtggacctcttgtcagtgggagagctttgtattcatgcaagaggccttttcttggagcttctttaatatatttcaggatgttaattactgcatcccaatgtctggtacatagagagttaggaaactcacttaccatactaatcgcaaaggagatatctggactaagtgatagtgagataatttag

SEQ ID NO: 96298 - DNA, 392 bp, Glycine max
  Peptide Sequence Number=SeqID_213076
ggatcgcacccgcaagacacccagtggacccggagaaattcaacagggtcctggggtttccagctctgattacgggcctttgtcagttctacagagtgcccatcgcacccaacaaggtcatcaggccccccactaatcgagctttcatcaagaagtactgctcccccaggcaggtgcagggtgagacaccacaacagcctggggatggccggcagcgggcaacagacgcactgccgccacctctagagtacctcagctcatccacaaaaaggttagagcattgcctacgacacatggccgaccaacaagtcatcatgcgtccggctcaagacgttaaagaagcgctactaggaggcaacctagtaccctttaaatttctgcttgtcatttga

SEQ ID NO: 96299 - DNA, 207 bp, Glycine max
  Peptide Sequence Number=SeqID_213077
atggtactagagtctattctagatccatcattgggtcacctgcatttggcacactctaggctgaaagtcctgggagtgagggagaaaaatgaatcacatgaagacagtacaaatggagacttcaatctcttctccgtctctctaacgtttgggaactctatcagagcagttggaggaaaaactgaaagaatcttaggaaaccgctag

SEQ ID NO: 96300 - DNA, 498 bp, Glycine max
  Peptide Sequence Number=SeqID_213078
atgccgcgcccgtccatgatgccgccggaggcgatcaccgggatcgacaccgcgtcggccacctgcggcaccagcgccatggaaggtgccgcggtgcccgcccgcctcggggccctgggccacgacggcatccaccccgtcctgttccagggccacggcctcgcgcacggtggtggcggtgccgaccgtcaggatgcccagttcgcggcagcgcgccagggcgtcggccggcatgtttccgaaggtgaagctgaagaccgagggccgcaggagcagcaccacctcgatctggccgggcagcggatcgggctgcggcccgggcgccacgggcgccggcaggcccaattgggtgtggtagcgcgccagcaggtccagcatgcgaatggcatcgccatcgaagggttgctcgggcacggaggcgaacaggttgatggcgaatggccggtcggagcgttcgcggatggcgccggcggccgcctagatctgttccgggctcag

SEQ ID NO: 96301 - DNA, 771 bp, Glycine max
  Peptide Sequence Number=SeqID_213079
atgggtgactctgacaggtgcggcttgtacatagaagcagatcctgcccacctggttgccatggggagagtttatgagggatccactattgttcataacactcctttgttgcctggtcaagtaaaggtagctgtgtctccggcaaaaccacctccgaagcccgatccggaggtcgatgatccgctttatctgatgacattgaccatcccagagcttttcttgaggccttatcaggttagatgggatgccaccgtgttcggggtcgttaatccagatttccccctctacataaagcacgaagacctctccgaaatcgcacacggtggtcaatgtctcagcatatcagtgttacagttgtggattttgcatctcactgaaacttgtatgcgagtggggaattctgatatctatggatttctcgacccacagtccattcagaggtctgcgcaatcacagtttgagtctgaaagttacataaagagttggatgcagagttcacaacgcgatgtctatcttggagcctacctaaatgggttccactgcagcggacattggcagatggtggccatcctgcccaaggaacacctagttgtctggttttgttcattgcataacaggccagacaactaccttaaggggattattaatagtactatcaagggtcttgatgatggtccacagcctaaatcaaaggcttctgctaggtggattgtcgtcaagtattttaacgatcctagaccattggagctagagagattaaaagcattgtga

SEQ ID NO: 96302 - DNA, 127 bp, Glycine max
  Peptide Sequence Number=SeqID_213080
atggcctttcttcacgcccagcgcgaccaccttcatcaggctgcgcccgttagccggcttaccgctgccgtcgagattggtcacggtgatatcgctgttgaactgcttgatcacgctcaccagcgcg

SEQ ID NO: 96303 - DNA, 465 bp, Glycine max
  Peptide Sequence Number=SeqID_213081
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtctccgcaaagtcgtaagaccatgtatgggggctgacgcctgcccagtgccggaagtcaaggaagttggtggacctgatgacaggggagcgacgaccgaagccccggtgaacgtcgtgccgtactatacgtcctaa

SEQ ID NO: 96304 - DNA, 252 bp, Glycine max
  Peptide Sequence Number=SeqID_213082
aattcgctaagcgcaaccttcagtggctaagcgcgaggaagaatccagaagaagatgagctgtcaagtgaaggagacattctcaccacttgtgtttttgcagtctttcatcttgttcttctctttgttgtaaaggaggttttcgaactatggaaagctaaatcctttgttggatcttcccttggaaactggtctgattctaaagtctttgatagtacgggactaagttgttgtgctatcacgaggaatcggg

SEQ ID NO: 96305 - DNA, 669 bp, Glycine max
  Peptide Sequence Number=SeqID_213083
atggggaccctgcgggacggggagcaaaatccccatccctgtccccgaattagctgcggggggtttttcattcccatccccgtccttgcaggaaatttttcccgaccgcagggccccgaatgggacagtccccgcgggatcccccgggttcttgaagttacgttcttctgggttctgaagtggatctgtatgctcaaattgttggtggagatttgcgatattgccaaaagtgttctcactataagcctcctcgtgcacatcattgtcgggtttgatcatcattgcatttggataaataactgcgtcggtcatgcgaactataaagtattcttcatttttgtcttgtatgctgtaattgcctgcatctactccctggtcttacttgtgggtagtctcgcttctgatggtgtgcaggatgaagagaaaaatagaagaagctcattccgaactgtatatgttgtttctgggctcttgctggtccccttatcgatagcattatgtgtgcttttaggttggcatatctatctcatgctacataacaagacgacgatagagtatcatgaaggagtgagagctttgtggcttgcagagaaaggtgggagtatctataaacatccatatgaccttggcccatatgagaatttgacatctgttatcaatctccgctaa

SEQ ID NO: 96306 - DNA, 126 bp, Glycine max
  Peptide Sequence Number=SeqID_213084
atggaaagcaagaaagaggacaggagatcttcagaccaaataaatttttggcgaggaaatcatgtgcaaaataaagtcatggagcagctatggtttgggattagggtaaaacacttgcctgtgtga

SEQ ID NO: 96307 - DNA, 651 bp, Glycine max
  Peptide Sequence Number=SeqID_213085
atggagctagaggctgaaatggaagtggtggaggagtggagagcaggcgcgagtggtgatgcggaggaagagatggaacgcgtggtgatggcggtgcttggagaggaagtagatgaaggtggtgtaggagacgacattgggggaagggagggagaggaagaggcgaagggcgtgggcgaagaggttgagtttgaggtaagtggagatgagggcattggagagatgggtgtcttcttcatcgcatttgaggagcatggcgtggacggtcttggtgaggtgggtgtcgccagagcaaaaggacatgtggagggcgtggaggagggagtgggactccgggggaagggaggagaaagggaagagttaaaaaaggcagagtttgagggtgagggacaggaggtgggggttgagcgggagaaggagtctacggaagcttctagggcacggaggagtatccttgtgcgtttggatattccggttaggatcttgtgggaagaaagtgaggatgagttggtgggtctcatgaatatttctcccaaaacatcatctaatacatcgtttatattgctcaacaacgaagaagagcgattcacagatgatgaggagaattccatgagacaattggagatgcagaaacacagtactgaatattga

SEQ ID NO: 96308 - DNA, 219 bp, Glycine max
  Peptide Sequence Number=SeqID_213086
atggaaagaggaaatgaagaaagaaagaaggaagaaagggtggtggggaagggggccaatagaaaatttggaggggccaatatcaatctccttggtcttattgagtcttggtcaatcattagttttatacttggaccttattgggcttggacaattattgttgcacttggaccttattgggtgtggttaatcattagtttatacttgggcattgcttaa

SEQ ID NO: 96309 - DNA, 204 bp, Glycine max
  Peptide Sequence Number=SeqID_213087
atggagcactaccatattaggtgtcgtacggagctcggagtagaagagcaagaacatgagaatggaggaagcgagtgtgatgacaccgccaaagagctagcggttgaagaaatcctcattgattttagggtacacgtcgaggttgcggagcttgcttattatgctgtccatgattattgtgtggatccaaaaccaaagatctaa

SEQ ID NO: 96310 - DNA, 180 bp, Glycine max
  Peptide Sequence Number=SeqID_213088
atgagtaacaacatccttgctcttaggtcacatcctcacaacaaaagattggttgctactgtggcgacactgcaatctgttcttgccaccgtcatcgcttcctcctttccatctccctcttctctcctccttgcttttctcattgctcttattatgtatccatcttttctagctgctgct

SEQ ID NO: 96311 - DNA, 423 bp, Glycine max
  Peptide Sequence Number=SeqID_213089
atggaacttcaacgtctcaaccaaaatgaagagaccgacaaaaggaaaagaagcatagcactcaaagcctcctcctcaatgcaagaagaagaacaagaacaagaacaagaacaagaagaagaatctgatgatgaagaggacttctcactctttgtgaagaagtttcataaatttgtcaaaaatagaagaatgaagagacaatgggaagagatctcaagaaggcacactgtcccacaaatgaatcatggccaaaaacgaatgagaagaaaagccatgaagaaagaagatccaagaaggcgtatattgcttgggatgacaatgactcatccaatggttcagaaaaggagatcaaccttctatccaaggactatgagagcgatgagaacatctctcaagaagattaagcaaaaagcaaaagtctga

SEQ ID NO: 96312 - DNA, 945 bp, Glycine max
  Peptide Sequence Number=SeqID_213090
atgcgtattctgattgtgggagccggtgccaccggcgggtactttggcgcgcgcctggcgcaggccggccgtgatgtgacctttctggtgcgcgagcgccgccagcagcagctgcaacagactggactggtgctgcaaacgccggagggcagcacggtgctgcaaccgcagctggcgctggcctcgacgctgaccggtgattacgatctgattatcctgacggtgaaaagctttgcgctggaacaggcgatggaagacatcgccccggcggttgggccgcagacgctgatcatgccgatcctcaatggtatgcgtcacattgatgcgctgcgcgcacgtttcggtgacaaggtgattggcgggctgtgtaagattcacgccacgctgggcgagcacggcgaagtgatgcagctgtcgccgctgcacatgctttactacggcgcgctggacggcaacaacgatgcccgtctggcgcgcgtggatgccgcgctgcgtgatgcgcagtttgatagtgtgttcgccgataacattatcagtgagctgtgggagaagtggctgctgctgagcacgctgggtgccgtgtgctgtctggcgcgcggcaatacgcagcacatcctgcgttcagccggtggtgaagcgctgttacagggcattttcgccgaggtgctggcggtgatcaccgccgatggctaccaacagcgtccggccgtgacggcgaagatttatgagacgctgaacaatcctgatacggcaatgacctcatccatgtaccgcgatttaacccagggctacgatatcgaagccgatcagatcattggcgatttgctggtgcgcggcgcgcgccatgcggtggcaacgccgctgctgaacgcggtggtcgccattcatggcgaccgatatcacgccggaaccatcggattcacccaatcctggggaacggcttaa

SEQ ID NO: 96313 - DNA, 108 bp, Glycine max
  Peptide Sequence Number=SeqID_213091
atggtgcctgccggtttttttcgtcaacagactaaggacgcatcatgccccgacccctccccatcgaacgttatcgcaacatcggcatctccgcgcacatcgatgccg

SEQ ID NO: 96314 - DNA, 138 bp, Glycine max
  Peptide Sequence Number=SeqID_213092
atggaagtgacaaaacccagggcaaacacgtccttggtccaaggctcgacaaacccaagattcacccttgatgggccctttccattactaagttccatcttcataggaactcaagacggaagtataagtaagtcatga

SEQ ID NO: 96315 - DNA, 471 bp, Glycine max
  Peptide Sequence Number=SeqID_213093
atgaggtcaggtcaccgagctaggcagcttctgcacgggtttaacaaaaaattccaaccaaatattattttagcgtttctattccaagctcagtggatttttgcgtctacattccaactgcatgttgacctcgctctgttccgagctccatcgccgttgacttcttgcccctccacctctcagtgctctggtcccatcaccgcagatccttcctcatttcctgtgattcctcctgccgcagatccaactcttgcaactctcatggcaacaacaacagcaatgattatctcaaagcttctctcctctcaggattcaaatcttataaactctttggatttcagggcatggatctttattttaagacatgatggccaagatgtgacatgtgaatatttttttgctgccatgcgagatgccaatgatgaagatgttgcaaatttcttgctatggtttgtattttttgccttctaa

SEQ ID NO: 96316 - DNA, 563 bp, Glycine max
  Peptide Sequence Number=SeqID_213094
ttaagagataccaccaactccttaaggaacccacattcatttctgttgcagtgggtttgcttgattccactgacaaggacattcctctttcaactgtttatgattctatgaggcactgcaatctgtttcaagctgcagtcagagatgttcaggaggcttgtgtctatgaacgtaattttgaggagtatagcattgtgtgggctgaagctcggaagcaaaagtatttgccttctttggctcaaatgaaagctatagcatgttgggcttttactaaacttgactatggaaatgatgccaatgctctaaagaccacaacaacaaagatgggaggtggttggatccttgatggccaaaagagatggataggaactaatacgtttgctggtttgttggttatctttactaggaatacaacaacgaaccaaataaatgggcataggtgggttgaatatgcagagaagacaagatataatgcctcccaggttccaactgaatggcatggttgggtccagttcataactgatcacactggatatgaggtttcatcttccaagcctaaatag

SEQ ID NO: 96317 - DNA, 448 bp, Glycine max
  Peptide Sequence Number=SeqID_213095
ggtacttcagatgaagttgtagattgctcccttggcaagcaactctggggtctatgtaaagagaagtatgaaccattgtggctcaaaggaggtaaccactgtgatttggagctctttcctgagtacatcaggcatctcaagaagttcataacaacagttgagaaatctccatcgcaacgatacagcttccggcggagcataaaccagtttaagcagcctcgaaagagtacaaatattttcaaaaatgacgataatggtaatgatgttggtgtaaacagcgatgacgatatatatattggtagtgataatggtagcaatgtcaatagtatccacaacgatagtggtgatggtgacagaggtggtagtgattgtgtcaatggtagtgacgatgttggtggcattggtggtggtgataataatgtcagtcgtgttggtggtaatggtggtg

SEQ ID NO: 96318 - DNA, 799 bp, Glycine max
  Peptide Sequence Number=SeqID_213096
atgtattctagtatttttggtgggataacaacagacccagctgctatggttattcctatggatgaccacatggtccacagaggccacggtgtctttgatactgcagcaataatggatggatacctatatgagctagatcaacaccttgatcgctttttaaggtcagcatccatgtctaaaatagatcccccatttgatcgaggaagcataagaagaatactcatacaaactgtaagtgcttccaagtgtagaaaaggatcactaagatattggctctcggcaggacctggcgactttcagttatctccctcttgttgccaccgatcaagtctgtatgcgatagtaatacaggatctgtcaccatcctcacctaatttcaggggcgttaaagttgtcacttcatctattcccattaaacaccccaagtttgctatcactaagagtgtgaactatcttccaaatgtgctctcaaaggtggaagctgaagaagctggtgcttttgtaggcatttggcttgatggtgaaggttttgttgctgaagggcctaatatgaatgtggcctttgtcactaaagataaggaacttataatgccacactttgacaaaattctaagtggctgcacagctaagagagttttaacccttgctgagagcttgttaagggagggtaagcttaaagggataagggtgaaaactgtgactgtcgaggaaggtaagcaagcagatgaaatgatgcttcttggcagcggagttcttgtttgccctgtagtgcaatgggatgagcaggttattggtgatg

SEQ ID NO: 96319 - DNA, 486 bp, Glycine max
  misc_feature (466)..(466): n is a, c, g, or t
  Peptide Sequence Number=SeqID_213097
atgcattgctcactgcattctttccttgaaattagaaccgtaatcattgaaatcataaggaaagaacgcactttatggtgcccttaccgaacacatgccagagctagagtaatgagtggaatagaggaggtgcaagagcagatgaaggctgacatggaggccatgatgagtatgagaaaaatgatggaggtcaacatggctacaatcattgccgcaagtaccatcactgaggtggatccgactcagccatctagcctcaatcaagtaaatcctctagtctcgcatatggtagggcagggaggcgaagtgttaggaagtacaggcagcccccattttgtgcatgttcagaacaagcattccttcccaccatatggcttgcctcccaactatacaacacccaatgttgcacaccctcccaataagaatgtcaataaatccactcctatactcattgagagtcaacaancccaatctggtcaggcatag

SEQ ID NO: 96320 - DNA, 189 bp, Glycine max
  Peptide Sequence Number=SeqID_213098
atggtgaacaacattttcacactatctaggtacaaggaaaacatggtgcagctcaaaccaagtgctggccttaaggcaaaaatacccttgaggcatttcaccgagcacttggtgggcgtacttttgggtaccaacaacaagaaaatgggggcaatgtggcttgccccatcatctcaaaacacaacctag

SEQ ID NO: 96321 - DNA, 1350 bp, Glycine max
  Peptide Sequence Number=SeqID_213099
atggttcaggcggcagacctggctaggcttcaggaggagaagcttctcgatgcgcattctctaatccgtgctcgacaaccctccacccttgttgtgccaccccacggcccctatcctgatgaagaagacgcaaccctaaatgaacctacccaattggagcggccgcctggcccacttgataccactaacccgactcaagcccagattacacttcactctctttcgggtcatttggtaccaacatcatcgccgacgcgctctctcgtacccccctattcatcctcaactacattgttagttttggcggtgccatgtttgacatttttagacgagcttaagaaacatctcatccgtgatccccaattcatccaactctggcgagacattagtgctcaaccagctgattatttggattactccattgcccaggacttgatcatgaaaggggggcgtatatggttgcctcggggatttcaattcatccccactctgttagctgagtatcatttgactgcctccagcggccacatggatgctgctaaaacggtggcgcaattaatagaaaatttcacctggcaaggacttcgaaaggatgtggagaacttcgtcaaggcctgtgtggattgtcaacatgccaaatatgaaacaaaaagggtcgtcggcttactttgtcctttaccagttcctcattacccttgggaggatctctcgctggatttcatcaccggcttacctctgttccgaggaaacaccacgattctggtggtggtggatcgcttctctaaaggcatccatttgggcatgttacctatgtctcattcagcccttactggcgtgatattattcatcgatatcgtcagaaagatacacggaatgcctcggagcttggtgtccgatagggatccgcttttcccgagtcacttttggcaggtgctattccgcttgagtgtgtctttgcgcgttcgtacacaagaaaccagcaacatgggggaagttccttccctagtatttcgccggcacttcaaaattgatgcggtggatcacctcctatgtcacagggctgagaccttcaccaactttcgcaagaaactcctcaaggctcaggaaacaatgaagttagttgcagattccaaacacagggatgtggcgtttaacgtgggtgattgggtcatgccctttcatggagctctaggcggcgatcctcagttaccattgtcggacaccgccatagataatcaacctcttattactcttctgaccattgattgggaccaactccatgctgactaccaccttgaggacaaggtgtttttgcaagtggcaggaaatgctagtaatcagggggtgtaa

SEQ ID NO: 96322 - DNA, 354 bp, Glycine max
  Peptide Sequence Number=SeqID_213100
atgtcatgtttgaaaaacttgcaaggaatggaagggagtttgaagaaaacactaagtagcacattgatgaatatgctgatgctggttttaggaccttcatacttgcgtatcgggagcttgatgaaaaaaagtacaaacaatggcactgaagagtttatggaggccaagaacttagttcctgaatgcattgacaaggtagcacaggcaggaattaagctatgggttctgactgctgataaaatggagacaacaatcaatattggacaagctatttctggactcagaacccaagagcaaatggtcaccatggcacaacttaattgttgggcctggtttcttgccctctacctttag

SEQ ID NO: 96323 - DNA, 483 bp, Glycine max
  Peptide Sequence Number=SeqID_213101
atgaacaacattacacacttgtctgctcgtttgctacatagtagcaatttcccgttctcatctcttacaattacagacatccgccttgttgtactactaaacactgttgtaataatttcatggccaaacctgaaggatgagaaatccacaacggggaagcagggactaggcatcaaggacagacccaagaaagtagatggctgctattttcaggattctgctgataacgattccctggaacaaccagcaaatgatgacataattaaagtagaaaagattattgaaggtaaagtaaagctgaaaaagttgtgcaaacacattttacaacaactcaaagttcttattgatgaacattcatcttcaattttatctgacttttcttcaagaagaaaggttgttgcttacttgaagcaaaagttgagaggtagtaggaagttttgtatcgaagggaaaaaagtgcgattcgcatcaaagagaagttga

SEQ ID NO: 96324 - DNA, 261 bp, Glycine max
  Peptide Sequence Number=SeqID_213102
atgtcaaatgaagaattgaagttgcaggatccacgatgtcggatacaatgtcctgacatcctgcccgagaatactggagttgctgtacattgcaagttaaaagtcaagtgcagaagtgaagttgcaggatccacgatgtcggatacaatattttttcagaagaagatagatctcctccagcacaagccgttgcagcccagaaacgcaaattgctatataatcatggaggctgcacgagttctgtaccaagtccgggattga

SEQ ID NO: 96325 - DNA, 426 bp, Glycine max
  Peptide Sequence Number=SeqID_213103
atgaatgcggtggaaaatttagaatggattacaaatgaattttttgatttatccaaattcttttttaaacacttcaatagccatagcccatcttggagaggcccaaagtgggactacgccatcgttcaagtccccatccccaaggttctgttgccggctccgcctccgtccaactatgttcctcttggcactggcgcgctcgatgcgatgtgggagaaggcggtggagagagagaggaagagcgtaaacttcaactcaatagcaaagcgcgtggtggcaaatactaataacaacaacgacgaaaatttggagaaaaagactagcgagttccagaagttcctccaagtctccgccaaagagcgcgacagggtgcaacgcatacaggtcatcaatcgcgccattgccgccgctaggcaactcctttag

SEQ ID NO: 96326 - DNA, 388 bp, Glycine max
  Peptide Sequence Number=SeqID_213104
atggattcccaagccactctggaaaatgcattggtgtgggtgtatgaagaagaagagagaatatatgattttgtgcaaaagacaaagatccctagcaaagaaagactcatagatgtgagtgatggaagcttctatggaggttggatctttaagcatcaattaggtccttcaatggtgattttcaatcatggaattgcagtggaagataaaggagaagaggagaagcttcaccaccaagagagtgccttggataagaagcttagagaggaagctttaatgggggaagagaatgaaagagaagggggggttgcatgggaattgaaagagcacatgaaaagcttccttaggaagctagaggaagaaaacttccttgagaagctagaggggg

SEQ ID NO: 96327 - DNA, 324 bp, Glycine max
  Peptide Sequence Number=SeqID_213105
ctttcaggcaaacctgttgcaatcatcaccggcaccaattcccaaggtggtggacaagagactacagtgcttactggtatcactccactggttcatcatggaatgatatttgttccatttggaataagatttacatacagtcatgagtttggcaatgtgaaggaagtgaaaggtggaagtccatatggtacaggaacttatgttggaagaggggccaacaggcttagagttgatgcatgcattcgaccatggttattactttggcagcatcacaaagcagctcaaggaagctactgcataatgttgaaaggatgtacctattga

SEQ ID NO: 96328 - DNA, 249 bp, Glycine max
  Peptide Sequence Number=SeqID_213106
atggcacgcaaaccgaggcgggattttagcgtttcaaagccaaagcagaaaaaaattcagacagctctccctcttcctcacgttgcctttctttctccctcattctccattgaagctccaaacaaagcttcaacctttggtgctcatttctgctccaaatcgcgaaaggatggcatttttggagtcgtgaagtgcgtggctacgagtgggacttcgaaatttcagggtttggggagatatgatgggtag

SEQ ID NO: 96329 - DNA, 210 bp, Glycine max
  Peptide Sequence Number=SeqID_213107
atggctacagccaggtgggcactcaagcatcctgtttatggcattgtgatactacggttgggagtttacacagacagaccccacgtttccaagttatgttctttcatcagttcaatgaattcatccatctttatcttggttcattccggaaaatacactcttagcatcagtcccttgtttccagaagatacgtttgctctttacgaatga

SEQ ID NO: 96330 - DNA, 429 bp, Glycine max
  Peptide Sequence Number=SeqID_213108
atgtcattttttgttttggtcattgtcgtttcatttggggtgctacagactctgaatcaaagccattattgttcccaaaaatgcttttcctctatcatcaagctcctccacacggccacacaggtgcgcgatctcctccgtcgtggcatcaatctggtgtcagaggcacttctcctccgtcagccatgcgttccggtgcgaggtgaagaacgagggggtgtgtggtggaagcgaatgaagaagaaggcagtggcggtgatgaatgaggttagggtttggagtagagggggtgtgaaacatgaggttgttttgggaggaggctctgatggagtggaagaggaggaatgtttcaaccaaccaaatgatgcttcaagtgttcctaatacacctttggatgcaagaggatcttctggtgctagcaacccttag

SEQ ID NO: 96331 - DNA, 444 bp, Glycine max
  Peptide Sequence Number=SeqID_213109
atggctgtccaagtttatattgtgtactactctatgtacgggcatgtggagagattagcagaagaaataaagaaaggagctgattcggtggaaggcgttgaggccaaactatggcaggcaagtttatttattgcttaccttaaaaattatattaagggttcagagttagattattatgtagctgagatattgccagaagaggttcttggcaaaatgggagcaccaccaaagagtgacgtaccaatcattacccctaatgagctctctgaggctgatgggtttgtctttggcttcccaacaagatttggaatgatggctgctcagttcaaagcttttatagatgcaactggaggtttgtggaaaacacaacaacttgcagggaagccggctggaatcttctatagcactagttcccagggtggtggacaagagactacagcgtaa

SEQ ID NO: 96332 - DNA, 654 bp, Glycine max
  Peptide Sequence Number=SeqID_213110
atgatgtcggaagaaacgacgtcgattgactacgtaatggaggcatcatctaggtctcacttctccgccctgagactcgacggccaggtcccatcctccgccacggccgcgtcctccactctcgattcaaccctaaccctcaattcccttcccaatcaacccttcgtcataggtcactactcttctttttttcttcttcacacttttctttccttcaatgttccaattccaaaattaaaacgacaatgcgattccaaaattaaaaccaccgtcggcaatatgatcattcagcaactccatgatcactgcgttgtccttgtaaataaggacttgttttatcacgggttgaatcctgaagagttgaaacgtgttcacaagtacaatttcaaccaccctggtgttgatgttattcttgattgtatgggagcaacctactatcaaaaaaatcttgatagcttgaattttgatggaaggctttttattattggctttcaagggaagcatacatcagcaggagacaaagagaagatggtgccattagcagaagtccaagcacaaacagatcaaacacaagcaaagggggtgcagggggtgcaaacaacaacaaacaagagaagaatggtgaggcctgcttaccttagtgacttcatttga

SEQ ID NO: 96333 - DNA, 858 bp, Glycine max
  Peptide Sequence Number=SeqID_213111
gtttattccgacgaactgcaccaggtgagtcaatgggtagtgagccaagaggagcttcaggaaatccagcaatatggaagtacgaaacatcctcgttgttccaacaaaggtggcagaactggtgttggggaagaagacccgaagtggtggcattctcgccctgcaattccacgaagtgcccgtgatgaaagaacatcacgcgtaatcgtgttggagcggtccgacaaggaagttgtgggtacttccccatcaacaaggaggaccacacgatggccggagagaaggccgatgaggcgcaaagttttcggtgctaaattacctgataaggagttcaaacgaatttgggccaaatgggtcaagtgtggggtttgggttcagggttgggtcaattgggtctatattaggcaattgggatctttgtcttcagcaacgagaaggaaagctttagaggcgcagcaatgcccgctagggtatcgtttgtcacaagtgaaacacaacccacgctcccggtggaaaatgggttcctctaacgtcaagggtttcaccatgggtggcaaagatggcggtggtgatggcaaaagaggcgaaagtgtcatgggacgagggggtggagggatgatagactgcgtggcgaatctccgacgtcaaactcgagatgaagcaactcaacaggaagggaaccggaacagaggtggagtggcgagggattggtgtggagttgggcatggtggaggaaggcacaggagcaaggcgattgagaagcttgtccattttaagggtcatagagtgcatggtatcgtcaagacgagcaaaggaatcatcgaggcaccagaacctccagaggaagaagaagagtag

SEQ ID NO: 96334 - DNA, 165 bp, Glycine max
  Peptide Sequence Number=SeqID_213112
atgggtgttaagtacctcggggcggtcaagcgaaggttgcatgccaccaaacaatggtccccggacgaaattaggtgcccaatgcttgggcacatggaaagattagctcaagaagtcaagaaaggagcttattctatcgaaggggttgtttcccaactatggcag

SEQ ID NO: 96335 - DNA, 252 bp, Glycine max
  Peptide Sequence Number=SeqID_213113
atgtactataggtacatgggatcactcactgcacctccttgcacggaagacatcatttggaccattgataacaagccacacctctgttgcactcagtccacgtcatcgcatgagtcccccgtcactgacatcgtcacgtcgctgctgttgagccctaaccgtcatgcccacgccaactggtttgcactccaatttgcctcagtcgtttcctctcccactaacgttcacactccaatcgccaattcgccatag

SEQ ID NO: 96336 - DNA, 360 bp, Glycine max
  Peptide Sequence Number=SeqID_213114
atggatattatattagcaaaaataaattgcaatgattaccattttttatttgtggtcccttctgcaatccttgcgatactaatccacccttttatgactcattggcgtttagttcgaattgtttgggcattcagtttgtatttggaagctgtttctgttctgcctcaacttcgttttatgcagaatgcaaagatggttgaaacatttacagggtattatgtattcgctctcggtgtttcaagattcgtagcactagcttatttgttaattcagctttatttttttgaagaccgaggccatcgcggtgctgcattatgtgtcttgtctaaatataaagctagcccacttttaaggaagtga

SEQ ID NO: 96337 - DNA, 1093 bp, Glycine max
  Peptide Sequence Number=SeqID_213115
cgtgagatgtttgtctcaacacattggagggtacatcctttgtggtacaagtagagggtacatctacttgggtttgactgagaacaagagagggtacatctcttgtggatcaattctagtggagggtacatccactaggttcaaagagaacaagggagggtacatcccttgtggatctttgcttgtaaaaggatttttacaaggccactcgatccaacaaaatggctatatgctagctagagatagaatcggaagagagatcaagccacctgataggtatggatatgcagacctgattgccattgctttgatagttgcaagtgaggttctagaagatgaacctactagtgttaaagttgctttggctagtaaagaaaaagacaaatggcaatttgctatggaagaggggatgaagaaagagggattgaaaggtgttgaacttgacaattttaaggccagacttgttgctcgagggtccacacaaaaggaggcaattgaattcaatgaggttttttcacctgttgtaaaacataggtccatcaaacttcttttggccatggttattgagtttgaccttgaacttgagcaaataggtgtaaaaagaatatttttgtttggagagatagatgaaactatcctcatgagacagcctggggatttgaaatcagaggcaatgaggattatgtttgcaagctttaaagaaacatacctcaagaaagttcttgaaaggattagaatgtcaaatttgaagcctgtagtgatatctacatctcaacaattcaaattgagtgtaagtcaatccccaaagaaaattgaagagctaacttatatggaaagtatcccatatgctaacattgcaggctcaataatgtatgctatggcttcaaagtggatcctaagatatatcaaaggatctcttggtagagttctagtttatggtggagccaaagacaaaaaaggaacaacaactattgaagggtttgtagactctgactatgcatggggcctagatactagaaaatctctcaatgtcgaatacatggttgtgactgaggctgtgaaagaagccttatggcttgaagggattgcttaa

SEQ ID NO: 96338 - DNA, 240 bp, Glycine max
  Peptide Sequence Number=SeqID_213116
atggcaaaatccaacactgaccaaattcaaaaggatgaatttgaaggattaacctttaaggtggagcttaaggataaggctgatgaagttcaagggcggaaatgtgtagaagcaaagcttcatggtgaatcaaagatgatgacaaaggtgatgactaaaagcttaaagatcaaccaagaacaattcaagaagttcaagataagaatcaagaagaattcaagactcaagaagaaagtctag

SEQ ID NO: 96339 - DNA, 309 bp, Glycine max
  Peptide Sequence Number=SeqID_213117
atgggttcgaccaagtatgaggctcttgaaggagaggtcaagcttgagaaagataagaaagcaatgctagaaaagcctcataatgcaattatcttgagtcttggtgataaggttctcatacaagtcttcaaagagaagactattgtaggagtatgggcaaagtttgataggttgtacatgaccaaatccctaccttacccttgcatatgcaaagaggctgtttccggattcgaacccatgaccaacaagtcaccaaggcacaactttaccgctgcaccagggctcgccctcacaaagatgaatgaatga

SEQ ID NO: 96340 - DNA, 459 bp, Glycine max
  Peptide Sequence Number=SeqID_213118
atgactccaaacaaatcatggtttgaagagtttagtgatcttgcaaaaggatcaatgctccttggaaacaacaagcctggaaagattgctggaattggatctataaggttcaggttacatgatggggttgaaaggctccttcctaaagtaaggtatgtactagaccttaaaagaaatttaatctctcttggcgagtattataaaaaaggatatgtgttcaagggtgaaaaaggaatgttggaagtagcgaaaggatctatggttatgatgaggggaattaagaaaaatggcatctactccttagaaggtgacatactaattggctctacaactgttgtatctaagaaattggtgtctaagattgagccatggcacatgaggctaggccatttaagtgacagagggttaattgatcttggtaaacaaaatctactatgtggagataaagtgaaaaactga

SEQ ID NO: 96341 - DNA, 330 bp, Glycine max
  Peptide Sequence Number=SeqID_213119
atgttaagtggaaacgatggttcagagttcttaccagccattcccaagaaagaaattaccattattcatactaagaatgaagccaccatccacattgagcacttctttgacatcaaatacttggagggtattagtttgaatatgaatgaaccgatgttgcgttatggcataagaggtttttacaaccactttcagacaatccacccaaaactcatcggaaggttttggcgctatgttgagtttcagaatgcttatgccatcgtctccgatgtagttggcaacaaagtcaccttttcatggagaccattgcttaagtcattggatgattga

SEQ ID NO: 96342 - DNA, 1158 bp, Glycine max
  Peptide Sequence Number=SeqID_213120
atgtcagatgatcaatttcaagcaagtggaaactggtgggaaacagcaagaagcgtgagatttgagagtagagaatcacaatcttcttctggcctcaccaacaacattggaagctatgcagcttcttggcaacaacatcaacaacatgacatggcaacaaggtcttcttccatggataacaactctgtctcaggtggttcctctgtggtcttccatgaccagaagcagcttcaagttcatgattcatcaccagcagccacttccaccaatgaccccaactttcacatgatggccttgggcctctcatctcaagccatggactggagtcaagcatctttgccgctgcgaggtgagaagggttcagagaacagtttcaggtcgatgttgcaagagaatttgagctcatcgggcacaaattttcagcagcaagaatgtgggagcaacagtataggcttgtctcaacaccaccatcaccatcatcaacaagttcattggaaaccagaaaagttgttctcagctgagtcatcaagcaacgaattcaagaggggtttctccttggaccaaacacagttttctcctcaatacagctccggggacagcactgtcacaagccaaggcttgccttgttcttttcagatagactatgttgggaacccttcttcaatattgcaaggtcttttgggacaagagagcaacaacaaccaacaacaaccccaccaaggtggtggtgccatgaattttccttactcagcagcaagctatggattgaactcgaatattgagttggtgccttcttggtctaaagttcctcagtttctgagagcttctccgccaaaacaaccccccaataaccagttgcatttcaccaacaacgctcccttttggaacgctaattctgagcctgctattaaggattctcgatccaactttatcccctctttgcaacctcccttccccacatcaaatttcgatgtacaatcgaagaatatatctgaagttagagattcgagtggtgtggtgaagaaaagtgggagtgaggcagcacccaaaaggcccaggaacgaaaccccatcacctttgccagcttttaaggtgagaaaagagaagatgggggacagaatcactgcactccaacaattggtttcacctttcggaaag

SEQ ID NO: 96343 - DNA, 336 bp, Glycine max
  Peptide Sequence Number=SeqID_213121
atggggagggctgagactttgaacccatatatgaaatgcgaggcagggcagattatccagatttttatgggttggtggcgagctggggcctggcggggggttgctttagtgcctaagccaaaagaaccagccattgcgttcaatgaatttggtattgttgatgtctcttttgatgctcctatatcttcaaaagaatgtcgtttacttacacctccaaggcaacgtccacctccatcacccaccaacttagcaaagtttgagcacaatagaaaaatgaaggcaccaatgtttgatcaaaataggtttccagtagctttctttgctaggaaaaaatag

SEQ ID NO: 96344 - DNA, 327 bp, Glycine max
  Peptide Sequence Number=SeqID_213122
atggagatggtaaaatgcttggtgttaattgttgctaaatggtttgaggttggacgacaactctcagtatgttcatttgagcctgttgatgattctatagaagcatctggtagatccttctgcactaaggtggcttcacttgagaggtcagcctacttggatgcaagggttgacaaccttaagatggatctgtgttgctttgggcaaagatatcagtgtaaaaagaagctagatgcacacaccgctgagtgccgtggattaaccagtgtggtttcatcttgtccaagtcatggtacattgatcacaatagcaagaagagctttgtaa

SEQ ID NO: 96345 - DNA, 300 bp, Glycine max
  Peptide Sequence Number=SeqID_213123
atgtcccttgaagaacttattggaaccttaaagaataagagtgggtccagatggaagatctcattcaagaaagtgttcaaggagaagaaagacaaagaaaagagactcattatatgccatgagtgtaagaagcttggacacttcaagtcagagtgcctaaaattggagaagtccaaggaaaagtacaaggacatgaaaagtctcataggcacttgggatctgaatgacaccacctttgatgaagaagcaaaagaggaagctaacctatgttcaatggctgatacaacttttgaagaatga

SEQ ID NO: 96346 - DNA, 225 bp, Glycine max
  Peptide Sequence Number=SeqID_213124
atggagaaatctgaaaagaaaaatcatagtgaaaagaaactgaagaaagcatacatcacatgggatgcgaatgatatggaatcttctgaagattcagaaaatgaagagataaatctctgccttatggctaaaagttatgaaagcgatgaagaggtaacccgcagagtctggtggcatgcggagacacccgacggtaacccgcacacactcatttgctatccgtaa

SEQ ID NO: 96347 - DNA, 417 bp, Glycine max
  Peptide Sequence Number=SeqID_213125
atggatcaaaagaccattgtgtctaaggtccttgggaaaaaggtgacgatgaacatggagtctatagcccaagtcattgatcgtgtcagggaagggagcacttaccttgggaggccacctatgaaaagtggaatggatgacatatactacgaagctctggtcaacaagctactttgggaacatggtgtttaccatgttttcaacaagatagacgaggagtcaaaacatcaaatcattgttaaaggatcaatcattgctaagcaacaacaatttaacaaggtgaactttaaagcaatgaaactagagattcaactagctcaaagggaagttcctcaagtggacgaggaagcaacaaggaggaaaaggcagagaagaccttgcatacttttcgcattgcaaattgtgtcaacaagatga

SEQ ID NO: 96348 - DNA, 411 bp, Glycine max
  Peptide Sequence Number=SeqID_213126
atgcccttgggggtaggattgcatcagatgagtgtttggaggatcgaccaaggacgcacccatcctgggttttggcgagactcaccaagggtagaccttaggtttgacgaacctttggagaatcgatcagagacacacccgtccttgattttcacgaggctcaccaaggacaaacctgggggacagaccttgggtttgaggagtctttggagatttgacaaaggatgcgcccgtcttgggtttggcgatgttcatgtgagatgttgttgtcatccagggtattgttggtctgatggggatgtgattgactctgggaagcttaaagacaaagttgtcgaggtcgttggagaaatgcgagattcaaggagcgggaggaagaggaagattgaagagagaaagaaagggacgtga

SEQ ID NO: 96349 - DNA, 498 bp, Glycine max
  Peptide Sequence Number=SeqID_213127
atggacaactattatccggtgtcaagagtgataaccttgataggtgcaactaatacgaagagcatctccctgttaccacgatccttccctattactcaggatgaggtgtttagacattgtagagacttgttgaaagagaggaatgatttggaaggcagggtagagcatactgctaaagagaaagaaggtcttgttgcgatagtggcggagtccactaagtcccatttgaaggagcctgagcttgaggcgacaaaggagaaggaagccaacaaagagcttgaagaggagttgttgacgttcaagaaggaggtcatggagcaacacgagaaaggattttacaaggtcatcaggcaggctgggttcttcaccaaatgtttttacttgggtctttttgacccatttatggacgtgaaggatggtgaactgcttaatgaagaagaagtggttgttgcaaaggaggacatcgatgaggagcaagatgatggggtcaatgtttag

SEQ ID NO: 96350 - DNA, 459 bp, Glycine max
  Peptide Sequence Number=SeqID_213128
atggggtcaagtcaaaagccttcgcttaaaaagaggttttatcaagtcaaaatcaagagcttagaggtcaccagtttacgaaagttggggcaattaatgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctatactccagctctctatgtggggctggtttcacacctttttctccaagaaggtaggcccgtctatccatcaagcttatcgataccgtcgacctcgagggggggcccggtaccagcttttgttccctttagtgagggttaa

SEQ ID NO: 96351 - DNA, 356 bp, Glycine max
  Peptide Sequence Number=SeqID_213129
atggccaatttggacgatgcaaaggttcagaaacgattaagattacaattactagaatgttttggtgttctggctatttatggcttcaatagctcatcatatgacatcgacatcatcaagaaataccctccacaagtcttgaaacactctaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 96352 - DNA, 231 bp, Glycine max
  Peptide Sequence Number=SeqID_213130
atggttgtaaaactctatgaaaagataaaaaccttgaaggataacctaggcaaagaggttatggatagtgaagaagtcattgttttctatttctgtggaaaggtaggtcatgagactcataagtgcaaggacctccctgaaaaggacaacccatcacagggtccatccaatgcttaccagcacccacaagctaacaaggaaaaagaaccaaaaatatttgggtactattaa

SEQ ID NO: 96353 - DNA, 297 bp, Glycine max
  Peptide Sequence Number=SeqID_213131
atggctcaatctatgggatttgaaagcgagaaaagtagtcacttagtttgcaagcttagaagatctatatatggactaaaaagagcatcccaccaatggtatatacagtttcataatatggtctccaaatacgaatttgtggaaattgttgtagaccaatgcatataccttaaagtcagtgggaatgacattttacttgcaagcagtgacttaggtcttttgcacgacactaaatttttcctctcacaaaactttgatatgcaggatatgagtgaagttcctatgtcattggcatag

SEQ ID NO: 96354 - DNA, 531 bp, Glycine max
  Peptide Sequence Number=SeqID_213132
atgataggaagagccgacatcgaaggatcaaaaagcaacgtcgctatgaacgcttggctgccacaagccagttatccctgtggtaacttttctgacacctctagcttcaaattccgaaggactaaaggatcgataagccacgctttcacggtttgtattcgtactggaaatcagaatcaaacgagcttttacccttttgttccacacgagatttctgttctcgttgagctcatcttaggacacctgcgttatcttttaacagatgtgccgccccccccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcatcagggtcttctttccccgctgattccgccaagcccgttcccttggctgtggtttcgctggatagtagacagggacagtgggaatctcgttaa

SEQ ID NO: 96355 - DNA, 228 bp, Glycine max
  Peptide Sequence Number=SeqID_213133
gtccccgtcccgaacccgtccgctgtcggttggactgctcgagctgcttccgcggcgagagcgagtcgtcgcatgccggtcggggacggattgggacgggcccttcggggcctcttcccgggcgtcgacatgcttctgaatgtcaaagtgaagaaattcaaccaagcgcgggtaaacggcgggagtaactatgactctcttaaggtagccaaatgcctcgtcatctaa

SEQ ID NO: 96356 - DNA, 141 bp, Glycine max
  Peptide Sequence Number=SeqID_213134
atgagtatgtgtcagagggggtttgtttttggaggaaactcatcaatggagttagcgagttggacacgtggcagcaactggtggaactcgcgagtggagatggcgagacacggtccacgtggcgggtctcgccattcgtaa

SEQ ID NO: 96357 - DNA, 639 bp, Glycine max
  Peptide Sequence Number=SeqID_213135
atggaaatttcaaagcatactaatcggtcttatgaagattttgatccgctgtttatgtggcgtagagaagagggtcgtgacacccttgaacttcaccttccaggcatgttacatagcatgtatctaaagttatatatagaagggttaagttttaggagagaccaaataagaattcagataaaccatgttggtttattggtaataagcggggagcgtcattttgaaggaaacagatggaaacgtttcaagaaagaattcgaaatcccatcatattgcaatgacgatgcaatccatggcaacatgatgcagagcattctttcggtggtgatgccaaagaaaagtcctcaaattagccaagaggagcaagaacacaagaaagagagaagggcaaataaaaaagaagacaccgaagaagcctcaaccaaagagggaatagctgaagaagatataggtcatgcagaagagtatcaccagtttgaagaaaattataattatgtgagacagttgccacaggaaacgactagagaagttgctctcaaattcatgcttgtgatggttctgatattggtcatagcaagttaccttgcagatgtaagcaaaagcctcatggctcaaggtgcttcatattttcacaattag

SEQ ID NO: 96358 - DNA, 213 bp, Glycine max
  Peptide Sequence Number=SeqID_213136
atgaggagtcgtaggggaaccgggatacggtggcgtacactaccacacccgactacaatgacgcaagacatgacccaagtcctccgtgctagtaagcacctctgccaggtgatggacaacgatgattactctcctgactggcagatgcagttttatgtgccccctatgcctgcacccgatcgatgctccgcaagctcagacagtgtttcttga

SEQ ID NO: 96359 - DNA, 468 bp, Glycine max
  Peptide Sequence Number=SeqID_213137
atggcttctgcagctcgcttggccttctttgccgtttccatggttctgctttcctcagtggctatggcaactgatttcactgttggtgatgggactggctggactgttgactttaactacactgcgtgggcagagggcaaagttttccgtgttggtgacaccctttggttcaactatgagaacacgaagcacaacgtggtgaaggtgaatgggacacaattccaggagtgcagcttcacgtcaaacaacgaggtattgtcgagcggaaaggacagcataacgctgaaagcggaagggaagaagtggtacgtttgtggagtggcaaaccactgcgctgctcgtcaaatgaagcttgtcatcaacgttgaaaccgcagctcctgctcctgctcccacttcctccgctcattctctgctttcttctgtgtttggggtcctcatcgttgccatcgctcccatctttgcgtga

SEQ ID NO: 96360 - DNA, 375 bp, Glycine max
  Peptide Sequence Number=SeqID_213138
atggcgaagaagaattgcaggatttgccaagaatctgggagtgccactctcattgagctggaatgttcttgcaaacatgacttggcttttgcccgcaaacactgtgccgagaaatggttcagcaccaggcctgacaaaatttgtgaaatctgtcgatccattgcacgcaatgtagcgttacaaggtgcggctgaaacgacgacgacattgtccgaacgtaggaatgcaccaaacaatcatgtgagcgaaatgcaattgccagaatggaggaatgtagtaataaacggtgaacatgatggatttcaattgcgccatggaagaataatgtgccaatatatatacggcgaaaatgttgtgtccactgcacacatttga

SEQ ID NO: 96361 - DNA, 1050 bp, Glycine max
  Peptide Sequence Number=SeqID_213139
atgtctgtagaaaattcatccacctcggtgtctgtcgcagaaggacaatccaagaatgccatgaagcccaaatattctagattctcacagcaagaacttcatgcctggcaaccaattctaacacctagttgggctatttcaatatttacggttataggactcatattcattcctgttggtcttgcttcattgtttgcatcagagagtgtggtggaagttccattccgatatgatgatgaatgccttccacctgatcataaaaatgatgcagtggcatatatcaaagacgttgggtcaaacaaaacttgcaccaagaaattgactgttaagaataaaatgaaggcccctgtttatgtctattatcagcttgataacttttaccaaaaccatcgccgatacgttaaaagtagagatgataaacaactgaggagtaaagcagctgagaatgatgtaggctcatgtagtcccgaagactatacaccaaatgacatgggccataaaccaattgttccttgtggccttattgcttggagtctttttaatgacacatacaaacttacaagcaataacaaggatttggtgatcaacaaaaagaacatagcatggaagagtgaccaaaatgggaaattcgggtccgatgtttatccaaagaattttcaggctggaggtttgattgggggtgctagacttaacgagagcttaccattgagtgaacaagaggatctcattgtttggatgcggacagcagcacttcctactttcagaaaactatatggaaagattgagactgacattgaagttaatgatgtagtgcttgtaatagagaacaactataatacatacgagtttggaggcagaaagagcattgttctttcaaccacaacttgggttggtggaagaaataacttcttggggatggcatacattctcattggtgggatttccttgttattggccgcagctttcctacttctatatgtgatgcagccaaggccacttggggatccatcatacttgtcttggaacaaaaatccaggaagtctaagatga

SEQ ID NO: 96362 - DNA, 447 bp, Glycine max
  Peptide Sequence Number=SeqID_213140
atgaagtcactgagaggaaaggagatcgcgttggtgaaagtgcagtggagacccgacgagggtgattcaacctgggagttagaggatagggtgagagaattgtacccaacaaaaccaacctctgaaccacgctcagggtctcattctgagtgttttgatatatatattgcctactttcgaaaacgggccccaacgggtgcagagaaacgcaaaggactagaaccagagaagcgacacgcaaaccgaggcaggattttagcattcaaaagctccaaaatttcttctcatctctactccaaatcgcaaggagaagctattttcagagtcgtgaagcgcacctctacgttgtgggacatcgaatttcaggtaggaaagtgtgagattttgagggttagagaagctaaatttggggtaagcttgggcagagcaaatgagaaaaatgagtga

SEQ ID NO: 96363 - DNA, 309 bp, Glycine max
  Peptide Sequence Number=SeqID_213141
atggtagccataacccctgctaggttccctcaacctccatttttccgaggatacgactcgaacgcaatatgtgcttatcatggaggagccccgggacattccattgagcattgtatgaccctgaagcgtaaggattttcaagtttatgccattattataaaccacagttacaatgctaaaatggatgaatttgacattcttgtctctcatcctctcacaaacacatatttgcttattcaacttccaccggaatgtgagtgtaagccattggcttgttttctcaaagcgacctgcgctcctgagtgttga

SEQ ID NO: 96364 - DNA, 441 bp, Glycine max
  Peptide Sequence Number=SeqID_213142
atgtaccctctcttgttctcagtcacaacaacccaagtagatgtaccctctacttgtaccacaaaggatgtaccctccaatgtgttaagacaaagttctcaggcggtagaagggagacacaaaagaattcaggcggttagtccttcgttcttttggaaaagggagaagagagacacaaaaagaattcaggcgaaaacttttagaaagcttttggcaaaggaagaagaagaagaagaagaagaagaagaagaagaagaaaaagttcaaagagattcaaaggttgtaaaagaatatgtggaaaagttgtttgtaagggttgtaggtgttgtaagtgttcttcaaataggcactggtaatctatggattttgaaaatgagggttcgggagttgtttacgcacggggaaggtgatgcaatcctaccccccaagggtattggatag

SEQ ID NO: 96365 - DNA, 210 bp, Glycine max
  Peptide Sequence Number=SeqID_213143
atgtgggttttccggcaatgtagggggttctgtgcgttccagcgaggacaatgtgggtttttcggcagtgtagggggttctgtgggttcgagcgacgacaatgtggatgtcgagggagcggtttccgacagatttcaggcgggaggagaaagagaagagcgatttcaggcgggaggagaaagagaagagcgatttcaggcaggaggatga

SEQ ID NO: 96366 - DNA, 324 bp, Glycine max
  Peptide Sequence Number=SeqID_213144
atgataagaaaaaagaagggaattgctcttaaagcttcatcttcattccaagaagaaagtgataaggaagacttaattgatttgaatgaagatgatgatcttagcctttttgtaaaaaggttcaacaagttcctgaaaaccagaggaaatcataggagaccaaattttaaatctaaaagaaggacaaaagattcatcttctactccaaaatgctttgaatgcaatcaacctggacatctgagggttgattgcccgatcttcaagaaaagaatggagaaatctgaaaagaaaatttttagtgaaaagaagatgaagaaggcctaa

SEQ ID NO: 96367 - DNA, 255 bp, Glycine max
  Peptide Sequence Number=SeqID_213145
atgctgtttggtctaagtctcatccaacaagagggatctgaggacaaagaggtgcaggcatacaatacaagggtgcagacagaaggaagatccaagagggccatcacaaagccctttgtcgcaacatgcccttttgcgggcgagcgaggcgaggctcacgggtgcgctttccaaaggaggaaagatgcacggagtcgccaccaacgtttatttgtggaaaacgtcggaaaaaccgaagaaaaacggtcaaaataa

SEQ ID NO: 96368 - DNA, 363 bp, Glycine max
  Peptide Sequence Number=SeqID_213146
atgtgggatgctctccagttaacccatgaaggaaccacagatgtaaaaagggaatggcagcccaagaaattcatcaagaaaagaagaattgacaggcgtcagaatttcactaatggaagaaaatcacaagatgattctcaagtccttaggtgttacaaatgcaaccaaattggtcacatcaaggccaactgtccttcaaatgaagaatggtcggagaaaagtgaaaagagaagatttgatgaaagaagaactaagaaagcatacattgcatgggatgacaatgattcatctgatggttcagaaaaggagattaatcttctaaccaaagattatgaaagtgatgagaacatctctcaaggatga

SEQ ID NO: 96369 - DNA, 285 bp, Glycine max
  Peptide Sequence Number=SeqID_213147
atggaggtgtataatgttattgtgaagcttcttcatcataacatttcttacttccacagtgtctcattccctgcatctaatttgatgtttctgacaacgatgcctccgacgaacgatgtagcttttgtgtcacgagtctgtcgtcgtcgcaaatttgttcgatcggtctgctccatatctgtgactgcaaccaagttgtgccaaagatggatctgcgacgttaatccatggaggcacccttgtcagagacatcgtggaagttgcgggaacgaagcaatgttgtga

SEQ ID NO: 96370 - DNA, 1668 bp, Glycine max
  Peptide Sequence Number=SeqID_213148
atgaccaaattgttaggctacgattacaccattcagtataagcctggagcctcaaacactgtagcagatgcattatctagggtttcgccaccttccaccatgttgctgttattggtgccacacaatctcttcctgaaccaactcaaacactcatgttcccaggatcctgtatacactgacttacttcgcggggttcttcacactccagaggctcatcccggcttcaccactcttcaaaacatgcttttttacaatgataaaatctggcttcctgaaggtcatgatcttactcaggttctcatggacgaatgccatatcaccccctgtggtggtcacatgggtgtcacaaagacactccactgtattgctcaacacttttattggcccaagatgcacaaggatatccgccaatatattgctcaatgtatcacatgccaacaggtgaaaaccgaaacgcgcaaaccagctggcctcttgcagccattactggtgccaacgtcactgtggagtgatctttccatggatttcattacaggccttctagcctcgcatgtttacactaccattatggtagtcgtcgaccgttattcaaaagggactcattttggagctttgcctgcacagtacactgcccataaagtagctctattgtttatggatattgtctgcaaaatccatggcttttcgagaagtattatctccgacagggatccgattttcgtcagtacattctggcgtgagctatttcgtattagtggcacgaagttgcgcttcagcaccgcctaccacccacaaacagacagccagactgaagtgattaatcgcattctggaacaatatctacgcgcgtttgttcatgatcatcctcagaaatggttctccttcctttcgcttgccgaattgtcttataatacatccactcatagcggcacgggatattcgcctttcgaagtcatgtttggacagccccctctggttcctcctttttacgctgccggaacatcaccagtagaagctgtggatgctctcacatcttcacgagccctcatacatcagaccctccaacgtaggctccgtaagtaccaggaaatgatgaagtcccatgctgactctcaccaccgggacgtccacttcgcgattggggactgggtttatgttcgtttacgtccccaccgtcaaacttccctccagccttcatacactaagctttccaggcgatactataggccgtatcaaatccaggaacgcgtgggccgcgtcgcttaccgtttgcaacttccccagaactccaagatacattccgtttttcatgtctcgttactaaaagcccaccatggtccccctcctttgaacgagcctgccctaccccgcttcaggaacaagaatcatccactggtgcaacccctttgcttcttggactggaaactcaacgagtccacttcacctcctactccacagtcctcgttcaatggaccggactggcccctgaagacactacatgggagtcgtggcctcagctccccgatatttatgaccttgaggacaaggtctattttcagaccgggggaattgatagcattactacagataaacacgtgtcctattccactacagacactggtcccacgcgtcactccacacgcactcacacgaggcctgcgtatttga

SEQ ID NO: 96371 - DNA, 276 bp, Glycine max
  Peptide Sequence Number=SeqID_213149
atggatgatggcttcgagataggtgctggagtaagactatgtgatcttatgaattttttcaaaaaggttatcatcaccattaatttcgaatttgcgggtcatacctttgctgggtggtttacgagtgtggtacaaagagcttcggagaggaaagagaactcagtccccaaaggagatgccgcagtggttgccgttgccgatgacggtagtggattcagatcttccttcttgaagtcggagagagtggaagatgacgaagatggttggaaggcgtga

SEQ ID NO: 96372 - DNA, 736 bp, Glycine max
  Peptide Sequence Number=SeqID_213150
atggaatttggagagaacaacatgttcagccttaacacccacacaaaagaggaaaatggaaacactggcggtaacagtaacaataacaatattgttaatgtttggtattcatcatgggatgctactactacaactaatgcaccacacaccaccacggccgcggagggctacgccggcggcggtcaccgcctccatcaccaccaactatacggcggcgaagggtgtcacgtgcaggcggaccctcacctcacgtgcttgcatcttggtaaaagacattactttgaggatgctactaacggtgatgatgctaacaatgttacttctctggggaaccgacacgtgtgcggtggtggtggtgcgggttttgtttttgcgggtaacgataagagagcgagggggtattatggtggaggaggaggtggggctggcggtggtggtggtggtgggaaatcggcgccgtttgcgatggttcctcgatgtcaggtagaggggtgccacgtggcgcttgtgaacgcgaaggagtaccacaggaggcacagagtttgcgataagcattccaaggcacccaaagctgtggtcttagggttggagcagagattctgtcagcagtgtagcaggtttcatgtggtgtcagagtttgatgactcaaagaggagttgtaggaggagattggcaggtcataacgagcgaagaagaaagagctctcacctttctgttactaggaattctagacaag

SEQ ID NO: 96373 - DNA, 288 bp, Glycine max
  Peptide Sequence Number=SeqID_213151
atgggcttacgtggaagccttctcgtcagtgggagcagcgagacaggcttctcgccagtgggagcagcgagacagcgtccacgtcagctgtctcgccaagcagaatggcggcaccctctaaattttctcgccactgctgatggcggtacgcatttctcatcagtgctgctgacgggattcatttggactttagtttacaccactgttgaagagggaccatttcaaattttggacgaacctcaatttgattacaatgtgcaccttgctcgtgggataataagaaattga

SEQ ID NO: 96374 - DNA, 1104 bp, Glycine max
  Peptide Sequence Number=SeqID_213152
atgttcctttcactcagatattccttcacgttcttcttcattctcctcctcttatcaccttcacacattaatgcttcaacaacaatactaacacaatcagccaccaaaatagccatcacaaaccacaacattattcagagcctcaacaatgctagaagaggcaccaaaatcacgggcatatcgcaattcaaacgttacctccatcgtttcgggtacttattacaaaagagcaatactagtttcagtgatgaatttgatgccacgttggaattagctctcgttagataccaacgaaaccttggactccaagtaaccgggaagctcgattccaacacggtttctcaaatgatcacaccaagatgcggtgatccagacacaaatgacacaacaccccacaatcacaatcatcatcacaatcacgttcacaacgtgcattcaacaaagaattttgtgtttttcccgggaaaaccacgttggtcacgttccatgccaatgacactaacctatgccttctcacgtgagaacatgatccatagtttgagcaagaaggagataatagaggcattccaacgtgcattcatgaggtgggcttcggttattccggttagctttgttgaggtgagtgactttgaactcacggacataaaaatagggttttacaatgcggagcatggcgatggtgagccctttgatggagagcttggagtgctggcccactccttctcgccagagatcggccgcctccacctagacgcggccgagacgtgggccgtggatgacttccggtcgaccgcgtcggaggtggcagtggacttggagtcggtggccacacatgagattggacacttgttagggttgtctcatagttcgttaaaagaggctgtgatgtatccaagtttgaggcctagagataagagggctgatttgaatattgatgacataaaaggggtgcaatctctatatggctcaaaccctaatttcagatccgagtggtcactagagtctgatatgtctgcaaatcatggttctggacttgtcaaacatttgaggttggcttctagtttgataattataatttccctcattcatagtttatgttcatga

SEQ ID NO: 96375 - DNA, 201 bp, Glycine max
  Peptide Sequence Number=SeqID_213153
atgacgaagaacaagtatgaagactttagcacatatgcatggggacctgccgtacttgcttttctatacagagagatgtgcagtgccaccgattataaaactaaatcaatcagaggtgactacgaacgtggaaacccacatatcggccatgatgaagtgctgatttttcgtcgcaagttggatattatgaaacgtcatgag

SEQ ID NO: 96376 - DNA, 285 bp, Glycine max
  Peptide Sequence Number=SeqID_213154
atggcgagaatgttgctgacctggaagggtgtcgctgggaggaatggcgagaccagtgatgccgcctttcacaatggcgagaaacttgctgacctggatgctacaggcgtgtgtcgccagcaccaattgcagcaagtactgcacgtaggcaagccgccaacaacaatggcgggacatgctaacaaaagcaatctcgccattgcttcctgcgagatagctgtacaaggatcacatgcatacagtgtggcttgcagagggtcacatgtatggttaaatggcagatga

SEQ ID NO: 96377 - DNA, 162 bp, Glycine max
  Peptide Sequence Number=SeqID_213155
ttacctcctttcaaagacccagaagtcttcgactacctttactttgaagaagaagaagatttagccattggtttggctaccactctagtggagcaccgtgataaggcgcctattactgacttctttttcatgatctcaagacgacttaagcaaaccgattaa

SEQ ID NO: 96378 - DNA, 303 bp, Glycine max
  Peptide Sequence Number=SeqID_213156
atggattgcacatggattgattggcctaactctctaacaaaggtccccagtggaatcgcaaatcgttgcaacctaaccttcggcgagagggctcacggggctcgcgggtgcgtcttccacgggaggaaaatgcgcggagtcgccaccaacgcttatttgaggaaaacgtcgaaaaaacctgaaaggtgtggtctacgaactttaagtgtgaaaggttcgggagttgtatttatgcacggggaagggtgtttcccttgctcctacgtattcctcaattgcggtaaggaaatcagacctaggtag

SEQ ID NO: 96379 - DNA, 306 bp, Glycine max
  Peptide Sequence Number=SeqID_213157
atggtgaacgacattttaacactatctaggcacaaggaaaacatggtgcagcccaaaccaagtgctggccttaaggggaaaccttaccaacatgctctcactcatcatgctttcttgtatttcaaaaaacaaaagcttgggccccctaggcctaagtcatgttttggcatttatcctaattctcgcaagctggccgcatccaaaaaatggcatttcaccgagcacttggtgggcgcacttttgggtaccaacaacaagggaatgggggcaatgtggcttgccccatcatctcagaacacaacctag

SEQ ID NO: 96380 - DNA, 807 bp, Glycine max
  Peptide Sequence Number=SeqID_213158
atgtcgcaaaccgtacaacagcagacctgcgcgctgctgcgccagctggcaccgcaggaaggttacactgcctcattgctggacagcgtgcgctttatgcgtgccgaccggcagtgggcgcgcacgccggttctttatgagccgagcatcatcattatctgtcagggctcgaagcgggcgtttctggccgacaaaatgtatcgctacgacgcacagcactatctggtgttgtcggtgccgctgccgttctccgctgagactgaagcgacctcggctgaaccgttgctggggctggctatccgtctggatgcggccacgctggcgcgcctggtgacgcaggtcgcagcggcagacattccgctggcggagacaccagccagcattatttcgacgccgggcggtgcggtgcgcgcagcgctgacctatcaggggcattttggccgcatcgcgcgggcgctgcagcgcattcatgctgactggcagcagccgctggatgtgccgcatctggccagcgaagcgggcatgagcgttccgcgcttccatctgcatttcaaaagcgtcacgcagacctcgccgattcagtatctcaagtcgctgcggctgcatcaggcgcgtttgatgatgattcgcgataatctcaccgccgccagtgccgccgcacgtgtcggttacgaaagtgattcacagtttaaccgggagtttaagcggatgtttggtcgcaccccggctgacgaggcgcgggtgatgaaacgcgcctttgcgctgctgccgccggaacaattatccgcgcggctacaggcacattag

SEQ ID NO: 96381 - DNA, 489 bp, Glycine max
  Peptide Sequence Number=SeqID_213159
gccaatccaacaaggacctaacatatttcaaaggactactaagctggaggagaccttaactcagtatatgcaagtaacaatgtcagatcataaaagcactgagtcaacactaaagaaccttgaggtccaggtgggacaactggccaagcagatagctgacaagtttgtggaggctgaggataaggatagtgttgtgcataaaaagaaaactgctgacaaaaaagccgtggatgaaggtgtggaagtaccatatcctgtggtaccttccaagaaagaaaaagatcgtcatttggcaagatttttagatattttcaggaacctggaaataaccatgccctttgaagaagctcttgttgtgatccagaagatccttccacccaagcataaagatcttgggagtgtaactattccttgttcaattggagaagtcaatgtgggaaaagctcttattgacttgggagccagtatcaatttcatgccactctccat

SEQ ID NO: 96382 - DNA, 600 bp, Glycine max
  Peptide Sequence Number=SeqID_213160
atgccttctcgccatatggcttgcctcccaactatacaccaccccaatgttgcgcacactctcgatgagaatgtcaataactccactcccatactcattgagagtcaacaacctcaatctgatcatgcacatgtctctcaacccatgggggagacacatgaagtaccccaccacaatctagttgacttcgagcctcgccttggatatgttgctgaagggcaagcagttggtggtgtacctctaccaaacactttggaggaccctcaattttgcccacaaccacaacctttacattttgcggtggggagagtccctccaaatacggtggaaaggggaaaattagatcatatagaggaaaggatcagggccattgaaggaggtggagattatgctttcactgacatggcagaattgtgcctaatgcctgacatcttcatccctccgaagttcaagatgcccgatttcgataagtacaaggggactactttccccaagactcacttgaagatatattgtcagaaaatggggacatactcgaaagatgaaaaattgttgatgcatctcttccaggaaagtcttactggggcagccttcacctag

SEQ ID NO: 96383 - DNA, 168 bp, Glycine max
  Peptide Sequence Number=SeqID_213161
atgaccaaacttggtctctgcttgtcatcgggcccgccgcctctggatgacaaaagggtgcgaataaccataagggtgcgaataaccataaggtatctccacgtatcatgggtgcagaatgaccaaacttggtctctgcttgtcatcgggcccgccgcctctggatga

SEQ ID NO: 96384 - DNA, 186 bp, Glycine max
  Peptide Sequence Number=SeqID_213162
atggttacttccatacttcaacttgacttgatgaaccttttcataaaagcatgggcttggttcaaccctataatccaaggaatgacaattctaatcgccaatacttcaacaacatttcatagggatgaaagactcaggaatacgcatgctatgcatgaggaaaccgcaaggatcatgcataagtaa

SEQ ID NO: 96385 - DNA, 313 bp, Glycine max
  Peptide Sequence Number=SeqID_213163
gcctcaagaggttaacattagcctcccatatttccatggaaaagataatgttgaggcctacttagattgggaaatgaaggttgaacaattctttgcttgccatcatattagcgaagagagaaaagttccattggctacccttagctttcaaggggatcctccagtagagtattggaaagatcttaaaagtgcccttaggaagaaacacattccctcctactatgagagggagcttatggacaagctccaaaggcttagacaagggagtatgagtgttgaagaatatagacaacaatgggactactccttttaa

SEQ ID NO: 96386 - DNA, 204 bp, Glycine max
  Peptide Sequence Number=SeqID_213164
atggaagctaaaaatgcatgggtggtcgctaaaatccgtctctacttgatttctactactattctgttttgccgcaagcaaaagtggtcgctaagtccgttgcaaaacactattcacagcaaaacacccaaaactgaaacagggaaagcgcttaataggaaaactgaaacagaacacacactaaacaaaataccaggacactaa

SEQ ID NO: 96387 - DNA, 459 bp, Glycine max
  Peptide Sequence Number=SeqID_213165
atggcctctaagaaacgtaagagtagggattctaggccacaagatcagaatgataacaagacatttcaatcagaggaagcctggaacttatatatcgataatattttagaccgaaggatccttccgaaaaggaatgtggaactttatcattctgagttcgacgagtttaaagcagaattggagagattaaggtctgatcccagagagatggaggctagtctatgcattccgggcaagggctttattctaaacacagagggccaaccatggaatctcctcagaaaaggtcttactaccctggctcagacatggagcgtcttctcttactcaaacctagttcctacctcccgcacttcaaatttgaacacagacagagctaggttggtctatggcttaatcacaagaatggacatgaacattggcggtttgatctctggacaaatgaccatgatggcctag

SEQ ID NO: 96388 - DNA, 1044 bp, Glycine max
  Peptide Sequence Number=SeqID_213166
atggcggcggtatacaccgcgctgagccggtgggagccgcgcatcagactgagcaccataaacatcaccatcgcctacgacggctcgatggtggttgagatggctggccagcgcgacgacggagcgccgctcgctttatccgtaccgacagggggcaacacaccggagattatcgaggtgccggactttgagacgctgctggctgaacgcaaagcggcactaattgcgctttatccggcagagcagcaggcggccgtgcgccgcgtgctggcactggagtccgatccgatggtgaaaatgctgcaggaaagcgtgtaccgcgaaatcctgctgcgccagcgcatcaacgaggcggcgcaggcggttatggtggcctatgcgctgggcagcgatctggaccagctggccgcgctgaataacgtgaagcgcctgaccgtgacgccagccaaccccgacgcggtgccgccggttgatgcggtgatggaaagcgacgacgccttacgtgtgcgcgtgccggaagcattcgagggtttatctgtggccgggccgacgggtgcctatgagttccacgcgaaaagcgccgacgggcgggtgctggacgtgtccgcaaccagcccggcgccagcggaggtgctggtaaccgtgctgagccgcgaagacaacggcacggcaacagctgacttactggctacagtgaacgccgcactgaacgccgagagcgtgcgtccggtggcggaccgcgtgaccacgcaggcggcaaccattcatgattacagcgttaaggcgaagctgcacctgttcgacggcgtggccgccggtccgtgccttgaggcggcaaacgaaaggctgaccgcctaccttaccgaacagaaaaagctgggccgcagtgtgcgccgggagtcttacggcgcggtgctgcgcgtggccggtgtggactgggtggaaatgatcgagccggcagaggacatcatcatggaccgcacgcaggccggcaactgcacgggcaccgacgtgtcggtggccgctgacggggtggcgtcatga

SEQ ID NO: 96389 - DNA, 403 bp, Glycine max
  Peptide Sequence Number=SeqID_213167
gggcgaaagactaatcgaccgtctagtagctggttccctccgaagtttccctcaggatagctggagcccgcgggcgagttctatcggctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 96390 - DNA, 792 bp, Glycine max
  Peptide Sequence Number=SeqID_213168
atggacatgaatgtgggagccattatctctggccaaatcacatctatagcccagtctaactcttctagacttgggttccctgctctgatcaccaccctgtgtaaagccagaggggttaattctgacagcttggttttcgagtgcctgagcccggtcatcaacttggcctatatcaggaaaaactattggaatcctgatgatctagttgtttctatcaaaggggccaggcaggcaaagatgaggctaactgagcctccttccacatctacagctcctattccagcatgtacctcagcagctccttctgtcccagcttttacaggttttcagcatcttgaagccatgcttcagagcgtccatcgagggcagatcattctattacagagtttacaggtggtggcgcctccaggatctattccttcagtggagcaggaagatgaaggtcccacaacccaggtacctcagcatgtggaggatgggtcatctgaggccaccatcctagagccatttgttataggagaagaggcagaggagacacaggtgagacaggtagttgctgccactcccgagcgatcccttgaggctacttcagagccttctgcacaaggggaggatataccctcacctcagcctgcaacaaacccctccactcctcttctagagatgccagaggacccgactacatcggtcctggctatggacacttctcctccaactactctagtattgcatctgatagttgaggaggatgttcagacacaggacacccaggaccagtcacaggaattttga

SEQ ID NO: 96391 - DNA, 423 bp, Glycine max
  Peptide Sequence Number=SeqID_213169
atgactggtatatttttgaaagagaaaaataatttggagtcattatttagggacgccacaattactcctacaccaggtcctcctggcccatctacccaggagtctcagcactttgagtccatgcttcagagtctttatcagggtcaggcaaggcaagaggctgctactccaaagaggtcaccacagatttcaccagatccaccctcgccagtggtggatcaatcttctcctcagcagctagcagaccctcttacaccagtgcatgagatgccaacagacccttctactccattactggagattctagaggaccctaccacaccagtcctgggactaactaccactcctatgctacattttatagataaggagggcactcaggatcaggatacccagcaggatgaccaatcacaggagttttaa

SEQ ID NO: 96392 - DNA, 225 bp, Glycine max
  Peptide Sequence Number=SeqID_213170
gagaagggagaattccacttagcaatcactaagcatggctccaaactcgaaggtgggggacacatgaaggaaaacacaactcatgggggtcctaaaaagatggagaatggagaaatgcaatctgcaatcactccgcaggggtccaaactcgaaggtggaggacacacgaaagaaaacgcaattcatggggctccaaaaagggtggagaatggagaattgcactaa

SEQ ID NO: 96393 - DNA, 144 bp, Glycine max
  Peptide Sequence Number=SeqID_213171
atgatggcacatcaaggagcaagggcaacacccttgttgactcgagcgttcgctaagcgccacacacatgggctaagcgcgaggaagactctggaagaagatgagctgtgcaggttcgctaagcgcaccgcttcatctcactaa

SEQ ID NO: 96394 - DNA, 417 bp, Glycine max
  Peptide Sequence Number=SeqID_213172
atggctaggttggatgaggttagtgtcaagcatggccgaaatctatttctcgatttctgttttctggaagtgtgggtatctataagggtggacgttgattggggtggtttggggaagaagatgaatgtgatgttgaatgtttcgtggaggaggaaactgagtgggttctgcaaaaatgtttgggtagcgagtcaggacattggttatcgagactgggatggaggtgttttctgctgtggaaggggtggatggggcgtctgcgctaagggtaatgttttggcccatgtggacgaaggtcatggtcaatgtttggtagttggtagtaattgtgtagaagaaagcttcatgatgatgaatcaagttgattcaagaagttttgataatgacaaagatgatgacaaaaagcccaaagaatga

SEQ ID NO: 96395 - DNA, 465 bp, Glycine max
  Peptide Sequence Number=SeqID_213173
atggtaagtgctccgattttgtctaatcccaatttctccttgcctttcactatagaaacagacgcatcgacggcgactacaagagccgtgttactccaggaggatcatcctatttctttttatagcaaagtcttctgcccacgcctgcaaaaggctttggcctacatccgtgaactccatgccattacttcctctaccccggagcaacaaacatatttgtctaaacttcttggctttgattacactatcaaatacaagcctggcgccactaatgttgttgctgacgctctatctcgcatcgtgccggcagacgccacttgcctcgcattgactatgccgcatttcactttcctaaaccaactacgacattcactattgcatgatcctcggtatgttagccttctgaaagacattcaggcaaagctggagaaccattccgatcttggtcttcaccaggaccttatt

SEQ ID NO: 96396 - DNA, 426 bp, Glycine max
  Peptide Sequence Number=SeqID_213174
atggttgtgggggatttcatcaacatactctccttccccgcatgtttgcattttagcgaagaaaacaccgagactttttcaagtctcacaagttatccagaactacgtaggtctgagttcctcattgggggatacgtaggagcaagagcctcgcttttgtcgaccacaccgccttttgtcgccatgactcaagagctggtagcccgcggagacaccttacggttatccgcacctcgtcattcagtgaccccaagtgtgattcacgagcagagaccaatatggtcatctgcgccctttccggagatgtcagcattttccgatggagactttccaagtctcacaagttatccagaactacgtaggtctgagttcctcattggaggatacgtaggagcaagagctttgcttttgtcggccgccccataa

SEQ ID NO: 96397 - DNA, 237 bp, Glycine max
  Peptide Sequence Number=SeqID_213175
atgactaatgcaaactatccgcaagaatcattgcatttagtctcaaacgggaatctacggttcactcagcatgaacaacagttatttatatatagcaaattacattcaacacgtataacaacattcatgacatacaagaacattcatgacgtacaagaacatacaaggacatcaacagttgtgtgtggtagcaaaggatcattaaattgtaaacatcatgggcgaaggtatcgataa

SEQ ID NO: 96398 - DNA, 384 bp, Glycine max
  Peptide Sequence Number=SeqID_213176
atggaagacgcacccgtgagccctcgcgtcgccctcccgccgaagggaagactttatgagggatccacaacggttcacaacatccctttgttgcatggccaagtgaaggttggtgttgaggaggttaaagatgcagaggctcccgttcctgtacccactaacgaggttaccttagtggggcaggcacttaacaccttccttgcttggccgacacatctcgtgaagcgtttatcaaaacatgcagctgtgtctccaggaaaacctccaaaaagcccagatcatgaggtcaatgatcccctgtatctgatgacattgaccattccacagctgtttctgaaagcctctctaggttatgtgggatgcttccgtgtacgggctgtttag

SEQ ID NO: 96399 - DNA, 201 bp, Glycine max
  Peptide Sequence Number=SeqID_213177
atgcttaattacattcgatgcatgtcttcaagcaagcttttcattggaggcctttcatatggagttgatgatcagtctcttaaggatgcatcttctggctttggatatgtggttgatggtaagttctatttgatttcattgttgtcacatggtgcccaattccagccacccgctagtctcactttaccatatgttctttaa

SEQ ID NO: 96400 - DNA, 276 bp, Glycine max
  Peptide Sequence Number=SeqID_213178
atgttggataaacaagtagttgtgtctccagcaaaacctacagatgggccggatgctcaggttaagtgggatgctaccatgttcggggtgtttaatgaacacttctcattgtacataaagcacgaagatctgtctaaaattgcacatggtggtcaatgtctcaacatatctgttatacagttgtggattctaaagttacatgaagagttggatgcagagttcaaaatgggatgtccaccttggagcctatctgaatgggccagacaactaccttaa

SEQ ID NO: 96401 - DNA, 201 bp, Glycine max
  Peptide Sequence Number=SeqID_213179
atgcaggattcaccgatactgatcggaaaaaatgctagccgacgtcggccaggaaagatgaccaatcgaggtcggctaggtttattcgttcgagctcaaccgaagttgtgttgtggccgacaccggcttgttttcatttgcttggcaaggaaaacattagccaacctcggaaaaaacacatgctggattcaccgatactga

SEQ ID NO: 96402 - DNA, 570 bp, Glycine max
  Peptide Sequence Number=SeqID_213180
atgggtatcggttcacgcgatattcaacttgatcttgttggtgtgatttatgaaatcatagcagtgatgctctatgtattatctatgtttgcaattgcacgagttggggctggtatacaccctatcattcaaatgacaggttcaacgatcgtgtcttggttaggttatgtgtgcttacttcccttttttctgtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 96403 - DNA, 677 bp, Glycine max
  Peptide Sequence Number=SeqID_213181
cagtgattgacactttccttgcctttcatcatggcaaggaaagcccggtcgtcgccattttggccatgtatgacacgttcgatcggggatgtgaaaagagcgacgcaagaattttttgttgtgcactggctctctatgtgtggctggtttcacacccttttctccaagaaggtaggcccgtctatccgctacaaggaaggaagaatcaggattctatcttcatgcgaaggatgtccaaatgttcccttgatggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaagactgtgagggacggtgaggttaaagcttcggaagaaagtgatgaggtacaagccctaaaggcagagcttgaaagagcccgagtagtcgaagagaagttcaaggcagcaatagtaagctcaagctccgaagaggtgaaaggaatcatcacgggtcaaaggcatgatcttgaaggacgagctaaaggcttaccttag

SEQ ID NO: 96404 - DNA, 1425 bp, Glycine max
  Peptide Sequence Number=SeqID_213182
atgagtctcattcactggtctttaatcttatggatcaccatgatgatgcttattatccataatttggataacgtggaaggaagataccactatcacagggggaagaagaaaatttcccctgctcctacaccaccagaggactctccttctccacccccttcaaattccccaagtgttccctctgacccttatcccaatgatcctcctggggactccccttcaggctgcattttcgatgtcagatcctttggtgcagttggagatggttcagctgatgacactgatgcattcgtggcagcgtggaaagaagcttgtgcagttgagtcaggggttgttcttgttccagaagatcactgcttcaagatcacttcaactatctttacaggtccatgcaagccaggactagtatttcaagtggatggtactctaatggcaccagatggaccagaatcttggcctaaggaagatagccacagccaatggcttgtgttctatagacttgatcaaatgactcttactgggaaaggaaccatagaaggcaatggagaacaatggtgggatcttccttgcaaacctcataggggtcccgatggaaaaactgtatcaggaccatgtgatagccctacaatgatacggttcttcatgagctccaatttggtgctgagtggggtgaaaattcagaacagtcctatgttccacgtgaaattcgatggttgccaaggagtactcattgataagttgtcaatttcttcgcctaaactcagtcccaatactgatggaatccacttagggaacacaaggggtgttgggatatataactccatgataagcaatggtgatgattgcatttccattggacccgggtgctcagatgtggacatagagggtgtaacttgtgctcctacccatggtattagcattggaagcctaggagtgcacaattctcaggcatgtgtctcaaacttaaccgttcgcaacaccatcataaaggaatcagacaatggcctgaggatcaagacatggcaaggaggaacgggctcagtgacaggcctgagatttgagaatatccaaatggagaatgtgaggaactgcatcatcattgaccagtactattgcatgtccaaggagtgtctcaaccagacatcagctgtgcatgtaaacgatgtgacatataggaacataaagggtacatatgatgtgagaacacctcctatacactttgcatgcagtgacactgtggcttgcactaacataacactctctgagattgagcttttgccatacgaaggggagctactagatgaccctttttgctggaatgcttatggaactcaagagaccatgactattcctccacttgattgcttaagagaaggtgagcctgatacagttgtggagctctcagcatatgattgtaggagttaa

SEQ ID NO: 96405 - DNA, 366 bp, Glycine max
  Peptide Sequence Number=SeqID_213183
atgccgtctcttcaaactgcactgcctcctgagctcgccaacaatgccactaggctttaccgtgaatgcctgcgaagagctaaatatattggtcatcggttttccttcaacactcagttaggagaagaaaataaaaagaaacataacacggagcttcttgttgatttggtgagacaacagtttaagaaaaacatgcatgaaacagatcccgagaagattcagaagttaaaggatgatgctgcgagggggcttatcaatcacatattgtatgagtcagagcaaatgacagaaaaagaggaaatccttttacagtcaaaccaagccaaagatgttggagttgaagagttagtgacagatggtcaatga

SEQ ID NO: 96406 - DNA, 348 bp, Glycine max
  Peptide Sequence Number=SeqID_213184
cttatagagccatataatggtggcttggaaactgagaaaaaggaaagcacaaaacagaaacttagtctccagggaagacaaatggagaaagtagaagctggtgtgggaccgccttttgggttgtgcagtatgtctgttgacaatgagtcaaaagagataaagaatatatatatagacttgtggacagcaaggtcaatgtctggagctaacaaaaagatgattgaggcactagctgctaggaagaaggaagagtatctaaagaaggaggagtacctgcaacaatttaagatgaattgtcataagttccattttcaaagctttcatccaatatatgcatgttttcaataa

SEQ ID NO: 96407 - DNA, 267 bp, Glycine max
  Peptide Sequence Number=SeqID_213185
atgtacgatatgagaggatacatgagcgatagtaatgggcgggtaaacactagtgtccgagtgagagggaggttcaatggtaaccagagagacaagtgcccaacttttttcttcacacactttcctaaaaacttcaatatgcttgtgaacaaatcgtatggaaaatacggtgccaaaggaagttttaggggtgaatataggagatcaagacaggttaagataggatacaaacctggtctcaagaaggaaggttggacgtatgcttaa

SEQ ID NO: 96408 - DNA, 3438 bp, Glycine max
  Peptide Sequence Number=SeqID_213186
atggtgaaggttcgcttgaacaccgccgatgtcgccgccgaggtcaaatgcctccgccgcctcatcggaatgcgatgctccaacgtctacgatctttctcccaagacctacgtgttcaagcttatgaacagcagtggagtttccgaatctggggagagcgagaaggttctgctgctgatggaaagtggcgtgagattgcacactactctctacttgcgtgacaagagcaacactccctctggtttcactctcaaattgaggaagcacattcgaaccagaaggctcgaggatgtgcgccaacttgggtacgatcggattattctctttcaatttggacttggggagaatgcaaactatgtcatattggagctgtatgctcaggggaacatcctcctcacagattctacttttactgtcatgactctgctacggtctcacagggatgatgataaagggcttgcaattatgtcacgccatcgttatcctgtggaaagctgtagagtttttgagcgaactactattgaaaagttgcggacatccctagtgtcttccaaggaagatgataacgatgatgctgttaaggccgatggaaatggaagtaatgcatctaatgtagcaaaagagaagcagggaacccacaaaggtgggaagtcatctgccacattgaaaattgtccttggggaggcccttggttatggacctgcactttctgaacatatactattagatgctggcctaatccccagtacaaaagttcccaaagatagaacgtgggatgatgctactgttcaggcgctggtccaagctgttgtgaggtttgaagattggatgcaggatgttatttcaggtgaattagtccctgaaggatacattttgatgcagaacaaaaatatggggaaggattcttccatatctcaaccaggaagtgttagccagatgtatgatgagttctgccccatcttactcaaccagtttaagtcaagggattatacaaagtttgagacattcgatgcagccttggatgagttctatagcaaaattgagagccaaagatctgaacaacagcagaaagccaaagaaaactcagcttctcagaaacttaataggattcgccaggatcaggaaaatcgagtacatgctttgaggaaagaagctgatcactgtgttaagatggcagaattgatagaatataacttggaagatgtggatgctgctatattagctgttcgtgtagctcttgcaaagggtatgaactgggatgaccttgctcggatggtgaaggaagaaaagaaagctggaaacccagtagctggtctcattgacaagcttcatctcgacaggaactgcatgactttactgttaagcaacaatcttgatgaaatggatgatgatgagaagacactccctgtggataaggttgaagttgatttagctctctcagcacatgccaatgctcggaggtggtatgaacagaagaaaaagcaggagagcaaacagggaaaaactgtaactgcccatgaaaaggcttttaaagctgcagagagaaagactcgcctacagcttaatcaggtggaatattcattttggcttctttatgatatttggccaaaggaaaaaactgttgcctcaatttcacatatgcgtaaagtccactggtttgagaaatttaattggttcattagcagtgagaactatttggttatcagtggacgtgatgcacagcaaaatgagatgatagtgaagcgttatatgtcaaaaggagatctatatatacatgctgatctgcatggagcttctagtacagttatcaagaatcacaagcctgcacaaccagttccacctctgaccctaaaccaagctggatgtttcaccgtctgccatagccaggcctgggattcgaaaattgttactagtgcctggtgggtttatcctcatcaggttagtaaaactgctcctacaggcgaatatctgacagtagggagtttcatgatccgtggaaagaaaaattttcttccaccacaccctcttatcatgggttttggcctactatttcgcttggatgagagttccttgggatctcatttaaatgaaagaagagtaagaggagaggaggaagcagcagatgattatgaagaaactggccctcttgaagataaatctgattcagagtctgagaaggatgtcactgatatagaacctgccactgacttggaaaggaatggtaatttgtcagcagattcacacaaacccctaccagaagacttccctgcagatccatcccaaactagtttggctactaccgatgccgaaactgcaatttcacaggattttcctgcgaaagagacaagtacattgaatatggttgatagggagatattatcagatgttggtggaaatggcttagcatctgtcacccctcagcttgaggaacttcttgatcaagctctggaacttggacctgttgctaaatcaactgagagacgaaagcttaaaaaagaacagaaacctggagaagaagattcaaatgttgaacatggaaaggatgaatcaaagctaaaagatatttctgctaatctaccagtgaaagaagatcaaaatttgaaaaaaggtggtggtcaaaaaatcagtcgtggacagaagggaaaacttaagaagataaaggagaagtatgctgaccaggacgaggaagaaaggagcatccgaatgacattgttggcttcttctggaaaatcaatcacgaaggaagagacatcatctgaaaatgatgcattggacaaagggaaaaaacctggcagtgagtcctcggcccacttaaaagggttgagtagtgaccctgcttggttcattgcccagtggcagactggtccttcggatgctccaaaaataccttctgatgctccaaaaatatgttacaagtgtaagaaggcaggtcacttatctcgggattgtaaggatcaaccagatgatcttttgcataggaatgcagttggtgaagctgaagagaatcccaaaacaactgctattgatacttcccaagcagatagggtggcaatggaagaagatgatattaatgaaataggagaagaggagaaagaaaaattaaatgacgtagattacttaacggggaatccacttcctaatgacattctcttatatgctgttcctgtctgtggtccttacagtgcagttcagtcttacaaatatcgggtgaagataattcctggaccgaccaagaaagggaaagctgcaaaaactgcaacgaacctattcagccacatgtcagaagcaacaacccgggagaaggagttgatgaaagcctgtacagatccagagctagttgctgcaattgttggtaatgtgaaaatatcggcagctggccttacgcaattaaagcaaaaacaaaagaaaggcaagaagagcagcaaacaagagagttaa

SEQ ID NO: 96409 - DNA, 1161 bp, Glycine max
  Peptide Sequence Number=SeqID_213187
atgtatggtatcctggcaattctgttcgagctgcgtaggataatatgggcgagcgaaaaattgtggataaatgcagccgatgtagagcaagtggtggagaccctaaaaaacttattaaggttgaggactgttaagggcactgtttttgccacggataacaatggagcttatgttgacattactgctaagtccacggcctacttgcctcttcatgaggcttgcatccacagaattaagaatgtggaagaagcaggcataattcctggcgtgagagaggaatttatgatcattgatgagaatcaagcggatgataccttgatcttgagtttgaggtctatccaatatgacattgcgtgggaacgctgtagacaacttaaggctgaagatgctgttgtcaagggtaaggttgttaatgcaaacaaaggaggtctggtggctcaagtggaaggccttaaggggtttgttccattttcacagatatcatcgaaatcagctggagaagaacttcttgagcatgtgattccttttaagtttgtagaggtggatgaggaacagtctagacttgttctcagtcaccgcaaagctgtggctgagagccaaggacagctaggaattggatcagtagtcactggctctgttcaaagcataaaaccatatggtgccttcattgacattggtggaatcagtggcctccttcatgtcagtcagatcagtcatgaccgtataactgatattgaaactgttcttcaacctggtgatattctgaaggtgatgatcttaagtcatgaccgagagagaggaagggtaagtctttccacaaagaagttggaacccacacctggtgacatgattcgcaatccaaagcttgtctttgagaaggcggaggagatggctcagacattcagacagagaattgctcaagcagaagctatggctcgtgctgatatgcttagattccagccagagagtggattaactctcagcggtgaaggaatcttaggaccactaacttcagacttgcctccagagggagtggatctgagtgagaaattagtcaatatcacatttgccaccttcattctgattctaaagttaagttatcatgcaagcaagcagcagcaaggcgaatactttaaagccactggaatagtgataagttga

SEQ ID NO: 96410 - DNA, 348 bp, Glycine max
  Peptide Sequence Number=SeqID_213188
atggagggggagggaggttgggaggggcggaaggaagaagagggagaggaggagggaggggagggggaggtcgcacaaggagaaggaagaagaagggaaaaagttgttgctcagcttggtactcgaactgcttgtggtgggatcctccgtgaccaacattggacaatgttcggtgcttcatgcagaattattggcaatttttttgtttgggatcaaattagctttctcaagagagccagagatgaaatgactaaacaagccttgagtcttattagtgattatcttgttttcgagtttgttcctgattgtattttaagtgctttgagggctgattcgttccatttatag

SEQ ID NO: 96411 - DNA, 324 bp, Glycine max
  Peptide Sequence Number=SeqID_213189
atgttgaattgtcaagccatagtaaacaacgaatatggagagcaaacagaagaggagctgcttccagggggaaagaaccttcgtgtcactaatgagaatgtcattactttcatccatcttgtggccaatcaccgcttgaattttcagatacgtcaacaaagttcaaatttcttgagaggacttcagcaacttattcagaaggattggattgatatgtgtaatgagcatgaacttcagcttctgacatcaggttcacttgacagcttggatgttgatttgcggcagcgtacaaactatgcaggaggctatcatagtgtaaggtga

SEQ ID NO: 96412 - DNA, 405 bp, Glycine max
  Peptide Sequence Number=SeqID_213190
ctggcttctgacaaagtaaacccggaaaagtcacaggttaatgtgaccctgccgttacatacgattgacacgcatgtgccagcgctgaccaaagagtttctgggtaatgagtattttgacgttaaaaaatatcctcaggccaccttccacagcacccatgtggaaagcaaaggcgataataaatatgatgtgcagggtaatttaaccatcaaagggatcactaagccggttgtgctgcacgccacgctgaacaagcaggatatgcatcctatggttaaaaagcaggcgatcggttttgatgctaccggcgtcatcaaacgctcggattttaaaatcgataaatatgttccggccgtgggcgacgaagtgacgattacgctctctaccgaggcgtacgccaaataa

SEQ ID NO: 96413 - DNA, 544 bp, Glycine max
  Peptide Sequence Number=SeqID_213191
atggcgcggcggccgcagggccgcggccaacgcgcccagcaggtagccggcgtaattggccgaggccagccaactgccctgcgccagcgacagcccggcctcctgcgccatcaacggccacacgggcgtgaaggcgaagcggccgatgcccatcgccgcggccagcgccagcgcggccggcagcgccaggccgagggcgccgcggggacgggcgatcttcaaggcggtggcggaccatggcggcgtggcgcgcgcggcggcccacctgaaccgggtgcagtccaatgtctcgacgcgcctgaagcagctggaagccacgctggaggcgccgttgttccggcgccagaaccgccgcctggtgctgtccgagcagggacgcgtgctgttgtcgtatgcggaccggttgctgcgcctgtcggccgaggcccaggcggccgtgcgcgatggcgcgccgcaaggcctgctgcgcatcggcaccatggaaagcacggccgcggcgcggttgccgccgatcctggcggcgtatcacgcggcctggccgcag

SEQ ID NO: 96414 - DNA, 238 bp, Glycine max
  Peptide Sequence Number=SeqID_213192
atgctggccgtgagcctgctcgccgtggcgctgctgacgctggcgatgccgtggttccacggcgtcctggcctggagcctgctgcggctggcggcggggtacggcagcgccagcgccttcatctgcgtggccgcttcacgcgccgtcggaccgggcgatccccgcgcgccggcggtgtcggccattacctacgcgggcgtcggcgccaggcatcgcgctgaccgggctggcgtgcctg

SEQ ID NO: 96415 - DNA, 256 bp, Glycine max
  Peptide Sequence Number=SeqID_213193
atgggagatcgcttggaggatatgatttgtgatcttggacaagagtcttttcaacaagcacattcccctatgtatgatacattgcaaactgattcaaagaagcctttgtatccggggtgcaagaattccttgacgttgttgtcaatggtgttaagtctggttaatgtgaaggctagatatgggtggagtgacaaaagctttagttcacttcttcaagtagtgcacgatatgcttccagaggaaacatgttgccaaa

SEQ ID NO: 96416 - DNA, 180 bp, Glycine max
  Peptide Sequence Number=SeqID_213194
atggatgtaggtgactttggtcttgctaaaatgttgacatctgatgatcttgcttcttcggttgttgggactccaagttatatgtgccctgagcttcttgctgatataccctatggctcgaagtctgatatttggtctttgggtaggatagattccatttgtactcctgaaattgcctaa

SEQ ID NO: 96417 - DNA, 222 bp, Glycine max
  Peptide Sequence Number=SeqID_213195
atggtggtgacgggtgacggagaattaggttggaccttgggttgggtcgatcggtccgcctccggtgtgcaccggtcggctcgtcccttctgccggcgatgcgctcctgtccttaactgggcgggacgtgcctccggtgctgttactttgaagaaattagagtgctcaaagcaagcctacgctctgtatacattagcatgggataacaccacaggattctga

SEQ ID NO: 96418 - DNA, 180 bp, Glycine max
  Peptide Sequence Number=SeqID_213196
atgggtgccaagcacctcacgaggaccaaagaatggtcgcacgtcatcgagcaaaggtccccggacgaaattagggtcttggatggtggcactcacattctattgaaactgaatgttactggtagccatttgcgtcgtcagctcctccaaggaagcttggtatttgctgtggaaggttga

SEQ ID NO: 96419 - DNA, 249 bp, Glycine max
  Peptide Sequence Number=SeqID_213197
atggacaaagatcaatggacgtatgactatgcgatgtcacaagaagtttatatggattatgattatgataatgaagaagaatgtggggtattcggtactcgagatgatgttttgcaatgggctcgaacagttgcccatgaaaatggatttgttgcagtgattatgaggtctgatacagatatcggtagcagaggaagaagttcatttgtcttaattgggtgtgaaaggagtggcttcgtgggaaactag

SEQ ID NO: 96420 - DNA, 1392 bp, Glycine max
  Peptide Sequence Number=SeqID_213198
atggcagagtcaccaaccttcaaagtccatgaagtctgctccatttcgccgccacaagaaaccccaccaacaactcttcccttcaccctcttcgacgtcctatggcttcggttccccccagtggagcgtctcttcttctattccttcccaaacccaacaacaacatcatttttcgacaccaccgttctcccaaatctcaaacactccctctccctcactctccaccacttccctcctctcgccggcaccatcacatggcccaatcactcacccctccctctcataacctacactcccggcaacaccatccccttcacaatcgcccaatccaacgcagatttcaacaccctctcttcaaacctctctcaagtcaaccaccacctccaaaacctaataccccacttaaccatttcccatgaagaagcttccgtgttagcacttcaactcaccctcttccccaaccaaggcttttcgattggaatcacaacccaccacgctgcacttgatggaaagtcttcgactttgttcatcaaatcgtgggcgcatttttgttctcagcttaatacctccccagaagaaccgttatcactaccaaagcatctaataccctcgtttgatagatctgttataagagacactttggggatcggtgagatttacgcgaactcatggatgaacttcggtggagccaccaatgaccgaagcttgaatgtgtgggattccctcggtggaagtcaaaccgatttggttaaagggttgttcgagttgacaccgttggatatcaagaagctgaagaaattagcggagtctaaggttgttgtcggagacaacaagaagaagattagggtgacatcgttcacggtcacgtgcgcttacttgttgtcatgcgcggtgaaagcggagcaacccaactgcgaaagagtgccttttattttcagcgtggactgtagggcgcgtttggatccaccaattccgggaacgtactttgggaacagcgtcgtgtctttgttggtgatagcaaagcgagaagagctattgggggaagaagcgttttttaaaagcgttttagggataagcgaagagttgaacaggatagagggtgacgtgttgaacggtgcggacaggtggatgccgaagattcaatcggtgatgtcggagaggccgaggttgttctctgttgcggggtctccgaggtttgaggtttacgatgttgactttgggtggggaaggcctaagaaagtggatgttacttccgttgataaaacgggtgcgttttcactttcggagactagggatcacagtggaggcattcaaattgggttggcgttgaccaagagtcaaatggaggcgttttctacggtttttgctcaagggcttgagtccttggaataa

SEQ ID NO: 96421 - DNA, 285 bp, Glycine max
  Peptide Sequence Number=SeqID_213199
atggatccaaactaccaagccaacaccctgtataaaatacacccaaactcgaaaatcatgcctgttgatgaagttcgcgcagctataaaatgcccattagagtcgcgtataacagcttccaaactgaattctcccaaagctgataatacggaggcgtcgatgttaaatttcagccttccattgcgagattggatgatagttaggggtgggaataggtcagaccaggctttaaaaggtctgagtctagcctacgatgaatttttgaggcctgaatctgacctatag

SEQ ID NO: 96422 - DNA, 3354 bp, Glycine max
  Peptide Sequence Number=SeqID_213200
atgttttcttcttctttttctcacagcagttcagcgatcaaatggaattccctcacacaatttctcttccttgttttcttcctcttctccgcgtcgcgaaacgacgccgtttcgcccttttcggacaaatccgcgctcctccgccttaaagcctcgttctccaaccccgccggcgttctctccacgtggacctccgccaccgccacctctgactccggccactgctccttctccggcgtcctctgcgacgcgaactcccgagtcgtcgccgtcaacgtcaccggcgccggcggcaacaaccgaacatctcccccgtgctcaaatttctcccaattccctctctacggcttcggaattcggcgaacctgttccggtagcaaaggttctctcttcggaaacgcttcttctctgagcttcatcgccgagctcacggagcttagggttttgtcgctccccttcaatgcgttggagggtgaaatccccgaagcgatttggggcatggagaacctcgaggttctcgacttagaagggaatttgataagtggctgtcttcctttcagaatcaatggcttgaagaatttaagggttttgaatctcgcgtttaataggattgttggggatatacctagttcaattgggtctcttgagagattggaggttttgaatttggctggtaatgaattgaatggttctgttcccggttttgtagggaggcttagaggggtgtatctgtcttttaatcagttaagtgggattattccaagagagattggggagaattgtgggaaccttgagcatttggatttgtctgcgaattcgattgttcgagcgattccaaggagtttggggaattgtgggaggttgaggacgcttttgttgtattccaatttgttgaaagagggtattccgggtgagcttgggagacttaagagccttgaggtgttggatgtttccaggaacactctcagcggctctgtgccgcgggagcttgggaattgcttggagttgagagtgcttgtgctgtcgaatctattcgatccacgtggggatgttgatgctggtgatttggagaaattggggtctgtgaatgatcagttgaattattttgaaggggcaatgcctgtggaggttttgtcgcttcccaagttgaggatattgtgggctcccatggtgaatttggaaggtggtttacagggaagttggggcggttgtgagagcttggagatggtgaatttggctcagaattttttcagtggggagtttccaaaccagcttggtgtttgcaagaagctgcattttgttgatttaagctctaacaatcttacaggggagctttctgaggaactccgagttccctgtatgagtgtgtttgatgttagtgggaacatgttatctggttcagttcctgatttctccaacaatgtttgtccccctgttccttcctggaatggaaatctgtttgcagatggcaatgcttccccgcggtatgcatccttttttatgtcaaaggttcgtgagagatcacttttcacgtcaatggggggagttggcacttctgttgttcacaactttgggcaaaacagctttactgacattcactcgttgccagtagcacatgacaggctgggaaagaagtgcggttacacatttcttgttggtgaaaataatcttacaggaccttttcctacttttttatttgagaaatgtgatgaattagatgcattgcttttaaatgtcagttataataggatatctggtcagattccttccaattttggtggaatatgcagatcattgaaatttttggatgcgtctggaaatgaacttgcaggaacgattccccttgatgtagggaatttggtctctcttgtatttctgaacctcagtaggaatcagttacaaggccagattcccaccaaccttggccagatgaagaatctgaagtttctttctttggctggtaataagttgaatggctcaattcctatcagcctggggcagttgtactctttagaagtcttggacctttcttcaaactctcttactggtgagattccaaaggctattgaaaacatgagaaatctgacagatgttttgctcaataacaacaatctttctggtcacattcctaatggtttggcacatgtcactacactctccgcattcaatgtgtctttcaacaacttatctggatccttgccttcaaatagtggcttgattaaatgcagaagtgctgttgggaatccgtttctaagtccctgccgtggagtttcgctgaccgtgccatcagggcaactagggccacttgatgcaacagcaccagctactacaggcaagaagagtgggaatggcttcagttctattgaaatagcatctataacttctgcttcagccattgttttggtccttatagccctgattgttctattcttttacactcggaagtggaagccaaggtccagggttattagttctataagaaaagaagttacagtgttcactgatattgggttcccattgacgtttgaaactgtagtccaagccacaggaaacttcaatgcaggtaactgtattgggaatggaggttttggcacaacatacaaggcagagatatcaccaggaatcctggtggcagtcaaacgacttgcagttggacgtttccaaggtgtccaacaattccatgctgagatcaagacccttgggaggcttcatcatccaaatcttgtcactctgattggttatcatgcttgtgaaacagagatgtttctcatatacaattttttatcaggtggtaatctcgaaaagtttatccaggagaggtccacaagggatgtggagtggaaaattcttcacaagatcgcattagacatagcccgtgcactcgcctatctgcatgatacgtgtgttccccgcgttcttcaccgcgatgtcaagcccagcaacatcttgttggatgatgatttcaatgcttatctatctgactttgggttggctagacttctggggacttcagagacacatgctaccactggtgtagccggaacattcggctatgttgcacctgaatatgccatgacgtgccgtgtttctgataaggctgatgtgtacagctacggtgtggtgcttctggagttgctctcagacaagaaggcattggatccttcgttttcttcttatagaaatggtttcaacatagtggcatgggcatgcatgctactgaagcaaggaagggcaaaggagttcttcactgctgggttgtgggaagcaggacctggagatgatttggtagaagtgcttcacttagcagttgtgtgtactgttgacattctctctaccagacctacaatgaaacag

SEQ ID NO: 96423 - DNA, 336 bp, Glycine max
  Peptide Sequence Number=SeqID_213201
atgaatgatgcaaaattcgaaagctttgctaatattttgtcaccccttggaaattgttgctcttttagtctaatggcagttgaatcttttccctctgcttcaatgccctctcagtcaatggcattggcttcaactaggacttctacaccctgtgggacaaagtgtaaagttgttatggttgatgtcactgatacacaatttgataagttcaacacaggtcttgataacgtggttgaagcgattgggtgtggtagtgtatatgctttaaaacaatcaaatgtagctgagaaacaagtcaatatttctgaatgtcaagttattgcaattgagaagtga

SEQ ID NO: 96424 - DNA, 946 bp, Glycine max
  Peptide Sequence Number=SeqID_213202
atggccttcttgaattatgagaacaagaaaggaagtggtaagaaactaaaagtgcattttgatcttcctgaggatgatgattttcccaatcacaggcattcaagttcttcagtttcatctgaatcctcattagattcagatgatactgacaatgacaatagcataaacaatgttgattccaagtacggtttgtacggctcgcctgtatggagctttcaaggagggtcagtaactcaatctcctccagttcagtttatgaattctcctggctatgatccaaacagaatcccctcttctgtattcaataaacctacaagtcctatggaatggagtgtagcctcaaatgaatcactattcagcatacaattaggaaacagcagtttctcaagggattatgcttttgcattcaacaacaaatctggggaattgcctaggactagtgatttgcccaacatgcccgcaacattgccatctgttcaagaggtacctgctaaagaaaaaaatgtggacatggagagacagtctgtgtcatcagattcatcaagtgaaaccgcagattcgattagggggcatgaccatgacaaaacatcacatgaatcagcaggttcagttgttgacctcaagaaaacagaaaattcagaagaaattggcactgatgaagtagtgttggacaaatatccagatgatcattctaaagaagcaaagatccctaatggggaagccaagaactatgcaagtgtttcataccgttcggtggaaagcaatatgagcacacggtgggatatcctgctattgacaatcattttcttcttgaattctttcagattgacagcagaaggaggaagaactagttcgtcaacagtagagtcagaaaagcaggagcagcagccagagaagccacagcagcctcctagtcctaaaacagaaaaagcaccaaagaaaagtg

SEQ ID NO: 96425 - DNA, 135 bp, Glycine max
  Peptide Sequence Number=SeqID_213203
atgttggtggtggctgaacgagctgagagggttgatggatcagtgggtgaagacattctcagtgcgggtggccggaacagtaatcagagcgccattggaatgccaccagaaaagctaccactcaaactggagtag

SEQ ID NO: 96426 - DNA, 363 bp, Glycine max
  Peptide Sequence Number=SeqID_213204
atggaatttacgtcctggttcataatccgccacgacggagccggcacctgggagccatggggtcgccttgagcccaacaactctaacgccgtcggctaccgttttgaagtcctccccggcaccgccgttttgaagagtaatggcttgattatgttgaaaggcagaaaagataggactggactggatgtggaagccttgaaaaagctaaacaaaaataagaagttggtgaagaatctagctaaaaaatatcatgcctcttttgcttctgaagctgtcattaagcaggattcatcgccttttgggtcctggtctcaacaaagcaagcatgtattgccgttatgtttttctggtttaggattgtga

SEQ ID NO: 96427 - DNA, 288 bp, Glycine max
  Peptide Sequence Number=SeqID_213205
atggtaaaggcggcgacaccgcttcacaaggcaatggaatatgagactgctccggcggaggtgccacctgtgagggcggtgccgtcgacgccgggagcattgatttatgacggaagtcaaaacagagtaagaagcaagttaagagaacaaacaatcgcaaggtctaggacaaggaggaatgaagacttgaagaggtggcgccgcaactggagaatgaaaggagagaaagaaaaccctaatgctaagagtaaggcaacgtgttttttcagctttgtttctctagggtag

SEQ ID NO: 96428 - DNA, 672 bp, Glycine max
  Peptide Sequence Number=SeqID_213206
tggcttctgtttctatcagctgtcctcctgttcagctactgacggggtggtgcgtaacggcaaaagcaccgccgggacatcagcgctggcaagtgtagcggctgcgcaactgttgggaagggcgatcggtgcgggcctcttcgctattacgccagctggcgaaagggggatgtgctgcaaggcgattaagttgggaattcgatcagcgattccactcgtcgcttatttagtgtggcaattagcgactcacggcgtattaagccaaaatgaattcgtgcaagtactccaagcggatccaacacttaacggattagtgaacgcgacgcgtcaaatcacgaattcccacatcatgggcgaaatcgtgcgtgtattctcagcgcttgcattaatcacctctttccttggtgtgatgctaggggtatttgaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 96429 - DNA, 240 bp, Glycine max
  Peptide Sequence Number=SeqID_213207
atgggacaattatggcgtatgggcagactggtactgatcactacctatattccagattttggaaatgcaggatgtggacaaataacttgggcatgggaaactgctagattgaaggacgaagttgcagcacatctaacagctgcaatgaagatgatgaagagtataccacatagacattaccatggaaaagacacacaagagacttatctcgagacgacttcttcagtcaaaagactctga

SEQ ID NO: 96430 - DNA, 225 bp, Glycine max
  Peptide Sequence Number=SeqID_213208
atggttaaatttcaacttaagaaagagctctgcatgggagtagctgtgggcaatgttaatatggaggaaaagcaaatcttccaaaattttgcatctttgttgaatttgttgcctattgactttggcaacatatggcagtgttcgttgatgagaatcctgaaactggtcaaatacaggctaaagacccaagtggagaaggatgaaggcccaagtggagaaggatga

SEQ ID NO: 96431 - DNA, 369 bp, Glycine max
  Peptide Sequence Number=SeqID_213209
atgatgaggccatggatcgggacccaccgtaggactagtgacaggatttctactttcctgtcttttgaacacttttatgttgaagcaaagcttcatgacgaatcaaggttgattcaaagatgttttgatgataacaaagatgatgacaaaggtgatgacaaaaagctcaaaggtcaatcaaagaatgagttcaagatgttcaagatagaatcaagaacacttcaagattcaagaagaaagttgaagaacacttcaagattcaagaggaaagttgatttcaagaatcaagattcaaggatcaagctttcaagaatcaagataaggcttaatcaagataagtatgaaaaggttttttcaaaaactgagtag

SEQ ID NO: 96432 - DNA, 501 bp, Glycine max
  Peptide Sequence Number=SeqID_213210
atgcacagtgcgcgtccgcagggggagaccacccttgccaaggcccttaacgctggcttatctgatgctctggcagccgacgatcgtgttgtcctcatgggggaggacgtcgggaccctcggtggtgtcttccgcatcacggacggcctcaaagcccagtttggtggccgtcgagtcatcgatacgccgttggcagagtcaggcatcgtcggaacagcgattggtatggccatgcgcggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcttaa

SEQ ID NO: 96433 - DNA, 835 bp, Glycine max
  Peptide Sequence Number=SeqID_213211
atggatgctgaatggggattatatcagagaatcgcagcggctcacaaatttccgtgggcgatgactttaggagccatacaggataaaaatcttatttaccagatgtcctctaaaattgccgaagactgtaagaggatgggaatcaattgggattttgccccggtagttgatgtgaatacaaatcctaataatccaatcattggaaacagaagctttggttcagaggtagataatgtcatcagctctgcattagcatactctaatggattacaggacaacaacatactagcagccattaagcattttcctggtcatggtgacaccagtacagattcacatctggatcttcctgtagttcctcaccaactcgaaagactgaatgctgttgaattggcaccttttaaggctcttatgactaaaggtatcggtggagtaatggtagctcacttatatgtgccaacgttagaatcgggaaaaggaattcctgcttcggtttccaaaaatattatcaccggacttttaaaagagaagttagggtataaaggcctcattattacggacgcactcaatatgggtgcagtagccaataaatataagcccggggaattagatgcattagcctttaaagcagggctggataaatacaattccaaaaatcctgaaaacattaataacgacctgaataatgattcacacaaacttttggttcagaatctttattctaatgcacttaccctattaaaagatgagcaaaagctacttcccattgccggaaaacaagtgtattatgttcctttagaagaagctccttatcagacgtttgccaatcagctag

SEQ ID NO: 96434 - DNA, 378 bp, Glycine max
  Peptide Sequence Number=SeqID_213212
atgagggttcactgtaatcaagcaagtcggagacctagcatgatcacggattcacctccactccttatgttcccacgaacccggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaaaggttcgggagttgtatttacgcacggggaaggtattagcaccccacacgtccgtcccaagggacgacagcctttaatcgaatgtgcaaacatgaccttgattttttatgttcccttttaa

SEQ ID NO: 96435 - DNA, 216 bp, Glycine max
  Peptide Sequence Number=SeqID_213213
atgcaatggttgaaggaggacgacaatgattattcgtacgaggtgaaaagggaacacaatagggacatggtggtagagatggttggtacgattaagacatgcccacaatgctccctcacttatctcgaaaaaaagcctatatcagacataccaacttactttcccacagtgagagatttgaaagtttttcccatgctagcctatgccttagtttag

SEQ ID NO: 96436 - DNA, 198 bp, Glycine max
  Peptide Sequence Number=SeqID_213214
atggaggaaggatgcacaagcattgctgctacgatgttgctaaatcagtttgcgaaggagattaatagaaagaaaaggaaaagagagaaggagagagaaaggaggatcaacaactcaacgatgttccgatggacactgaggtggtacatgctctacacctcacggaagatgtcctctagggacaaggggaaatcacct

SEQ ID NO: 96437 - DNA, 417 bp, Glycine max
  Peptide Sequence Number=SeqID_213215
atggtcgtggagaaaggggagagcttgccctcttactccaggtttgctagactgaggcctgatcctcaggagcttgcaacccagctgtgtatccctcgtaggggatttgttcttgatgccgaggttctgctgtggaagctcttgaggaaagatcttaccaccctggcccaaacctggagtgttctatcttattctaacttggccccgacatcccatacttcttatcttaatctggatagggccaagttagtctacgggcttgtaatgaagatgaacatgaacttaggatcacttatttctagtcagatttcattcattgctcagtccaactcctcgcggcttagatttccagccctgattactgccttgtgcaggcccgaggagtcacctcagattctcttaccttcgagacactga

SEQ ID NO: 96438 - DNA, 656 bp, Glycine max
  Peptide Sequence Number=SeqID_213216
ggtggacccttgggtacttgtacctatcacttttagaggactacacgtccttgccaacagagggctgcacgccctcacctccagaggactacatgtcctcgccttgagagggctacacgccctcaccttggagggctacacgccctcaccttgggtactagttaccctcaccgttagaggactaccgtctcgccttgtgaggactacatgtctcaccttcagagggctacatgtcctcgccatcggaggacttcatgtcctcgccatcagagggctgcacgccctcacctccagaggactacctgtcctcgccttgagagggctacacgccctcaccttgggactacacgtcctcaccatcagagggctgcacgccctcacctctagaggactacatgtcctcgccttgagagggctacacgccctcaccttgggactacacgtcctcgccttgagaggactacacgtcctcaccatcagagggctgcacgccctcacctccagaggactacatgtcctcaccttgagagggctacacgccctcaccttgggtactagttaccctcaccgtcagaggactacacgtcctcgccttgagaggactacacgttctcagcatcagagggctgcacgcccttacctccagaggactacat

SEQ ID NO: 96439 - DNA, 697 bp, Glycine max
  Peptide Sequence Number=SeqID_213217
gctacacgccctcgccttcagaggactacttgtcctcgccttcagagggctacacgccctcgcctttagaggactacacgtccttgccttcagtgggctacatgccctcgccttaagaggactacacgtcctcccctttagatggctacacaccgtcgccttcagaggactacatgtcctcgccatcagagggctacacgccctcgccttaagaggactacttgtcctcgcctttagagggctacacgccctcgccttgcgaggactacacgtcctcgccttcagaggactacacgccctcgccttcagaggactacacgtcctcaccttcagagggctacacgccctatccttttggggattacacgtcctcaccttcagagggctacacgcccatgccttcagaggactacatgtcctcgcctacagagggctacacggcctcgcctttagaggactactcgtcctcgccttcagagggctacatgccctcgccttcagaggactacacctcctcaccttcagaggactacacgtcctcgccatcagaggactacatgtcctcaccatcagagaactacacgtccttaacaatgcatcttcaactctaaaatttatgttctcctaccatttaggatggaagaactttatgtacatcaacaccaaaatatggaacaagaaaagaggctggaaatga

SEQ ID NO: 96440 - DNA, 654 bp, Glycine max
  Peptide Sequence Number=SeqID_213218
atgccatcccctgcctcagtgattcttagattgatgcttgacaaagggctcaccatgcgatcacggtcaagctggatggatatcttggtctaccttgttcttgatgcttgtgtgaggtttaaattgtctttgaaaggcattctagagatgaatggtttgagaaatgagatgaaggaattgaaggatcacattgatggagttttggctttttatgtttgtcactattgccagttctatgatagtttgttgagcttgcacttcaaatttagcaacattgatgctgctgctaagcttgttatggatatgactagctcgcataactatgatgttaaaaaagaatgtgagaaacatatgcaaaagccttgctttattgccattggatctcctttccttaggactgtcttaaagatacatattaagtctgagctactgcataaggattctatccttaaagtggaaagcagacaagatcttattttctatgatgatgggaaactagttcttagtaacagtgctctggctaagttcatcggtggttacaagaaagatgggaggattagtgaactttcaaaagttttacttagtattcaaggggaactaaattcagtggcagggtccagtttgtgttctgatgtaattggtgctcgtgtttag

SEQ ID NO: 96441 - DNA, 414 bp, Glycine max
  Peptide Sequence Number=SeqID_213219
atgcctaaagttaatgaagaaactggtaagttttcatatgaagctgaatcaccaaatgaggcagcttttgtgattgtagccagggaacttggatttgaattttatgataggacacatgcaactatttcactgcgtcaattagacaccatatcagaccagaaaatcaacaagtcctacaaacttttgaatatattagagtttactagtgcaagaaagcggatgtctgtaattgtgaaagatgtggaggggaaactattactactaagcaaaggggctgacagtgtaatgtttgaacaaattgcaaagaatggaagggattttgaagagaagacaaagcagtacattagtgaatatgctgattctggtttgagggccttgatacttgcatatcgtgaacttaatgatgaagagtaa

SEQ ID NO: 96442 - DNA, 270 bp, Glycine max
  Peptide Sequence Number=SeqID_213220
atggtgcttcctttcaccaaattcattctgtttcgtaaccacttgttcagaaaggtttcacctttacccagaatttttcaagggcatgtctgctttaaccggttcaatccgtttccgcaaactttttccacttctgaccactgtgaaagattatcatgggaacgttccaccgaagaaattctattgaggaagcttaaatttgctttgaggaatcaccagattgttagagagaaatcaggtttacttcatggtgatacgattggagaataa

SEQ ID NO: 96443 - DNA, 498 bp, Glycine max
  Peptide Sequence Number=SeqID_213221
atgataagaaaatacttaggatcgctcttgaaaacaagtataacaagaaaggaacttgatcctaaccgcgacatgcagatctttgatttatttgatgtcaagaagaagggagtcattgacttcgaagactttgttagatctctgaatgttttccacccaaatgcatcattagaagacaagatagctttttcatttaggctctatgatttgcacaatactggctttatagagcgccctgaggtcaagcaaatgttaattgcacttctttttgagtcggatatgaagttggcagatgatgtcatagaaacaattcttgacaagactttcgtggaagctgacctaaaccaagatgggaaaatcgacaccgaagagtgggaaacttttgttaaaaagaatccgtcactattaaaaatcatgacccttccttatctgagggacataacaacatctttcccaagttttatatttaactctaatgtggatgagattactgcttaa

SEQ ID NO: 96444 - DNA, 225 bp, Glycine max
  Peptide Sequence Number=SeqID_213222
atgcttcgcatacccaagcctcttctcacacggattcccacactgaaaagcacgatcacaacggtcttccacaaacctcaccgcaagaaagcagaggtagatctggaccatcggagtacaacggcagaacctgggtatcggagcacgacggaagctttgagcacgaatcgcgaagagctcctcctattccagggtggtggtgctggtggggttcgccgggaatag

SEQ ID NO: 96445 - DNA, 699 bp, Glycine max
  Peptide Sequence Number=SeqID_213223
atgttaaataatggagttccgcacaccttcaccgttgggatttgcgagattatagttacggagagagaaacaggaatcacacaagacagtacaagcggaggcttcaatcccttctctgtctctccgatgtttgggaactctatcggagcaattagagaaaaaaattggaggaatctcagggaaccgctaaagatgttgttatcgctggctaaagacacgagaaataaagaaattcgaagcaagcaagttattccacacgctggtggatccaaagttaatcctagaagaagaaatgagttggaacaaattgaagtaggattgactcaaagcatagttgaagaatatgaagtttctcctcttgatgttgttggtagagtgttagggttagaacactctgggagagtgcgatgcatgggattaggagctgttccttctaatacattcaggaacacaagacttcgagcttttagtctgagctcttcttcatctggtgttgcctttccatcttcaaaccaatggcaagagaaatacaacaatttagaatcagcttttaaggcctacatgataatgaaggaaggaaggatccctgaagaattagctagttatttcactcctgatcaaacacatccaaatgatgcttcaagtgttcctaatacacctttggatgcaagaggatcttctggtgctagcaacccttag

SEQ ID NO: 96446 - DNA, 294 bp, Glycine max
  Peptide Sequence Number=SeqID_213224
atggagaatgcagaattttataagaaattgtggaagctacaaataccatctaaaggaaaggggttcatatggaaattgagtcataaaaggttaccatctaaagacgatttgcagagaagaaatattcttgcaggggggagtgatactaactgtgtattctgcaatttggggttggaaactgcagatcatatattgtttgaatgtcagtttacctatgaagtcgatgatacttatggggaggtgaggttggagtgctaccttaggaggttcagaatcattcttggcagtctgaag

SEQ ID NO: 96447 - DNA, 387 bp, Glycine max
  Peptide Sequence Number=SeqID_213225
atggatgagaaatctctgatcaagaagtatcagaaggaaatttctgagttaaagcaggagttgcagcagttgaagcgtggcatggttgagaatcccaatatggccacatcttcacaagaagatctgattactttgaagcttcagggttgtgctgatgcatatatcttggattatctaataagtgtcactcttgaagctgtgcaatccaaattgaagtcaagattgcaagaggaggaacaagctaaagcagcattgatgagaagaattcaacgactaaccaaattaatcttagtttctacaaagaatgcaatgtcatcaagcattgcagaaaggcccagtcatagacgaaggcattcttttggggaagatgaggtgtgtttttcataa

SEQ ID NO: 96448 - DNA, 840 bp, Glycine max
  Peptide Sequence Number=SeqID_213226
attattgccatcaaggatatcatacgaccccccaaaaaggagaccttcaatgatgtgtacattgtttatgaattgatggacactgatcttcatcatataattcattctgaccaacctcttagtgaagaacattgtcagaaacttgtgcagtacttcttataccagctgttacgggggcttaaatatgttcactcggctaacgttttgcaccgtgaccttaagcccagtaacttactaatgaatgcaaactgcgaccttaaaattggggactttggtttggcaaggacaacatctgaaacggatttcatgacagagtatgttgtcacacgatggtaccgtgccccagaattgctccttaattgttctgagtatacctctgcaattgatgtttggtctgttgggtgcatacttggtgaaattatgaccagagaacccttgtttcctggcaaagactatgttcaccaactaaggcttataacggagttattaggttcacctgatgatgcaagccttgaatttctccgaagtgataatgccagaagatatattagacagcttccacagtaccggaagcaaaaattctcgaccagattccctaacatgttgcctaaggcattggacctgttagaaaagatgctgatctttgatccaaacaaacgcattactgttgatgaggcattatgtcacccatatctttcatcacttcacaacatcaatgatgagccagtctgtcccaggccattcagttttgattttgatcagccaacatgcaccgaagagcacatgaaggagctcatttggaaggaatcagtgaagttcaatccagatccaccatgctag

SEQ ID NO: 96449 - DNA, 1185 bp, Glycine max
  Peptide Sequence Number=SeqID_213227
atggatagctttcagcttgctttgcagtttgggatttctgtcatggtcatagcttgtccatgtgctttaggtttagcaacgccaactgctgttatggttggcactggagtaggtgcatctcagggaatacttatcaaaggaggtcaagcattagaaaatgcacataaggtgaactgtgttgtatttgacaaaacaggtactctcacaatcgggaagcctgtggtagtaaatacaaagttgttgacaaatatggtactccgggaattctatgaacttgtggctgcagctgaggtgaatagtgaacatccactggctaaggccatagttgagtatgccaaaaaactgagagatgatgagaaccccatttggccagaggcacgggattttgtgtccattgctggacatggagttaaggccatggttagaaacaaggaaatacttgtgggtaacaagagcttgatggaagaccacaatgttgcacttcccatcgatgctgaagagatgcttgcagaagcagaagcaatggctcaaactggaattatagtgtctattaatagggaagtagttggggttttagcagtatctgatccattgaaaccagctgcacaagaagtcatttccattctcaagtctatgaaaattaggagcatcatggtgactggggacaattggggaactgccaattctatagcaagggaagttggaattgaaacagttattgctgaggccaaaccagatcagaaagcagagaaagtgaaggacttgcaggcttctgggtacagggtggctatggtgggggatggtatcaatgactcgccagcacttgtggcagcagatgtaggaatggcaattggtgctggtacagacattgctattgaggctgctgatattgtcctaatgaagagcaacttggaggatgtcataactgccattgatctttccagaaaaacgttttctcgtatccgcctcaactacatatgggctttgggctataatctacttggcattccaattgctgctggagctctttttccttctacacgatttcggttgccaccatggattgctggggctgccatggctgcatcttctgtcagtgttgtatgctgctctctaatgttgaagtattataggagaccaaagaagctggacaaccttgagatacggggcataagcattgagtga

SEQ ID NO: 96450 - DNA, 600 bp, Glycine max
  Peptide Sequence Number=SeqID_213228
atggatggtttatataactggaaatcattgaatgcacacatggatggagttgtcattgactgggacattgtggcaaaattattgtcattatcacagcagagatcaagggctctgtgcatcatgtcgggcactgggacagtttcttcagtcactctgcgacagcctgcttctaccaatgctagtgtaacttttgagggacgattccaaatactatgcttgtctggttcttacttggttgccgaagacggtggaccctccaatagaactggtggcattagtgtttcgctctctagccatgatggtcatgttattggtggtggtgttgctgtgcttattgctggaggccccgtgcaggtgatgttgtgcagttttgtttatggtggctccaagaccaagtctaaactaggaaccactatcaaagatgaaagttctgagccacctcctcagcataacgataagttagcttctccagccagtgctcctgctccccccggtcaaaactacctccctctttctgcaacaaacctttggcctggatcacgaccagcagagctgaaaagcacacacatgcatactggcatcgacttgactcgcggttga

SEQ ID NO: 96451 - DNA, 627 bp, Glycine max
  Peptide Sequence Number=SeqID_213229
atgggaaagctaaaggtgtatgcggatcaaatgtcccagccttctcgagcagttctcatattctgcaggtttaacggaattgactttgaggagattaaagttgacatttccaaacgccaccacctttctcctgaatttagagaaatcaaccctctgcagaaagttccggctatagttcatggaagcttcaatctctccgagagaagcacaccaccttttacagcgaactatgtaataaatactgtactaggaccggcaactggccgtccacttagtccaaaagcagctgctgaagctgagaaagttctattatcttctttatcaaaactagagaatatttggctcaatggagatggacacttcctgcttggtgtctctcagccatctatagcatatctcagcatggtttgtgaactcatgcaacttgaggatcacagtcgtatattatcaccatacaagaaagttcttcagtggattgaggatacgagaactgcaacaaatcctcactttgaagaagtgcataatatcctttatagagctaaaaagaaatttgaacagcagcgttcaagggtagctgaaactgggactgagcctagcaacaagatgggggggcattcaaagatgtga

SEQ ID NO: 96452 - DNA, 348 bp, Glycine max
  Peptide Sequence Number=SeqID_213230
atgaaagtggtggtgaagttggatttgcacgatgacaaagcaaagcagaaggcgatgaagtcggtttctagcatatcaggcatctattccatctccatggacatgaaggagaagaaactgactgtagagggtgacataaaccctgtcaatgtggtgagcaaattgagaaaaacctggcacccagaaattgtaactgttgggccagcaaaagagccagagaataagaaagatccaaatcaacaaattgaggagcttgtcaagctctacaaagcatataatccccacatgaccacacactattatgttcaaagtgctgaagagaacccaaatgcttgtgctatttgttga

SEQ ID NO: 96453 - DNA, 966 bp, Glycine max
  Peptide Sequence Number=SeqID_213231
atgggtcaccattcttgctgcaaccaacagaaggttaaaagaggactttggtctcctgaggaagatgaaaagctcatcagatacattactactcatggatatggctgttggagtgaagttccagaaaaagctgggcttcaaaggtgtggcaagagttgtcgcttgagatggattaattatttaagacccgatattagaagagggaggtttacacctgaggaggagaagttaattataagccttcacggggtcgtaggaaacagatgggctcacattgcaagccacttgccaggtcgaactgacaatgaaataaagaactattggaactcatggataaaaaagaaaataagaaagacttcttcggtgtcttcaacaaccattgcacaaagtatcgatcacaattcttctgaccagttcaattacaattccaatctagtactagaccactttcccaaccatgataacaatctacaaacaaaaccaccagttcaagaaaccttgttttcctcaacatgccctctgttcatgtttgacactactagttcactagaagctggcacagcaatagactgcaatagtactactgtgcgagcagaacattttcaagatgctgtgggtttgagcactgaaacatggaacttgagccaccatcaggttcatgcacttccacctctcacagtgagtgtaggtttggacaccacaaattatttgccaccattgattgagaacgtggacaacatggtcccaattgaggtacaatcttgtaccatggatgagcaaggagatatagcactagagtgcttgcagaggcgaggcttaaatgaatggatggtggagacgcagcaacaatgtcctaactttcttttttgggacagtgttgaaggacagcttggtggggaagaactagcaccaaattcatcaaatgtggaagcaaatatgctttctccttttccttcttctttgtga

SEQ ID NO: 96454 - DNA, 204 bp, Glycine max
  Peptide Sequence Number=SeqID_213232
atggtgaacccgttttccaaatttcacaacaatccaacggttaacgagtccgggatcgtagttttactgggacagattttgggtctctacgggaaaggagaaggaaatcttaaacagctcatattcatgcggaagggtgttcaaaatgaaatgcaccaggaagaactcagacatatcaacctccagtttcttaagttgagctga

SEQ ID NO: 96455 - DNA, 135 bp, Glycine max
  Peptide Sequence Number=SeqID_213233
atgccttcaagtagcaataaacctactgaaggtggtttaggtggtcttaaaggtgcaaagggtactggacagtacaaagacagcttgaaaagggacaacagaaaagtcaagttgcgagaaaagatggagtcatag

SEQ ID NO: 96456 - DNA, 504 bp, Glycine max
  Peptide Sequence Number=SeqID_213234
atggcggcgcctgaatcccctctctgttacgtcggtgtcgccaggcaatccgctgcttttcgcctgatgaagcaaatggggtgggaagaaggagaaggtcttggaaaagagaagcaggggatcaaaggacacgttcgagttaaaaacaaacaggacactattggtattggccttgagaagccaaacaactgggccttcgacaccactcagtttgataatattcttaagagattgaaagttcaagcaccgcaatcccatgacatagaggaaaaagtggaaaccaaggctagtgttcctgttgataatgaggaggattctgtccccaaaactacaagaccacaaggaagatacgcgagaagagagagggggaagcttgtctcgcaatattccttgaaggatctggaaggaattcttttactggattctgtcaataaatttgcttctgcatttgattcaatgaaccaagaacaactagtactgttaaagattgtttctggcttgtaa

SEQ ID NO: 96457 - DNA, 732 bp, Glycine max
  Peptide Sequence Number=SeqID_213235
atgttaaagacatctgaaattcaaaaatttgaagatgaaggaagcaaatatcctgctatacctccagattggtggggctacaagtatggttttgtctctggtggatttcttggagcagaatcaaagaagaaaaagtccatgatttctggtaaggcagagaggactgcatttttcgaagaggatcaagaaaacctttataatctagtccaggatatggtgatgctcaacctaagaagcatggcggcggctgcgcaggggcgtgtcccgcgtcggaatcgcaccagatacttattcagacatgactcacattcaacgtggtgtcgggtgcatttaagttttgccggacacggttgggctgttggacatgcgcaattggatccatctgggtgcgaacacgtgcagagctcctcgctgccgcacgcaaagcacgccgtcactgcgctcagacctctgtcgctgtgcgtagaccgggagaaatccacaacggggaagcaaggactaggcatcaaggacagacccaagaaagtagctggctgctattttcagggtaaaaagaaatcctttgatgatagtgatgaagattctgctgataacgattccctggaacaagcagcaaatgatgacttaattaaagtagaaaagattgttgaaggcaaagtgaagctgaaaaagttgtgcaaacagattttacaacaggtgcctggagaatcattgaaactgaaacagctcaaa

SEQ ID NO: 96458 - DNA, 274 bp, Glycine max
  Peptide Sequence Number=SeqID_213236
gaagataggaaagctagagaaaaggaagagaaggagaaggaaggggatgaagacaagaggagtagagaaaagatcagagactcggtgcgtgaatctcaaattcaagacccctcaaattgttgtaggtttgatcttgcacgcttggaagtggttgggaggccatggaaagcaaaactaggaaaagagtctagcttaagcaagaacctttctaacttaagtgagaaaaggttcaaggaacatctttgggacccttttaagggagcagttggagaag

SEQ ID NO: 96459 - DNA, 900 bp, Glycine max
  Peptide Sequence Number=SeqID_213237
atggatgaatttgcgtgcttgagagattgggatttggaagctattgtaagaggaagcaccggtgaagccatcaccatggatgacccaaatgctgatttttcttatttcttctctgaacaagatgagctacttgatagctttcccgaattctcagaaaccacgagagttctcgatgatttggaagagctttacaaacccttctacccagttttgcaccctctttcaccgcacaccatcgttacaacttccctacctatcaacatggaacctaaacaagttatcaaagcatcagaacagaaagtagcagccctgcaaggattgaaagtccccgcagcacctaaatgtaaaaaaaggggtatgtgcagtagtgcaaacaagaagagccagaacaagagtgtggtgaagcaagtgacaacagcagaaggtcttgacgatgcatgggcatggcgtaaatatggacagaaaccaataaagggttcaccatatcctcgaagctattataggtgcagcagttccaaagggtgtttggcaaggaaacaggttgaaagaagccacttagatcctgcggtttttctggtaacctacactgctgaacacagccatccacacccaactcgaagaaactctcttgctggaaccacaaggaagaacaattcccttgttcctcctccaaccactcatcgtcaccaaaagaatactaattgttcctcaaagtccattgaagtgcaacaaagcatgaacttgaagaaagaggaagattttactgactggttggatgatgatagtgctcaatttgttgatggttggattccaagctcggatcttgagaaactgatagggcttgagtgccaacattttgcattagatggtggtttcacggatgattttccacacccttaa

SEQ ID NO: 96460 - DNA, 120 bp, Glycine max
  Peptide Sequence Number=SeqID_213238
atgtatactacccataggggtatgcaagatgttttgcctcatagagaggtcatgatagcatatgggtgtcttcatgggagaatcttggagtatggagttgcttgcttggaggaagattaa

SEQ ID NO: 96461 - DNA, 4126 bp, Glycine max
  Peptide Sequence Number=SeqID_213239
tgcagatcggtggcgtgcatatggtccgacacgcccttccctcaccgcgtcaccgccgtcgccgctttacccgaacctccgactccgaccttttacaccgccggatccaatggctccgtcatctggtggaccctctccacttccccaccgggcggtgggcgtgttgtgcggtcacgccgcaccgatcaccgatctcgccgtttgcagtcccgtcgcagatgcagaacacgtttacggtccaagtggaagaagtaagttcagtgcgttgattagtgcgtgttgcgatggttttttgtgtgtttggagcaaaaacagtggtcattgccggtgcaggaggaaattgccaccttgggttggcactccccgcataattcgaactttgccttcaacgccgagatatgtctgtatagcgtgttcttttgaaggaaatgaaggagtaattgatagagaaactcagcctaggaagcctcctaaatgcactattcttattgtcgactcgtattcgctttccattacccagactgtgtttcatggaagtctatccattggtccaattagttttatggcactagttttaggtgatgacgagaagaggaattcggtttttgtggctgattctgctgggaggcagcagacggttttgatatcggaggatcgaggggaaagcttggtgagttcgctcggagataaaggtcaatcggagagttctttttgctatgagggattgagtggtgtggagcaaattgtttcagttttaacgtatgggaatgctgttgcttttatattgaaagataggtgtgtgtttaggttgttaaatggtgatagtgtgattggagaggtttcttttgtggacagtctatttggtttggatcggggttctactcaaatgtatgctattggtggaatttttcttgaaagtgatgatgtggggaatatgtgcaatgccaacgaatatggaaactcgattacagtacaatttgttgtgtggaataatgtaggtcatgcagttatatacaatgtgttgtatcagaatgatgtttttaaatgtgaacctcattctgagattcctggtactcattatcaacctgatatgagattatctgttttcttcctacaagtaaatcaacatcttgtttgtgtcaagtcagtttgccttaatcatgaggagcctttactatggagaccacttgccacaatctggtcgacgcatgattgtgatgatgaacctggtagattgtaccgtcaatgcagaatgatcagtgatggtgtatctttcatcaactggtttgagaaatcgactcagctccagggactggatgggctagagactacgcctacttttggtgtgagtccaagttcggatgatgtagacaacacacatgtggatagcatgagtaattattatgcttacaaggggaaggtagtttcttcttccatgattatctctgagaacctctttactccttatgctgttgtatatggttttttaagtggagaaatagaggttgtaagatttgatctgtttcacgggatttgcttggacgatgcaagttccaatcctgatgaaaagtctactgcatgcaaacagtgcttctcaggacatacaggtgctgtactttgtttggcagcacatcaaatgatgggtagggccaaaagctggaatttcaaacaggttttggtgtctggaagtatggattgcacgattcgtatatgggatcttgacactggcagtcttattatggtaatgcatcatcatgtggctcccgtgcgtcaaattattcttcccccttctttgactgtgtatccttggagtgattgcttcctttcagttggagaggatgcatgtgttgctcttgtttctcttgagactctgcgagtggagagaatgtttcctggacacatgaactatccttctaaagttttatgggatggagcaagaggttatatttcctgtctctgtcaaacacattatggaacttctgatgctactgatttattatacatttgggatgtaaagacaggttcacgcgagcgagtcctacgtgggacagctgcacattcaatgtttgatcatttttgtaaaagcatcagcatgaattccatatctggcacattgctgaatggaaatacatcagtctcttcattacttcttccaatagttgatgatgcaaaattctctaactccccattaaatcggtcagacaacttgcttacttcatcaaggtcgtcaccaagtatttcaaatatgactgagctgaattcttccaaaacaaatgcaggtaaaggaaattcagtgatgcagaattcatcctctctgattggtcttttgagtagcaagcttcctatcaaatgctctagcccattcccagggattgtgtctctgtgttttgatcttgcatcattgatgctttcttatccaaagaatgagtccatggaaaatggtggtggcaagccagtgaatatcaatatgaagcagcagggagttcaggagcaaaatcccagctaccataatccagaaactgtagaggggcatgacttggttagcctatttgaagaatacttacttcgatttagcttgtcatttctacatttgtggagtgtagacagagagcttgataatttgctgataagtgaaatgaagctgaggagaccagaaaattttatagtagcttctggtctgcagggggataaagggtcgttgacattgacgtttcctgctcagagtgctactctagagctctggaaatcatcatctgagttttgtgcaatgaggtcattgacgatggtgtcccttgcccaacgtttgattagcttgtctcactctggttcagcagccagcaggtgttatggatctagtgctcagtttctttatgttttgccgctcttggtggctttttggcaagatgaaagtgaacatgtgcgtatggctgcgcgctctatatttcattgtgctgcctctcatgctattcctctacctctatgctattcaaaacctacagattcaaacaacatgggttcccaaactggaagtagagacaaacatctaggaaatatggcagaagaaagtatatctcctaaggcagaaaatcaaggaatttcccaagatgaggaatccaagatacttgcttggttagaatcatttgaagtgcaagattggatttcttgtgttggaggaacaagtcaggatgcaatgacatctcacattattgttgctggtgcactggctatctggtatcctagtcttgtaaaaccaagtcttggcatgctagttgttcatccgttaatgaagttggctatggccatgaatgagaaatacagctccactgctgctgagctccttgcagagggcatggaaagtacatggaaagaatgcattgtctctgagattcctcgtctgattggggatatttttttccaagtagagttgagtggtccatcttccaagttagtgaaagaaatttcagatgcatctttttctattaaaaagactttggtggaggttcttcttccaagtttagctatggctgatataccaggctttttgactgtgattgaaagccaaatttggtccactgcatctgattcacctgttcacatggtgtccttgttgactcttataaggatcatgcgtggttctccaaagaattcggctcaataccttgacaaggtggtcaacttcattttacagactatagatccaagcaactcagtcatgcggaaggcatgctttcagagttcaatgacaactttaaaggaagttgtacgtgtatatcccatggtggctgtcactgattcatggaccaaactagcagttggagatgtgattggagaaattaacaacgcaagaattagggttcttatcagttggtatcagagcctttcaccatgtctaggactagtcaaagggcaagtccacagccagcccacatggggcaccggggctgcggaacatggtgggatgttaggatccaattgtaagtgtgacaatggtaaaggttttggatgcaagtgggcctcctggacttccaactctgctcccagcagcaacttcaggaacaatgttgactactgcaatttcagcactgagcttttcaccagatggagaggtaccaacatattgtgttga

SEQ ID NO: 96462 - DNA, 570 bp, Glycine max
  Peptide Sequence Number=SeqID_213240
atggaccccgttgaattgccgttaccagttgacgtggcagctgcccccaaattgatgggatcggaggatgttgcaagtataaaaacggcagctgagtttccttcctgcaataaatttgtagaaactcaactctctaagaattctagtctgctgccccatctcaagggtgaagaggcgtccaaaaatatgcctagtggtaatggcagaaattgtcctgtaattaattctagattagaaggtgtaccatttcaacgaaaatcagcaaaatcaaacaggagtaatagttcttgttcaaagaggccacggatgtcacaaccagaagattctttaagccctaatggaattgaggagtcaaaggatatttctgataaacttggatcacataatttaaactgtacttctccagagaaaaatcaattacccaagcaaaagagcaattctagcaagcgtggtgataagaggaattttaaagtgccttctgccaaggctaaatttgagtcatcctctatgaagatgggtgcatcaatcttcagttctacgtctggggggaacaacttttttggtatgtaa

SEQ ID NO: 96463 - DNA, 1107 bp, Glycine max
  Peptide Sequence Number=SeqID_213241
atggacgagaacgtgctcgacgatattatccggaggctcctcgcggcgaagaacggtagaacgacgaagcaggtgctgcttaccgaggcggaaattcgtcaactctgtgtttcctccaaagagatctttctcagccaacctaatcttctcgaactcgaggctcctattaagatttgtggagatgttcatggccaatactcagatcttttaaggctgttcgaatatgggggatacccgcctgaagcaaattatttatttctcggagattatgttgatcgtggtaagcagagcatagagacaatatgcttactcctcgcatacaagatcaaatacaaggagaatttctttcttctcaggggcaaccatgagtgtgcatccatcaatcgtatatatggtttctatgatgagtgtaagaggaggtttaatattcgcctctggaagacatttactgattgttttaattgcctacctgttgctgctctggtagatgagaagatcctttgcatgcatggcggactatcgcctgatcttaagcacttggatcagattcggagtattgctcgtcctattgatgtgccagatcatggccttctctgtgaccttctatgggctgatcccgataaagatctagatgggtggggagaaaatgaccgaggtgtgtcatttacatttggggctgataaggttgctgagtttcttgaacatcatgatctcgatctgatttgccgagctcaccaggttgtagaggatggatacgagttttttgccaagcgtcagctagtgactatattctccgcaccaaactactgtggtgaatttgataatgctggtgctatgatgagtgtggatgacaccttgacatgctctttccaaatacttaaatcttctgaaaagaaagggaaatgtggatttggcaacaacacatcaagaccaggaactccaccacataagagtaacatcaccggggagaccataatgatagcagaggcaatgcagtccagggtgggaagaattaacattcccgagctatacaaggcttatcgttctgctgcctggcattcacaacatataaagcatgacgccttccctccttggcaacgaaactaa

SEQ ID NO: 96464 - DNA, 675 bp, Glycine max
  Peptide Sequence Number=SeqID_213242
atgagggtgttttctaggttcaaatttctgtcaagagcagtgcacgaggaacaagagggtgagcatgatgggggggagaaaatcaagtaccctttaacggagggaaatttgtgtacgtccttaacattaacggtttggagaaaatcccttgtgattagttgtaaaggattcacggtgatagatccatatggaaaccttgtgtatcgggtggacaattacatcgtgcaccccaacgaagtcattcttatggacgcttcaggaaactctgttctcaccttgcgccgctccaggaagctaggattagtagatagctggtttgtgtatgaaggggaaatggggaagcagaaggttaaatcaagagatagtccagtttgttgtgtacggaagcgtgtgaatattttagacggcaaacccaaggttcaggcctacgtgtaccgcgtgacctcggattcagataaaagacatgcggcgtttacaatagaaggttcctatgcacataggacatgtaaagtgttggatgagtacaagaaagccgtagctgaaatcaagagaaaggaggccaataccaaagacgtctctttcgggatagagatttttcagttagttgttcaccctgggtttgatactagctttgctatggcactagttttactactggatcaaatgttttcataa

SEQ ID NO: 96465 - DNA, 108 bp, Glycine max
  Peptide Sequence Number=SeqID_213243
atgtctgaaggtcaaagttgcattgtcaatgtcgactggatcaaggtccagatgaggcttgatggcaccaataaccatcatgaggagacaaaatggagaacggaatga

SEQ ID NO: 96466 - DNA, 1161 bp, Glycine max
  Peptide Sequence Number=SeqID_213244
atgttgccagggctatatggtctgaaacatgattttcatgatgtcacaaagcttattgatgaaccaccgttagatgagctccttaggggcacttttgagtgccccattttaagcaaagataaagggaagaaaacatcaagtgtgagtgatagttttttaaattcagtaagaaaggcatgctctatccttcagtgcccaaaacccgttcagtcccaaaatatgactgagatggattactcctccaacatgaaaatgtcaacttgccaattgagctcagtttgtgcagtagaaagtgttggtaatggggataaagagcagtcttgtacattagatatgtcttcatgtcagaaggatcattgtagtgaagtagaaagtacaactagtccgcttgacttcccattacatcaacctaaggatgttttggaacgaattgcactccatccattccaggatttggagtctttgctgcttgatgtgtccaagcctgctgttaccacaaagaatggtattgatcaacggtcaggcaagcaagtgtctcgtcggccaagcctgccaacctttccatggtcacatgcttttggtggccattctagaactaattctgacacagaatttggaggcccagctgatactaaagagaacgatgagcgttgtccaagagtattaactgctgcacaaactctctgtgaaattgcaactcattcacagaggcagaactcagatggaattttaagatggcaaaggaaaacttcacaaaagaccatgaaagcttgccactataaatcaaatgagaaacttgaggagacatcttctagaccaatttcaatgatcggatctgacatggtggccagaagtgtggagcagataatgccctcaaagaagccaagactttccatagtcgagaataagaacagtggttactccaatattgccaagaaaggacacattgtgtggcctatttcaaaatcaagtagatcgtttcccagtaaacaagttagagactcgtttgtggaaaacaaacgcacaaatgccagcatcttgaagcaacattgtatgatgcccccacctgcaaggggtttagataagactcgtgatggtcagcagcaggttggaaaattagtagtgatggattggaaaaggggaagagacaacacagattga

SEQ ID NO: 96467 - DNA, 2728 bp, Glycine max
  Peptide Sequence Number=SeqID_213245
atgaatggtattccgagacacgagcgccgatgggcgtccgacagcgttccgggaaaagcgaccgtcagcgccggaacttcgccgggaactgagtccaactccgccgcggaggagttcgtggaggtgacactcgatcttcaagacgatgacaccatcgttctccggagcgtcgagccagcctccgtcattagcatcgacgacagcgtcgccggcagcggaaatcaaactccggcgtcggtttcgaggtctccgactatacgtcggagctcgtcgagaggattccggcagttctcgcaggagctgaaagccgaggcggttgcgaaggccaggcagttctcgcaggagctgcggcgcttctcgtggagccatggccatgcttcgcgcgcgctttcgtcttcctctgctccgaacggcgccggcgccggatttgaaacggcgttggcggctcgcgctctcaggaaacaacgagctcagcttgatcgcacgcgctccggtgcgcacaaagcgcttcgcggtctgaaatttatcagcaacaggtccaatggcgttgatgcgtggaacgaggtgcagagcaacttcgataggcttgctaaggacggttttctcaatcgcaccgatttcgctcaatgcataggtatgaaggattcgaaggaattcgctctggaactgtttgatgctctgagtcgtaaacgaaggttgagaactgacaaaatcagcagggaagaactgttcgaattctggtcgcaaattaccgatcaaagttttgattcgcggctccagatcttcttcgacatggtggacaagaacgaagatgggagaatcaccgaagaagaggtgaaagaggaacaggctgaagaatatgcagctctaatcatggaagagttggaccccgaaggacttggctacatcgagttgccaagtggcctttcggcttcttcgccagttaggcgtacacaccttattgaacacctatggcaattggagacgcttcttttacaaaaggacacgtaccttaactacagccaagctcttagctacacaagccaagctttgagccagaacctacaggggctgaggaagaaaagtcctatacgtagaatgagccgcagattggtctactatttgcaagagaattggaggagactttgggttttaacactgtgggtttccataatgattgggctgttcacgtggaagtttattcagtacaagaacaaagatgcatttcagatcatgggttactgtcttctcacggctaaaggtgcggctgagactctaaagttcaacatggcacttatactcttgcccgtgtgcagaaacaccataacttggctcaggtcgaccaagctgggctatgttgtaccttttgatgacaacatcaactttcataagacaattgccggggccatcgtgattggtattatacttcatgccggggatcaccttgcttgtgattttccaagacttgtaagtacgtctgaagaacgttatgaaaagtatttgaaaggcgtatttggtgatcataaacccagttatgtagacctagttaaaggcgtcgagggtgtgactggaattttgatggtgtttcttatgataatagcatttacacttgctaccaaatggttccggagaaatctcattaagctgcctaaaccgtttagcaggctcactggcttcaatgccttctggtattcacaccatttgtttgtcattgtctatgtcctcctcatcatccacggaataaagctttacctcgtgcataaatggtaccacaaaacgacatggatgtatcttgcggttcctgttttactttatgcgtcagagagaatactcagattatttcgttctggtttgtatacagtccgtcttggaaaggttgccatatatcctggaaatgttctcacattgcaaatgtctaagcctcctcaatttcgctacaagagcggacaatacatgtttgtgcagtgtcctgctgtttctccgttcgagtggcatcctttctctattacctcagcccctggcgatgactacctgagtgttcacattcggcaactgggtgattggacacaggaacttaaaagagtgttctctgaggcctgtgagccacctgtgtcagggaagagtgggcttctcagggctgatgaaacaactaagaaaagtttgccgaagttaaagatagatggaccttacggtgcgccagcgcaagattataaaaaatatgatgttttgttacttgtcggtctcgggataggagcaacacctttcatcagcattctaaaagatcttctcaaaaacatcatcaaaatggaggaaatggcggattcaatctctgatataagtagaggttcagaccttagtgttgggagtactactgattcaccatctcttaataaaaatgcgccaaaacggaagaaaacactgaagactaccaacgcttatttttactgggttacaagagagcaaggctcttttgattggttcaaaggagtcatgaatgaagtagcagagcttgatcaaaggggtgtcattgagatgcacaactacttgactagtgtatacgaggaaggggatgccagatccgctctcatcaccatggtgcaagcactcaaccatgccaaaaatggagttgacattgtttctggcactagagtgcgaactcattttgctaggcctaactggaagaaggttttctctaaaatgtgctccaagcactgtaatggacgaatag

SEQ ID NO: 96468 - DNA, 444 bp, Glycine max
  Peptide Sequence Number=SeqID_213246
atgaaacgttcaattgaagccaaagataggatgctcagtgtcctttcagagaaaataagctcttatgtagcattgtttgattcaatagagaaggaggcgttttctatcaagcaaattgtggataaagtccagaacgttgtcaatgatagagaggaagttgtggccggcttgagaaacaaaatggattgggtctctgcatttgaaaaagaatttgttgaaaatatctctgatctaagaaataaactggaaaacaatgagtctgaattaagaagaaaggatagaatcatctcagaacttgaagcaaagctggatgtggcaaaagtttgcaaccataaccaagctcaaatggaagatatatccatacctgcattgaatatttatctgtcaaacaccaaaattttatttgcactttcatctatgggttcttttttaatattttcttaa

SEQ ID NO: 96469 - DNA, 375 bp, Glycine max
  Peptide Sequence Number=SeqID_213247
atgcaattcacctctgtcgtagagcttcctcacctcatcaacatcgtcgatctcctcgcggaagcgctcgtccacgttgacgtcgcgctcgtcgatcgagatagtggagccgtgaaggatggattgggcgacgtggtagttgtcgtaggtgcggcagacgacatagaggctgatgtagtagacgacgacgacgaaagggttggagtccgaaggcagtttgacaaaggaggtgacggtgcgggggcaagtaaaggagcagatgagggaggggatgaagggaaagaaggagaaggggttggacggtgcggtggtggtggttttcgttggagaagggaaggaagggagaaagggaagaaggtgatgacgtggtgctga

SEQ ID NO: 96470 - DNA, 472 bp, Glycine max
  Peptide Sequence Number=SeqID_213248
gggtcagaagcaggggaatgttgctctgcctgcgggtctacgcaagcatttaggcaaggcccgttcggcggcggtgccgcctccgccaccaccggcgttggtgtcttcgaaacggcgtgatgattcactgttgcagcaacatgattggattcagggtgctattttgctttgcaaaaactccttcaatgcttctcctgaatgtgagatttctcagctgccacgatcagtgagcgacggatctcctgaactatctgagaattctaagaatgaccgagtgcctttgagatataatataatcaattttcatgtcccaggcacccaccgaaggaacattaccatagttagtcgagacgacggaaaatgcggtcagagaagtgggaaagatggggacatgagcagtgaaagtgagatcttttgggtgaaggggagggaaggaaaggtgttattgaccgtggcacaatttaccaagtga

SEQ ID NO: 96471 - DNA, 694 bp, Glycine max
  Peptide Sequence Number=SeqID_213249
atgttcacaacttggatgcattctaacaaaatatattcttatggacgggatcttacatatcatcaatatatctcaagatttgtttatgtcgcccgcaaaagatgctggcaaccaataaaacaagggaatacaataggcagactcatatgggtcccaccttcagctggtgaattgttttaccttagaatgatgctatccactgccaaaggtgcacagtcttacagtgacattagaacaatcaacggtctggtatatcctacatttagggaagcatgttttgcaaaaggcttcctaggtagtgatcaagaatttattagtgctttacaggaagctaataattggggtactgcacactacctaagaaaattatttgtcaagcttttatttatgaacaccatggacagactggaatatgtttggcaacagacatggcaatggatggcagatgatatcatattcaatcatagaaaacaaggtattcgcattactgaaaaggaaacaattcatttatgcttaactgagattgagaatatgctacaagcgaacagaagaagcttgcgagattttccatccatgtcatacccaataggatatgcgcgaaaccaacatcataataatctgatccataatgaaatggcatatgacaaagaaatgttagcagaacaatacaacacgacataccaattgctcacag

SEQ ID NO: 96472 - DNA, 261 bp, Glycine max
  Peptide Sequence Number=SeqID_213250
atgactattgaagaatcaattcatgttttctttgatgagactaactatattaggcaaagaaaggatatacttgatgatattacagatactttagaagatacgcatattcatgaagaagtccacaaagacaaagaagatggaaatagcatagattctcaatccaaagaaaatcaaataaacatggatcttcaaagggagtggagaacttcaaggtatcaccctcttgataatatcacaggtgaaaaagaggctaagtcatga

SEQ ID NO: 96473 - DNA, 375 bp, Glycine max
  Peptide Sequence Number=SeqID_213251
atgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccgtaaggtatctccgcgtatcatgggtgcagaatgaccaaacttggtctctgcttgtcatcgggcccgccgcctctggatga

SEQ ID NO: 96474 - DNA, 159 bp, Glycine max
  Peptide Sequence Number=SeqID_213252
atgaatccaaaacctgaaggccctgatgaagtggggctagcaacatcaccctctacattgtcaaagactgctctcccagttaacatcttaatagctatttcgcaaacttcaacaaaccattcatcctcgggcaagacactgccattcacaggttcttaa

SEQ ID NO: 96475 - DNA, 255 bp, Glycine max
  Peptide Sequence Number=SeqID_213253
atgcttgatgttggcagggcaatccacctccgacacgccctcagggaggacgacagagatagcaacaaggttacaacaacggttgaaatcctcttggacggattgagggacaatgaggcgctcgataccatggatgacgccgtcgacacgaagtatctcaacggagttgacgattatctggctagagggcttagaggccaaatgcaggtggtggtcggagagagtgtaggaaggtcgacaacgagccagtggtaa

SEQ ID NO: 96476 - DNA, 351 bp, Glycine max
  Peptide Sequence Number=SeqID_213254
atgttgagtacctcttcttattctgtcttcacccgttcctttctccccaatccaattaagggtatcccccgaccagctacacttcgaccttttcctgggatcttggaatctcatgccaagtctccaaagaacagattgagtattttgtgctttaggcacgaccatcattctccagaaacaccccaacctgaagttatcgagcactatcttcatgaggaattggtgcaatctgaattcaatgactccagtgtcaccaaaagagactggaaatcaaccattcagaagaagtttcacgaaaaacgtgtgagtgaagacaacaacaacaacaacaacaacgccttatcccactag

SEQ ID NO: 96477 - DNA, 162 bp, Glycine max
  Peptide Sequence Number=SeqID_213255
atgaattttttttactatgccgtgctctcatttatgcgcccttcatcatgcttttttgtggtttgcatgaaaggtgtcactccagctgagaggcttttggaattgtatcatggaaagtgggagcaatccgtagatcatgtgtttgaggaattgctttattaa

SEQ ID NO: 96478 - DNA, 822 bp, Glycine max
  Peptide Sequence Number=SeqID_213256
atgtggtctataaagggaaacttgataatcagatgcgaattgctgtcaaacggttcaacagaaatgcttggcctgaagcgcaaccatttttgtgttgagaaaaaggtcttggctttgtttcctgattcggatccttcatttgaggaggctagggctgttggtcagctaaggaaccaaagattgataaatctgcttggatgttgttgtgaaggtgaagaaaggttacttgttgcagaatatatgcccaatgatactttggcaaagcatttattccattgggaaactcagcccatgagatgggcaatgcgaatgagagttgctctgtgccttgcccaagctctagagtactgtaccagcaaaggacgtgctctatatcatgatctgaatgcttacagagttctttatgatgatgaatacaatcctagactttcatgcttcggtctgatgaaaaatagtagagatgggaaaagttacagtacaaatttggcattcactccacctgaatatctgaggacaggcagagttactccagagagtgtaacttatagctttggaacccttttgcttgacctcctcagtggcaagcatattcctccaagccgtgcccttgacctaattagagacaagaaccttcaaatgctatcagactcttgcttagaaggagagcttacaaatgatgatgggactgaattagtgcgtctagcctcacgatgtttgcaatctgaaccacgagagcgtcctaatccaaagtcactggttgctgctctaatacctctacagaaggattctgaggttagctggtttgaaagtggttcagcataa

SEQ ID NO: 96479 - DNA, 747 bp, Glycine max
  Peptide Sequence Number=SeqID_213257
atgatcaggaaatttcgtgcaggtcttgctttgcagccaatagcaacggctctttttgcaaattcaccctttaaagagggaaagccaaatggttttttcagtatgagaagccatatttggactgatactgacaaggatcgcacaggcatgctgccttttgtttttgatgactcttttggaactacccatgaagacttcatggagactaaagaatatggagaaagaactcggtttcagcagtatgttgattatgcacttgatgttcctatgtatttggtctatcggaaacacagatatatcgactgtactggaaagaccttcagggacttcttggctggaagacttccttgtattcctggtgaattaccaactctcaatgattgggaaaatcacttgacaactatatttcctgaggtcaggctgaagagatatttggagatgagaggtgctgatggagggccttggagaaggttatgtgctttaccagcattttgggtagggttattgtacgatgaagtttctctacaaagtgttttggatatgacagctgattggactccagaagaaagacaaatgctaaggaataagcaacggtcattattcatgctagatgtctatactaagttactaaccactagtctatggcaggttcctgtaactggtttgaagacaccattccgagacggtttgctgaagcatgttgctgaagatgttctaaagttggcaaagggcattcagctgttttag

SEQ ID NO: 96480 - DNA, 405 bp, Glycine max
  Peptide Sequence Number=SeqID_213258
atgagtgcctctaaccctctatcacattttggaacctttacaacccccaaagcacgtttgataggcaacgttccaaaggttcttttgaaagcaacttctaaaattatacgagtatttttttttaatacattcacatcagctatcagatacttagtgtatgttcgaaaacatttaattgaggttgaaggaggagtgtatactcaaagaaggggtagatcattggagctggaagggagagcatcagggaagatgactgaagaggaaggtattgattggtgtaatctgtggaactgctatgtgccagcaaaggttacaactttcgtgtggaaattgctacaaaataggattcctacgaaagataatctagctcaaagaggggttattcagcaaggagataaaatgtag

SEQ ID NO: 96481 - DNA, 699 bp, Glycine max
  Peptide Sequence Number=SeqID_213259
atggttgtcttttcgcgaagtgcgacgacgacgacgacgacgacgacgacctatacgcgccacaacttaatacgacaaacgaaaacctgcgttggcaataataatagtttgtgttactctgctactaagaaggctcctccgcagaggattcttggtggtgcacgtggcagtagagtgattcttgctgccagccctcccaccgaagacgctctagttgccactgaccctctcaccaagcaggatcttgtcgattatcttgcctctggttgcaagcccaaggataaatggagaataggtactgaacatgagaagtttggttttgagtttggaaccttgcgtcctatgaagtatgaccaaatagcagaattgctgaatggcattgctgagagatttgactgggataaagtaatggaaggtgacaaaattattggactcaaacaggggaagcagagcatatcattggagcctggtggtcagtttgaacttagtggagctcctcttgaaaccttgcatcagacttgtgctgaagttaatttgcacctttatcaggttaaagctgttgccgaggaaatgggaattggatttttggggattggtttccagccaaagtggggaatcaaagacatacctataatgccaaaggtagtttttttctctcttctcgtctttcaagatcttgaactgctgaacacttgctga

SEQ ID NO: 96482 - DNA, 352 bp, Glycine max
  Peptide Sequence Number=SeqID_213260
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctag

SEQ ID NO: 96483 - DNA, 282 bp, Glycine max
  Peptide Sequence Number=SeqID_213261
gctaacatagaaaagaagaaagaggctcctcctattgaatgcaaggagaaactggaaattaccttgccttttggagaagcacttcagcaaatgcccttctatgccaaatttttgaaggatatgttaaccaagaagaacttgtacatccatagtgacataattgttgtggaagagctatgcatgtctagagtttctagagagagaaagttccaagttccagagagttttgagagattttgttgtgtgaagatctgcagagaccagagcttgaagcaagagcag

SEQ ID NO: 96484 - DNA, 256 bp, Glycine max
  Peptide Sequence Number=SeqID_213262
atggaagaagaaaaagcagcggcgtactatgacaaggtgactcgtaagggcgagagagctgcgaggttcaagcaaggtctcgaattttcctcttcagcaccaaatgacgatgttgcaaaaccctcctcctccttcctctccaaattcatcaaagcctcctccgagtcgaagatggaagcgcaactccaatccatccacgacaggctcaaggaaaagccttctttcgagtctagggtttcgagcagggatagggaca

SEQ ID NO: 96485 - DNA, 174 bp, Glycine max
  Peptide Sequence Number=SeqID_213263
atggcgagtgaccctggaagattattcaagtacttctatgccataattcttcacaagcattgcgcggccagagaggcgaaaagatggctccattcatttaaaggtaatagtcttaagacttgggatgaagtggttgaaaaattcttgaagaaatacttccagagtctaagatag

SEQ ID NO: 96486 - DNA, 309 bp, Glycine max
  misc_feature (74)..(74): n is a, c, g, or t
  Peptide Sequence Number=SeqID_213264
atgaaattccccaccaacaatctagccgacttcgagccttgcatcggatatgccactgaagggcaagcagttgntggtatacccctgcaaaacactttggagggccctcagtatcacccacaaccacaaccctcacattccacagtggttaaaaaccctcatgctatggcagaaatgggaaagaggaaaggctcagggctattgaaggaggtgctggactttgacaagtacaaggggactactttccccaagaaccatccaaagatgtattgtcggaagataagggcatacgcaaagatgaggaattga

SEQ ID NO: 96487 - DNA, 483 bp, Glycine max
  Peptide Sequence Number=SeqID_213265
atgaagatcttaaaaaggtatacaaagaatctacactatcctgaagcatccattgttgaaaggtacattgcagaagaagttattgaattttgttcaaagtacattgaaaaggagaaactagttgggctttccaagtctcggcatgacgagaaagtgagagtttgtcacgaaaccttagtcagggaaagtaacccaaaaatgaacaagaatagggtgttgaaaaagcataacaagactttcctaaatttgtttaaagatacactctttggtaacaataatgtttctgaaacattaagaaagtggttagtggttctacacggaaaaaccattggtattaatcttgaaggtgatgattcaacccttgatacttgtttcactcctttctccacacaaatgcctaacatcaacggagaagaagaagtcgatgaaatccatgcaaatcgtaatgatcatgatgaaggagaattaattaacaacatataa

SEQ ID NO: 96488 - DNA, 220 bp, Glycine max
  Peptide Sequence Number=SeqID_213266
atggcacgcaaaccgaggcaggattttagcgtttcaaagcccaaatttcagacagctcttttctccctctccctcacgttgccattctttcctccttcattctccattgaagctccaaacaaatctccaccttttggcatcatttctgctccaatcgcgaaaggagggcattttcggagtcgtgaagtgtgtgtctacgaatgggacttcgaaatttcag

SEQ ID NO: 96489 - DNA, 774 bp, Glycine max
  Peptide Sequence Number=SeqID_213267
ccaggtgccgaagccgtaaatgccgcacaccatgccgaagttgagcagcgcgtagagcaggtatttcttgttcttcatccctttcaggaagtcgcccagcgtgattttagagccggatttggagcggccggcgttgctcatcagccaggccttttcctccacgttcagataaccaacgtccttgggcgagttcttgatgaggaacgggatcagcaggccgatgacgatcggcggcaacccttcgaggataaacagcagctgccagggggcgaacccgaaccagtcatgctgaatattgagaataaagccggaaatcggcgagccgacggcgttggacagcggctggacgatgatgaacatgccgagaattttggtgcggaaatagccgataaagaaaatcccggaggcgaagccgaaggccgaggcggtcaggcccagcgtcaatttcctgatagcgctgcgttcaatatcctgcggcttgcttattttcattttgatatttccaatgtggttaatcggaataatagaggcccggctcattaccctgagctgaatacgctgttatttcatttagccggcggctttgaccgagcgccggctgatgaccgtcggcgggaagagaaactcgccgggcggttgcgcatcatcgttgatgcggccgatcaggcgctcgaccatcagctgcgccatctccgccagcggcggcctgacggacgtcagccccggttcggccaggccggccagcgcgatattgtcgatgccgattaccgagat

SEQ ID NO: 96490 - DNA, 117 bp, Glycine max
  Peptide Sequence Number=SeqID_213268
atggcgagtctgatgacatgcgggggtaccttatggttttactttcatcatccagagacattcaagcccgacgacgcacaagattcttctttgctaggcagggacgatcgagtttga

SEQ ID NO: 96491 - DNA, 498 bp, Glycine max
  Peptide Sequence Number=SeqID_213269
atgaatgtaggagctctcatctctggccagatcacatctatggcccagtctaactcctctagacttgggttccctactcttatcacaactctatgtaggtctagaggggttgcttctgacagcctagtctttgaacgcttgagcccggtcattaacttggcctatatcaggaagaactgctggaaccctgatgatctgacagttactattaaaggggctaggagagcgagggcaaggctagctgaggctccttccacatctgcaactcctcctccagcacgtaccttagcagctccttctaccccatcttctacagactctcaacatcttgaagccatgcttcgaagcatacatcaggggcatattgttttattacaaagtttacagctggtagcacctccagactctatcccttctattgaacagtttaatgaatgggtagcttggcccgggactcagcctccctttcatagggaggacgaaggtctcaccgcttag

SEQ ID NO: 96492 - DNA, 1053 bp, Glycine max
  Peptide Sequence Number=SeqID_213270
atgccaacctctccttcagagaaccaaaccagatggaggaagcacaagagagattcacaaatcagtcagcgccaccagaagcacgaggaggaggacgacggcgacaaagaaaaccccaatgaaaaggaagacctcaccaaatgcgactacgattcagaggaccaaatgcaccacaaccaccctaattcgcaacctcacgtggagacggaggtcctctccgaccacggcgttcagatgtcgcagttcccgatagtgataaagcgcttcgtgaatctccctcactcctccgtcactgcaattgtttctctggagcgtgccctcgagtccggagagaacaaggctcgaagcgctctcgagcataagcctcccccttccaataatgacaacaagggattgtttaatcatccatgggttacttgtccagttatccctgtcctaagaatgagtgatgcaatggagaaagcgataaaaaacaaagttgctaaagcggtggtacctacaatagatgttatgtttcaagctttaagtgattttggagcaaaaattgtgcccccaaaaagaattttgaagatgcttccagaactctttgatcatcaagatcaaaatgttcgtgcatcctctaaagggttgactcttgaactttgccgttggattggtaaagatagtgtaaaatcaattttgtttgagacaatgagagacacaatgaaaaaagagctagaggcagagcttgtaaatgttacaggaacaacaaagccaacccgtaaaataagatctgagcaagataaagaacctaaccaagaagctgtgtcagaggttgtgggtcctggcccttctgaagaatctgggaatgatgctcctcaagaaatcgatgaatatgaacttgttgatcctgttgatatattgactcctttagagaagtcaggattttgggatggagttaaacctaccaaatggtctgaacagaaggaggttgttgctgatctaacaaagcttgcatcaactaaaagaatttctcctggcgatttctctgaagtttgtcggaccttaaaaaag

SEQ ID NO: 96493 - DNA, 567 bp, Glycine max
  Peptide Sequence Number=SeqID_213271
atggacatggtggcgatcatggtcggggaagacatggtaggggtgatggcatgccagagacaacaacaagcaaagcaacaacaaccagtttttgagactagtcaggatggtgcacatcacaagcagccactggttcagcctactgtggcggagtttgcaacttttcatttgcatgatgtagcgaggggatgtgttagagacaatagagaacgagagtttgagacacttgtgcagatagatcagatgtcagtgatggagtataatgtccaattcatggtgattgcaggacatggtgacatgacttatgatgaagccctaaatagggctttaactattgaggcaatggtggtggagattttagagataatactaatcaacatcggtgaggccaacatggaggttgactgtcgtagcggagtggcaacacctatggtccaaatgggacagtctagtggttgtagatcacgtgcactaaatggaccacatcggggtggtagaggatcaggaggcagaggacagggacaaacaagtggagggcaggctcatgtgttcatcttgactcattag

SEQ ID NO: 96494 - DNA, 189 bp, Glycine max
  Peptide Sequence Number=SeqID_213272
gcaccaaccacaacggcacacactcgtccagcgaccaagagggagaaggcgcacttcttcagctccttaaagaaacatgaactgcgtgtctgtctgttcttgtcgcattcaccactttcttttcttcaaggggctgaaaggagatcttcttcttgttcttcttcgttgttagaagggtatgtgccttag

SEQ ID NO: 96495 - DNA, 711 bp, Glycine max
  Peptide Sequence Number=SeqID_213273
gggtggagagaccattggttaatgttgatcctttcactgagaaagttcctgatgctcagaaggatttgatttgggaggacattcagttggatttgacctccaaatgggctctagcacaatggaaagacaagtggaaccaattttgtcaaagcagtaaagacccttcatgggaggatgttagaaagaaggcgcaatccatccagaaacaaaacactgcccctcacatgttgtcttgtggggtagttgttgatcctctgtctcccattagacgacacatgaagtggaagctggcttccacaaaaaaatcaggtcaaatgacatctgaggaagcacgccaaattgctaataagattggtagctttgtagcccatggacgtcaagatatgctgactactgccattagacgaacagagcaccttgatcgtgtccgtgttgctggagttgacctaaacactgatgcatcagacaaacattggttgtatgttaatgataatactccccgtcacattgcccttggaataattaatggggggtcgacaattgtgcaccatttgcctatgggcaatgatatggtgaagttgggtgttgaggaagttccagattcagatgctcgtatccctatacccactgaagatgttcaattagtggggcaggccttaacaccttccttgcttaggagaaacatcttatacaagccttttggaaaaaaag

SEQ ID NO: 96496 - DNA, 450 bp, Glycine max
  Peptide Sequence Number=SeqID_213274
atggctaaggggaatccatgccctcgagcaaactatagatgcactatggcagctggttgcccagttcccaaacaatctgttaacaattaccataagcaattactgattttactccgtatgatattgtgtgtatatgtaaatttgtttgggccccttggatggagtaccctcagcatcgaggatgtgatggggctaaccatagaggaggaccgtgcaaaggatcacatgggaagggttgtaagggtagcagaagctcttgatgctaatgttaaaaggtggtcaagaacattacatcatacatatggtgaaggaaaaagctttgaggttataagcatcaattttggtgtagaaaccaagggttggaaagtagaaactaaaaatggttccaggggagtgctgacatcaccatggtcgaccccatgctatgcaatgaaggtctggttgcaatga

SEQ ID NO: 96497 - DNA, 354 bp, Glycine max
  Peptide Sequence Number=SeqID_213275
atgacacctcacttagggaaacaatgcagtaattatcaagggcacccagtcgtgcactgtaactccccctccccctcggtgattagcctgggccacaagggagttccctaccagggacatccgacaaggtcagcacacccccccatgaacatacacaacatacaacgtattaacatgggcgtcatcaagtacatggccatggatgaattaaagctcctagcatcccctcagaaatgcttaaattctttaaccactttagtctcccacgcaagggacatccgacaaggtcactgcaccccctacgaacatatagaacatccaacgtatgaaacatgggtgtcatcaagtagatga

SEQ ID NO: 96498 - DNA, 542 bp, Glycine max
  Peptide Sequence Number=SeqID_213276
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccggctttgagcactctcagattgaactgaaatcagaacaaaaagcaggatccaattatttggttaagaagcagccaaagaagccattggcacgtgcctcacaagaacctgttggctctgatttctcctcaggggcaactcttgctactattgcagatgtacagccaacttcccatctgatgcaaggtggtagatgtgagaggtctggcaatcttgatgtcgggaaacctgtcgtgccagctgcattaatgaatcggccaacgcgcggggagaggcggtttgcgtattgggcgctcttccgcttcctcgctcactga

SEQ ID NO: 96499 - DNA, 543 bp, Glycine max
  Peptide Sequence Number=SeqID_213277
atggcatttttccaaagctacttggactacaaggctcaaaatgcacaaggtgttacattgatcacaaatctatgcaaggccagaggagtccaatcagattctagatccctggagagcctgagcccttccattaacttggcatatattaagaagaactattggaatctagatgatccaatagtgacatttagagggccaaggaaggtggcctggccaagtgcccagccttctctttctggagggggtggggcctctgcaacccaagagcctgagccagaggagccagcagcagcagcagagggggaggatgagctcactcctcctgagcccttttattttgattcaggtgtacagatggctcagaaggatgagacttccacagaccaaattcgaaagccatccccagtacccatacctgatgaatccatgccatcttcaccagcatctgagctagagcaacatatccctcagaattcaccagctgctcaattgttggatctcaatgagcatgcacaagagcaatcacaggagcaggacatttaa

SEQ ID NO: 96500 - DNA, 213 bp, Glycine max
  Peptide Sequence Number=SeqID_213278
atgggtagtgatggaatagtgcaattctccattatcatcgtggttcggagcaccaggaattgcgttttcgttcatgtctcctccacccgcgagtttggagccattagtagtgattgcttagtgcaattctccattttcaatcttttttcggagccccatgaattgcgttttcgttcatgtgtcctccaccctcgagttcggagccatgcgtag

SEQ ID NO: 96501 - DNA, 762 bp, Glycine max
  Peptide Sequence Number=SeqID_213279
atggacgtgtggggtgctaataccttccccgtgcgtaaatacaactcccgaacctttcacttaaaagttcgtagatcgcgtcttttccggtttttccgacgttttcctcaaataaacgttggtggcgactccgtgcgtattcctttcatggaacacgcatcccgcgagtcacgcgtcgccctcccaccgaaggtccctactgctgcaatatgttcttcgaaggggatgatacctctagaaaccatcaagagagatatgtctaccttggggattactgctaaaagcctagggcacggagcaaacacgctgcgtgccatttttcacactgccatgcatgagtatcatatacccttttgcttatgttcggcattgcatatgggttctgtcttgatcccttctataaacaaaccaacggagggtccgtgtcgccttcttaaaaacgtgcgttggggcattttgctacccctagacgtcgtatctaagaaggggacaaattccccggacccccgcattcctaaattgcatctgtgtcatatgcattccatcatgcattcatccatctcacccaggagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaacccctccaaatgcaaccttccgcaagacttacggaaagatcttagagtga

SEQ ID NO: 96502 - DNA, 173 bp, Glycine max
  Peptide Sequence Number=SeqID_213280
caaatacaaatggtaatgatgctgatgttgcacttgaattttctcctttgaaaaccgttcaatttggaaatccttctcaagacactgttgacccaagagatggaggctttggagatggaaatgggaaaaatgaatcaagacaatatattgaggggttaatggatcttgaatag

SEQ ID NO: 96503 - DNA, 522 bp, Glycine max
  Peptide Sequence Number=SeqID_213281
atggccccagctgttatgcacacggggcaggatttcgcccgggaccgctgcagggagccgggtgcagatcgtgcgcaccagcatgaccactttgacccagatgtggatgacactactgctcagcaatgtatgccacctaccaggcaccctctggaaccagataagtctaacagggccctggggtttctggcgttgatcacgggcctctgccagtcattcggggttcccgtcagcccaagtaaagtgattcgaccgccgatcacccgggccttcatcgagaagtactgcacgcctaggcaagcacagggtgatgcacatcagaccgcaaacgcaccgccaccacctcggcaggccgatcccgctggatcactaggcatggagcgttatctacaacacttggtacgccagcaggcggccaaccaccgtgggcaagtgcaaatacatgagtgtctctaccggttcagcctcagtcaacaggggcaggtgtcacaacctacccttcagcgggagggcgacgcgtga

SEQ ID NO: 96504 - DNA, 411 bp, Glycine max
  Peptide Sequence Number=SeqID_213282
atgttgcggaactttacggattgcgcaacaatactctttttgacttccggaatgttgcggagctttacggattgcgcaacaatgcttgttttgacttctagaatgttgcgagactttacagattacacaacgatgggtgttaaaaattttgaggtggtcaagcgaaggtcgcatgccaacaaacaatggtccccagacgaaattaggggtgacctattggaggctcccaacttacttccaatgaaaggcctttttgttacaaaatttgaaagcaatgaaatgcttcttagtccaatagctcttaagttggttttcaccttgcttcttgactcaaattcttcaagggatggcaccaatcctcctttccaattccctatatggcaactcgcaagcaaggaaacaaagagacaa

SEQ ID NO: 96505 - DNA, 237 bp, Glycine max
  Peptide Sequence Number=SeqID_213283
atggataaccattcatggtattatccagcctgtgctcaatgtcataggaaaactgacatccaaacaggaccattcacatgtggatgtgacaaggataatgatcaacctgttctaaggtatagagttgaggtcatggttacacaaaacaatgagagtggcaaatttttgctctgggaccgtgaatgtgctaaattgattggccaaacagctgatggtgtgaatagggtcaagattgaa

SEQ ID NO: 96506 - DNA, 228 bp, Glycine max
  Peptide Sequence Number=SeqID_213284
atgtgggtgcaagccattggtttgtttgctcaagcgacatgcactcctgagtttggacttccaagaccgttcaatcagaaattactcatgctacacatttgtcgcttttttcattcttccttgctacaaggttgtgaaaacaagacaacgattgatacctcaaagccctacactggggcaatgaggggcaccatgcataaacctcaagcaaacctaggggcagattag

SEQ ID NO: 96507 - DNA, 249 bp, Glycine max
  Peptide Sequence Number=SeqID_213285
atgtcatcacatcagcttgatggctccataaaagaatctcatttcatatactctactgttgtccagctgctcccacgaatgaaggttcacaatcatcataggtaccaaccacacggaaataacctaaatgtgtccacgcgacactctcacttagaaaaactagacaacaagtgtcgaggttaccctgtcatgcacaagcaactcccctccatggtgatcaggttgagtcttaagggagttctaaactga

SEQ ID NO: 96508 - DNA, 474 bp, Glycine max
  Peptide Sequence Number=SeqID_213286
atggttagaacacgaggtataggtcgtgctttagctagggttataggcagaggtagacaggatgagcatgaagcagttgatgttacctggaggcgtaggcctactgcatcagcccataggcaacgggtacatattgcggttgataagggtgtttctcaggtgactgaggatgttcctcatatggcggaggatgttcttcagatgactgaggatgtccctcatatggctgacgatgttcctcagatgagtgaagatgcacctcagatgactgcggacgtagatgcgactgttgtagaggacttaggttgtgatggtgttgaggggcatgttgcacatgccatttggattggacaagagcgtcctgagctgaagttggtgtcgcacgggaggaaggtggcatttgttggttttgaggaggaaattataaaaaaaacagaggagagaagaaagacaatacgtatgcagaggaaatag

SEQ ID NO: 96509 - DNA, 522 bp, Glycine max
  Peptide Sequence Number=SeqID_213287
atgttaatcaaaacctttgatggtcataatgacctgttgctcaacctgtggttgcatcatcgcgacgatccggccgctgccttcttcaccggtatcgaaaaaggacacctcgattttccgcgcatgcagcagggcggctttgccggcggattgtttgcgctgtttgtgccgccgcagcgctacgtcagcgaagtggcgccgcagctggccggtgaagcctggcagccgctggagatcctgtggcagcagctggagattctgaaaacactggttgcccgttctgacggccgggcgcgtctgtgcctcagcaccgccgatatcgccgcctgccggcgcgacggcgtgctggcgatggtggcgcacattgagggcgcggacggttttgacggcgacggcgccgatcttgccgccttctggcaggcgggcgtgcgtagcatcggtccgttctggatctggaaaatcgctttggcgctggcgtcaccggcgcatttcccggttcgccggatagcggtccgggactga

SEQ ID NO: 96510 - DNA, 168 bp, Glycine max
  Peptide Sequence Number=SeqID_213288
atggctactccaatgagtactacttgctacttggacaaggatgaaaccggattatggtatcataatttctctacacttgctccgccactcaatgagttggtgtgggagttgagttgttgcaaggtgggtgtaacgacccgcctcgtcgctacgatatccacactctaa

SEQ ID NO: 96511 - DNA, 252 bp, Glycine max
  Peptide Sequence Number=SeqID_213289
atggagcaaggtgttggcatcttaggtgctctgcttcagtacttgctacctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcag

SEQ ID NO: 96512 - DNA, 502 bp, Glycine max
  Peptide Sequence Number=SeqID_213290
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtccagaacgtagaggagtcggtggctctcctagggtttcctcatttgggatcctgggaagagagatcaagctggcccttgcgaacagcttgatgccctatctccccttcaaccctttgagcgaaatgtggcaaaaggaaaaaagaatccatggaccgaccccctcgtctccaccccgtaagaactacgagatcacccccaaggataccttcggcatccaggggtcgcggaccgaccatagaaccctgttcaaaaaagcggaacgcattagctatccgctctcaggggggcgggggaagctctccgttcccggttctcctgtagctggatcctccggaaccacaagaatcctta

SEQ ID NO: 96513 - DNA, 951 bp, Glycine max
  Peptide Sequence Number=SeqID_213291
atgcacgacagaagcacgcgtcagtctcaaaggtctggaactgttctcgcggcagatgtcggtgggtccttcattcggcttgcgcgctcgacgcatccgggaaatatcgagcttctcgaaaagctccccactcccgctgacagctgggaagaatttgggcgcgcgctggaaacggcgctacgaactcatgcgtcgaaagaggagtggccgcttgccctctccatcgccggattggtcgatccggatacaacgactgctctgtcggcaaatattccctgcattacaggtcacaagctaagtctcgaacttggagagcgacttcagcgccgggtcatcgcggccaacgatgccgattgtctgacgctggcagaagcgattgaaggcgctggtaagggccacgatatcgtcttctgcgcagtgctgggcacaggcgtcggtggtgggcttgttgtcgatggccggctcgttcgaggtaagggcggattgactggtgaatggggacatggtccgatcctcaacacatcggtggacctcgatggacaaactgtactggtcccgcgcttcagttgcggttgcgggcaaagcggttgtgtcgataccgtcggcggcgcgcgcgggattgagaggctgcaccgtttgctgaatgccgccgatgcaacgagccatgagattatacaggattggctcgacggctgtcagatggccggaaggacaatctccgcctatctccagctggttgccgatccgctggctgccgtcgtcaacgtaaccggcacatcgatcattcccgtgggtggcgggcttgccacggcgtccgagctgatttcagcgattgacgaggcggtgagagcccgaatcctgcgcaaaacggagcagcctatagtcgttcccggaatattcggaagcgatggcggtttggtcggggcagcaatattggggcatcaggcgtga

SEQ ID NO: 96514 - DNA, 435 bp, Glycine max
  Peptide Sequence Number=SeqID_213292
atggggaagacacatgaatttacccaccacaatctagccgactttgagccttgcctcggatatgccactgaagggcaagcagttggtggtatacccctgcaaaacccttctatggaaaaatggtgggttacaaaccttcaagctttgtggaattggtctttgccagcgaaaggatcaaaatgggtctggaaagaggcaaatttaatcatccctttgatgaatgcaaaaactggggcaaatgaagaggatgagaatgagggagaaacctttgctatgactggcattcctacacggtcaaatttcccatcagcccaacaatgtcattactcagccaataacagtccctctcacccaatcatccacaaaagccatccccaaatcagccacaaggcctgccttctcaccacacgaccaatgcccaaacaccacctatag

SEQ ID NO: 96515 - DNA, 861 bp, Glycine max
  Peptide Sequence Number=SeqID_213293
agggctgcttgccctcgccttcagaggactacacatcttcgccatcagagggctacacgccctcaccttcaagggactacacgtcctcgccatcagagggctgtagccctcacctttagaggactacacgtcatcgccctcagaggactgcacgtcctcaccttcagaggactacacgtcctcaccttcagagggttgcacgcctccgccttccgaggactacatgtcctcgtctttagagggatacttgccctcgccttcagaggacttcacgtcctcgccattagagggttgcatgccctcacctttagaggactacacgtcctcgccatcagagggctgcacgccctcaccttcagaggactacaagtcctcgccatcagagtgctgcacgccctcaccttcaaaggagtacacatcctctccttcagaggactgcacgtcctcacctttagagggctgcacgtcctcacctttagagggttgcatgcccttgcctttagaggactacacgtcctcgtcttcagagggctactcaccctcgcctttagaggactacacgtcctcaccatcagagggctgcacgccctcaccttcagaggactacacatcctcgccatcagagggctgcacgccctcaccttcggaggactacacgtccttgccatcagaggactgcacgtcctcaccttcaaaggactgcacatcctcaccttcagagggctgcacgccctcgccttcagagggatgcacgccctcgccttcagaggacggcacatcctctctttagagggctgcatgtcctcgcctttagagggctacgcgtcctcactttcagtgggctccatatccacaccttaa

SEQ ID NO: 96516 - DNA, 186 bp, Glycine max
  Peptide Sequence Number=SeqID_213294
atggaaccagaattggccatgatactttacacttatagaacagtctttgatttgccatcaggattaccccctagcagaactcacaatcattcaatcccattggttgaaggtgctggaccagtaaaagtcaagccatataggtatcctcacagccggaaggatcagattgaaattacagggccttga

SEQ ID NO: 96517 - DNA, 759 bp, Glycine max
  Peptide Sequence Number=SeqID_213295
atgggggagtggattgttggagctttcatcaacctctttggtagtattgcaataaactttgggaccaatcttctcaaactagggcataatgagagagaaagacatttacttggaagtgatggggtaaatggaaagatgaatctgaagcctattatatatttccagagttggagaattggcattgtatttttctttcttggaaattgccttaatttcatttcctttgggtacgctgctcagtcacttcttgcagcgctgggatctgttcagtttgtatctaacattgccttcgcttactttgtcttgaacaaaatggtgacagtcaaggtactggttgccacagctttcattgttcttgggaatgtttttctagttgcttttggcaatcaccaatcgcctgtttatacgccagagcagttgacagagaaatataccaatatttcattccttctataccttctagctttgatctcaattgttgccttgcatcactccatctacaagaggggagaacttctgcttggagtatcaggacatgacctcagaccctattggagcatgctactgcccttctcatatgctgtagtttcaggggctgtaggttcatgctcagtgttgtttgctaaatcactaaaatcaaatccgttacatcatttagaaacaccatggggcatgggttcaacatacaaaaccagacctagcctagataattggagctttgagccatgggtcattgcttactgctggggaacaatatga

SEQ ID NO: 96518 - DNA, 801 bp, Glycine max
  Peptide Sequence Number=SeqID_213296
atgacttcaaacttcaccattgaacaaaggctcgagcagctgcaaaaagcaaaagaagaagcacaaccccaaccacccaaaaaggccatgcaaaatccaacgtgtagcacatcatctccgagaccgaaagcatttcaccaagcgttacgagccgaaactgatatcattttgggtcccatccatcatggtgctcctaaactgcagctgggagagcagtacaagcaaaggtgggcagcgaggtacatcgacaccactggacaaaccccacaagacctacacaataaggttctgaaggatattggaaaccttaacaacttgtttgacgatgaccttttaacagcctctgcccaagaacgacaagattatatactaatcatgccatggaaggtaccagaagcaaggcgttgcaaccatagaagaaaagatttgctggatgatgggagacgtgctcttgttgaagaaccagcttccgttcccgttgctgcagctgctgtggagagacaccgaacgcgtgttgatgggaaaaatgagaaattttcttcgcttcctgagatcgttgtggatgacacaacagctgctactgtgctaaacctaatagcatatgagatgtgtcctgattttgagaacgactatgggatttgctcttatgtgtccttcttggactcactcattgaccacccagatgacgtgaaggcattgaggtcagaacaaattttgctcaattcgttaggtagtgatgagaaagtggccaacctcttcaataccataagcactgacttggtgcctgacatgggaaaataa

SEQ ID NO: 96519 - DNA, 825 bp, Glycine max
  Peptide Sequence Number=SeqID_213297
atgaaaccctacacatcatcaccatcgtcctccaggtccaaaaagaagcaaacaacaacacaacaagatcatgaaacagcatggggaggaaggtaccttggggtgaggaggaggccatggggaaggtatgcagctgaaatccgtgacccttccaccaaggaaagacattggttaggcacgtttgataccgcagaagaggccgccctagcatacgatagggcggcccgctccatgcggggctcacgtgctcgaaccaactttgtctatccggacactcctccgggttcctccgtcacctccatcctttctccggacgagcaaacccaaacccaaatccaccaggcccaagaagagctctcctctctattcaatccgaacccgtttgcacaacccgacccaaacccgcatttttccttatgcgggtattcgggtgtcacgaacactcctacattttctgccaccgaagaaattgccccatccggtggctatagctataattatggatacactgaaggaggaaccagcatggagagttcacattttaagctctttgatgatggtgaaacggagcttccaccattgccaccggatatcacaagctccatgggctatgaaatgggtaatgggttttatggaaacgatgccgggttttcggatccaagtttcggcgctaatgctaccgggtcaggttacccatattcgggatttggatccggtgattacgtggtgcatagtccactctttagcgcaatgccaccagtgtcagataatgtttcaacgggccatgagggttttgatttggcaagctcttcttttttcttctga

SEQ ID NO: 96520 - DNA, 414 bp, Glycine max
  Peptide Sequence Number=SeqID_213298
atgggtagtgaaattgatatggccgatgtcacagttaatgcaataagttttagttttagttgggcagtggacagtgccataaggagcgatgagagtgagactgcatcaaatctgggagcatcccctgcccatagttttggttcggtactggacagtgcaattagaagaactgttgctgcacaattattctccctgactgagcttaaagcggccaccgacaatttctcatttcacaacaggattttaagggctggaagcatcggtgatgtgtctagtggcaaacccatcgatggtcgtgaggtggctatcaagagggagtcttgtttgtatgagtacatgaagaatggggcgttgtttgatcatttgcatgacaagaagaatgtggacaagggtagccgtgtgttgaattattga

SEQ ID NO: 96521 - DNA, 267 bp, Glycine max
  Peptide Sequence Number=SeqID_213299
atgggcaatgtcatcagatacactttcgcaccggagagggctaccagaaatgttggcagtgcagtagacaaggacaaagatcatgccatcgaaggcctgtgcaatgccgagaaggccaatgccgtcacatggtccggttttttttttgtgaccaatgacgatggcgatggtgccgtagaggaagagaagtgtgacgacaaactcgacaatgagggctttgtagaaggactagagcttaatcttagccaagtcaatgaggggcgctaa

SEQ ID NO: 96522 - DNA, 951 bp, Glycine max
  Peptide Sequence Number=SeqID_213300
atggtactgggctggccttgcttatatgacggttatgtttgtgactacatttctgatggcactagtcataatgtttgtctggcagaaaagcattctgatagctataatattccttttgttcttttgggtgatagagggtgtatatctatctgcagcattggtaaaagtgtttcaaggaggatgggttcctcttgtcttatctttcatctttatgcttgtaatgtatgtgtggcattatggcacttgtatcaagtacaattacgacctatgcaacaaagtttcattgaaatggttactggctttgggccctatagcctcatctacacagaacttgcaacaggaatacctgcaatattttcccactttgtaactaaactccctgcatttcacatggtgttgttctttgtttgtgtgaaaacagttcctgttccacatgtctcacacgaagaacgttacctaatttggcgagtttgtccgagaccatgtcaaatgtatagatgcactgtcagatatggatacaagcatattagaagggatgatagagattttgacaaccatatcatacgatgtatagctgagtttatccaaatggaggcacaggaattacaactctcattttctgaaacttcctcattcgatggagggacggctattataagtgttagaagcttagaatcagtttcaagtaggaaagtgtctgagaatgaagatgttggtgtggacaagaacaatgctagtggtagatctttctccgtacgacgacccctttccacttataacgaagaaaacccacattcaagaaggcgccacataagttttcgggtacctaatgatcctgtattggatcatgaagttaagcaagagcttcttgatttagctcaaactatggaggcaggggtccagctgtggctcttaacattcctcacatcagtctcattgaagttggaatga

SEQ ID NO: 96523 - DNA, 432 bp, Glycine max
  Peptide Sequence Number=SeqID_213301
atgaggatcaaaattgctttggatgcttatcggggaatagaataccttcataataattatgtggttccatctattattcatagaaatatcaagtcttccaatattcttcttgacgctacttggacagcaaaagtacctgatattgaatcctcgtccattagtctagaaactgatcgtgtttaccatgatatggtacgactgggaaccttgggatcctttgatcctgggtacttgtgtacaagtttgttcaaagcaaagagtgatgtgtatggtcttggaattgtacttgaaattttaacgggaaaaccaactatattcaagtatgggaaacatggaagcaccaatatggtgaactttgcacgacgtgctatttcggctggagaaatgttgaaaattctggatccaaagggttggaccactgggtgtgaatga

SEQ ID NO: 96524 - DNA, 1587 bp, Glycine max
  Peptide Sequence Number=SeqID_213302
atgaccgattctgacgccaatcacaatgacccatctctcgctaccgataccgatgcacccaatgatgctgaagatgaggtcaagttgaggtctagggaccaaagactggctctgccaggtgagcccaagtgtattatatgcggccgctacggtgaatacatatgtgatgaaactgatgatgatgtttgcagtttggagtgcaaacaagcactgctttgcaggattgccaaatcgtcgtctccaccacctaaaaggattcctgcagctgatgagtgcttttatgttaaagatgctgattacgaatcggggactgcatctatggctagtgatcttagaaagaaacttgacattcatgtgaagggtgatgtagtggcaccggttttgtcattctctgcctgtaacctccctgacaagcttcttcacaatatagaagcagcaggatatgaaatgcctacacctgtccagatgcaagcaatcccagctgctttgacgggaaaaagcatgctccttttggccgatacaggatctgggaagtctgcttcgtttcttattccaatagtttctcgttgtgcgattcatcgtcgacaatatgtttcagataagaagaatcctttagctttggtgttaactcctaccagagagctctgtatgcaggttgaagagcatgctaagttgcttggaaagggtatgcctttcaaaaccgctcttgtggttggcggtgatgccatggctggacaactccatcgcattcaacaaggggtggaattgattgtaggaaccccaggaaggcttgttgatcttttaacgaagcatgagattgacttagatgatgtgatgactttcgttgtggatgaggtggactgtatgctgcaaaggggctttagagatcaggtcatgcagatatatagggctctgtcacaacctcaggtcttgatgtattctgctacaatgtctaatgatttagagaagatgattaacactctggtgaaaggtacggtggttatctctgttggagaacctaatacaccgaataaggctgtgaagcagctagctatttgggtagagtcaaaggaaaagaagcagaagctgtttgaaattttggaaagtaagaagcattttaagccacctgttgtagtatatgttggctccagacttggggcagatctcctggctaatgcaattacagtttccacaggaattaaagcagtttccattcatggggagaagtctatgaaggaaaggagagaaacaatgcagtcccttttggtgggggaggtccccgtggttgtggctactggagttttgggtaggggggttgatctgcttggtgtaaggcaggtgattgtatttgacatgcctaataacattaaggagtatgtacatcagattggaagggcatctagaatgggagaggaaggtcaaggcatagtttttgtgaatgaggagaataagaatatatttgcagaattaattgaagttctgaaatctggtggagcagctgtgcctcgggagcttgccaattcacggtatgccacaggagttttctctggtggcaagggttcaaagaagagaaagcatacaggatga

SEQ ID NO: 96525 - DNA, 741 bp, Glycine max
  Peptide Sequence Number=SeqID_213303
atgaagaataatagagcatctgggattttgaagttgatagctgcactgaggtcaatggcaaagtcaaaatctttggctctaaagtccaaaacgaacgccatcaaggctcggttggttatattctcacttgtgatgaacaagaggtatgtgatgagcaccatttctgacaagttccaatctcttctggggcatcaccattcacatctcaaagaagtggaagatggtaatgatagtgtggaggacaagtgcactgtggtgatcaatgacaatgcacacttgcatgaggattttgtttcgacctcaagtctacaagcatcgatagggtcatctatagtctcgacttctgagcgatgtgagatttttggacataccagaaaagcagtgtccaatgttaatcctagtgagacccaaatggtagtggaggacaatgatggtgctgatgatgatgatggatgtgaatgtttctacacgtatggtgatgatgatgatgatgatgatgatggtggtggtggtggcaataagtacccggatcttacacacacaatgtttgagtcagacgatttggaaattggagggtcagtgattgatttggtgaagagttcaaaagaagaggcagggcaagagttcaagatggaggatgagattgatcacatggctgatcttttcatcaggaaattccgcaggcaaatcatgctgcagaagcaagattctttgaagaggaacgagatgcaaatccaataa

SEQ ID NO: 96526 - DNA, 468 bp, Glycine max
  Peptide Sequence Number=SeqID_213304
atggacgagtcgggttcagcctcctctccaacgcggccggtgacaatcgagggcggcgagtgcgacgcggcgttgtcgaagtcgcgggtgctgacgcgggaggaggtgctccggcggcggctccggcgagtgaggcagctggggcggtgctaccgggcccactactgggccctgatggaggagctgaggtcaaagtacagagactactgctggacctatggcaaaagccccttcaaggaggatcacgatgacaacaacaacaacaacgaccaaaacggcgtcgtttctggtggtgacgatatcgtccggtgtcgttttagcggttgcaagaccaaggccatggctttgacgaattactgtcatgcgcatatattgggcgattcaaaacagaagctttaccagggatgcaaagccgttgccaaaaagtttgtgcttgttcaaattgaaattgaagatagtgtgaagtga

SEQ ID NO: 96527 - DNA, 195 bp, Glycine max
  Peptide Sequence Number=SeqID_213305
atggatgatttcatcaaacaaggaaataacaccaacccaaaagtctcccaagataggaaaacaaatctaccaagaaggagattgatggtggagtgcagcagaaaaattgggaaagggcagcaaggagtaacaaacattgataatggcaacaatgacaagtgcaaatgggaagagagggaaatgttcagaacttag

SEQ ID NO: 96528 - DNA, 195 bp, Glycine max
  Peptide Sequence Number=SeqID_213306
atgacagtcacaaaaaagacctttgctgaggaagtaaacgctgctttcagagaaagtgcagagaatgagctcaagggcattctctctgtgtttgatgagccccttgtctctgtagattttagatgctctgatgtgtcatcaactgttgactcatcgttgaccgtggtcatgggagatgacatggtaggacaatga

SEQ ID NO: 96529 - DNA, 159 bp, Glycine max
  Peptide Sequence Number=SeqID_213307
atgattatgagagacgttttcactgttaagagtgagaagaattttttcgaagacctggagagtggagatccacctgtagatgaagttattgagatgctcaatagtgagaaaggaaaagcagataatgctgattcagaggaaattgatccaaatgtttaa

SEQ ID NO: 96530 - DNA, 690 bp, Glycine max
  Peptide Sequence Number=SeqID_213308
atggcaaatgaagtggacttcaagattgaattgaaggtgtcagctaattgctgcgaaggatgcaagaggaaagtcaagaaggctttaagaaaccttgaaggtgttttgagcatagacatagaccccatggagcccaaaataacagtattaggaaacgtgaatccacacattttgattaaaaagcttcacaaggtcggaaagcgagccgtactgtggagctatgaggaagttgaagaagaaacaacaaaacaggacacaatgtgggaacaagagaaacagcctcatccatgtgacattaaaattgagaaaactaaggatgtcacaagaaagaaaaaaacttcaaaagaagacaagaagatgagttacaattcttgtagtactcaagaaatgaagaaagaagaacattatgtgcctcatcaagaagggaatttcatggttcatggtcatcctagcatgatgaacccatattatagtaacagcatcaaaactcatcctcagtgttgttacattgctcagccttgtgcagttgcagtaccctattatgcaattccttcttcatattcagctcctcctcaagcttgtgttgaagaccacattccaagattttttcagcctccattcttgagaccaacagagcgagtaggggactatttcagtgatgaaaacaccatgggatgccttgtcatgtga

SEQ ID NO: 96531 - DNA, 576 bp, Glycine max
  Peptide Sequence Number=SeqID_213309
atggccacaagcttcaccatttgtcgattagcagtatcaggtccagcaaatgggaagggcttctctgaattctctggccttcgcaactcatcaataggttacctttccttttcttctagaaaaagttctgaggacttccattcagtcattgccttccagacttcagcagttggaggcagagaaggaaacacaaaaggcgtagtagaagcaaaactaaaggtagccataaacggatttgggaggattggaagaaacttcttgagatgctggaacggtcgcaaagactctcctttacacatcattgcgatcaacgacactactggaggtgttaaacaagcctctcaagcctcactttctcaaggacttggaaatcgacttttgattgaaggaactggagtatttgtggacagagacggtgcaggaaagcacattcaagccggagcaaagaagattttgatcacagctcctggcaagggagatattcctacctacgtggttggtgtcaatgctggtatttacgacccagatgaacccatcatcagcaatgcttctagtacccttcgtcaaggtccttga

SEQ ID NO: 96532 - DNA, 468 bp, Glycine max
  Peptide Sequence Number=SeqID_213310
atggacgagtcgggttcagcctcctctccaacgcggccggtgacaatcgagggcggcgagtgcgacgcggcgttgtcgaagtcgcgggtgctgacgcgggaggaggtgctccggcggcggctccggcgagtgaggcagctggggcggtgctaccgggcccactactgggccctgatggaggagctgaggtcaaagtacagagactactgctggacctatggcaaaagccccttcaaggaggatcacgatgacaacaacaacaacaacgaccaaaacggcgtcgtttctggtggcgacgatatcgtccggtgtcgttttagcggttgcaagaccaatgccatggctttgacgaattactgtcatgcgcatatattgggcgattcaaaacagaagctttaccagggatgcaaagccgttgccaaaaattttgtgcttgttgaaattgaaattgaagatagtgtgaagtga

SEQ ID NO: 96533 - DNA, 322 bp, Glycine max
  Peptide Sequence Number=SeqID_213311
gttgaatgtgtatggtttatgtgaggtcaaggtatctggagatggaaattgtcagttccgtgcactttccgatcagttgtataggtcacctgaacaccacaagcatgttcgcaaagagatagtgaaacagctcaaagatcaccgttccttgtatgaatgctatgtaccaatgaagtacaaaaaataccacaagaaaatggctaaaactggagaatggggggaccacgttaccttacaggcagctgcggataaggtttgtggtgctgttttcaaagagcttgttactttcataggatgctaccaagtaccaattgatcagtaa

SEQ ID NO: 96534 - DNA, 270 bp, Glycine max
  Peptide Sequence Number=SeqID_213312
atggccgtggaatctttcgattgtttcaggttgaaacttggagtgccggctcaggatattatgatgaatggaaatggtactcagactgagtattggggcgaaagttcgggttcaacttcccatagcagtcagcaggatgtggaggatgacaggatgattgctcttgtgctgtcagaagagtatgccaaattagatggagcagttggtcggcgccttaccaacttggaacctgttcctgtaagaattccttcttttcagttgtttccctaa

SEQ ID NO: 96535 - DNA, 676 bp, Glycine max
  Peptide Sequence Number=SeqID_213313
ggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggtggctggcaagctgtgaattttgtgtgatatgtggattatggcctctggtaatcgattaccaagggtgggtaatcgattaccaaggctgtgtaatcgattaccagagatggaaagccttaaaataccccttttacttgcatatcgtgatggcggcgcagctaatccgtgatcgagtagagatggagtgcctagagggagcttgggagaccctcgaaggcaacacgaggtgccgatttcgggacaccattcgattcacggctacttctttggtgcatccagatgaacttgcacggacgcttcagcgcacggtggagtggatactacccacgcctacaccatatcgtctagtggagcccgtccaagtgatcgaggtaacgtcatccgaggaagaccctgaggaggatcccgaggagctacctcctgagcctgctgtggattctcccgaggaagtcatgtcggcatctgaggcagattctaaggaggatgatggcccgggggagatggcgatcagcggaggctcttcatcctag

SEQ ID NO: 96536 - DNA, 823 bp, Glycine max
  Peptide Sequence Number=SeqID_213314
atgagtggcggagatggaaaagacagccgtggcccaactggcggtattaaaggtggggcttcagaccaggggcccaatgtaggacacggtggatctatggatacaaatattcctggcatgggggatgtgcatatcgatggagtacacggtttaaatcccggtcaagataacagtaccaactgggagggggggaacggtaagggtggcagggacagtagcagcagtggagactcccaaggagcggcaatacggcgacaggtgaacgcaatcaaaaatgaccctaaagttagtaatatcctgaaggagttacaaaaaaaagtacgtgcggttacagcttatgcaaaggtagctttgaaaagtgtggaggctgacggaaaaatacaggtacaggttggtgaaattcgtacacgcgatgaagctgccgttagcagggctattacctctgtctcacaagttaaaaatgtacttggcgtggggttgcctgctcaaggcgggatcgtgttcgctggcaatatcgataccaatcatagaatcggtaattatcagaacgtacccaacgggaacaataacggcaacaattctgccgcagaggataaggcgtcattagccacctattccgaggtgcttaatgggaaaattccaccgggcttctggcttgataataatagggtaatgaccgaaattactgagcagtatgagatcaacggcggcggcaaagggagcgatcgcacagggtatcggcaacgtaatgtcgaagtgccttctttaacctcggcctaccagcaatttaaacaggtagaacgagaagtggccgaagaggccc

SEQ ID NO: 96537 - DNA, 337 bp, Glycine max
  Peptide Sequence Number=SeqID_213315
cagctccgacgcccgcatgaaaacggacatcacccaaatcgaaggcgcattggacaaactagccagcatcggcggctacacctacctcaaacagggcgtgccggaagccggggtgatcgctcaggaagtggagagcgtattgccacagtcggtcacccaaaccgaattgaagctcaatgatggcaccgtattgcaagatgcccgcagtatcaatatcaacggcgtggtggcgttgctggttgaggcgcttaaggaggagcgctcacttcgagatgccgagcgcgaagaatttgaagctcgattggttgctttggaaaaagcgattgcgatcgcctga

SEQ ID NO: 96538 - DNA, 220 bp, Glycine max
  Peptide Sequence Number=SeqID_213316
atggcagatatgaaaactattgcattctctatagtagcagtagttttaattgtaatagcagctgtaggtttttatgaatattcagtagcaaactcgagatacattaacgcatataatgagtatcagagcgaaaatagccaatacatggcattacaaggaaactatactaaattaaatcagacatattcacaactagcttcccagtacaaagtactagaag

SEQ ID NO: 96539 - DNA, 405 bp, Glycine max
  Peptide Sequence Number=SeqID_213317
atgaagggtggaaggtacacgctgtggatccaagcaggaagtttaggaggtgtcaccgtcaatcacgaattcattccaagatcggctagggcccgcagtggcatcacgttgatggaggccccagggtcgatctctacccgcggtagccttctttctttcgccgatgtcaccggtgagaaaaagaggccgcttatgtatgcttcttcctgtccagcaagatgtcttctgtcgagaagcaagacccgaggaatcagatacggatctttttcagtctctttcgctggggcaaagcaaagagggaggactttcggaagaaggcgtcgtccgctgatgatcttgaggttgggaggcaggtcagggggagaactaatgcttgtggatagcccgctaaaactcctgacttag

SEQ ID NO: 96540 - DNA, 618 bp, Glycine max
  Peptide Sequence Number=SeqID_213318
atgtcctcacctttagaggactacacgtcctcaccttcaaaggactacacgtcctcgccttcagagggctgcacgccctccccttctcagggctgcatgccctctccttcatacgaccacacgtcctccccttcagaggactacatgtcctcactattagaggactacacatcctcaccttccgagcactacatgtcctcgccttcagagggctccatgccctccctttctgagggactacacgtcctcgccttcagaagacttcacgtcctcgccttcagatggctacatgccctcgccttccgaggactacacgtcgtcgctcctagaggactacacgtcctccccttcagaggactacacgtcatcgcctttagagtgctacacgccctcgccttaagaggactacacgtcctccccttcagaggactacacgtcctccccttcagaggactacatatcctcacctttagaggactacacgtcctcaccttcagaggactacatgtcctcgccgtcagagggctgcatgccctctccttcataggactacacgtcttccccttcagagccctacacgtcctccccttcaaaggactacacgtccttaccttctga

SEQ ID NO: 96541 - DNA, 411 bp, Glycine max
  Peptide Sequence Number=SeqID_213319
gatagctggagcccgcgggcgagtctatcggccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 96542 - DNA, 407 bp, Glycine max
  Peptide Sequence Number=SeqID_213320
tggatggctccggtttgattgaggtaatctgggtttatgacccttctaaattggttttctgggtggatgacccagcctgggttggtgacccagaagaggttgatgatttcttagtggttggctctggaagagccagtcttgatcctttgcctgtacttcatcctccccttagggagattcctgatgccttaggaggcattaccacttttctcgacgaggcgggttgttacacatcaggccgcgggcgcaccaccaccaccttggcaggtctattcgactggaccactgagcttcgagcggggcagggttttgccccttttgtatgccctaccctggagcagtttagggctgaggtcgcttggcccgaagactggcccgatgcccagacaggggaggagcctgcataa

SEQ ID NO: 96543 - DNA, 255 bp, Glycine max
  Peptide Sequence Number=SeqID_213321
atggcattgactatctcagagcttttcttgaggccttaccagcggacactggcagatggtggtcattgtgcccaaggaacacctagttgtcagtgtaatcgacaaaaaggaagcactgagtgtgactattatgtcatgcactggatgtccaccatcattttaggaagtttcaggaataattgggaaacgaccattggagccagagagattaaaggcgcttcgaatccagtgggcacaatattatctctgagttag

SEQ ID NO: 96544 - DNA, 429 bp, Glycine max
  Peptide Sequence Number=SeqID_213322
atggctttggccaccggcaccggtgccgaagttcagcggccattggcgacggtggtgattggcgggatcctgtcctccaccgcactgaccttgctggtactgcctgccctgtatcactgggcacaccgcaaggatgaagacggcgacgaggccgaagtggccaacactttctccgagagcaagcagcttcaatacaccaaggaacaccagaccgcagtggccaagtacgcggagaaaaatggcaagccaatgccagagattcaggattacaaatatggcatgaagatagacgttgcgaaattcgtacgtcagtcgcaggacccccgtacctgccaggtctatccacggttgatgaccttcgaggactcccagggcacgctcaagactgttcgttactcgatgtattcgcaatgcatcaacaacaagtag

SEQ ID NO: 96545 - DNA, 252 bp, Glycine max
  Peptide Sequence Number=SeqID_213323
atgaagcccagggacgctaccaaggctgtcatcagaacaggtcgcagacgggtcaatgcaccttcatcgactgcctgtctgagcgttcgtccctcctcccttagcccgcggatgaaggcaatcatcaccaggccgttcagtactgcaacgccggacagtgcaatgaagccgacacctgccgagatcgacagtgggatgtcccgcagccacaacgccacaacaccaccggtgagtgcgaatggataccggtga

SEQ ID NO: 96546 - DNA, 141 bp, Glycine max
  Peptide Sequence Number=SeqID_213324
atgggccagttttgtcaaacccgtagagacccctcgtgggaggattctttggaagagcaggcgtcacagggttcgtttgtcccccatggacgtcaagatctcctgactgctgccattgggcgaccagaacaccttggccgt

SEQ ID NO: 96547 - DNA, 152 bp, Glycine max
  Peptide Sequence Number=SeqID_213325
atggaacatacgaatttggggattccacggtcatgtggctccgcatgccactggactcttgggacacggttaacaaaaagtggggtggtcgacaaaagcagggcttttgctccttcgtatcctcaatttgtgaatgaggaactcagacctac

SEQ ID NO: 96548 - DNA, 427 bp, Glycine max
  Peptide Sequence Number=SeqID_213326
atggcagaaccatcgaagaagcgaaagggggttgcgacttcatccgcagtcactggaacacgaagccacggaacatccaaggtgcatacatatcaaattcctccctccatatcatctcctacgttgttttcctcggaagaacaacgtatccggtacaattctcttttctcttctcgttccattatcgaccctaagttcgttgacttagctttctttgatgatgaagtctttgattgctttcaagcatttcaaaattctggtttaattcagtttatctccatgaaacttcctttttaccctgaattggttaaagtcttttattctaacttggaaattcaaaaagattccttgatttctgaagtttatggaattaagatggtcatagaccaatcccttttctttgatctcactcaattatcaagtgatg

SEQ ID NO: 96549 - DNA, 498 bp, Glycine max
  Peptide Sequence Number=SeqID_213327
atggcagaatcatccaagaagcgcaagggttcatcctcctctgctgtgacacatcaaacatcacgttccggagccaccggagcatccccgacaccaattccaccatccttgtcatcctctacactgttttcttcagatgaacaacatattcggtattcctctctctttcaatctcgtcaaattcttgatcccaaatatcttgaacttgaattttttgatggggaaacatttgattgctatcaagtgtttcaaaacactggtttgattccttttatgtcattaaaattaccatattatcctgagttagtgcgagtcttttactcaaatttgaaaattcaggatggaactttaatttctaaggtgcatggtatacctatgattattgatgagtctcttttcttttctttgacacaattccccagtcaaggtgaaccttttgagggtacccttgttgatgactggaagtttgattactctagtcatgatgctcgccgcatg

SEQ ID NO: 96550 - DNA, 507 bp, Glycine max
  Peptide Sequence Number=SeqID_213328
atggaaagaccaaaaggttcacacaaatgttcttccatcctttatactaaaagtgcttcatcattgttgtcgtcttggcagacgtgcttcttccatcaatcatgtggaagcactgaagagattttgacaaagaagatatttgacaaagaaaagatcttgaagccatcgagaggacttgcatgttcaaaactagatttggaggctgcaataggttgtgaattatcccctaaggcacatgcccaggcggatcttaagttgacttatggtaagcagaaagaagagcaaaagcctgaggccgctaatattgctttaattatgcaaagaaatgaagctcttcgggtcattttcgttgttgttgttgaaacttcaaaaaagggaaaagtgaaagctcatatcaacgggaagcacaatattgtggaaatgtccaaaacactcaagatgtccaaatactaccacaaatctagcttggatagtggccaacctccaaatctaagaatatctcattag

SEQ ID NO: 96551 - DNA, 1237 bp, Glycine max
  Peptide Sequence Number=SeqID_213329
gtctcaggggttcccaaaccctaaccaattccaaaaccctaataaccagttgaacaacaatcaaacctctgttcaatcacaagcgtcccctgctcctcctccacaacctccttcgatcactgatttgacacgtttgtgccgagaggggaaagttaaagaggcaattgaattgatggataaaggggtcaaagctgatgctggttgctttgcccttctgtttgactcgtgtggacaatctaagtcccttgaggatgctaagaaggcccatgaccactttctacaatccactttcaggagtgatctcacactgaacaacaaggtgattgaaatgtatgggaattgtaaaagcatgactgatgcacgtagggtgttcgatcatatgcccaacagggatatggactcttggcacttgatgatgcgcggctacgcaaataacaccaacggagatgaggcattgcagttgtttgagcagatgaatgagcttggtttggagatcacttcggagactttgcttgctgtgttgtcggcttgtgccagtgcagaggatgtggaggatgctttcctacattttgagtctatgaaaagcaagtatggaattgagcctgttgtggggcactacatggggcttttggatgttcttggacaatctgcatacctcaaggaagctgaggagtttattgaccagttgccatttgagcccacggtagctgtatgggagaaactgaagcattatgctcgcgctcatggagactttgatcttgaagactatactgaagagttgattgttagtcttgacccatcaaaagctgttgccaataagatccccatgccacctccgaagaagtatactgcaattaacatgcttgatggcaggaacagaattattgagtataagaatcctacactttacaaggatgatgaaaagttgaaggccttgagtgggatgaaagaagcagggtatgttcctgacacaagatatgttcttcatgacattgatcaggaagcaaaggagcaagccttgctctaccacagtgaacgtctagcaattgcctatggtcttattagtactccaccaagaacacctcttagaatcatcaagaaccttcgagtctgtggtgactgtcacaatgccatcaagatcatgtccaggattgtagggagggaattaattgtcagagataacaaaaggtttcatcatttcaaggatggaaaatgctcttgtggggattactggtga

SEQ ID NO: 96552 - DNA, 513 bp, Glycine max
  Peptide Sequence Number=SeqID_213330
atgttcgctaccaatgccgcgagcaacctcttcttccccggcaatccttcgtccttccggtgccgcgccgccgccggagacctctccgcgggcccctccttcttccagtccgtcgctggcggcctaagaataggccagtttcccgacggcgcaggactcgtcgtggaaggacggcgcggcggtggaaacgagccgataagggtgaagaaatggtctcggaagaatgagagttacttggacaacgacactgagcctcttccccttccaatgacgtatcccgattcctcgcccgtttcgcaagaagagattgataagcgcctccaatgcgatccccaaattcaggattgtaaagaggtggtgtatgaatggactgggaagtgccgtagttgccaaggatcgggatatgtgagctactatggcaagagagggaaagcggttacctgcaaatgcattccttgcatgggaattggtattacatttgccttcaacatgccttgccttttttattcgtga

SEQ ID NO: 96553 - DNA, 984 bp, Glycine max
  Peptide Sequence Number=SeqID_213331
atgtttatttgtggacctagttttccagatgacaaattaaaccggatgtggcaaccatacaaggaccagaatcttgttgtggaaagccattcaaatgtgacttcttcagacttttggaatcaacctccagtgaaagcattcagttctgcaatgacaactagtcgggggaagacacttgagattcagtggcctcctatgtcccttcccagcacctattactacatttccctctattttcaggacaacagaaatccaagcccttacagctggagaatttttgatgtttctattaatggccacaccttcttttccagcctcaatgccacaactaagggtgtcactgtttatgctgcaaaatggccactctcagggcagaccaaaattacattgacccctggtagtggaatacctgttggacctgtgatcaatgccggggaaatttatcaagttctacctcttggtggtcgaactcatactagagatgtaattgcaatggaagatttggcaagaagcattcagaatcctcctgctgattggcatggtgatccttgcctacctaagggaaattcttggactggagttacatgctctaatggtttccatgcacgagtcacgacactgaatttgacaaatgctggagtgtcagggtcacttcctccaactcttggccgtctaagtgcactagagcatttgtggcttggggaaaacaaactctcaggcactatcccagatttgagtggactgaaggagttagaaacattgcatttggagaagaacaactttgaaggaccacttcctccatcaacaaagaaactcccaaaactgcgtataattgagtcagattttgagaataagtcaccaaacactaatttaaagcaaagcgaagtgaaagtagaacaaagattcatccgtgagaatgagcacaagccattgcaaattcgacaggttttgtacgtgactgaagaggctttaatacaatcatag

SEQ ID NO: 96554 - DNA, 213 bp, Glycine max
  Peptide Sequence Number=SeqID_213332
atgaaggatataatgttggcatccattatattacataacatgattgtcgaagatgaacgtgatacgttcaatggtaatgtcgatgctgattatgatcacttagaaaatgacatttcaaatgttgaagtatctcgtggtactcctcctaactttgctacattcttgcaaagaagacgcattatgcatacaagaagaattcatcaacaactttaa

SEQ ID NO: 96555 - DNA, 438 bp, Glycine max
  Peptide Sequence Number=SeqID_213333
atggcttatttactcttcgatctgcatgagttcaatgccttcatttctcctcctcggaagctccatgtttttaagggtgtgtcaaatgcttgtggttggaggacaccattgataggatggtataaagtaaatgtggatggagttgtgtggttgaaggataatgaggcagcttgtgggggagccattagagaccataacggtgttttcatgttggctttggataggggattttgtaatattatgattgagtcgaactctgtggaggtagttgattcaatgtctaaggactggaatggatctcatcctttttcttcctatatcagaaagtttgttcatctccttgagggctttctgattccgcacatcctgaggagagtgaacatggtagctgacttgtttgccaagaatgcttttgcatttagatgttgcaaagactag

SEQ ID NO: 96556 - DNA, 5220 bp, Glycine max
  Peptide Sequence Number=SeqID_213334
atgtttccgtggcgggcctttgcgaaatcggcggaggccacgttctcgcgctgggccctcaagagggtttgcaagttcttcctcaagaagaaactgggccagttcatcctcggcgaaatcgacctcgaccaactcgacgttcaactctcgcagggcacaattcagctctccgatctcgcgctcaacgtcgacttcgtcaactcgaagtttggcaagacatcatccttaatggtcaaagaaggttcgattggctacttgttgattaaaatgccttggagtggtaaaggttgtgaggttgaagtaaatggacttgaaatagtagtttctccatgcacagatcaaatgtcaactagtgaaggtgaaacttgtggcttggatggtagtgacaatcaacacctcaaaagctcaatgaggactgagcgtgaaatatcagatgatgctcagaagttgacttcaatggatgttcatgaaggtgtgaaaactattgcaaagatgataaagtggttgctcacaagcttgcatgttacaataacaaatataattgttgcatttgatccatccttagataatgaagaaaataaaactcattgtcgtcataccttagttcttcagatttctgaaatacagtgtggaactagtctgtctgaagatgctgattcaaatgttgatgtccttggaataagccggttaacaaactttgtaaaatttcatggagcagttattgagcttctgaaaatagataatgaggatatataccaacatgaatcaggagcaggacgtggtgaacctgttttggggtcaaatatagcaacatgtccagtcattactgggaaccaaggtggatttagtggaaatataaaattaagtattccttggaagaatggttctttggacgtttgcaaggtggatgctgatgtttgcgttgatcccatagtgttaaaatttcaacctagcactattaaatggctattgcaatcatgggaaactcttaagaatctgaataagggtggaaaaggtttcacaaatcacaactcaagaggatctggccaattgaattctgcattgttctgtcattcatcaacttcagtttctattaccaatgctcccagtgacatgatgactgctaatggtagttcaacagctgattacacttctttgacccaacctgaaacccttgctgaagatttacttcctgtggctcatcttatatccaattgggtgccattgtctactcatataaatcataaagatggtattcaagaacctgattttggggctagtgtggaccagttttttgaatgttttgatggaatgagaaattctcaatcggctttagggagcagtggaatgtggaattggacatattcagtttatagtgctattactgctgcatccagccttgcttctggatctttgcatattccatctgaacagcaacatacggaaaccaatctcagggctacttttgctggaatatctgttgttttgtccttctgtgttgatgaacagaataatttttctgaacctgaaattggtcacaaggttggattacaaattgattatcttggtgcagagtgcaatgacatctttattgcattgcaggtatgccctcaaggtatgactcttgatggaaaggtgaagcatgtagaagttgccaatttcttgaacattggaattgatgctaaaaatcaaagtgcttcggttaaacacctacaagctaaggtccttgatgctctcccttcatctacctcttacaatgtagattcacattcattaattgaaccagttgcaacagattttccatttggaaataatgattgcttgttgaaagttacattgtttagaacttttggagtcacaaattgcaaatgttcaacacaatcaagttcatcagatggttgtcggacagggatgacatcattctcactgaacttgcccccatttgttttctgggtgatcttttcagtaataaatgtgctcatgaatctgctaaaggaagttgaaaaatcacttgaaatgcataataaagaaaaggaaattctgtctgaagtctcagataacaagtgtggatcgtctcagagtgatatggaggaagcttctggtccccgcgtgacatctttctccacaacagaatgtttgcatggtgatatatctatttctaatgcaagagtgatactgtgttttccttttggaagtgatggggatcataaaaattcattttcctgggaacagttcattgctcttgattttacttcatcatcacctttgaacaagggttgcactcctgattatagtcaaacttcaaatgcaagttcgaagaaaagatttccttcagtagctgctcaatctcttcaattgagtttctgtgatcttgacatctacttgattacatcaagtaatgagaatggtagaatcatctcctatgatgtgcagaatgagaaattttctgctagctgcttcttttctatttttcatagaaggggatgtttctctgttgttcttgttgtttggcaggggggccaagtgactggtccttggattgctaagaaagccagattatttgctaattcagggcaaacaaggggcaaagatgatattggaggaagggggtatgagtttgcatctgcatcaacagtgaaagatcttgaagattggaaatctcaaactcaacaagagatgattctaagctcatcatttctcatgcatgtccgtctatctcaagttgtgattaatctgaatgattctcaatataaaggcatacatcaccttctacatcagatgctgaatgcattggcatgtgtgacttctaaggaagccaatattgagaaggaatcttctgtctcacaatcatcagtatttttggaatgtgattctctagaaattcttattagtagggatacatatgtgagtatcgaaagttcaatcaagagtgaacttcctggaatgtggaatcaattcaggctcaaggttcaaaagtttgagttgctgtctgtcactaatactggtggtgttaaggctgcgagtttttttcgattaactcacggtgaaggcaagctgtgggggtttgtcactggagttcctgatcatgagtttcttctgattacttgtagcaactcctctgtgaaacgaggtgatggaggaggttctaatgcattatcttccaaatgtgctggttctgatgtcatttatttctctgacccagagatttcccatagtgttatatctataactgtcagttgtggtacggttttagctgtaggtggtcgtttggattggtttgatgcaatattatcctttttcagctttcctgcttctaataccaaagatgcaggtgatactagcatttcaaagaaggaacataatatctcttacacgacttattttgttctctgcttgattgatattgctttgagctatgagccttttatgaagaatcttgtagttcagagtgaacttagttcattgtctggctgttcttctactaaagaagatatgagtgaacaatgtgtttcctgtttgttggctgcatccagcttaaccctttcaaattcatcttcggcagatacagttgaaagtgttttccaaatcagagtgcatgacctggggcttcttcttcatttaatgtcagaactgaattctttgtctggcatttatagtgttgaacatcttcaaaagactggttacattaaagttgctcaggaggcttttatggaggctattttgaaaacaaactgtgctagtggtcttctttgggaactagaattatctaaatctcacctttctgtggaaacttgctatgacacaactgcaactctgattcgtttggctgctcaacttcagcaattatttgcccctgatgtggaggaatctattgtgcatttgcagaataggtgggataatgctcaacaggcacagcaaaggaatgaatttaaaaatgaaaataagaatctcagatttgattcgatgtctgcaacttctgaacagtgctcccctcaaacattttcaacggatggatctagtatagctggcttgatggatgaaatatgcgaagatgcatttcaactaaataacaataatacacaccaatcttatccttttgaatcagggttttgcatgccacttgatggaagcttaattgaggttggtcagatgaatttggatgagcctgaagttctctctcaagaattgacttggactgagtcagtgcctgtgataggaccagaaggtagtcacacttcatttctgcaagaaggttgctttccagagattatagaaagctattgtttatctgacttaagccctctgtcagagctatctttaagtatacattctgatgagctttctggacacaaactgaggaatgtggaacatagagagatcgaaagaggaagtggtggatggtatggaagcacctctctaaaagtattagaaaatcacattttggaggaaagcaaacaagccggtgtaataaaggctgtagatcatcatgtcatgctttcatctgatggtagttcatcacatggtgagacttgtggacgtgtaattcttaagaaaattgatataagatggagaatgtatggaggttctgactggctcgactcagagaaaagtggacagcattctgggagagacacatctgtttgcatggaacttgcattgtctgggatgaaatttcagtatgatgtatttccagttggtggactacgtgtatctaagatgtcggtgtctgttcaagatctttttctgtatgacagaagccaagatgcaccttggaaactggtattaggatattatcattcaaaaggccatcctagggaatcttattcgagagcatttaaattggacttggaggcagtgagaccagatcctcttactccccttgaggagtacagtccccatcatgtagatctagcggcattaagacatggaaagtatgtagaacttgtaaatcttgttccttggaagggggttgagcttaacctgaaacatgttcatgcttctggcatctatggttgggccagtgtttgtgaaactactgtaggggagtggttggaagatatatctcaaaatcagattcataaaatactgcgggggcttcctactgtacggtcattgattgcagttggggctggtgctgctaagctggtttcatcaccagtacagagctacaaaaaggagcggagagtgctcaagggcgtgcagagaggtaggttagattga

SEQ ID NO: 96557 - DNA, 471 bp, Glycine max
  Peptide Sequence Number=SeqID_213335
atggtgatggctcagagattgagggtgattatggcggatcttgatattggcctatgtgagaagtttgtggatgtagtgtggtattgcatttctacctcctctacaaggttagggagacaaggtcctaagttatctcatcttatggctgcggatgattcaatcttgtttgtgaaagtgtttatggaccaagtaggggttttgaagtcatgtcttgacttcttttatgagagtttcggtgaaaaggatttgacaccccttgcaaattcgaagaaagagggattaaacctctggtctggcttgaaggaaaattggagtactattcaaaataacatgggatgtatgctgggagatgggtctcatatcttgttttggacaaatgattgggttcctgacataggtcccttattggacctagctactgatagtttggatgggcatgatctgagactcaatttttgctatcgtaattga

SEQ ID NO: 96558 - DNA, 258 bp, Glycine max
  Peptide Sequence Number=SeqID_213336
attcaaaacaagttgcctccaaaccaaaccatcagatccaaatcgaaaccaccaactcacaaattttcccaaattgaaatccccaactctcgattttgccctaaattaacatcaaaacccattgtgaaatttggggaagaaggagaagaagtcggggatgaaggtgttggagacaaagttggagtcgaagaagaggatttgggagtggtgggagttgtataccaggcatattccttggggttggagaggacttcgtag

SEQ ID NO: 96559 - DNA, 405 bp, Glycine max
  Peptide Sequence Number=SeqID_213337
atgactatggagaaagagtttagtggtctagggttttgtcatctccatgacttcaatctttccatgctaggaaagcaagggtggaaggtctccaccaatgaagatgctattgttactaaggtgtttaaagttaaatatttttctaatcggagtttcttggatgtcccccttaggcataatccaatgaatatttggagccagccttggattcaaaacaatcccaattactatatcacaattgcacctcctcttggtctggaacaactcactgttggagctcttattaaccatgaaaactcaaattggagatgggaaatgttgaaccagtttttcaatgatcacaatgtgaaagccatccaatccattcctttgctaaatggctcgaacaaggatcaacaattctag

SEQ ID NO: 96560 - DNA, 337 bp, Glycine max
  Peptide Sequence Number=SeqID_213338
tgatgccctccagcaacagctggtgcaatggcgggccgattgcttcgccgcagacgcgggtaaaccggtggcggcggcgaatctgcacctgacgctggcgtttcttggtgaggccagcacggaaacggcggatcagctgcagcagctggcggcacgcatccgccagcccggctttacgctggatctcgatgacgccgctggccaacctgctgcgcgcccaggccgcgcgtcatggctgtgcgcagagtacgcagccgttccatccccacatcaccctgctgcgccacgctgcgcaggccgtggcgctgccgccgcgcggttttcactggcgcgttga

SEQ ID NO: 96561 - DNA, 433 bp, Glycine max
  Peptide Sequence Number=SeqID_213339
atgcagttcgatccgccgttacaatcagcccgcttaattacccgctataaacgtttcttagccgatgtcattacgccggaaggtgacacctttaccctgcactgcgccaataccggcgcgatgaccggctgcgccacgccaggcgacacggtgtggtactccaccacggccagcgcgacgcgcaaatatccgcacagctgggaaataacgcaaaccgcgcagggtcactggatttgcgtcaatactctgcgcgctaaccaactggtgcgcgaggcgctgctgcgcgacgcaattccggaattatccgcttatagccactgccaggctgaggtgaaatacggcacggaaaaaagccgaattgacttcctgttgcaagcggagggcaaagtcaactgctatattgaagtcaagtccgtcacccttttacaaaatg

SEQ ID NO: 96562 - DNA, 645 bp, Glycine max
  Peptide Sequence Number=SeqID_213340
atgaggaatacaataagaacacgcaggaaaagcaatgaaacaataacaggacaatttcgagagtgtccaattctctcccaagccttaacaaaattccagcctccctccctcacactccacctcccacttatatttcctctcttactctctctcccattaactcgtgcacacctcatgccactactgccaggtatgcaagttctaagggaagagttccccaaaggtattgacatcatctatgagtctgttggcggtgacatgttaaacttgtgcttgaatgctttggctgtccatggacgactcattgttattggcatgatttctcagtatcaaggagagaagggttggacgccatcaaaataccctggactattggagaagcttttagcaaagagccaaacagtgtctggctttttcctggtgcaatatggtcacttgtggcaagaacatcttgacgggctatttaatctttactctacgggaaagctaaaggttgctgttgatccaaagaaatttataggcctgcattctgctgcagacgctgtagagtatctccattcaggcaaaagtgttgggaagctcttgtgcaagcaatgttgtcgaatgtttctgaaattagctgcatcagctcaatgcggaagctga

SEQ ID NO: 96563 - DNA, 141 bp, Glycine max
  Peptide Sequence Number=SeqID_213341
atgaatcatataaggattacggataagtggtttttacgggatgggtacattagcttccgttatgctgattcagttggaagatgcggtgctgcaatgcagaaagtgtgttgctttataggagtcaaaggaatcacaaagtga

SEQ ID NO: 96564 - DNA, 448 bp, Glycine max
  Peptide Sequence Number=SeqID_213342
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcgggggcctcttccccgggcgtcgaacagtcaactcagaactggtacggacaaggggaatccgactgttttaattaaaacaaagcattgcgatggtccctgcggatgttga

SEQ ID NO: 96565 - DNA, 276 bp, Glycine max
  Peptide Sequence Number=SeqID_213343
atggtgggggatttggacgcaccagagaagggaaaatcaatgattgtaattgttggtggaatcaaaggagtggtcctaatcttcgagtctgagagtggtaaccgaggcactccgaccactgctgtaatgtttggtacatcatcagcccccccttcatcctacttctccatcacacgagagagaaagagaacagaaagcacaagtcgattagaaagtaaagtagccctaacaatactcttcctactcgcatgcaacccgggtccggtggcaaagtga

SEQ ID NO: 96566 - DNA, 1264 bp, Glycine max
  Peptide Sequence Number=SeqID_213344
ctgaaattcgctcgtttcggttactgggtcggtctccgagctatgcgtggagctgagggtggtgatggtggcttcgccgtcagaggcggtaacatctactgggggagaaaagaggaaactgatttcagaggaatcgttgtaatcttcgcttgggtttctgttccgcagaaccttttccgtgatgaaagtgccatgccattggcattttgtgttcttgatgaacttattgaggagctgagaactaggtcatgccctgttgtatttgctactttttctgctgggtcaaaagcctgtctgtacagggtatttcagcctaactatcaattacttaggaactgtctttctggacacatatatgattctggtccaatagatattacaagtgattttggcttccgctttgcactacgaccctccattgcaaaagtgcctggaccatcaaaacttgtttcttgggtagcaaaatctgttacctctggtttggatgcgttatacctgactagatttgaatcccaagctgctgaacattggcaggctttatattcttctgttaattttggagctccatttctcattttatgttctgagaatgatgaccttgtacgataccgaagtatctatgattttgcccaacaactacgcaatctcaatggtgatgtcaaccttgtaaatttcagtagctcctcccaccttggtcattacaaacaccatccaattcaatatagagctgctgtgaaccaattattagagaaggcttcttcaatatattcacaaaaaatgttgcttgaacgagaaagaactggtatggatggtacacaggatgagatatctgagttgatctgtgacctacagaaggtggcaatcaattcaaataagagccttagaagagttgcagtcgggccaacagaccacttctttttgcctagttcagcagggcattacggtgatagagaatctgggactccacaagatgaacaaaaagaaaaatctgtttgtgtacctagcttcccaagcatcagtgctcatagtgtccttggccaatttctttttgatgtttgtgttccgaagaatgttgagggttgggatgtgaaatcttctgggaatctaaataggaagtcatgtgcttcagctccaaggcattcactattcagaggtactaagcgcatcgttccatcccttctgattgccctcaggaaaaatcacacgactgttgtatcagaaaggagagcttctgatagttcaaactggttgatgcctggctatg

SEQ ID NO: 96567 - DNA, 891 bp, Glycine max
  Peptide Sequence Number=SeqID_213345
atgtcgtttagtggccactgtagctggagaaggacgaaggggagggagacaagagggacccaccttctgattaataaattaaatctgaaccgtccaaggatcgattcactgcgctcagtaaatattctctgcgatcaccctctttttaagctccctctacctctctccctaagcctaccccatctcaaaatagaaaaaagaaactctcccacaatacaaacacagacacagagaaagaaaagaataatgggtgagtgtaaacgctgctgctctctcacagttctggccatggaagaaccttcttcaagccaacattccattttcaaaaaaagaaaaaccaccgctactgctgctcattccacttccttccagttatgctcttccgatatgcagtttccccacactatcgtctcgccggaagtttcatttagttccgcctgcacggttgtttccggcgagttttgctccgatcgctcctgctgcagctccagccacgttaaggacctccactccgtgccgtcagatctgcagaccaagggtttcgaaacggtagaagactcaaccagcctcaatttcaaatcgttcagtttgttgagtgagttttccggagactcggaggaatcggcgatgattccggcgaagtcttccgcggcggtgctgaaagtgaagacgccgccgaaggcggagatcgaagagtttttcgcgatggctgaaaagtacgagcaaaaacggttcacagagaagtacaactttgatattgttagagatttgccgttggagggtcgctaccagtggccattggagtacactggtgaggaagctaacctgacacgaggtaaaacgaaaacgagcatgcaacttttgttggttgctctgaaaagacggtgctag

SEQ ID NO: 96568 - DNA, 279 bp, Glycine max
  Peptide Sequence Number=SeqID_213346
atggcagtgacatgtcgcaaaatgcagtgtcgtgacaaggagacggcggtgtcgcaaaatgctagtgagggagaaaggaaatttggaaaagaccgttgctgtgagtacttgatcaagatatcactcatcccaacttgtgcaggtttctctgagaaagctttgaaatcagctttaatttcaagaagtgtggcagcttatcttttggaacaggtttattactggcagaaagtagatggactcaaacggaaaaaattcatggtggtaaatatgggtaggtaa

SEQ ID NO: 96569 - DNA, 108 bp, Glycine max
  Peptide Sequence Number=SeqID_213347
atgattcagcagcctcgtgttccatcatctgggctgatgcctgccagtgatgttcttattcctgcaaaatgcaaaggaggtgatcatatacaggaacaatcttgttaa

SEQ ID NO: 96570 - DNA, 831 bp, Glycine max
  Peptide Sequence Number=SeqID_213348
aaacccggcgaaggatgcgcgaccggtaaagccggtgttcagattcaagagccgaagccggaggtgatcaggcagaccgtggtactaccaccggccggtccggtaactgagaaggtcagcatcgcagttcaagttcctaacgacaatgaagcaaccgggaatgagaatataaccggcggtaccggtggcggtggtgcagggaaaaagaagaaaaagaaggcgagcgtgaaagggagtactaataacaacgccaacgaaggtgctggtgctgctactgttactgttgaacacgctaaagcaaacgatggttccggaccttcttccggtaaccagtcacatggtcaaggtcatgtacatgttcatgggtcatggcttccattttcaagcccagccaatgagagtccaccacgtcatcataacatttaccgtcagtacccaccgcattactatgctcctcctcctcctcctcctcctcctactacccctgctgttcatacggtcatgagttatcacacggcgcatcctagcagcagctacggtacagcgtattacacctctccgcaaccgtattcgtacgcccacgtggtgcgtccagggaacgaaatggagcctccaccaccgtacacgtacgaaagggaatcgtatgcttcatcgcagccgtcggattccttcgagctcttcagcgatgaaaatccaaatgcgtgctcggtcatggatcatatgcttcttaggcatcgagtggtagaaggttattggtttatagcctttataggtggcgtgatgtgggccaaacggaacaactttctcaaaaagagacgtgacatgtcttaa

SEQ ID NO: 96571 - DNA, 201 bp, Glycine max
  Peptide Sequence Number=SeqID_213349
atggccgcaacagaaacaataatagcggaacctcacgaagccgaagaacaacaacaacaacaccacgtatacgtagaagcagaacctctctcatacaagaccgtcgtgttgagagtctccatccactgccaaggctgcaaaaggaaagtccagaaaattcttcaagccgttcacggtaacgtaaccatctccaaaacctaa

SEQ ID NO: 96572 - DNA, 2760 bp, Glycine max
  Peptide Sequence Number=SeqID_213350
atggggtgtggtggttctgagcatgttaccatgatctttatcatcaccatcttgatcctcctatcatcacaaagcaccaacattttgactgtggctggttctgtattcaatgcagttggaaacttccaggttcatggcctaccagagatgtatttcattgaagagaatgatgaaaagctggttaagaaaatctcaggaatagatgagaatgaaaagaagcaagccttaatagtggagaagtttagatccttgcttggactcaagagtttccacaccaaagtaccattcaacggtgatttggagtttctctctccctcaccttctccatcacctatcattgaagaaactcaggctccagctccttctccttctcctcttccacacgtgcaccatcattcacaccatccaccacatcataagaatccatcacttcaccaaactcatcatgaagatagaggcagggctaagagaatactaatagctgttcttgtatctgctggagttgctatattgattggtgcttgtgggctattcttggtgtggaggaaattctcaaatcatacaaagaaaaccaaaaggacaatgccactatataatagcaagagcaaaggaagtggaggtgtttatcaaagttcatcaagcaaggtaagtttaaactctgaactagatctgttttatcttaatgctttaggtgaggacatagagcaacactcttgcagcttcaaaaagactcgcgaggatggtttagaatatgatattgttagcggttcttccatgaaggatattgcatctgttcatgaagatgaggaagcagttaaaggtgaaggtgaaggtgaatctgatggcggcaactcttcttctggggataaaattatccctaaagattgtcattcatcagacaatgaaagttttcattcctttgttaatgattcacactcaaatagtaatagactctccaatgcttccgcttgtagtcttagtgacacaaactctctgtcccgtcaaaattcaagttcattaccaaacccacaatttcctagttctcaacataacttaatgtcaaatatacaacctcaccaatcaccaaatagtgcaaaacatgatcaagagaaagagattgaaacctctctccaatgtccaaagacattcacttcccctccacctcctccaccaccaccaccacctccaccattgcgaatgccattattttctttgcattctctcacttcttcatctagactctcctctcactccccactttccttgacatctaataatttatcatccctggtaaattcagacacttcctcgtgttcaaatcaaagtccagaaaaggagttgccttctccaaatagaccttaccctacacaatctcctcccaacattcccccaccaccatgtccacctccatttcttaagggcaatagtgtcaaaaccccacctcctccaccttctcaactccctcaatttacccctcttggtaaagatggtgcaccattgccaaaactcaaaccacttcactgggacaaagtcagagctgcaccaaatcgcacaatggtttgggacaagctacggtcgagttcattcgagttggacgaggaaatgatcgagtctctatttggttacaatttgcaaaattcaattaagaatgacgaagcaaagagtaaaaccccgtctccaggcaagcatgtacttgagccaaaacgcctgcagaacataactatactctccaaagctctgaatgcaacagctgagcatgtctgcgaggccttaatgcaagggaaggggttgtctttgccccaactagaggcactagtgaaaatggtacccaccaaggaggaagagtccaagctcttcaattataaaggtgacatcaatgaattggggtccgccgaaaggttcgtgagggcaatgctcgatgtgccatttgcctttcaaagagtagaaggcatgcttttcagagaaacatttgacgatgaagtagttcacctcaggaactcattttcaatgcttgaggaagcatgcaaggaactaagatcaagcaggctcttcttgaagttactagaagcagtgctcaaaacgggaaaccgaatgaacgttggaacaaccagaggaggtgctagagcatttaaactcgatgcacttctcaagcttgcagatgttaagggaactgatgggaaaaccacgttgctccatttcgttgttcaggagattgttcgttctgaaggaataagagtttcagacagcattatggggaaaatcagccaaagaagtaagaacagaacggaggaagagaaggaagaagattacaaaaggatgggactagaacttgtttctggtctcagcactgagttatacaacgtgaaaaaaacagctaccattgacttggacgttcttgcaagctctgtgtcaaacctatcagaaggaatgaacaagctgcaacatctagtggataaggagttgcataaggacgagagaagcatgaactttgtgcagtgtatgaagtcattccttaactatgctgatggaaacttgaaggagttgcgtggagatgaagatatagtgttggcacgcgtgaaagaaattacggagtattttcatggggatgtgatcagcaaagaagatgcaaacccacttaggatatttgtgattgtgagagattttctggggagtttagataatgtgtgtaaagaacttagaaggtctaaagctccacgtagcctgaaccctcttgctattctccctttagatagatcctag

SEQ ID NO: 96573 - DNA, 405 bp, Glycine max
  Peptide Sequence Number=SeqID_213351
atggacttgggcaagatcgttttcgccataataggcttctccacgtccttcttattttgcgtgccgaacataaagaaatggcagaagaaacaagtggccggagagaaactaaaaatcgttagcgaggcattggaagctgcagaagaaagagcagtgagatttcaacaaagacatgacagaatactgagccaaatatgcgcgtcttacttgaccaatacagaggtggttgaagcattagcgggtgctcgagcaaccatgaaccaggcattggactttgcagttgaattgaggaaaattcagtttagaatcattgcttctttccccgatgcaatcgatgttctgttggatacgtcaaaacagactccaacaaatatacggatcttaggcccttcgagaggtgcttga

SEQ ID NO: 96574 - DNA, 1320 bp, Glycine max
  Peptide Sequence Number=SeqID_213352
atgtcttgcacaaaagccatgcacctttttgttaaaatatcgaaggaggaagaaaatcctggtaggtattcaagagcatctaactctgctgtagaccctgttgttgatgtgctaatgaatcacaattccaaagttgatccaatcattgagaatggaaacacgtatccagagataaaaaccatttccactgagaatggaagtcaagttagaactcaagataaagatgttgttattgaaagctttggttcaattggagtctatgaccaatggattacacctccagtacctggtcaacgtccaaaagccagatttgaggttgttgaatctgctgactcatccttagtaacattcccttgtgctggacattccctgaatgaaaaaggaagcatgttaatgcttgatgctaaagaagtcttaattggtagtggggtgcctccttctccaaggtcggattatgttgcgactgttcatgtggagcaatacttgcttatcttcggtggggaaaaatcatcttcatctaatcatttatgtgaactacacagatggaatggtctcgaccaacacaattgggtgatagtaggggagaactggttcattgttggcggaggtgacaataagagtggggtctcggagactgttgtggtaacttctgttcaagggcgtgttcctattgctagtgagggctcgagtttggttgtaagctcatatgatggtgaagacacccttttatcatttagaggatacaatggacgttacaataatgaggtctatgtccttaaatcaagccacatatcaaccttgcaatcaaaactaatagaaaactccatcccaaatagtgtttatggtgtgcataatgccacaaatgctacccgaaatctggagtctgaaacaggccacaaatggattaaggaacttgccgtggacaatgttgattcaatagctgagaaagaagaattgaaatcatcgctccacaaggacaagttgcaaactcttcaactaaagcaagagctatcagaagctgaaactcgtaactctgacctttgcaaaggggctattatgttattggtacacattgaatataatgcatgggaactccaatcaatacatggtcaacttgcttctgaacagtcaaagtgtttcaaacttgaggttgttgaattaagtcagaagctccaaacaattgggacgctacaaaaagaacttgaactcctccagcgacaaaaaaatgcatctgagcaggctgccttgaatgcaaagcaaaagcagggttcaggtggtgtatggggttcaagtgatcgcgtgattgaactaaccggatag

SEQ ID NO: 96575 - DNA, 228 bp, Glycine max
  Peptide Sequence Number=SeqID_213353
atgtctactccagcgcgcgtcactcgtcgaagcgcttttgattcagtgaagccctccctcgcgtcatcaccctctgaggagtctaaaaacataaagatagcatctgcaagtgcctcaaatcttgggatacctccatcctctttgatgtcctttttggaaaagatgctggatagatattactttttttttctccccctaaataatgatattgtgaaaagagttggctag

SEQ ID NO: 96576 - DNA, 3138 bp, Glycine max
  Peptide Sequence Number=SeqID_213354
atgagtcaacatcacaacaaccacgccacgctcaccgtctcaaccggcgatgcaaaccccgacaaccggctccaaccggtcgatgctcccatttccacagcagaacatgttagggttagggtttcatcggaggacaacgcggcacccgcatccgaatcagcgagattctccaactccgaggtcaattcgctgctatcggagttcgacggttacgtggcagccggcggagcgtcgaggaacgtagggcacggcttcgaaatcggtgacatggtgtgggggaaggtgaaatcgcacccgtggtggccggggcacatatacaacgaagctttcgcgtcttccgcggtgcgaagaaccaagagggagggccacgtgttggtggcgttcttcggtgacagcagttacgggtggttcgagccgtcggagctcatcccatttgacgcgaatttcgcggagaaatcgcggcagataagttctagaaacttcctgaaggccgtggaggaggccgtggatgaggccagtagaagatgcggccttggattggtttgtaggtgtaggggccccgggaattttcgcccaaccgatgtggaagggtattattctgttcaggtgccggattatgagcctggagtgtattctaatgctcagatcagaagggcgatgagtgagtttggaactgtggagatgctttcttttgtgaagcaattggcgatgaatccacatggtggtgatccgagaagcattgatttcactaagaatagggccactgcgtttgcttttcgaagggcagtgtttgagcagtatgatgagacttatgctcaggctttcggtgtgcagccgaggcgcccttcagattctatcggtaatcgccttgatcagcctgtgaggcttcctgctaaagctcctttgagtggtccaatggtgatagcggaaactttgggcggtgagaagaagagtgcaacaaaatctgttaaagctaaggacaattccaagacggacaagtatctttttatgcgtcgagatgaacccagtaacaccttccagttatcttccagggagacatcggatgcagctgggagttatgtgcttcagaagaggcctttagcagtgtcggccgtgcctgaggctttggagaagcatgaagacacagggattatgagccaagatattgcagcttcaactgtaaaagccgaaatagctgttgcagaccaggttcaatcagatggcattggtcatgcatccccagaaatgaccaggagtattgaaccagttgaagttgctagtaaaagcatgggtaggcctcatttgtctggggagatggcattgccaaacatagttaatgagacatctcagtctaccaatatggagagcaaaacttatattgatgtaaaaaatgatggaaatttaacaccatcaggaccacatgaagattttcagcaaatagagcagggattcctggctacatctgatgaggttaagcaagttaagcatcacaaacttaatgttgatggtgtgccaaagaagataaaagttcataagcggcctgcaaatgacttaaagtctgagacttctggtattgaggggaaaaagaagaaaaaaatgaaaaagggtttgaatttacaacctacctcaggccatctggagaagatttctacttctgaaaaagctgtacagctatcagggcaatctgaaaaatctgaaccaatgcaggtggatgcttctaccagtaatttgatgcccatggattccatggcagaagttaatattgagttgccccatcttttgggtgatttgcaagctcttgctttggatccttttcatggtgttaaaagagggatccctgcagttactaggcagttctttttgcggttcaggtctcttatttatcagaaaagcttgcctgtatccccacccatagtaacagagaatgaagctgctgaagttcgtagacctccatccagtgttgggacatcagacggtcctgatgatcatgccagagcttcatcacttataaagcctgtaaagcacattgttcggcctgacgatcctaccaaagctgggcggaaaagggccctctctgatcgtcaagaagaaattactgaaaaaagatggaagaaaatcaagaatataaaggcactggctgcagagaagaaggcaggcggccagaaaacttctgaagcccgtcaaggagatggaaaagaatccatggcccaggctccacccaaggtagtgaaaccagaattgaccaggaaagtggagcgtccagccaaggcggttgaacccaccatactggtgatcaagttccccctagaaacatcactaccatctgttgcagagctgaaagcaaggtttgctcgttttgggccaatagaccaatcaggtctccgcgtgttttggaagacctcaacatgtcgagttgttttcttgcacaaggtagatgcacaatctgcatataaatatgctctagcaaaccaatccttatttggcaacgttggtgtgaagtgcttcctccgggaatttggtgatgcttcatctgaagtctctgaagctgcaaaggctaggggagacaatggtgccaatgaatcacctcgggtcaagaatcctgccgtggttcaacgccagtcatcagcccagcaacctcttcctcagccaacgatccagctcaaatctatactgaagaaatctactgcggatgagccaggccagttaaccggtaatggaggtagtagtaaggggactccacgtgtgaaattcatgttaggtggggaagaaagtagtaggggagagcaattaatggtgggtaataggaacagcttcaacagtgttagttttgctgatggtggtgcaccttcttctgttgctatggattttaatagtaagaacgttcaaaaggctatttctcaaccaccgttgcctaatactcctccccctcctactcagtttacgaaaatcctacaacataatttgcataattccgaaatggcacccagaaatacacccaattttataaacgcgactacatcagctactgcacccaccgttgatatatcacagcagatgataagccttctgacaaggtgcaacgatattgtgaataacttgacaagtttattaggttacgtgccctatcatccactttga

SEQ ID NO: 96577 - DNA, 447 bp, Glycine max
  Peptide Sequence Number=SeqID_213355
atgggaaagttgttctatggaaagcctcgcccagaaagaggtgacaagaagtctctcaacaccttcttcaggataataaacttgacctacttgtgtaggatgatccacagtgtgttgttgaacatagttatgcctggagtaggctcaagggactacgtggaaatcctagaaacacctacccctttaccttcaccttccttagcccttccttctcaaccaacacctaaatctgcttcaccccatcctagaaaggctaaagttagtaccattactaaggccaagcaacactttgttgaaaatgctaagagaaaggcaaaagcagaaaaggccatgaagaaggtaaaggcagaagtagcaaagaaggtcgttacccttaaaggatgggcttcaaaggagattcatcaagaagctattatagaatttctgaagacatctgtcataccctaa

SEQ ID NO: 96578 - DNA, 228 bp, Glycine max
  Peptide Sequence Number=SeqID_213356
atggctacaccacccagctctcctcctcctcctcctcctactggtgcagcatcacagtcgccctctagcttgaagcggacaagaaaagccacacgcctaagaccattgatgactagactagttggggcagagagactcttagtccatgtggatcttgcgaccaggaaagccgacgatccccacagaaagaagttaagaacatatttggggatcttcacttgtgataag

SEQ ID NO: 96579 - DNA, 204 bp, Glycine max
  Peptide Sequence Number=SeqID_213357
atggtggaaaaaatggatggtaaagttgatgatgaagatattcaagaagtattacgtgaggcagctttgataccagatattaatagacaacaatgggctaaagctattaaatggttagctgacgatccaaagcagttagctattgtgaaagcccttccaattcaccaaaagacagattatgttttaacacatcttggagaatga

SEQ ID NO: 96580 - DNA, 387 bp, Glycine max
  Peptide Sequence Number=SeqID_213358
atgataaggtcctccagcagcttcagtggacaccaaccactggcactcaaatatcttaacatcccaacaaagtcaaactttccattcataaatttgactagctattccttccttccatctcttccccttaaagctcataaccatcttccaattccttctcagaaacttgcaaaacccttaaactctacaccaccctcatcgaccatggcttcaaccaccacagacgacagcgaagaagtaacctacgacctctcccctatcctcaaagtctacaaaagcggtcgcatagagaggctagccggcaccgcggttcttcctccgggcctcgaccccgaaaccaacgtgaaatcgaaagacatcgtaatctccgaagaacacagaatatcg

SEQ ID NO: 96581 - DNA, 468 bp, Glycine max
  Peptide Sequence Number=SeqID_213359
atgaaacaaaacctccccccacacttattcccaaaacaattccaaagctccaaaaatttccttaagggtaaggtgatatcatggttttcactcaaggcttgtagtaagcttcaaaacaaggaaagggaaacacgactcaaaagggctatcaaaggaattaattcaaggaagcatcaagaagaatcaagccaaggcaattgtgcaagcaatcaatggggcaaaacacaccaaactattattatgatggatggctcaaattctcacaaagttatatcaccaaactccatagatagtgtgcctgcatatacaactatcttagttctagaagttttcataacaggtttgcctagaatgatgggaactgatcctctagaaaatccctcccccatattccaaatataccaattgatagggaaaataagttcgccaactctaactaagacatcctctatgaaacccacaggatag

SEQ ID NO: 96582 - DNA, 828 bp, Glycine max
  Peptide Sequence Number=SeqID_213360
atgtttcatggggagagtgcctgttcaccaaaaccagttataaactttgaaatgcctcagagtgttgcaggatatgtacatcgaattggacgtacaggaagagcatacaattctggtgcttctgtctctctggtttccacggatgaaatggatactttagaagaaataagatcttttgttggggatgatgaaaacaaaggcacaaattccattgctgagtttcccctcctcaccaagaatgcagttgaatctttacggtacagggctgaggatgttgcaaagagtgtgactagaattgctgtccgagagtcacgagcccaggatctgaggaatgaaattttgaactctgaaaagttgaaaacccacttcgaaactaatccaaaagacctagatctactgaagcatgacaaaattttgagcaagaatgccccacctcctcacctacgggatgtgcctgagtacctattagacaaaccaacgaaagaggcaagggaaatggtcaagcttgcaagggatgcaatgggaaataataatcgccgcaagggatccaagagaaaattaagaaaagaaggagaccctctgaaggctatctatgctacggcgtcatcaaaaagaccgcacaaagctaggaagactggtggaagcgatagcctaaatagcagtgataggcataaacacaaaaagaataagggtccaaatatcgtaaaacgaaaaacagtacaaatttcgctttcgtccatgtctcttgtctcgcatggcatgtggcatgcggaagatcatattggtgacactagaatgtcttcccattccaagattgttgtggcttag

SEQ ID NO: 96583 - DNA, 1605 bp, Glycine max
  Peptide Sequence Number=SeqID_213361
atgtcaaacatcacaagttgtgatagtgggagcttctctacagagaataccagagaagatgcagcagttaaacaacagcaatctgagatgcttggtcagttccacagtccacattctcacacttcaactacaacaacaaataatagcaatggttccaacacaaattcacaaccacctgcacctgttaagaagaaaaggagcctaccaggaaatccagatccaagtgctgaagttattgctctatcaccgaccacactaatggccacaaacaggttcatatgtgaaatctgcaacaaagggtttcaaagagaccagaaccttcagttgcaccggcgaggccacaacttgccgtggaagctgaagcagagaacaagcacggaaattcgaaagagggtttacgtgtgtccagaaccttcgtgcgtccaccacaacccagcaagagcactcggagatctcactggcatcaaaaagcacttctgcagaaagcacggcgagaagaagtggaaatgtgataagtgctcaaagaaatacgctgttcaatctgactggaaagcccactcaaaaatatgtggtacaagggaatacaagtgtgactgtggtaccatcttttccagaagagacagcttcattacgcacagagctttctgtgacgcactagctgaggagaacaacaaagccaacgaaggacaattgccaaagataggtccaaacttgcaatgtcaacaaatcccaaacctcgtttcatcattaccaatcaacaccaacagcattgttcccaaccctgcacaaatgggtggcaccacctcggagttcaaccatgctgatcacaagcacccactatcactcccacacgagctcatgccaatgcctgcacaaaaacccttcaacaacaacatggctgcaggaacagtgttcacgagaagcctgtcatcaacctcttctccctctcttcaactaagctcaaacatgttcgatgaaaacgggctccaccttgctgcagggtcgccacacatgtcagccactgcgttgttgcaaaaagctgcgcaaatgggagcaacactgaccgaaaaaagtacttttgcaacaaacatggcaccaccatcgtttggtgtgctgcaacagcatcatcatcatcaacaaccaaatgggcaacccttcacgaaccagtacatgcacagtggccaccaccaccaacaacaagaggttaacatttctactcagtatagtttcggtagtgcaaatgggatgggtggagggagcgttgggatgaacggtgtggacatgttcaacgctattttggaccaaagcaaggctttgtcgaagatcatagagcaaaacaacaatagaagcagtagtggaggaacaacaaatggaggttcgagtagtgctattaataacgttgctggaagtaaaggaagtggggatgttatgactcttgactttttgggaataggaggtggaggaagtggtagtggtgggggtgcacatggaaatttctatggtggtgctcaacaaggggaaactggtgcaccggatgaggtttggagaaactggtctagtaagaacgcaggctttgaatcattttcaacaacgagcagcatttga

SEQ ID NO: 96584 - DNA, 312 bp, Glycine max
  Peptide Sequence Number=SeqID_213362
atggtgtggaaggctcaaaacaatctaaagatcctagatagtcttcccaaggtgtgtgaaccaagtagcacagtcatccaagaaggtcatgatatgaaaaccttgatgttggacaagttgttgggagttcataaggttcatgaggtgcatcttcaaaaacgggacaagctcaaaatgaaggatcccctagccctaaagataggagaatccagtctaaagaaacatgagaagatatgggtctacactgttgcactggctggtgctgcgaaactcgaccacactgtcgacgactcaatgcgtcttcctctttag

SEQ ID NO: 96585 - DNA, 2108 bp, Glycine max
  Peptide Sequence Number=SeqID_213363
atcctcccgctgatgtaaacgcttctgaatcatctactcctgaaactcctgctacccctgtcgtcacaccgcttcctgcagaaaccaagaaagctgacgaagaagcaaagaagaaatatgaaaaggacaacaaaactgctagaggtcatctgctaactcatatggcagataatctgtttgatcttttcattaatcaaaagtctgcgaaaacaatatgggatactctgctgaaacgttacggcgatgacgatgctggaagaaagaaatatgtggcaggaaattggctgcgtttccaaatgatggatgacaaaccaatcatggagcagattcatgagtatgagaatctagttggtgatatactaaatgaaggaatgaagatgtgtgagatattacaggctaatgtgcttctagaaaaatttccaccttcgtggagtgactaccgcaaccaactgaaacacaagaagagggacttgtcacttcaagaattaataaatcatatgaagacagaggaggcaaaccgacttaaagataagcataaaaaaggacaaaagaaaacacacactaatatcaacaaaggtgataacaagattcagaaaagaaagggtgagtgctatgtttgtggcaaaacaggtcataaagcttatgagtgcaaactgaggaagggacaacaatctaacaactcgaaacctgctgcaccacatgctcctcaagcacatctagcagaaaatgaagaagtgatagctgctgtggtagtggaggcaaacatggtcgacaacaaggtggactggattctagataccggtgcttctaaacacttatgcgccaacaaagagctttttcaccagattgaggatactgatgacggaaaatgtgttttcatgggaaattcagctacagctggagtgcttggtaaaggaaagattctccttaaacttacttctggaaaaacattatctttgagtgatgtcttagttccccataaacgactagataaaactccctatgaattatggaaaggatttgcgccaaatttaaattttttaaaagtatggggatgtcttgctaaggtagctctaccagatttcaagaggactaatgtagtgcctttacatttgcatacttcttcctttgtaacaaatgaacaagttaatgaacctagaagaagtaaaaggaagagaataaaaagtagttttggaccagattttgttactgccttcgtggttgaaaacaatgatgtcgataaaataaatgatgtttttgtatctacttttctcattgaggaagatcctaaaacttataatgaggctgtaacttccattgatgccaatttttggaaagagacaattaatagtgaattagattctatcatgtataatcatacttgggatttagttgacttacctaaaggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttagctgctattcatggacttatagtgtatcaaatggatgtaaagacagcttttcttaatggtgacttgagagaggaaatttatgtggaacaacctgagggctatgtgattcaaggtcaagagaacaaagtgtggagtgttatgtttctcatgaattgtactagacctgacatagcatatgctgtgagtagactaagcagatatactcacaatccaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcaaatccattcactaaaggtctaacaaagaaagttgtacttgaatcgtcgagggggatggggcttaagcctttgtgttga

SEQ ID NO: 96586 - DNA, 255 bp, Glycine max
  Peptide Sequence Number=SeqID_213364
atgagtacaaagaagaacaaagagtgcccaaaaaacaaagctgataagccctatgagaaagatgctttggtaccagtggaatggttaccttcacttgcagttgaacttcgttcaacacaacttagccaaaacacggcaatgagcgtgacagcggacacaatggtgagcgtgaggcgaacatgggggtcagagatgatggttagtgacgacactgaggaggttagagtcgcgatgagggtgggtttgcgagactaa

SEQ ID NO: 96587 - DNA, 589 bp, Glycine max
  Peptide Sequence Number=SeqID_213365
gatggcacttggagattttgcacagattacagggccttgaatgccatcacaatcaaagatagctttcttattcccactgttgatgaactacatgggccagtatatgtctcaaagcttgatttgagatctggttatcaccaaatagtagtaaatgaggaggacatgcataaaacaactttcaggacacatcaagggcattatgaatggcttgtcatgccatttgggctcactaatgcccctactacatttcagtctctcatgaatgaggtggattacttgggccacacagtatcaggcaagggagtaacaatggatcaagaaaaggttcaagcagtcttgaattggccatatcctacaaatctgaagcaattgagaggcttccttggtctaactggatactataggaaatttatcaaaggttatgcgtcaatcgcagctcctttatccaatctgttgaagaaggaaaactttcattggaatgaccacactttcatggcttttgacaatttgaaagccgcaattaccaaggcaccagtactggcattgcctgatttttccaaagcctttacattggaaactgatgcctctg

SEQ ID NO: 96588 - DNA, 387 bp, Glycine max
  Peptide Sequence Number=SeqID_213366
atgacatgcggagacaaagtttggtcattccgcacccctttgccattcagacacagtcgtgtccgatggcgcgcagagacaaaatttggttattctgcaccctttgtcatccagaggcggtggcccgatgacatgcggagacaaaatttggtcattccgcacccctttgccattcagacacagtcgtgtccgatggcgcgcagagacaaaatttggtcattctgcaccctttgtcatccagaggcggcgggcccgatgacatgcggagacaaaatttggtcattccgcacccctttgccattcagacacagtcgtgtccgatggcgcgcagagacaaaatttggtcattctgcaccctttgtcatccagaggcggcgggcccgatga

SEQ ID NO: 96589 - DNA, 704 bp, Glycine max
  Peptide Sequence Number=SeqID_213367
accccggtggtgctggtggcgctgttgaccacggtgctgggcgcgggcgcgatgttcacgctgtacacctacgtggcgccgaccctggcggaactgaccggcgcatcacccaatttcgtgacggcgatgctggtgctgatcggcctgggcttcaccataggcaataccgcgggcggtcgcttcgccgaccgttcgctcgatggcagcctgatcgccttcctggtgctggtgatcgccgacctgctggccttcccctggctggcgcagaccccggtgggcgccgcgatcggcctcttgatcttcggtttcggcacgttcgccgtggtgccgccgctgcagatgcgggtgatgcgcgccgcgaccgacgcgcccggcctggcgtcgtcggtcaacgtgggcgccttcaacctgggcaacgcggtgggcgcggcggccggtggcggcgtgatctcggccgggctgggctacgccgcggtgccggtggccggcgcggtgatcgccgcggccggcctggggctggtgctgtggcaacgcgccgccaaccagcgccagcgcaagctggcggtgcaaggctgctgaacgtcagaactcgaacgtcgcgcccagttcgtacgtgcgccccggcgccagcagcacctggctggtggcgcggccgccgtagtaggcgtagagcttgtcggtcaggttgcgcacgcggaaagtga

SEQ ID NO: 96590 - DNA, 485 bp, Glycine max
  Peptide Sequence Number=SeqID_213368
atgacaggagaagagttggtcgataccagaccaagtccaaggccaaaggggcaagtacgagtaggtactgggcccatgatcgacaggtcatcgtcctacgtccggctcaagacgttaaagaagcgctaccaggagccactttgggccaaaacctcaatccttcaaccctaagcctcgacccaggcgagcttagcatgaagaaggaatctggaagtgcaccagaatcgaagcagtgtgctaagcgcgaggttagctcgctaagcgagccgtctatcacttgccaagctcaacgcaacattggcaccaagcccaaatccacttactcgttgatgcaagctccattggaacttgtaggcctaggatcttcttcatcaatggattcctttgcttcttggaagataaatggcagcggaatggagaaggaagagacagaggagacgccacttcaaggagaagatgagtctagaagaagctcaccaccatag

SEQ ID NO: 96591 - DNA, 288 bp, Glycine max
  Peptide Sequence Number=SeqID_213369
atgtcactaggtccaccaccgccttccccgttgccctctccagcaacaacctctcattgcttgtccatagaaaactctcatcaaatgcctcaaagtaaaccctacaacacctcaagcactcttcaaaccctttcacaaactcaaaccactcaaatcccatgtccaaatcagcctcctccactaagtgataacatggtgaggaaggaggagatcaagaagctgacgacagagctcgacagattaaggagcgacagtgcaaataagagtgggaagatcaaagagctatag

SEQ ID NO: 96592 - DNA, 285 bp, Glycine max
  Peptide Sequence Number=SeqID_213370
atggaaggttcccaacgagacactcactatcctaaggaaaaattgcctaaaattattacacacaaatggaagtttggtaacctattggaggctcccaacacacttccaatgaaaggcctttttgttacaaaacttgaaagcaatgaagtgcttcttagtccaatagctcttaaggtggttggccccttgcttctggactcaaattcttcaagggatggcaccaatcctccttccaacttcctatatggcaacccacaaacaaggaaacaaagagacaagcaataa

SEQ ID NO: 96593 - DNA, 420 bp, Glycine max
  Peptide Sequence Number=SeqID_213371
atgactatggtcgaagcattaaagcaagaaacaaaaagagcccgaaaggaagaatggagcaggaacaaatttcgaggggctctatggggtagtagcaatgagctcaagcttagaagggccgaaagggacaagtcaagggtggaaaacatggtgttggaggataaattgaaagcttgtcaacggtcgaagagaagtttgaccgaacagttaagcaaaacggaagagaatatgttgacaattattgatcagtataaggaaaaggtgaacctagctgctagtcatgggcagaggctggaggatgagcatgtgaaggtattgacacggggaagcctgagagagggtgatagaatcattgcacggggaagcatgagagagggtgatagaatcattgcgcggggaagctatgaaatggatggatag

SEQ ID NO: 96594 - DNA, 780 bp, Glycine max
  Peptide Sequence Number=SeqID_213372
tagcattccttggtaaaactaactttccaaatgtttgccttcgcaggaaatggccccgaggaagcttgcctcaaagaggtctaggaaggataaggcggccgaaggaactagttccgctccggagtatgatagtcaccgctttaggagtgctgtacatcaacagcgctttcgaggccatcaagggatggtcgtttctccgggatagacgcgtccagctcagagacgacgagtatactgatttccaggaggaaatagggcgccggcggtgggcatcactggttactcccatggccaagtttgatccagaaatagtccttgagttttatgccaatgcttggccaacagaggagggcggccaggaatgtgagtatggccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacaagggccctgggattccccgcactgatcacaggactctgccagtcgttcggagtccccgttgcaactaccaag

SEQ ID NO: 96595 - DNA, 453 bp, Glycine max
  Peptide Sequence Number=SeqID_213373
atgttaatccgcactgcaagtaaaaagctgtcgctgctggccgtcgcctgcggcgcgctggttctgtccgggtgcgtcaccgtaccggatgcgatcaaaggttccaccccttcgccggtgactcagctttcctcggtacaaaatgcacccaatctgtttaccggcgcggaagcccgcttcggcggcaccgtagtaaacgtcgccaacgagcaggggcgcacggtgctggagatcgcggcggtgccgctcgacagcggtgcgcggccgattctgggcgaaccgtcgcgcggccgcttgctggccacggtaaacggcttcctcgagcctgttgatttcaaaggccagttggtgaccgtcgtcggccccattaccggcctgaaagaggggcgtatcggcatgacgccgtatcgcttcgtgacgatgaacgtgaccggtttcaaacgctggcacctg

SEQ ID NO: 96596 - DNA, 1189 bp, Glycine max
  Peptide Sequence Number=SeqID_213374
cagctatgcaaaagataacggcgttttattttacaacaatgacgtctttatccgtgaagacaccccggcatttgcgctgctggaagtgcgccgggtgctgggacgcacgttcgtcccggtgaccctgacgccggaagcctttgacgagctgctggcgaaaatctggcagcagagcagcggcgtctctcagcagttggtggacgatatggacgcggatatcgatctgatggcgttaaccgaggagatcccggataacgaggatctgctcgacaacgacgaaaactcgccggtgatccgcctgatcaacgccattcttggcgaggcggtcaaagatggcgcgtcggatattcatatcgaaacctttgagcgcacgctgagcattcgttttcgcgtcgacggcgtgctgcgcccggtgctccagccagcgcgcaagctcgcgccgctgctggtgtcgcgcatcaaggtgatgtcaaaactggatatcgccgagaagcgtgtgccgcaggacgggcgcatggcgctgaaggtcggcgggcgggcgatcgacgtgcgggtgtcggtgatgccggccagccacggcgagcgcgtggtcatgcgcctgttggacaaacagggcgtgcggctcgaactgcccagcctgggtatggcgccggcgcaccagcaggcgttgctgcgcctgatccgccagccgcacggcattattttggtcaccgggccgaccggctccggcaagagcaccacgctctataccttgctgagccagatcaacgatgaacagcgcaacatcatgacgatcgaagatcccgtcgagtatgagttggccggcatcgcgcagactcaggtgaatcccaaggtggacatgaccttcgcacgcggcctgcgcgcgctgttgcggcaggatcccgacgtggtgctgatcggcgagatccgcgacggcgaaacggcgcagatcgcggtgcaggcctcattgaccgggcatttggtgctgtcgaccctgcataccaacacggcgatcggcgccgtgacccggctgcgggacatgggggtcgaaccgtttctgctttcgagttcgctcagtggcgtgttggcgcagcgcctggtgcgtcggctttgtccgcagtgccgcgagccttatgcgctgtctgacgcgcagcggcgcctgctggggctgccaccgacgcagcggtga

SEQ ID NO: 96597 - DNA, 408 bp, Glycine max
  Peptide Sequence Number=SeqID_213375
atgccgcataattgcggtctcgtttgcagcgcagacttgtttttggggctcttagctcagctgggcccaccaaaaattccttttcagcctggattcatccaggctgattccttcggaatacccgagggggctcttagctcagctggcatccacgcagaaatacgtgggctcttagctcagctggtagagcagcggactcttaatccgttggtcgagtgttcgaatcactcagggcccaccaccaatacccagaacaaggcactcggcgcgacagcgctcagtgccttttcttgttgtattccatcagcacagacatattgctgctgccagccttggccacccactcccggccaaagcgctcccccaccaaatccagcatgcggcgcaggtccgccgatggcgcggtga

SEQ ID NO: 96598 - DNA, 609 bp, Glycine max
  Peptide Sequence Number=SeqID_213376
atggtggcgctgagccgggcccgcgtgccacccggtgcgcagccgcaaaaaaggcggccgaggccgcctttggggtgctggcgcgcagcgcgtttacatcagcagatgttcgcctgcgttgtcaccgcccaggatcacgtagttgaccttgcggatgtccatcagcttcttgccgccggagtagctgatcgagctttgcacgtcctgctccatctcgatcagggtgttggccagaaggcccttgaccggctcgaggatgcgcttgccctccacgtgcttgtactcgcccttgttgaagtccgaggccgagccgtagtactccttgaagcgttggccgttttcctcgacggtctggcccggcgattcctcgtggcccgcgaacagcgagccgatcatcaccatggtggcgccaaagcgcacgctcttggcgatgtcgccgtggctgcggatgccgccatcggcaatgatgggcttggtcgccacgcgcgcgcaccacttgagcgccgacaactgccagccacccgtgccaaagcccgtcttgagcttggtgatgcagaccttgccggggccgatgccgaccttggtggcgtcagcgccccagttctccag

SEQ ID NO: 96599 - DNA, 656 bp, Glycine max
  Peptide Sequence Number=SeqID_213377
tggacacttcaaaggccaaagataaagcctacaagctctctgacggcggcggtctttaccttctcgttaacaccaatggctcacgatactggcgcttaaagtaccgcgttgcgggaaaagaaaagctgctggcgctgggggtatatcctgatgtctctctggccgatgctagggcgaagcgtgatgaagcaaaacgcactttagctgctggtggtgatccgggtgaggttaaacagacggaaaagcaggctaagattctggcggtcagtaacagcttcgaagcactggcgattgaatggcatgagcataagcgccctaactggtcactgggctatgccagtgacatcctggagtacctgcaaaaagatgtgttcccgtttatcggtaaacgtgccatcgcagaaatcaaagcggcagagatgctgctggtgctcagaaagatggagcagcgtggcgttctggataaattgaagaaaacacgtcaggcttgccgccagattttcacctacgccgtcatcaccggcagggcagagcataaccctgttaccgatctcgccggcgcactaaaagcgccaaagcaaaagcatttccctcatcttctcaccgaacagattggcggcttccttcgcgcacttagtgaatacactggcagcaag

SEQ ID NO: 96600 - DNA, 297 bp, Glycine max
  Peptide Sequence Number=SeqID_213378
atgtctgaatggcgaaaaagtgagcggaatgaccataatttctccgcatgtcacatgaccccaggcatttcatttctaaatgaccatttagaggaaacactgggttcaacaaaaatagaagaaaatcactcaaagtgtatcaatctcacacagggtaaggtttatgatgagttgggactttggctcacggcttgtaggacggatggacatgatatatgtcagggtgttggtctggcccgtggtttagggataaaggggatgtcccacattatttccatgacacacatgcaacaatga

SEQ ID NO: 96601 - DNA, 407 bp, Glycine max
  Peptide Sequence Number=SeqID_213379
gtggctgcgacgtggaaaccaacatatcggcaatgatgatgtgaaagtttttcgtcgcaagttggatattatgaaacgtcatgagtttgtgtgggagccttacccatcaaccgttatatcattgttgcctcccgtttgtttagtcggaagtatcgcgtggcgaaagacaaagatgtttgttgacccagaaaatgcaaagacggctacattgggtgaagttgcggaggcattacaatacatggtgtctcctcaagggaggaaaacatgcacatttgatgatcttgtgccttatgtggaaaaaattacaattttatccgaagagcaagagagagtcactgagccagtgtcacatggtccagcatcagagcgtcaatttcccccacaacagtttcacatgcttcaatcaa

SEQ ID NO: 96602 - DNA, 699 bp, Glycine max
  Peptide Sequence Number=SeqID_213380
atgaccatcgacacccgtcccgcgccgaccgccgcaccccgccgtgccaccgccccgccgcccgtctcggcgagacgtcgccggcgtgcctccgacgtcttcgccggaggcggcgtgcacctcctgctgatcgtgatgggactcttctccgtcgtcccgatcctgatcgtgctgatgaactccttcaagacgacacaggggatcttcggtgcgcccttcgcgctcccggatgcggagaccttcaacgtgcagggttacatcaacgtgttcacgcgcgggaactttttgctgaactaccagaacagcctgatcgtcacgctcgccacgatcgtcctcaccatcgtgctgggcacgctcgccgcgtgggcgctcgtggagtacaaggtgccgatcacgccggtgcttgcgggcttcttcgtggtggggatcatgcttcccatccgtctcggcaccgtcccgctgatcaagatcatgacctcgtgggggttgatggacaccctcacggccctcatcctcgtgtacaccgcgatgcagctgccgctggcgatcgccctcatgaccacgtacttccgcgccgtgccgaacgagctcaaggaggcggcccgcatcgacggtgcaggggagtggcgcacgctcggcatcacgctgccgatcgtgcgagtcgggatcgccgcggtggcattcatcaccatgctcccg

SEQ ID NO: 96603 - DNA, 201 bp, Glycine max
  Peptide Sequence Number=SeqID_213381
agtccccggaaaacatgttcttcctattttttatgatggtgatccatctgaggttggaaaacaaacaggggattacgggaaagccttcaccaaacacgaagagagattcaaagatgatggagagaagatggaggaagtgaaaagatggagaagagctctcacacaagtagccaatctctctggttgggatatgatgaataa

SEQ ID NO: 96604 - DNA, 501 bp, Glycine max
  Peptide Sequence Number=SeqID_213382
atgacactgctgctcatcaatgtcttgcctagcgaccacaactccgacctccctccgcctaagtgccagttggtgtatgctatcctgacacggatgagcgttcacgtggcccagttgattgatgatgccatttatttgtttgcaagattggcgcctactaggcatcctttagacctagagaagtccaaaagggccctagggttttcggctctgatcagaggcctctgtcagtcctacggagttcctgtcacccccagcaaggtaattcgaccgccgatcacccgagccttcatcgggaagtactgcacgcctaggcaagtgcagggtgacgcacatcaggccacgggcgcatcgccaccacctcggcaggccgatccggctgggccactgggcgtggagcgttatctacaacatttggttcgccagcaggcagccaaccaccgtggacaggtgcagatacatgagtgtctttaccggttcagcctgagtcagcaggggtag

SEQ ID NO: 96605 - DNA, 960 bp, Glycine max
  Peptide Sequence Number=SeqID_213383
agggcgctgaccacccgtagggagtacgactgtcttggtcgactgcatcgccgggatgtatacactgtcaatgcccagcgcccgtcaccgcgacgccagatgttgggcggacagccaaccggcaagccggtcactacccggttcgtctgggaggggttccgcctgctgcaggaggtgaacggggacgtgccgctgacctacgtctacagcgatcaggacagttacgatccgctggcgcgtgtcgatggcgttgatgccccggagatcttctggttccactgccagcccaacggtacgccggagcggatgacggatatcgaagggcaggtgcgctgggaaggggtgaacagcgcctggggcaagctgctgcgggaaagtgagacgcaggtatcaggatattctcagaacctgcgcatgcaggggcaatacctggaccgtgagacagggctgcactacagtctgttccggtattacgacccggactgcgggcggtttacgcagcaggacccgatagggctggcgggggggataaacctttaccagtatgcgccgaatgcgctgggctggatcgatccgtggggattaacgaaatgtagtagtggaggacctaataaagaaactagttatgaaggagttagtcgaagagatgcattcaggcaggctaaacgtgatgcgggaattcctatgaatcagcaccctagaactatttccagaccagacctattagatggggaaggcaacaaaatacttaactcaaaaggtttgccgataaaaactcgacaatacgaatttagagattcaaataacaagcctgtttttatccaggaacatagtttgggacatgataaagcaacctctggtcatggtgctgaaccccatttcaatgttaggccgccgcaaaacttgaatacaggtagtgttccgggtactcatggtcattataattttgagggtttataa

SEQ ID NO: 96606 - DNA, 345 bp, Glycine max
  Peptide Sequence Number=SeqID_213384
atgactttacaattagctgaccgctccattacaaggccatatggagtaattgaagatgtgctggtcagagtaaaacattttatcttcccggcagactttgtggttatggatatctctgaagatactgacatccctgtaatattgggaaggccattcatgttgaccgcaagctgcatagttgataaggggaagaggaagctggagctaggttttgaagatcagaaaattgattttgatttgtttgttgaagataaacctgctccagaacacaatgtctgctcaagaggttctgaaagtaggaaccaaaacataagatcacccagtgaggtaaaaacgtcaagctaa

SEQ ID NO: 96607 - DNA, 327 bp, Glycine max
  Peptide Sequence Number=SeqID_213385
aaatcgctggctagaacccatagaacctcctatcgaagaaaagtcgaagaaaaccctacactgctgttggaactgtgtgtgtcgaaaaaaccctacactgctcttggaacagtcgtgggtgctcaaagctcaaagctttctacgctgccagttaacaagttgattgtgctttacgtggttttcaagcttgacgagagttacacgccgagcaaagtttccatccgtgccggtgatggttttcacaacttgaaggagattaagaccgtggaactcgtgaaggcaactgggtgggtttatctatccttgtctggagctgatcctaggtaa

SEQ ID NO: 96608 - DNA, 243 bp, Glycine max
  Peptide Sequence Number=SeqID_213386
acaggagattcaactgtgctgaagataggaaattcggctaaagttgtgataaaacaagacatgaagggaagaaggcataaatatgggtttaacaacaacaaacgtgagaaggcagagatgaaaagggtggtggatgatgaaactggcgacaaacatcagctggatgaacaccaagagcggctacgcaagaagcttgcacttgaggagggaaggatatttgcagctaatgaacaactttcttaa

SEQ ID NO: 96609 - DNA, 462 bp, Glycine max
  Peptide Sequence Number=SeqID_213387
atgatgagagagattagatttatggaagatgatgaaacaaaacagagaggaggaattatagtgaaacctgaatggaggatgaaggttaggtggagagggaaattgattttggagcttaacagttccagtgaaacccttctcttcttcatcttcttcatctccactaaagaaaaattgaagcattttcccacggaatactttccatcggtattttccgtcgataatcggaaaattttcatcgataataatgatttttcttctacaagtggagatgctactccaccatctccaaaaaccacaaggctcatggcagagatgattaaacctagtgatcaaatgagaagaatgagttatgacaatgaagaaaggatggagagaatgagaaaggagaatgaggagaatttaggaataatacatgggagtagtgaagctttaattgtgaggattgaaaatatagtgtga

SEQ ID NO: 96610 - DNA, 231 bp, Glycine max
  Peptide Sequence Number=SeqID_213388
atgaggggcatcgtgcatgagcctcaagtgaacataggggcagatcaaaagttctcacccgtcgatgtttttaaacacacaaaaaaggggggggacaaaccttggaatttctatggattgattaaacgtcaaacgactccattgccgtcactccaaaatggtcaagtgactaaatcaaacagaacaaacactctgagggagttcccggagagattagcaaagataggataa

SEQ ID NO: 96611 - DNA, 629 bp, Glycine max
  Peptide Sequence Number=SeqID_213389
atggcagaatcattgaagaagagaaagggaacatcctccaccaccgctgctactggccatcgccgccacggaccatctgaagcacccagagcacctattcatccttccttatcatctccacgatcctctactctattttcttcagatgatcaacgtctacagtacaactctcaattttcttctaggatcatcttagaccctaagtacctagacacagatttgtttaatgatgagacatttgactgttatcaagtgtttcaaaactctggattggttgattttatgtccttaaaattgtcttactatcctgaacttgttaaattcttttacatcaatttaaaaattcaggatggtattatttcgtctgaggtgcatggtatttctatgattattgatcaatctctgttcttttcattaactaaattacccagtcaaggtgcaccttttgagggcaccattgttgatgactggaaattcaactattctagtcatgatgctcgctgtatggtttttcatgaccgaattttgcttccccgttcttctaatttggctcaagcctctgaggagtatttgattttgatgtgggctttccttaccggtcgtcagattgactgggctcacttggttag

SEQ ID NO: 96612 - DNA, 1074 bp, Glycine max
  Peptide Sequence Number=SeqID_213390
gaagcactgcagcgttttgccgacgcgcatttctgcgtcatcggcatcggcggcgtcggttcctgggcggccgaagcgctggcgcgcaccggcatcggtaaaatcaccctgatcgacatggacgatgtgtgtattaccaataccaaccgccagattcatgcgctgcagggcaatgtcggccaggccaaaactgaagtgatggcgcagcgtattcacgctatcaatccggagtgtgaggtgatctgcatcgatgacttcatcacgccggacaataccgctgagctgatggcggcaggattcgactatgtgatcgacgcaattgacagcgtgcgccccaaggccgcgctgctcgcctggtgccggcgcaataagatcccgctgatcaccaccggcggcgcgggcgggcagatcgatccgacgcagattcagcaagggcaaactggggatcgactgcgtgttttctaccgaggcgctggtgtatccgcagccggacggcagcgtatgcgcttcgcgcagcaccgcggaaggcccaagcgcatggactgtgccgccggctttggtgcggccaccatggtgaccgccaccttcggttttgttgcggtgtcgcacgcgctgaaaaattcctcgcgcgcgcggcgcgtcagtctgcctgatgcgcgcgggcggcacgctgtaccgcctctgccagcgcctggccgcgggcgtttttccttccaccgctgtcagcagcaccgccagcaatccgcgcacaatgcgcccctcactgtcgccgtaaaaatgcagcgtgccgtcggcccgctgctggctgctgagccagacgcggttttcgcagccggagagctcaatgtccgccgttttcagcgcttccggcagcgccggcagctggcggctgagctgaatcagctggcgatagcgatcttcccactgatgaaaatgggcaaacttctccgtcaggctggcttcgacgcgcagcgtgccgctgacgccaagcgccgccatcagcggctgggcacagtgctggccggcgcgcagcgcgatgccctgttccgccagcagcgtcacgatatcgctgtg

SEQ ID NO: 96613 - DNA, 159 bp, Glycine max
  Peptide Sequence Number=SeqID_213391
atgggccaagcaataagtgggccaagggagttcatgaagaggcccaagaccaaggtggaaagtaaggaaatgaatggaggaaatagaattttactgtctaaattgttaaatgtcaatgagaatgacgtgtgtggatcaacggctataaaattgttctag

SEQ ID NO: 96614 - DNA, 336 bp, Glycine max
  Peptide Sequence Number=SeqID_213392
atggtagaaattgaacaacggaagctctcgagatattcaattggtcataacttttcactcggatgtccaattcaggctcataatatatcaagacgattgaaattaaacatggaagcacaatgcaatttcaaacggccaattgatgaggacatgaccaagagcaagggcaaggatccacttgaaggacttggaggacatatgacaaggcctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 96615 - DNA, 708 bp, Glycine max
  Peptide Sequence Number=SeqID_213393
atgctggccgcagcagaagccgtgcatgcaggcgatgtcatgaactttgaaatggccgcggaaatgttgccgtttgaacatgccacggtctatacctcagacgactgcgccgtaatcaacagcacctataccaccggcaggcgtggtgtcgctggcacggtgatcgttgaaaaatgcgtaggcagcctggcggaaaccggcgcagaactcgctgcctgcaaaacattgggggagaaaatcaaccagcgtacctccagcataggcgttgcactgaccagttgcaccgtgccagcggctggccgcccgaccttcgagattaccgatactgaactggagatgggcgtgggcatccatggcgaacccgggcgtcgccgcgagaccatgcgcgaagcagatgccattgtggcagacatggtggccgccattgtgcatgacttcgagaccaagcaattaccggctcagggcgagattctattactggtcaatggcctgggcgctacacccttgatggagctgtacctgatgtacaacacggccgccaagttactgcaagaaaagggattttccgttgcccgcagcctggtaggtaattacatcaccgccattgatatggcaggcgcctccatcacggcctgtttgctggatgacgacatcaggcaacactgggatagcccggtgcacacacctgccttacgccggggcgtctaa

SEQ ID NO: 96616 - DNA, 282 bp, Glycine max
  Peptide Sequence Number=SeqID_213394
atggggagcgattccaaaagatcattaggaactttttttcccatcgttttaaggtggttctatcaacttgcaggatcatgccatttgcttgatgaggtctttcagcaaactcatttacgaaaggatactggtcaatttgtcgatgatagatctagacggacacatgaagaatttgaggctagactatctcaagctaggtctaatgctacatcaagtgttggtgaatcccaagtcactcccttagaccctactgaagaacaaagacttaggagttggtgttga

SEQ ID NO: 96617 - DNA, 273 bp, Glycine max
  Peptide Sequence Number=SeqID_213395
atgccccaccacaatttagccgacttcgagccttgcctcagatatgccactgaaggccaagaagttggtggtataccactgcaaaacactttggagggccctcaatatcacccacaagcacacctcttgcatttcgcagcaggaaagttggatcatctagaggaaaggctcagggccattgaaggaggcatagattatgcctttactgacgtcgaagagttgttcctagtacccaaacatggtcattcccaagttcaaggtgccggactttga

SEQ ID NO: 96618 - DNA, 432 bp, Glycine max
  Peptide Sequence Number=SeqID_213396
atgttaatgtgtaatcatgaattttcatttgttggtccgattgagttattatgtagcattgctagaaccccagatggtattttaaacttacttcaagctactataacccctactcatgatgccctgctatattacaatgggaggtggaacatgtcacgccaaaatgagtttgttggttactcgttcacaggaaaaaatctcaaaaagtttgacattccctccggatttaccatggatgaactgaaggatttgatcaagcaagttgcgcctactgggattcccccttatggtattgatgaaacacaaatggtgttgattgagtctagctactggaaaaagattgagccaatagaaattttagttgttttcagtaaacctgtaccgaaaatggaagagacgagttgtccttgtcgcaaaattaacatgagttaa

SEQ ID NO: 96619 - DNA, 698 bp, Glycine max
  Peptide Sequence Number=SeqID_213397
atgctaaacttcgtcgctcgaacgacttatgacaacgacacctttatgacagcactggacgccgcacagcccaacaaattgcatcagcgtgtcaatctgggaacacgcctcgtttttctcatcgccggtttaagcatgtctgcgtgggcaccgctggtgccgtttgccagccagcgtctccagctgacgggcgcgtcgctgggcggcctgctgctgtgtctcggcattggttcactggcggcaatgccggtgaccggtgcgctggtggcacgctttggctgccgtcgcgtgatgctgtgctccacgctggtggtgctggcagtactgccgctgctggcaacgctggatgtgatgtggttgatggccgccacgctgatggtgttcggtgccgggctcggcatgctggatgtggccatgaatgtgcaggcggttgaggttgagaaagcggcggccaagccgatgatgtccggtttccacggtttcttcagccttggcggcagtcggcgttatcatgctgctgatggtgctgctgttgctgtgcagcctgccgacgctgatgacagagcgcctgcatcagcccgatcaaccctggctggtgatcccgcgcggctgggtcgccttcctcggttgcctgtgctttattctgttccttgcggaaggcgcggtactcgactggagcgccctgctgctgctgcaaa

SEQ ID NO: 96620 - DNA, 1134 bp, Glycine max
  Peptide Sequence Number=SeqID_213398
atgatttatatgattcttgctattaccgccggcactatccgtcgcgccggcgttaaggcattgcaccagtgtcgtgcatcctgcatcacttcagcgctggcgcagtgtaacaaagcggccacggggcacgtggcgctgagagcggtggcatggcatgaattgtgcagcgttgatagtgggttgaacatcagcgagacccagctcgctcaggcccggatgatcgtccgggcgtctgccagccggccagtaaaacagccgcgcttcagcgctgatcggcaaatcgttgatgcaggcgaagcgctgaatcatcagaccatcggcaccaaagtgccagttttcattgccgtagctgcggaaccagttgccgctgtcatcgcgccactcataggcaaaacgcaccgccagcttatcgtggtgccacgcccacaactctttaatcaaccgataatccagctcgcgggcccatttgcgctgcagaaatgtcacgacgtccgcgcggccgttaacgaattcgctgcgattgcgccagcggacaatcctgtctacccccgaaaacaggaattttttcttatgctcgcacccctgctgtttgatgccagcgccagcgcacgtgaccgcatcctgctcagcgcgcaacagctgttttatgcgcaaggcatccgtgctaccggcatcgataaagtgattgccgcggctggcgtaaccaaagtgaccttctaccgccacttcccggccaaaaatgacttaattctggcgtttctgcagcagcgtcatcagcgctggatgagcggctttcgcagcgcgctggcgcagcagcctgccatcaacgtggcgctgccggctgcgttactgagctggtttcaggaggaggatttccgcggctgtgcgtttattaatagcgcggcagaactggctgataccctgccggaagcgagcgcactgattcgccagcacaagcgtgagatggcggccgccattgccgaaagactcagcacagcgcagcaggataaaaccgggcagatcgtgttgctggtagatggcgcaatcgtgcaggttcagatgggggaagcggcgcagcaggtgacggcaacgctgcaggcggcgctgaacgcgctgctggagagcagagcgtga

SEQ ID NO: 96621 - DNA, 360 bp, Glycine max
  Peptide Sequence Number=SeqID_213399
atgctcgataatattgacgcaatcgagtttcatatgaaacaagcagcttacgaaactggtgcgacaatagttaattcttctttccaccggttcctcccctacggagtaagcggtgtggtagtaataagtgagtcacatcttacgatccacacatggccagagtacggttacgcagcggttgacttgttcacatgtggtgaccatgtcgacccatggaaagctttttcttacttaaagaagatattcaagtcgcaaagggcacatgtcgttgagcaccttagaggaaaatacgatgaagtcggaattcctgaaaacgcaccacataaagctgttgaagcagaaatggcagaaatattctaa

SEQ ID NO: 96622 - DNA, 393 bp, Glycine max
  Peptide Sequence Number=SeqID_213400
atggatcaaggaaaaggttcaagcagtcctgaattggccatatcctataaatctgaagcaattgagagcttcctccgtctgactggatactacagcaaacttatcaaagccgcaattaccaaggcaccagtactggcattgcctgatttttccaaagcctttacattggaaactgatgcctctggtattggcattagggctgtattgagtcaggaacaacacccaatagcttttttcactaagaagttcacacctaggatgcaaagacagtcagcttatattagggagtcctatgccatcacagaagcagttgcaaaattcagacattatttacatgggcatcgatttgtgatcaaaactgaccaaagaagcctcaagtcactcactgagtaa

SEQ ID NO: 96623 - DNA, 363 bp, Glycine max
  Peptide Sequence Number=SeqID_213401
atgattgagacaagtatgcgagcggggaatgtcgatgtgtatggattcctcgagccacagtccatacaaagatctaggccagacaactacctcaaaggaattattaataggtcaattctatttttcaatacatttttattagcattagtcgggaacatcagtattttaattgtacaatacgcatccatgtttgtattgaacaatgctttgaaaggacttgacgatacttcacaaagtaaatccaaggctgctgccaagtggattgttattaaaggtaatagacaaaaaggaagcactgagtgtgggtattacgtcatgcattggatgtcaactataatcttaggaagtttcaagaataattga

SEQ ID NO: 96624 - DNA, 186 bp, Glycine max
  Peptide Sequence Number=SeqID_213402
atgacaagtttgtcctatcttcttcttcacttctccctactctcacaattcaaagaacaaggcatcgttatcgtcaccgcaattcgtttccaccatcaatgtttcggcagaagcagtgccagttcaatcagaggcagatctggtgaagcatattcaatcttcaacatctttttttatcctagataa

SEQ ID NO: 96625 - DNA, 228 bp, Glycine max
  Peptide Sequence Number=SeqID_213403
atgccagcgatcctcatgaaacatacattgcttgcggcagcaagagaacttttcaggatagcccaattacgattgacaatgccgaccaagaagaaagtagacaaaaaaacatcaatgcaaatcaatagggaagaaaaggatccaagaggggaacagagaaatgcccctgccaataagtttgacaataattaccgccaatcggcaaagaactctgtggccatgttgtag

SEQ ID NO: 96626 - DNA, 513 bp, Glycine max
  Peptide Sequence Number=SeqID_213404
atggaagccattgagaggactgacgtaaggccttatcatttggagagggtgttaaggaaatttggccatcaacatatcattcctctagggaaagttgtgctacctgggggtccttgggcctacacctctaactatttgctttggctttataaggtttcccacccctatgtcattccatcggaggagggacaaccaccacatggtcctgtatggttaccgcccatcccaatacaaccattggcagactatgtaccagaaggagactactcttgtcagttactaattgtaattgttattacaatatcgattctggttggcatcaagagctatgtagagcttactagacctcaaagttgtgccagagggcataagtcatcattaggtcatacatcaagctttgtaattgttgtaggaggacttagtatatggatgcaactcggacacacagagacaacggaaagaattgtcaaggatggtggcaagggtggaaagaaaggtggcagatgtggttga

SEQ ID NO: 96627 - DNA, 387 bp, Glycine max
  Peptide Sequence Number=SeqID_213405
atgcaaaagctagagccagagatagcgacaaagttgcaactaaggccagctactaatagaataattggacctccatttggaggaggtctgattgatttgtcctttattcggtcttgcaagaaccattgtgttggtcatgtttggatctgtcaggagtggccaaagttgaagtttgtcagccacgatgctcaggttctagcactctttactcatctgctagttagggctcatgtggaccggttggggttatcaactcttgttacgatgcattatattgccgcaaacaagggcttggtgaatgcctatttggtgaggtggcaccaagagatatcttttttccacctgcctgtcgaagagatgaccatcattatggatgatgtgacttga

SEQ ID NO: 96628 - DNA, 153 bp, Glycine max
  Peptide Sequence Number=SeqID_213406
atgaactttgccggtgagggagaaggaaaggtcaagaatagggctctggttggttcggattccgatgtggttgagtcagatcagggtagaggaggaagaggaagggcacggagagtagacgatgacaacggttgtaacaacaggaatttatga

SEQ ID NO: 96629 - DNA, 3312 bp, Glycine max
  Peptide Sequence Number=SeqID_213407
atggcggatggaacgcgttctaaggcatcatcagagcgtttggaagatgcaattgccaagctcactacttcgcaacttgctatgaattcaaagattgattatcttctccaacgaatgtctcagcttgaggcgaatcaacaacaaccgcagtcttcgccgtcgtcgtccgcaggacacacgccacagactcaaacctcttttcaccgtatgaagcttgatgtcccgaggtttgatggatctaatccaatcggctggaccttcaagattacgcaattctttgagtttcattctatgccggatcacaagaggttaaccattgcctccttctacatggagggaccagcacttgcgtggtttcaatggatgcatcgaaatgcccagttatcctcgtgttacttcatctcaggattgaatccaacgattcgcagagaagtacaagtcttacaaccgatatcgttaactcaggcagtatcctacgcacgattacaggaagaaaaacttctcgatgctcgccggccgccgccatatcggccactagtctccacaggaccttctaacacgcgctcatcatcaagcaactctacgcaacccttgctaccaacaccggtacgaactccctcctcaattccttttaaacgtttaacaccaaaagaattggcctcgcgcagggaaaaaggactatgctttcactgcgacgagaaattctctcgtggccacaaatatgcatcttcattgtttcttttagttatggacgatgaggataccacgatcgaagcggagtcaatacgagactatacaccaactcaggagttgctaccggaatcgccgccggtgcagctaagcttacatgcattatctggccacttagcaccagagacgttacaacttaaaggctttattaatgaccggcctatcaacatcttgatagatggaggcagtactcataatttcctccataatcgtgtggtactgagcttaggattaaaaaccactgaaacaacaccgcttagggtcacggtggggaatggagaggagattcactgtaatcagttgtgtacggcagtccaggttcacatacaacaacactctttcaccattgacttccatgtattgccattatgtggagttgatgtggtcttcggggtgcaatggttgaagactctcggcccagtcttaacagactacggtgctttgacaatgaagttcatcactgggggtaaactcattgaactccatggagatcgcgagaagggaatcgaaccaatgtcaccatctcaactacataggttcgtacacacaaaccctactacaaccttcttccacattcgtgtcgaaacagcaaccacacacaactcttctccaaaccatcccttgccggcaatcaacacattgatctccaaatacacttccctctttcaacctcccgcgaccttgccgccatcgcgatccacagatcataccatcaatctattgcctaactcaactccggagatcgaagaacaggtagctactatgctcgagaaagggttcatacaacctagctcgagtccattttcatccccagttttgctgtggatgagttactcgatgagctgggtggagcacggtagttctctaagcttgatctcatgcaaggaccatcaaatattgatgaacacgtctgacatctgcaaaacttcatttcgaacacatcaagggcattatgagtttcgtgtaatgccctttggattgtgcaatgcacattctagttttcaggccacaatgaatcagctatttcaaccataccacaggaagtatatcatcgtcttctttgacgatatcttgatatacaacaggaccatacatgaccatcttcttcacttggagaaagcttttcaggttcttgtggaagggaaattttctctcaagctttccaagtgcacgtttgcacaggagcagttggagtatctgggacacatggtgtcctcgagcggggtcacttcggtgctggagaaggtacaagctgtctcacagtggccaacacctcgcacacctcgggcattgagaggctttctaggcctcgccggattttacagacaatttataaaaggctacgcagccttagcctctcccctcaccaaacttttgtgccacgaccaatttgaatggagtcacgaggccgagatagcatttcagaacctcaagagggctctcacagaggcacctgttctcgagttacctgacttcaccacatcgtttgtggtggaaacagacgcttcagggtctggtatggggacggtgttaacacagaagggccaccctctggcttactatagcaaacaattctgccctaagctaattaatgcttctacctacagtttacgtgagctcatgaaccagacaattcaaacaccggagcagcatcgttatttggccagactattggggtttgattactccattcaatatcgcgcaaggaaaaccaatgtggtcgcggatgcattatccagatcacaggaagaccacactgtttcactcttcttcctttcgatgccacgctttgtcttcctcgatgatcttcgcaaggagctagcctctcttgagacgtttcaagacttgcacagtcgaatccaggaaaacccagcttcatatccagattatgcattaattgagggactcaacatgtacaagaaacgaatatggcttccctctaactcttctttcatcaaacaattgcttgaggagtttcatcaatctcctacgggtggccacatggggatccagaagactctccaaagacttaatgataattttacttgggcctcgatcaaggaagatattcgcaagtttgtcacggcctgtgcaacgtgccaacacactaagtatgataatcgtaaacctacggggctcctttgccctcttccagtgccgacactaccatgggaagatctatccatggattttattatggggttaccctcttatcgcgacaacacatgcatcttcgtcatggtggatcgtttctcgaaggctgcgcttaagctcatcataccatctgcagttcgatggacaaacggaggtcgcaaatcgccgagcaatatctacgagctttcgtgcatgaaaaaccagcaacgtgggaaagatacctgccttgggccgaatggtcctataataagtcttgccattcaactacggagggaagaagtttttgcgatgttgcggcgcaagctactcaaagcccagtctcgaatgaagacaaatgcagattgccactgccgtgatcaggaattccaagtgggtgattgggtcctcgtcaagcttaggccacaatga

SEQ ID NO: 96630 - DNA, 951 bp, Glycine max
  Peptide Sequence Number=SeqID_213408
atgatggaaatgcctgccagaagatccaactactcgctcctcagccaaattcccgacgaccagttctccgcctccgccgccccctcctcctccggcgacggcaagtccgcccgcgccggtaagtccgaccgcgccgccttcgactgggacctcgtcgccgatcaccgggccgccaaccggatcggaaacctctactcctcgatcggcctgcagcgccagtccagcgggagcagctacggcgagagctcgctctccggcggcggcgacttttatgctccgacgctctccacggcggcggtcagcgacgtcgacgccttcggatacctccacgacgagcggagcaagttctcggaggtggcgccggcgaggatcgccggctcctcctccgggaagagctgggcgcagcagacggaggagagctaccagctgcagcttgcgctcgcactgcgcctctcgttgcacgccacgtgcgccgatgatcccaatttcctcgatccggtgccggacgacgccgcgccgcggctctcgtcgtcggccgaggcggtttcgcataggttttgggtttttgtagtctgcgtcaaagggaggatcaatcaaattgtgcttgacgatcgcaaacttttagaagttcattcacactggttggtgaatggctgcctatcatactctgacaaaattccagatggcttttacctgattcatgggatgaattcctttgtctggaccttgtgcactgatctgcatgaaaatggccgaattccatcagttgatatgctgaagtctgtgaatccctgcgtcgtttcttcacttgaagtagttatggtggatcgacgcagtgaccccagcttaagagatctgcaaaataatgttcataacatttcttgtactagcataacaacaacagatgttgtagataaactttccaagctggtttgcaaccgtatggggtga

SEQ ID NO: 96631 - DNA, 153 bp, Glycine max
  Peptide Sequence Number=SeqID_213409
atgtccaaagacttgctggtgggtttgagtatcgacgtagaggttggaggaaacaactctgcctccatcagaggcgactacgttcttgttgacgacagtgctcgtgatgagcctctacttcatcgacttcatcatcacactccacatgtttga

SEQ ID NO: 96632 - DNA, 507 bp, Glycine max
  Peptide Sequence Number=SeqID_213410
atggagattgggatgttattgattttgggggagtgggttctcatgaataatcccatcaagcgtgacaaagatgttggttcaaatacaaagagattttctttgagggaaaggaggaaaaatagcatgggtcaaatgggagaaaatctgcctcccaaaggaagaggagaacttacaagtagcacaaaatattcaatttggtggcgtgatttcaaggccaacattgaaggattgcaattaaaggaagatgaacaagttgtggagatggatttccagtttgcacagtccatgtgtgttgtccaaacttgtgacccacttaatcatcttcaacaacactacatagagggtctgagtaaggaagccaatgatgcgtggatggtgacttggtttgcagttgtttggttcttatggattcagcggaatgcaatcatcttcaacaatgagcagaaggatgaaggaaaggtgtgggaaacttatcaaaaccagagcgtggctatggctggtagctaa

SEQ ID NO: 96633 - DNA, 423 bp, Glycine max
  Peptide Sequence Number=SeqID_213411
atgaggaggggtgtgaaaagaaaagagtgggaggtggtggggggagtgaggatattaaaagggtgtgagggcggtggagggtggagagatgatggcggtggaagagaaaggccattgcacagtgagagtgatgtgggtgtaaatgactgcattggagatgatatgctaaatgaaattgataatataacaaaaaacattgttgctcattatagagacaatgatggtggcgtggatagtgtggaaggagatgtagtggctcacaaatttggagaggttgttcatcctttgtatgacattcaacttgattatggtggtcttaatgtaaaaaaagatgtagcaactaaagtaatgactgatttctttggtgacgttggagatgataatcaagatgatgtgcgaaaaaatgaagatgggagaggataa

SEQ ID NO: 96634 - DNA, 1242 bp, Glycine max
  Peptide Sequence Number=SeqID_213412
atggagattctggattctccatttcagaacagtttgatgggaagtgcaaagacagcagtaaccctaggccaatttcgtctgatagcaatagaagttctcaccttcctctgcatccgcaagattctcatccaagctcacgtgaacaagaacattgtagactcaactctgggaaagtatccaccaccaataaagcataagcgtcctgctggtataccaaccccattagcacttacaaatactaatgatgacatgattgagggcaagaggtttgttgaaggaagtcaactgattcctagcaaacatgctcgagagcttaactttgacatggaggatttggacataccatggagtgatcttgtcctaagagagaaaatagggtcaggttcttttggaactgtacatcgtgctgagtggaatggctcggatgttgctgtgaaaattttgatggaacaggattttcatgctgagcgcttcaaggaattcctaagggaggttgcaataatgaaacgtttacggcatccaaacattgttttgtttatgggggcagtcactcagcctcctaacttatcaattgtcacggaatatttatctaggggtagcttatataggcttttgcatagatctggcgccaaagaagtattggatgagaggcgtaggcttggtatggcttatgacgtggcaaaggggatgaattatcttcataaacgtaatccccccattgttcatagagatctgaaatctccaaaccttcttgttgacaagaaatatacagtgaaggtttgtgattttgggctttcacgtctgaaggccaatacgtttctctcatccaagtcagctgctgggactcctgagtggatggctccagaggttctttgtgatgagccatcgaatgagaagtccgatgtttacagctttggtgtaatcttatgggagcttgcaacattgcaacagccatgggttaatttaaatccagcacagcgtgtggctggaaatagaaatctgagaatgattgcaagaagtggatattggttgaagcatgttgtggcagctgttggctttaagagaaaaaggcttgagatcccacatgatgtgaatccccaagtagctgcgctaattgaggcttgctgggcctatgagccttggaaacgtccttcttttgcgagtattatggattctttgaggccattgctcaaaccccctacacctcaacctggtcgtccaagcatgccattactgacctga

SEQ ID NO: 96635 - DNA, 597 bp, Glycine max
  Peptide Sequence Number=SeqID_213413
gtgcggataaccataaggtatctccgcatgtcatcggacttgccgtctctggatgacgaatgtgcagatgacgacgtgtggataaccatagggtatctccgcatgtcatcggacttgccgtctttggatgacaaaggtgcagatgacgacctggcaaaaggtgtggatatgcataagtatctccacatgtcatcggacttgccatctctggatgacaaaggtgcagatgatgatgtgcagatgacgacgttagtctctgcgtgtcaacaggctcgcttgcctctagctgacaaaaggataacaaacaacactttttcgcagtcttggccgaaagatgctgacatctccaagaaagggcgtctccgcttgccaccggacccacaagtcatgatagaaaaaggtggggtggtcgacaaaagcgaagcttttgctcctacgtatcctcaatttgtgatgaggaactcagacctacctaggcgaggatggaaattctcatctcgagtcaaggttcatggtgagtttggattttggctcagagcttgtagaacgactggacatgatatatgtcagggtgttggtttggtcaacagtccaggg

SEQ ID NO: 96636 - DNA, 330 bp, Glycine max
  Peptide Sequence Number=SeqID_213414
atgaagagaggctactacatgaccaaggttggtgccattgttggttttgatttaaagacaaagatgcaaccaattgttttgtttttctttgttctccttctttcctctttcttagcttcttcccgtctccttgaaccgctgaaaggtaaaggtccaagacaaggtgagaaggaagtggaggtgaatgaaaacgctattcctcagtcatctgatatggaagaactaataggatcagaggagtgttatatgaaggatgaagaatgcactagcagaaggatgatggtggaggctcacttggactacatctacacccaacaccataagcattga

SEQ ID NO: 96637 - DNA, 702 bp, Glycine max
  Peptide Sequence Number=SeqID_213415
atgaagaccacctctcttgagaatgaaaacaaagaacaaaatgaattttccgtgaagatggtgcatgaagaaggaaaaggaagaagttatcaggggtacttttggaatttagaaaatttgctgggtgcacaacaagttttatgggtgcataaagcaattcctaaaacattgtctttcggcccggcccaggagttcatttacgaggttttattatatagaaccgagctgtgccgattcagcggtgccaagatctacccagggaaaggcatcagatttgttcgtggtgattctcaggttttcctgtttgctaactcaaaatgtaagaggtatttccacaacaggttgaagccgtcaaagctcacgtggactgcaatgtaccgaaagcagcataagaaggatattgctcaagaagctgtgaagaagagaagacgtgctaccaaaaaaccttactctaggtctattgttggtgctactttagaagttatccagaaaaagagaaccgagaagccagaagttcgagatgcagctagggaagcacagcttcgtgaaattaaggagaggatcaagaaaactaaggatgacaagaaagctaagaaagcagaagttgcagctaagtcccaaaaatcacaagggaaaggaagtatttcgaagggtgccatgcccaaaggtcccaaacttggtgggggaggtgggaaacgctga

SEQ ID NO: 96638 - DNA, 366 bp, Glycine max
  Peptide Sequence Number=SeqID_213416
atggtagtgggagatagtacctataaaacaaacaggtacaagctatcgtttgtttttttcattggctctggcaaggttattgctggaattgatgtggcagtgagatcaatgaaagaaggaggtattcgtagagttatcatacccccatcatttgggtatcaaaacacatcacaagagcccatcccacctaatgtaagaacctttttcttctccagacttattgcatgtttgtgcttgtatacaatgtcttcagagcaagttttttcgcttcacactcttctgctcttggaccaaggacacacaatgtgccacatggctgtcagagttatagaagaaaaacagaaacaacagaaaaagggacactag

SEQ ID NO: 96639 - DNA, 408 bp, Glycine max
  Peptide Sequence Number=SeqID_213417
atggcaaagaataaaaaatgcttcagtccaaaagataggagtaaacatcataataaggcaggatttgaaagattctctaagggcaggagatccgtatggttacttgtacgacgacctaaggcgcgctttccacgggcaaacgggtcacgacagctacacttctttaagatggcacacaggtcacggcatgggcgagctcattatgtgtactcacagtgcgagctcaacaatggacgttggagcttcagggagagagagcgaggttctgataacgggtcacggcacgtagatgatgtgcatcagggagagagagcgaggtttgagggagagagggatttaggatacagagcttcagggagagaggggtttaagttacgacacaacaatggatgttggagctgcggctaa

SEQ ID NO: 96640 - DNA, 364 bp, Glycine max
  Peptide Sequence Number=SeqID_213418
atggcgatttgcagagccattgggaaccgccagtcaaactggcgagttccaacagctgagggtgcctgccatggcagtgaagggcagagcgcgtcgcgtcagtcaaggccaaatcgccaatggcaatggcgatttgccttgggcatggatcgccagccatgctggcgggttgctcctaaatatgcttcttccattataaaagctcagtccgagagtgcaccagctacgcttccttcgtggctcagtccgagagtgcaccagctagcttccttcgtgcctttgcttccattgatccttccattgctttgcttccattgctgtgctattttcttcataagtttctcagtgcgtttttgttattttg

SEQ ID NO: 96641 - DNA, 345 bp, Glycine max
  Peptide Sequence Number=SeqID_213419
atggcgatttgcagagccattgggaaccgccagtcaaactggcgagttccaacagctgagggtgcctgccatggcagtgaagggcagagcgcgtcgcgtcagtcaaggccaaatcgccaatggcaatggcgatttgccttgggcatggatcgccagccatgctggcgggttgctcctaaatatgcttcttccattataaaagctcagtccgagagtgcaccagctacgcttccttcgtggctcagtccgagagtgcaccagctagcttccttcgtgcctttgcttccattgatccttccattgctttgcttccattgctgtgctattttcttcataagtttctca

SEQ ID NO: 96642 - DNA, 549 bp, Glycine max
  Peptide Sequence Number=SeqID_213420
atgtattccggcaatgcaaccagcagcagcagaggctcttcggaatccggtaggtaccgcggagtgaggcgtaggaacagcggaaaatgggtgtcggagattcgcgagcccaagaaacctaacagaatttggttaggcacgttccccacgccagaaatggcggcggtggcctatgacgtggctgcgttggctctcaagggtaaggatgctgggctcaacttccctgactcagcttcttcccttcctgtccccgcttcgctttctgcacgcgacattcaggtggcagctgcggccgcggcggcggctgctggagcagcaaaggattctatgaggacacaaacagggaattataacatttcagaggggcaagagaatccaactgggatgggtaaccaatttgtggatgaggacttgatctttgacatgcctaatgttcttgtcaacatggctcagggaatgctgcttagtcctcctccttttgacattggtttggaaccgaatagcccagaaaacaccgaacaagagacaagcctgtggaatttcccttaa

SEQ ID NO: 96643 - DNA, 156 bp, Glycine max
  Peptide Sequence Number=SeqID_213421
atgacagtggatgaaatagtgattgatgacgatgattatgatgatgatagtgatgacaatgaatgtcataacattagaggtggtgacggcgacgattatgatagtgactacaaaggtggtcatggtaatagcaacaacattggtgatgagatttga

SEQ ID NO: 96644 - DNA, 627 bp, Glycine max
  Peptide Sequence Number=SeqID_213422
cacgctaagtacattagaaggaaaacaagacgggacgaaatgcagaaacggagggctgggaggaagaagttccacgagacgcgtcacccggtctacaagggggtgaggcagaggaacgggaagtgggtgtgcgagctgcgacaacctaacaacaaaaacgcgcgcgtgtggctcggaacattcacgcaccccgacatggctgctatagcgtacgatgttgccgccttggctttcaagggcgacaatgcttccttaaacttcccgcacgccgccacctcgttgccgcgcctcaactcgcggacgtgttccgttagggccattcagtttgcggcgacgcaggcggcggagaagcatttttcttgtgcagagtctcaacaactccaaagggagggttccttagaaggatcaggttctggaagcttctctttggacgaagactcttcggagttttcgtcaaaagaaggaggttctgaaaggttcttttgggatgaagaggaggtgtttaacatgccggagttgctgaacagcatggccgaagcgttgattatcacaccgccggcattggaaagagggttcaattgggttggtggggaaaccactgtggatttgactctgtggtcaaactga

SEQ ID NO: 96645 - DNA, 303 bp, Glycine max
  Peptide Sequence Number=SeqID_213423
atggtatcatgcaagtgctcgggaggtggagatgcacattcatcaactatggtgctactaaattacatttctagctatgcatggcatgcgaaagttgtgttaaccttagcagcctttgctgttatttttggattgttttggcttgttgctcagttgagtgctgaaaacacacttgccaagtatgtggccctccttaagcaactacctaacatttctgagaatttcatgtccctaaagccctattttgaggcactcattaggctcgtgaagccggcaattatctactctagctcacaaagttag

SEQ ID NO: 96646 - DNA, 646 bp, Glycine max
  Peptide Sequence Number=SeqID_213424
gaaaatgactacaccacctaggtctcctcctcctcctattgatgcaacatcatattccccttctaccttgaagcggacaagaaaagccacacgcctaagatcgttggctactagaccagttggggcagagagacccctggtccatgtggatcctgcgaccgggaaagctgatggtccccacagaaagaagttacgaacatatttggggattgtcgcttgtgataaggtggatgtgacatacgagaattggaaacaagtcactactgcgcagaaggatttaatatgggaggatattcagtctaatttgacgttgaaattggcacttgcagccaacaagaacagtgtcaatgacactatatgcgaaaagtacaacattagcaaggagaagtggacccaattttgccaaagccgcagagacccttcatgggtggatgtgcgaaagaaggcacatgtcattcggaaacaaaacgctgtccctcacgtgttgtcccatgggggttatgagtttcttgaaaagaagttgatggatgagaagaaaaagaaacaattggaggaagcaaatgatgattcattggaggatcaggccttacaggattcctttatcgcccatggacgtcaggatgtactgactgctgccattggataa

SEQ ID NO: 96647 - DNA, 438 bp, Glycine max
  Peptide Sequence Number=SeqID_213425
atgaccacggctgaagcgctagagcgaaaaacaaaaaaggcccaaaaggaagagtggagtaggaacaagttccgatgggctttgtggggcagcagtaatgagctcaaacttagaaaggccgagagggacaaatcaaggatggaaagcatggtgttagaggataaattgaagagttgtcagaggtcgaagagaagtttgacagagcagttgagcaaaatagaagagaatatgttgataatcatttatcaatataaggagaagattgaaaaggaagcgagagaaggggtgatagagctattgcacaaggaagccatgaaatggatgaatagatttgctctcactctaaatgaaagtcaagagcttccaaggttgttagccagagccaaggcagtggctgacacgtactctgctcccgatgaacttcacgggtctttttga

SEQ ID NO: 96648 - DNA, 462 bp, Glycine max
  Peptide Sequence Number=SeqID_213426
aaggcgaggacgtgtagccctctaaaggcgagaacatgcagccctctgaaggcgaggacgtgtagccctctagaggcgaggacgtacaaccctataaaggtgaggacatgtagccctctagaggcgaggatgtacaaccctctgaaggcgaggacatgtagccctttgaagtcaaggacgtgtagccctctgaatgcaaggacatacaaccctctggaggcgaggacgtacaaccctctgaaggcgaggacgtgtggccctctgaagtcgagcacacgcatcgcccgctgtcgcaacgtgcccttttgcaggcgagcgaaggcgaggctcacgggtgcgctttccaaaggaggaaagatgcgcggagtcgccaccaaagtttatttgtggaaaatgttgggaaaaccgaaggaaaccggtcaaatgaaaaattctaagttcgggagttgtatctacgcttga

SEQ ID NO: 96649 - DNA, 243 bp, Glycine max
  Peptide Sequence Number=SeqID_213427
atgttgagggaggaagcagatgctgaccgagcaattaattggctcatcaagaaatcaagaaacctgccaataggtgtactagtaaaatccacatatgtaaggtgtaatgcattgttcaacgaaagagggagagaagccacaagaatgcttgcatttgaccaagtttatacgaaagtactaagcaaggtcatcgaagacgcacttaaaaaggcgaacactcacaatgttcttgagtttgattga

SEQ ID NO: 96650 - DNA, 465 bp, Glycine max
  Peptide Sequence Number=SeqID_213428
atggcagtatgtactttgtactatggggtgtctcacctggttgggaactcccttgtggcccaagctgatcaccgaagggctattcccttggtattggatacagtatgtatcgcatttcatctgagagttaaggatgacatcagtagggtgcaggaagtgagatctgttgaggagccgccgagccgacgtgatggcgcgggtcgttacaatgcctataggttggacttcccagaacagtatggagttaacaccacttttaacatttctgatttaattccttttgtaggtgaagctgatattcaggaggaggaaccaatagatttgaagtcaaatcctcttcaagggggaggggatgatgcaatcctccctaggaagggaccagtcgcaagagccatgagcaagaggctccaagaggattgggctagagctgctaaagaagaccctagggttctcatgaatctcggg

SEQ ID NO: 96651 - DNA, 453 bp, Glycine max
  Peptide Sequence Number=SeqID_213429
atgactgttcctcctctaccagctcaatatctttcgtttcacctttgcttttgtaaactacactatattgagctggtagacgaggaagaagcacagattggtgctgatcattctagtgcaacctctaataaatctgagatttataaggaggaagaacgaaatgcagcacagaagcataaaccaaagagggtggggagtgtcaatgctgattcagaagcctttgctgaagcaatggaacatacgaagaaaagagatacagtgcatcaaagtgtgtcattggagaataagacatcagattcaactgtgctaaagataggagattcggctaaagttgtgataaaacaagacatgaagggaagaaagcataaatatgggtttaacaacaataaacgtgagaagacagagaagaaaaaggtggtggatgatgaaactggcaacaaacatgagctgtaa

SEQ ID NO: 96652 - DNA, 162 bp, Glycine max
  Peptide Sequence Number=SeqID_213430
atggtgtataaaagctcacacaggacatcgccagtcgggagcgacctcgaatggcaatcccaaaggaagaaccacttcagaaaatgggttttccctttgccggcggtcatttacctcgccgaaaatttatctggtccgaagatcgtctgttctctttcctaa

SEQ ID NO: 96653 - DNA, 192 bp, Glycine max
  Peptide Sequence Number=SeqID_213431
agttattttcataaggagacaggctttcggtgtcggtctttgaaggagattaagaattacgagaaatatggaagtcctcctcgacgtcacaaagtgaaaacacaagccaaagaagaaagcaatgacaaaaccaaaaatgaaacagaatttactgacaactataagctcatgagtaggactgaaagtgattaa

SEQ ID NO: 96654 - DNA, 360 bp, Glycine max
  Peptide Sequence Number=SeqID_213432
atgaccaaacatggtctctgcgtgccatcggacacgactgcgtctgaatggcaaaggggtgcggataaccgtaagaatgaccaaacttggtctctgcgtgtcatcggacacgccgcctttggaagaccaaagggaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatcatgggtgcagaatga

SEQ ID NO: 96655 - DNA, 255 bp, Glycine max
  Peptide Sequence Number=SeqID_213433
atggtcaacaagtcatcacttcttcacttggatcctaaatcacctgaagctcaagcttttaatcaaattggtcagaaatccaatggtggttctatcagtccttcgcccactacttctgctgaaggaagttcccagaatggtagaaaccaagggatagatgaaacggccacagctaagaatagtgcgtcttatatcgggaagagattgttagaaagtttggttgcagttgcagggcttctaatttggctttcatga

SEQ ID NO: 96656 - DNA, 609 bp, Glycine max
  Peptide Sequence Number=SeqID_213434
atggtctctgaaacggtaaagaaagcaaaaatagctacccagcttatatttttagtttgtggattgggaattgcgagttgggcacctatggttccctttgctaaagacaggcttagattagatgaagccgatttaggcttactgttgcttttgctgggaggaggagccttgttgatgatgcctttatcaggactcctgatcaataaaatagggagccggaaaattatagctgtaagcgttttgttgagtgcattacttcttccttttctattgattatatcggatgtttatattatgggagccgttcttttcgcattcgggtgcagcataggaacgattgatgtagctatgaatgctcatggagtacaggtgcagaatcaatatggaaaacctattatgtcatccctacacggactctttagtgttggcgggcttttcggttctttaggactgggttttcttatgaagctgggattaaatccgatttatgcggcagtaaatatttatttgatcgtgaaacggaaagaaaaagcattatccagttttcccatgtggatcctgaaagtaaaacgacttcccgttttcaatggatggattcgagagttttga

SEQ ID NO: 96657 - DNA, 219 bp, Glycine max
  Peptide Sequence Number=SeqID_213435
atggtgaaggaagtgatccacggtcccaattctgcaacgcctcggctccactttttctcttcttattcttcttatgcttttttctctttgaaaacaaccattgagtgcaagggaattcacccaagcgagctgcagctcacccaggcgagtttgcttagggctgaaggtatctactcgcccaggcgtgttgtagctcgcccaggcgagtggcttgcttag

SEQ ID NO: 96658 - DNA, 306 bp, Glycine max
  Peptide Sequence Number=SeqID_213436
atgaatgttttgaatggtgcaaccctctttggtaaaatcacccaggcatccgacatcttcatgattcatatacatagggactcattaggggttcccatgaaccctaagagaataaaggtcattcctgagaggctcactccaccaagtgtggagggaagaagcccagagtttcatgaacctcgggatttgaggtcaaatccttttcaaggggaggtaatgatgcaatcctacccccaagggcattggatagaagactttaaaatgattgggccaaggatgcaagagaaggccctagggttttcatga

SEQ ID NO: 96659 - DNA, 297 bp, Glycine max
  Peptide Sequence Number=SeqID_213437
atggggtacattcagaccgttcctccaccaccggttcgtgattcgttgacaggtggccccagactacatgcagtggtttttcagatttcgcacccttttgtgacgccgacggaggacactggtgagccgagacctgcgcctccccctcccactcatgatgatgacttcgtcgagccacctgtcgccgaggttccagtcgcgtcagatccccctacgcattatgtggttgattgcacagcatgtatcaggattggaaggattgctgagcatttggagcgtgtcatcaacctcaggatg

SEQ ID NO: 96660 - DNA, 303 bp, Glycine max
  Peptide Sequence Number=SeqID_213438
atggttcactgttatcaagcaagtcggagatctagcatgaccacagatttacctccactccttatgttcccacggacccagaacataaggaaaaagacaaagaaaaaagaacaaaagggaagtcatggtaaggaaagcagattgattgattggtctaactctctaacaaaagtccccagtggagtcaccaactgtcacaaccgggtgcgtcttccaagaaaggaaaatgcgcggagtcgccaccaacgtatattcgaggaaaacttcggaaaaaccggaaaaggcgtggtctacgaactttaa

SEQ ID NO: 96661 - DNA, 195 bp, Glycine max
  Peptide Sequence Number=SeqID_213439
atggcaaaaaaattctcatgccgcctaaggcgtctggaacctccctacggggaggaaaaaacacacgtaaaggttttaagttggtcctacctaagccaaccatcaaaaggagttcttctacatcccctgggtcaccaacccaggctggggcatcttcttagaagcccaaaaaagaagggtcatcgacccaaatag

SEQ ID NO: 96662 - DNA, 849 bp, Glycine max
  Peptide Sequence Number=SeqID_213440
atgtcgatggttgcggacgtcgcccagcgggccgacgatgagcgagccgccattgatgagcgggcgttgcggatcccagcccggcacgtccaggcccagttcggcgggcgacggctgcacctggcacgcgctgatgacgaagcagcggccctcgtgggcgatgtgacgcatcgagcattgccagatgtcgcgttcgtcgacggtgggtgcgcaccagatctgcacgcccttggcgtacatggcggtgcgcagcagcggcatgtggttttcccagcagatggcgccgccgacgcggcccgcggcggtttccaccacgggcagggtggagccgtcgccctggccccagatcaggcgttcggtgccggtgggcatgagcttgcgatgcctggcggccaggccggcggccggatcgaagtacagcgcggtgcagtacagcgtgctgccggcgcgttcgatgacgccgatcaccaggctggcgccggtgcgttgcgacagcgcggccagcgcgtcggtctcggggccgggcacgtcgatggcgttctggtaatagcgggcataggcctggcggccttcgggcaagcggtagccgaggcgcgtgccgaatatctcgcccttgggatagccgccgagcagggcttcgggcatgaccacgagcgcggcgcccgaggcggtgatctcggcctcgaaggccaggatccgttccagggtggcttccttgccctcgggcgaggcgccgatctgcagcgcggcaacggtctgggtggtcatgcgggttccttggctggggctgacggggtgtcgggagctgccagtgtcggcgccagcctaaaatcgatcaatcccatttga

SEQ ID NO: 96663 - DNA, 345 bp, Glycine max
  Peptide Sequence Number=SeqID_213441
atggctttttatggaatcgcgggtggtggttttgatatcttcaataaaaaagggaaaaaggtacgttttgttccttggggatttcctggaaaaaatcgtcgtattattctcgaaatacctatgaacgagcttcactccatcagaataataacagaagttaaagaagagggtatttttactcgtaccagtacttttgagagtatcgtttatctggaaaccatagaacaggggtttattcccttgactcgtattgaagataatttgaatgggacacaaattgcacataaagctggcgaattatctggtatttttgggtgtaccacttttgttactgatgagaattga

SEQ ID NO: 96664 - DNA, 213 bp, Glycine max
  Peptide Sequence Number=SeqID_213442
atggaatttatgcataaggctccagtgccgccttggagtttgatagtcaccgttttcggtgtgtcgagcaccagtagcgcttcgaggccatcaagggatgatctttccacagggagagacaagtatcctgacttccagggagatatctcttgcagacattgggcacgactagtgacccctatggctaaatttgacccggagatagtcatataa

SEQ ID NO: 96665 - DNA, 638 bp, Glycine max
  Peptide Sequence Number=SeqID_213443
atggaggccatgaaagaccaaatggccgccatgatggaggtcatgttgagcatgaagaaaataatggaaagcaatacagctgcagttgccactacaagtgccgccactgaggtagacccgactcacccatcgagcctcaatcaagtaaatcctccaatctcggatatggtaggtcagggagaagaagcattgggaagtacaggcagtccccatgttatgcagagcaagaattctttcccaccatatggcttgcctcccaactatacaccacccaatgttgcacatgctctcgatgagaatgtcaataactccactcccatgctcattgagagccaacaaccccaatctgtccctcctgctatggtggaaagggagagatttgatcatataaagaagaggttgagggttcttgaagaaggtgaagattatgcctttgctgacatgacagaattgtgcctaatgcttgacgtcgttatctctctgaagttcaaggtgctggattttgataaatacaaggggactacttgccccaagaatcacctgaaaatgtatagcaggaaaatggggacatactcaaaaaatgaaatattgttgatgcatttcttccaggaaagacttaatggggcagccgtcacctg

SEQ ID NO: 96666 - DNA, 915 bp, Glycine max
  Peptide Sequence Number=SeqID_213444
atgaaggtgaggacgtgtatccctctgaaggctaaggcatgcagccctcagatggcgaggacgtatagtcctctaaaagcgatggcgtgtagccttctaaaggtgaggacgtatagtcctctaatgaccaaggcgtgtagccctctgaaggtgagggcgcgtagccctcagaaggtgaggacctatagccctcggttggcgaggacgtgtagtcctctgatggcaagtacgtgttgtcctctgacagcgaggatgtgtagccctctaaaggtgagggcgcatggccctcagaaggtgaggacatgtagccctctattggtgagaacgtgtagtcctctgatggcgaggacgtgtagtcctcagacggtgtgggtgtgtagccctctgaaggtgaggacgtgtagtcctttgaaggtgagggcgcgtagccctctgatggcgaggacgtgtagtcctctgaaggtgaggagatgtagccctctgttggcgaggacgtgttgtcctctaatggcgaggacgtgcagtcctctaaaggcgaggacgtgtagatctctgaaggtgagggctagccctctgaaggtgagggcgtgtagccctatgaaggtgaggacgtgtggccctctgaaggcgagggcgtgcagccctctgatggcgaggacctatagtcctctaaaggcgagggtgtgtagccctctgaaggtgaggacgtgtagccctctgttggcgaggatgcatagtcctctgaaggcgagggcgtgtagccctccaaaggtgatggcgtgcagccctcggatagcgaggacgtatagtcttctaaaggcgagggcgtgtagccctctgaaggtgaggacgtgtagccctctgttggcaaggacgtatagtcctctgaaggcgagggcgtgtagccctctgaag

SEQ ID NO: 96667 - DNA, 456 bp, Glycine max
  Peptide Sequence Number=SeqID_213445
atggcgggcattcgcttcctttcggcaggcgtcctgctgctcgcgttcctgctgctgcgcggccacaagcttcccccgctgcgtccgctgctgaatgccgcgctaatcggcctgctgctgctggcggtaggaaatggatttgtaacgattgccgagcaccagaacgtgccgtccgggatcgccgccgtggtcgttgccaccgtgccgctctttaccctctgcttcagccgccttttcggcatccgcacccgcaagctggaatggctgggaattggtatcggactcgccggtattattctgctcaacagcggcgggaacctgagcgggaacccgtggggcgcagtgattatcctgataggctccatgagctgggcgtttggctcggtatacggttcacgtatcgaactgaaaaacgatctgatggcgggggcgattgagatgcttgccgcggggatc

SEQ ID NO: 96668 - DNA, 919 bp, Glycine max
  Peptide Sequence Number=SeqID_213446
agggctacacacccttaactttcgatggctgcacgccttcgccttcaaaggacaacacgtcctaaccttcagaggactacacgtcttcgccttcagagggctacacgccctcgcctttagaggactacacgtcctcgccattggagggctgcatgccctcaccttcagagtactacatatcctcgctttcagaggactacacatccccgccttcagaggactacacgtcctccccttcagaggactattcgtccgcacctttagaggactacacgtcctcgcgtttagagggctacagtacctcgcctttagagggctacacgccgtcgccttcagagggctacacgtcctcaccttcagatggctgcacgccctcgctttcagaggactacatgtcctcagcttcagaggactacatgtcctcgcgtttactaggttacatgtccatgcctttagagggctacacgccctcactttcagaggactacacgtcctcaccttgagagggctacacgctctcgtattcagagggctacacgccgtcaccttcagagtgctgcacgccgtcaccttcagaggactacacgtcttcgccttcagaggcctgcacgtcctcgccttcaaagggctgcacgccctgcccatcagagggctgcatgccctcaccttccgagaattacacgtcctcgccttcagaggactacacctcctcgcctttagaggactgcacattcttaccttcagaggacctcacgtcctcactatcagaggattgcatgtcctcgcctttagaggactgcacgttcttgccttcagaggacttcacgtcctcactatcagaggattgcatgtcctcgcctttagagggctacacgtcctcaccttcagagggttgcacgccctcgccttcagaaggtag

SEQ ID NO: 96669 - DNA, 750 bp, Glycine max
  Peptide Sequence Number=SeqID_213447
atggcctctgccatagcgctcgtcattttgctggcgctcggcacatggcaggtagagcgtttgcagtggaaggaagcgctgattgcatcgaccgagcagcgcattcacgagccaccactgcccttgtcggagatggaaaaggtctacaagcaggaaggttctgtcgaatatcgcccggtaacggtctccggcactttcatgcatcagggcgagcggcattttctggccacctatgaaggagccgccggatataatgtctatacgccgttgatgcttgaagatgggcgtttcgtgctggttaatcgcggcttcgttccctacgaaaaaaaagatccttcaacacgtgttgaaggacaggttgatggcccggtgagtgtgaccggtctggcacgcgaccccttgtcggttaagcctggttttttccttccagacaacgatatcgccaagaatatcttctattggaaagactggacggcgatggccgaaaccgccgatctgccaaatctggatgaggtcgtgccgttcttcgtcgatgcagataacaaatctaatccaggtggtctgcctatcggtggcgtgacgattatcgattttcccaacaaccatttgcagtatgcaatgacatggtacggcctcgctctggccctgataggggttgtcgggacgtggttgtggcgctatcgctgtcttaggaaaagtggagaccggttttccgtccgagacagcgagaataaagacgaagagcggtga

SEQ ID NO: 96670 - DNA, 582 bp, Glycine max
  Peptide Sequence Number=SeqID_213448
atgtatacaatagaatttcaaaaacgggggctacctcatgtccatttgttgctttttttacatcctggtaacaaatacccatcctcggatgaaattgatcaaattatatcagtagagataccttcacagcaagatgatccagaactgtattcattagtaaaaaaccatatggttcatggcccatgtggaactctgaatcttggatctccatgcatggaagaaggcaagtgtagtcgtttctatcctaaaatgttccagccacatactattttagatgctgatggttttccggtctatcgtagaagaaacaatggtcatgcaattgagaaaaatggtgttataattgataacagagtaactgttattttgattcatgaagataatgatgaaactcacaatggtggcactcataatgatgagatcaaagaatatctagattgcagatacatatgtccctgtgaatctacttggagaatctttgggtttccaatacatggcagaaaacatgttgttgaaagattacacttccatcttccagcgcaacatagtgttctctacgtagaccatggtgatattgatgat

SEQ ID NO: 96671 - DNA, 444 bp, Glycine max
  Peptide Sequence Number=SeqID_213449
gtgaaggccgacatggaggccatgaaagagaaaatggccacaatgatggaggccatgatgagcatgaagaagataatggaagccaatgcggttgcaattgccgctaccagcgttgtcgctaaggtgaacccgatgctcccatttggcctcaagcaaatgaatcatccaacctcaaatatggtaggcaaagatttaggaagtacggatgaccccatgatgtgcaaattcaaaacaagcacgccttcccgccatatggcttgcctcccaaactatacaccacccaatgtggcgtacattctcaataagaatgtcaataactccactcctatacccattgagagccaacaaccccgaactgatcatgcacatgaatgggaaattggatcatctagaggaaaggctcaggccattgaaggaggtgaagattatgcctttgctaactag

SEQ ID NO: 96672 - DNA, 312 bp, Glycine max
  Peptide Sequence Number=SeqID_213450
atgacaattctcagaagattcggacctccactgccatggaatgtagttgtgctcgacaaaggcatcggtgacaagtatgtcactctcccttggtacaaattcattcaagaaggtgattttagccatggagacaagctctcattcaattataggcgtgctgagaagatttgggaggttgttgatatgaatggcaacggaatggagaaggaagagagagaggagacgccacttcaaggaaaagatgagtctagaagaagctcaccaccatggaaggccatggataagagcttggaggaagaagaagatgaatga

SEQ ID NO: 96673 - DNA, 315 bp, Glycine max
  Peptide Sequence Number=SeqID_213451
atgcaaaaacatgttggtgataagaaaggaaagaaggatagaaaacaaaagaaagcctacatagcttgggaagataatgcgtcaacaaccttcgactcttctagtgatgaagaaattgcaaatgtatgcttaatggaaaagtcaatggataactcatctaccattgaagaaactgaggtaaatcgtgaatttgaagaagttttggaagcatttaatgaaatgcatgaagaagctcaaaggtttgttgttttgaacataaagatgaaaagcgatctaaaattgcatattactaaattgggcttcaacaccaagtga

SEQ ID NO: 96674 - DNA, 456 bp, Glycine max
  Peptide Sequence Number=SeqID_213452
gcttttcgtcttacagatagcaaaaagatttatacggataaccactcgggtatctccgcccgtcaacgtgactcaaaagtcagtatgacagatcttgtgagcgcggaagatgacgcttttcgtcttacagatagcaaaaagttttatacggataaccactcgggtatctccgcccgtcagcgtgactcaaaagtcactaagacagagcttgtgagcgcggaagataacgcttttcgtattacagatagcaaaaaggtttatacggataaccactcgagtatctccgcccgtcagcgtgactcaaaagtcagtatgacagatcttgtgagcgcggaagattatgcttttcgtcttacagatagcaaaaaggtttatacggataaccactcgggtatctccgcccgtcagcgtgactcaaaagtcagtatgacagatcttgtgagcgcggaagatgac

SEQ ID NO: 96675 - DNA, 246 bp, Glycine max
  Peptide Sequence Number=SeqID_213453
atgacaaatgatggaacatacgaatttggggatcccacggtcatgtggctccggatgcccccggactcttgggtcacgacctacgtagttcttgatgaatgtgaggctaaaaatagtctcggtgttttctttaccaaaatgcgaacatgctttagtacagagacaaaacttccaactgatcagagcaacatatgctttttggatgaaaaacaatgtgtctatcggggaaggagagtatgccgatga

SEQ ID NO: 96676 - DNA, 360 bp, Glycine max
  Peptide Sequence Number=SeqID_213454
atgggtaaagtagaggaggcgcaagagcagatgaaggctaacatggagaccatgaaagagcaaatggccacaatgatggaggccatgatgagcatgaagaagataatggaagccaatgcggttacagttgccgctatcagtgctattgctaaggcaaagatttgggaagtacgggcggccccccattatgcgcaaattcaaaacaagcatgccttcccaccatatggctggcctcccaactatacaccacccaatgtggcatacattcccaatgagggtgtcaataactccgctcccatactcattgaaatgtctctcaacccatgggggaggcacatgaaattccccaccacaatctag

SEQ ID NO: 96677 - DNA, 282 bp, Glycine max
  Peptide Sequence Number=SeqID_213455
atggcagcgatgacgccgcgactctgtgaccgcaaccgccattactatcatgaatttatgttgccgaataacgtacgcgacatgaccgaaatctttattcgccgcgaacggcggatcgttgccggtatctcgctgatgcgcgacgtgcctttttccagcgaggaacggctgcgggcccaggcggtactgcatttggtggaactggctattcgcgatttcctgcaggaagaggatgaactccctgccatcatgacggccaaagagcgcgaactcgtcggcatg

SEQ ID NO: 96678 - DNA, 174 bp, Glycine max
  Peptide Sequence Number=SeqID_213456
atggcatgcagcgtgtttgcttcgtgcccctatttaagggacctacatgggagggagctaaaaagggcttttagtgataattcccaaggtggtcatatgtctcttgatgcagtagggactactagcaacaatacgttatcaaagagaaaaactctagatgagggttcactgtaa

SEQ ID NO: 96679 - DNA, 309 bp, Glycine max
  Peptide Sequence Number=SeqID_213457
atggggatacaaaagaattctcaggcgggagaagggagacacaaaagaattcaggcggttagtccttcgttcatttggaaaagggagaagagagatacaaaaagaattcaggcggagaagggaatgaaaaagatgaataacacagttttcaaggtttggaaaaccaaaaaactttggaaagcttttggtaaaaaggaagaagaagaagaagaagaagaagttcaaggagactcagaaatcaattggcaaaagtttgttgtaaaggttgtaagtgttattcaaatgcaaatcaaggtcttgcttttatag

SEQ ID NO: 96680 - DNA, 651 bp, Glycine max
  Peptide Sequence Number=SeqID_213458
atgaggggagcaccaacagaagaaagtctctcgcctttccttgtgagggatttaggcgcgcaaggtctcaaggtgatacaaagagtccacaaggcgtggagaagtccgttgaggaaagacaaggagattagaggcatccgtaatggcgtcatcgatggttatcatggatggctaaaagttcacacgcgagggttaaattggctctctaaattgaaagttatcgatgaggagaacttcgaagctccggaggaagatgaggaagtccaagctctaaaattagagctagggaaggtgagactcgccaaagaaaaattcaaatcagctgctacacacatccgaaaggagtgcaccgagttacgagaggaaaacgtggccactgcaagagcccttgaacaagaaaccaaaagggcccgcaaggaggaatatggtcgagagaaattccaaggggctttgtggggtagcaacaatgagctcaagctccgaagagaggaaagagactggtcacaggtgcacgacatgatcttaaaagaagagttagctgcttgcgcaaggtccaagagaagtttggctcacacttggacccacggagcaaagcatgctaactatcatagggccatacaaggaagagttgaaccagtctgtgacccgtga

SEQ ID NO: 96681 - DNA, 558 bp, Glycine max
  Peptide Sequence Number=SeqID_213459
accaatatcctcgcgctgaacgctgcggtggaagcggcacgcgccggtgagcaggggcgtggtttcgccgtggtcgcgggcgaggtgcgcagtctggcccagcgcagcgcgcaggcggcgaaggagatcaaaggcctgattgaagattcggtcagccgcgtcaataccggctcggtgctggtagagagcgcgggcgaaaccatgagcgagatcgtcaacgcggtgacccgcgtgaccgacatcatgggcgaaatcgcctcggcttccgatgagcagagccgcggcatcgaccaggttggcctggcggtgaacgagatggaccgcgtcacccagcagaacgccgcgctggtggaagagtccgcgacggcggcggcagcgctggaagatcaggccagccgactgaaacagtcggtggcggtgttcaatattggtaaagaatttgtcgcccaggccgttaacgtaactacagcgccaaaaattgcgcgtccgtctgcaccgcaggcgctggcgccagcggcaggagctcgtggcgctgacgataactgggaaaccttttaa

SEQ ID NO: 96682 - DNA, 1020 bp, Glycine max
  Peptide Sequence Number=SeqID_213460
atggtggtggacagcgatctggactacaacaacccgctggcggaggtgcatatcgatcgcgccaaggccaacagtctggggatccgcatgagcgacatcggcgaatcgctggcggtgctggtgggggaaaactacctcaaccgcttcggcatggacggccgcgcctatgacgtgatcccgcagagcctgcgcgaacagcggctgacgccgcaggcgctggcgcgacagtacgtccgcacgcaggacaatacgctggtgccgctctccaccgtggtgtcggtggccgttaaggtcgagccgaacaagctgacccagttcaaccagcagaacgccgccaccctgcaggccattcccgcgcccggcgtttcgatgggcgaagcggtggccttcctcgaacggcaggccaatgcgctgccggccgagtttagccacgactggcagggggattcgcgccaatatacccaggaaggcagcgcgctggcattcgcgttcctggcggcgttggtgatcatctatctggtgctggcggcgcagtacgagagcctgaaagatccgctgatcatcctcatcaccgtgccgctgtcgatctgcggcgccttgctgccgctggcgctgggctacgccacgatgaacatctatacccaggtcgggctggtgaccctgatcgggctgatcagcaagcacggcattttgatggtggagttcgccaacgagttgcagatgcatcaggggctgacgcggcgcgccgcgattttgcaggcggcgcaaattcgcctgcggccggtgttgatgaccaccggggcgatggtgttcggcttgattccgctgctgttcgccagcggcgccggcgccgccagccgcttcggcctggggctggtgatcgtatccggcatgctggtgggcacgctgttcaccctgtttgtgttgccgacggtgtatacgctgctggcgcgcgatcacgcggtggcgtcgccccggcagcgtgaactggccgcggcgcaaaaagcgctggcggaataa

SEQ ID NO: 96683 - DNA, 621 bp, Glycine max
  Peptide Sequence Number=SeqID_213461
atgaggaaccactgcatgaatgtgctgcacattaaagtcagcccggatctggcgggatcggcgtcgcgcatcgcctcggcgcgtctgatcgaaaagctgcgcagccgccatcacgatctgcacgagacggtgctggatctggcgcaacagccgctgccgcatctggatgcctttaccatcagggctttttttaccccaccggaggcgcgtgatgaagcgcagcgtaacgccattcgcacctcggaacagctgatggatcagctgtttgcctgcgacaccctggttatctcatcgccgatgtggaacctcgggctgccgtcggtgctgaaagcctggttcgaccatattacccgcgccggccgcaccttcgcctttacgcctgaaggcaccaaagtcgggctggtgagcggcaaaaaagtttactgcgtgatggccagcggcagcgtgtttgcccacgggccctttatgcaggatgaccagttcacgccgtatgtgcgcgcggcgctggcatacatcggcatcagcgatgtgcagtttatccgcgtcgacggcacgcacgacccgctcaaccgtgctcgcgcgttacccgaagcactcgaaaccattgaacgtctgttctga

SEQ ID NO: 96684 - DNA, 156 bp, Glycine max
  Peptide Sequence Number=SeqID_213462
atgcaggctgggttagagcggtctacagcgatggtttatctgcagcagagattggctgtaaatgatccattcatgattgtgctgatcccaaagagatccccgatcgccgcaggccgcaccagctctggcctgaacaggggtccgcataagctatag

SEQ ID NO: 96685 - DNA, 201 bp, Glycine max
  Peptide Sequence Number=SeqID_213463
atgtattataaaaatctaaagctactctatcatcatggacctcatgtatcaaaagcaaatacaaatggtaatgatgctgatgttgcacctgaattttctcctttgaaaactgttcaatttggaaatccttctcaagacactgttgacccaagagatggaggcttcggaggaagactatggagatggaaatgggaaaaatga

SEQ ID NO: 96686 - DNA, 261 bp, Glycine max
  Peptide Sequence Number=SeqID_213464
atggcgagggtacgagtacccaaggtgaggacgtgtagtcctctgaaggttagggcgtgtagccctacaaaggcgaggacgtatagtcttctaaaggcgagggcatgtagccctctgaaggtgagggcgcgtagccctcagaaggtgataggtactagtacccaagggtccattcttatgagaaagcaagagatcgactcatcgagagggtcggtcatcccaaattcaaaagatttggacattattaggaaatctatgtag

SEQ ID NO: 96687 - DNA, 330 bp, Glycine max
  Peptide Sequence Number=SeqID_213465
atgctccacaggccgcaggcgcaccaccaccacctcatcaagctggctcggctgggtcatttgacatggagtagtatttacggcatttggttcgccagcaggcggccaaccaccgggcacatgtacagactcatgattagccagggcttcgcttctttttcatgccctactccagaccagttcaggacagaggtcgcatggcccagggattggcccgaggcccaagcaggagaggcacccccagaggctcccgacgatggagaggaggcccacgaggacgaggagatggccgatttgcttgacttcttgggagggagtgaagctacatga

SEQ ID NO: 96688 - DNA, 543 bp, Glycine max
  Peptide Sequence Number=SeqID_213466
atggctgagttggccggcgctcagcgccgtacgcccccagcgcagggcgtcgccaccggcatcgagcagggtaaaaccgccccaggccgagttggccaggtgcaggttgttgacgccggcggagagcagcgggtgttccgagaccacggtgagcagcgtggaggtgccggtgctgtcggaggcgatgccggcctgatagacgccggagccgagcagggtagcggccatatccgccgtgcccgccaccaccggcacccccggcggcagatcggtaacgcttgccgctgcgggcgtaatgtggccaatcacctcgctggagagatggatggcgggcagttgatcggcgcgcagcccgaactgccgcagcgcctctggcgaccactgcagcgtggcgctgtccatcaggtaatagcaggaggcttcgctgtagtcggtggcgcgtacgccgcagagccggaaattgacgtaatccttcggcatcaacaccgtggcaaatgcgctcccactgcgatggatgatgctcgcgcagccaggccagcttga

SEQ ID NO: 96689 - DNA, 240 bp, Glycine max
  Peptide Sequence Number=SeqID_213467
atggtctttggagtgggaatgggatgttgtgtattgttaataggaaagcctcaatggctagtgagaatggttggaggtcaactcaataaaaaggtgaaatggaagacaaggatgagagctaatgagaatgaatgtcttcttgcacaccttcctgttgaaattcaattctgccttgttggaaaacaaaacttaagggcaagaaccttatcacactgcattgcatatgcatgcgagatctga

SEQ ID NO: 96690 - DNA, 321 bp, Glycine max
  Peptide Sequence Number=SeqID_213468
atggaggaggaggttgccgcccagctcgctcaggagagctgggttgcttcctccttaagtaacccagcttcgaaaatgttctggaaggcccaaattcgaaaatttgaaaattgctatttgcgcccccatcttgataagttcaccccctctttcgtaatttacggaaaacaatatcaagtgaaatatgcttacccaagattttcagaaattttacagaagcattacgaaagtcccggaagccctagaagccattttttaacaaaacgggggaggtggttgccgccgagctcgcccaggcgagctaggttgcttccaccttaa

SEQ ID NO: 96691 - DNA, 207 bp, Glycine max
  Peptide Sequence Number=SeqID_213469
atggtgaccagtgctatggctatgtcacacgcagggagatgccctcacgtccctaccatttttccttgctcccctaaaagccgaaggggggagaatcattgtgaccgggacagacttcttggtcggggaagcagtagaaggttacgtcctcctacaaaggaaaaagttacctccaccaatatgacacgaagccctcaccctctctaa

SEQ ID NO: 96692 - DNA, 480 bp, Glycine max
  Peptide Sequence Number=SeqID_213470
atggacattagcaccaagaggctctacgcaaggttgccaaatggagggcctattgctcgcacagtttggagaaaggagcgccctaaggtcgaaccaccaacatcttccaaggttggaagtgtcttggccaagttgttgtgcacatggttggactatgatgaactgttcacacgctgcaaaggtttgctagaagagaaaaaggacttggctgacagggtggaaggcattgtggcggagaaggacgagcttgccaaggtggttgctgatttagaggtccgactaaaggagttgaagtccaagctagaggcgttcgagttatgggcaaccaagctactccatagagcgattgcaattggggataagtggggttgcattgtggtgcaaaattttaggacaccacttcagttcccgtcaattattgaagagtctgcctcttctttaaatggagggacgtttgattttggagcaccgtcactgtga

SEQ ID NO: 96693 - DNA, 345 bp, Glycine max
  Peptide Sequence Number=SeqID_213471
atgaatgatttcgatcacaatccatccatcccaaacaacgacacagattcaacaacaacaacaacaacaacaacacaaattcaacatagattcaaaacttgcaacaaaaaaggggggcaaggggcgcatgaatttggggtaaggtgcatggatattgatggcacgggatggcgcatggatttggacatcaaggtggttggtgcaacacaaatcaacgacaacaatgcttggtggaatgagggtggggtcgcactcgatcgtgatgggcaaggggtggggtcacatcacggtgatgatcaatgggggtgggaggctaagaagtttggggaaggagaggagctgtaa

SEQ ID NO: 96694 - DNA, 216 bp, Glycine max
  Peptide Sequence Number=SeqID_213472
atgtgcacaacaacttggccaagacacttccaaccttggaagatgttggtggttcgaccttacgacctcaacaaaggcgatggtggcattagctaccttagggcgctcctttctccaaactgtgcgagcaataggccctccatttggcaacctccatctctaagaacaacaccttgcgtagagcctcttggtgctaatgtccattctccttcataa

SEQ ID NO: 96695 - DNA, 255 bp, Glycine max
  Peptide Sequence Number=SeqID_213473
atgaacgatcctctccctgccttagacgatgaagtgcctaaccttgcccccgttttatgtctaagaaattatgggcaacttcacttggagccccttgtaaagcaggtcagacctgtaggtggaattgtgccaccgtctactgttgcccctactactggagaagagggtcaacctactggtgaggttggccctattgctgctattgttgaggtcacccccggtgccccttcctctgttttggcaaagaggaaatga

SEQ ID NO: 96696 - DNA, 234 bp, Glycine max
  Peptide Sequence Number=SeqID_213474
atggtgacaagagaggtattgttaactcgttggcaaatgcaccaatttgtctcaaatattggtatccgttgtgtagggattgatatctcgtttaatttccatgtgacctcgcgcttagcgctggctttcgcgctaagtgcgtctttgaacttcttcatgggccttcttcgctctaagcgtgagctggccgccaagcaaggagacgtgatggctttgccttgcacgctaagctag

SEQ ID NO: 96697 - DNA, 327 bp, Glycine max
  Peptide Sequence Number=SeqID_213475
atggcagaacaagctaaacaggtattttatgttcaagacccttgtgatgaaaggtggtcagtggttctacacgggaaaacaattggtgtcaatgttgaagatgatgattcatacattgataattacgttagtcctttgtccacacaaatgtctcctaacatcatcggagaagaagaaactgatgacattcataattggaaacaagtccttgctgcccataaggatttgatatggaaggatattcaggctgaatttgatatccatgaagcatctgattggaggacgaaaaagaaaatacttcagactgtaggggagtggtggagatag

SEQ ID NO: 96698 - DNA, 528 bp, Glycine max
  Peptide Sequence Number=SeqID_213476
atggttttagtgcattacatgaagttaatagaagagacaaaaactatcccaaggacagtctggatgacgtgcacgcagactgttatgctcattgtataccttctgtttgcctatgctatcaatggaaccctttatcctgcaattgcatttcttggtgtctgctatggtgtgcaagtttctgtgatgctcccaactgtttccgagctttttggtttgaagcactttggcgtgttgagcagcttcatgtcgctggggaatccaattggtgcattcctcttttcagctctgctagcagggaacatatatgacaatgaggcagcaaaacagcatggtataggccttcttcttgattctggtgtttcctgcatcggtccaaattgctttaagcttacctttttcattcttgctggagtgtgtattgccggcatcgtctttagtgttatcctgactctgagaattaagcctgtttaccaaatgctttatgctggaggctctttcaggctacctcaaacatcttcaaatcaatga

SEQ ID NO: 96699 - DNA, 855 bp, Glycine max
  Peptide Sequence Number=SeqID_213477
atggactggttctcctggctatccaggaccagcctagagccgtccctcatctacgaatacggccttgccttcgcgcgtaacgagctccagctggaggatgccatctacttcaaccacgagtttctccagagcatgggcgtttccatagccaaacacaggctggaaatcctcaagcttgcgaagaaagaagacggcggggtggtggtgaggagcagcatcaagttttccatcaagaagtgcctgaggaagtgcttcagcaagttggtttcgcgcgaagaccaccacgaagcgatgatcatgttgaaggacatgccgcctgagccaaactggtaccaagggaagtggaggagggcaaggcacaatgggaacaatgaggagctcaaaggagagaataataacaacaacaacaagggagttcaaagaaacagaaccattgccttatcagggcctttggatgggaatggaagaataattcatgagaagatggtgaacaacaacaaggtgatgaaactctctggtcctcttgatgggaaaatgaatggtggtaacaatgagagagtgaatgtgtatgcaaatgcaaatagaagcccattgatgggtgctactactcctactagggctcttgatggaaggttcatgggctcaacaaagagccctaggctttctgggccacttgatgcaagaccaacaatggttaatagtagaagtccaaggttacctaggcctttagatgatagggctgacagcccaatgggttatagtccctacaatattaaggtcagagctgatgctgctgattatgatgatgattatgcaatgtggcctacattgtttgaggatcttaaaccaacttag

SEQ ID NO: 96700 - DNA, 324 bp, Glycine max
  Peptide Sequence Number=SeqID_213478
atgtcggccttcatctactcttgcacctcctctacttcacccattactctaactctagcacaggttcgaaatgggtttatgatcccaacatggttggctcatgagaaaaacgcaaggatcaagcatgagcaaaacatgaaaacaaaaggtatgcattttgtagaacaaaaatgccccatgtgtgcagttaggagggtgttatggattttccagcttcccgtgacaaaagacgagaccaacatacaacgcgtgcgtgacgacatgatgcagacgcgcaaaagcacaacatggggatgtacacagtatggcaatatccacaaataa

SEQ ID NO: 96701 - DNA, 303 bp, Glycine max
  Peptide Sequence Number=SeqID_213479
atggtggatagtgacccgcacctagtgtcactcttcatgctaccactattccacgtgtttgagttcttcatgttgaggttcaacttcgaagggatgctcaaagtcatggagaggtatagaatcatctacatgctggagttgtcatcgctcatggtgacgttggcgaagtcagagcttgtgaagaagtatgatctaagctcgctccgatatttgggttgtggtggtgtgctgctcgaaaaggaggtcgtcgaagacttcaaagtcaaattccccaacatgaaaattggacatgtgaacaaatag

SEQ ID NO: 96702 - DNA, 414 bp, Glycine max
  Peptide Sequence Number=SeqID_213480
atggaaggttcgagacccgaacctagtgatggcactgctaaatcgaagcaagagctttctcttcaccttaaggaagagtatgagaatgtgattaagtgtgtgaaggttttgagagagagtgctaatggcaatgatgagcattcgagtctttcggtgttggcaatgaaggcgtggttagggttgggaaggcatggagaggcgaagaaggaattgagggggatggtgattgacaaagggatttcggagagggtttgggtgtcaactatggaggcctattttgtggcggtggggacgacaagggtggaaatcgtgaaaggggtgttcttggggctattgggaaggtgtcatgttagtgtcggcttgacagtgagggtggtgcataatatttacaacaaagaaaactccattgaataa

SEQ ID NO: 96703 - DNA, 189 bp, Glycine max
  Peptide Sequence Number=SeqID_213481
atggtgattttcccttatgaatctgagtctttcacatctcgttgttctccaccatcctccaccgtaggccaaggggagagatacatacaaaggtatcctgacactcaaaatcctcacagggtgacacctactcaaccccatgcttgtcttagatttcttaggtatagctcgaagattttggccatctag

SEQ ID NO: 96704 - DNA, 708 bp, Glycine max
  Peptide Sequence Number=SeqID_213482
atgggtgaaagggtgaatctgcctgaagtcatcttcttctattggcttcaagctttcaaggacttatttcatgccaaagataagaagaaccttgttccgtatgggatgtttttcactcaaatcatgaggaatagtggggtagatgtgtttgtgttgaaaccatttgcaggtggcacacaacatagagctactccaacgactcactttcaaattattattagtcagcatgttttgtatcaaaatgtcaaatgctacaagggcaagcaattgctgactaaagatgatgaagatgctgagtctattagattggttaaagctcgacttgatcatctattcaaacatgaacttgaagctttccaacacaagtatgtgcttataactttgtatcgatatgccatgaaaaggttctacaggatgtggaaatgctgctctggtttggaatctaaggagaagccacatgcgaatgcctatcatcatgaagcacttgctcatgccttaaaggattatgctcatgctgagaaggaagctcatagatggtctttgaatggtgatgacttctacaggaaagccattgggtggaaacctcatcgtcctccaatgccacttggtagccttgttcatctttctattaattttgaggactctggagatgagtttcttaggaatcttgatgaagaagttgtcaaacaaaaggaggagaaaatgtaa

SEQ ID NO: 96705 - DNA, 192 bp, Glycine max
  Peptide Sequence Number=SeqID_213483
atgcctaattcattgttgagggagtatctctcacaaagaaaccaggcttcacaggagaggactatccatatcggaaagacaaaatggagatctctaggatacaccttccccaaagcttggatcaacttgaaaatcccatacaattttcccaaaggtgtgggaaccaaaaataacaactatccaagaaactag

SEQ ID NO: 96706 - DNA, 855 bp, Glycine max
  Peptide Sequence Number=SeqID_213484
atgggctcaaaaatctaccttaaggttcatgagaaccctagggccttctttagtagctctagcccaagcctcttggagtcttctatccaatatccttgggggccaccacctcagtgccacaaggtcgtcagccaatactccacgctccttgctcccctcaccatcgacatcattctctttgtcgtggatgtcgccaagcccaacatggtcgatctctacgatgtcaagattgtgaagaagcttgacgacatcgtcgacaacaccgagctcatgaaagatctcatgttttacaaggttctggtggttttggtggtggcggtgggttcaagggtggtggtaggcaaaggaaggggcagtagaggaggaggaggagataggggtacacctttcaaagttagaggcagtgttagaggtggtggtggccgtggaagaggcaggggtggtggtcgtggtggcggcagaggtggaatgaaaggaggtagcaaggttgtggttcagccccatagacatgatggtattttcattgccaagggtaaagaagatgctcttgttactaagaatcttgttcatggtgaagctgtttacaatgaaaaaaggattattgttcagaatgaagatggttccaaagatgagtatagagtttggattccttttcgatccaagttggttgctgccatccttggtggagtttacaacatatggattaaacctagagccaaagtcctttacctaggaactgcttctgggactgatgtagctccatgtggagcttgtaggccttggatcttgttcatcaatgaagtcctttgcttcttgaagttcaatggcagcagaatgaagaaggaagaaagatga

SEQ ID NO: 96707 - DNA, 345 bp, Glycine max
  Peptide Sequence Number=SeqID_213485
atgttcattctaaccccaattgtgataaactcatctcttacctctaagcgggctcatggtttccaagctttagagagaagaggaagagattgtagcctccattttactgtcacgtgtgagactaatttctctctgcaaaaacattatttcgcaagtcccaatggtgcaagtgtgcgaaaatgggttccaaaggtggtgtccaaatttcacaaagatccaacgcttgaagattccgggatcgtagttttactgcgacagatgaatggcagtggaatggagaaggaagagagagaggagatgccacttcaagaagaagatgagtctagaagaagctcaccaccatag

SEQ ID NO: 96708 - DNA, 750 bp, Glycine max
  Peptide Sequence Number=SeqID_213486
atgtggttaatgtctgtgatgatctcaaactttcgtttgtgggagcagatgagcagcaaccagacaaacacttcatatgaggcatcttccttatcagaacattgtgatttggccaattcaagtgcattaaagaggccaaatggtattgataattctgatttgatagatgatgctatgtcagaggactttggtacgggtattgagattcatgatacacttttagaaggttgtgactatgtattacttccccaagaagtttggaaacaattatttagatggtatggcggtgacctacattggcaaggaaagttatttagttcaggtctttcccagactgaattggcagtagaggaaactattggacagcttcacataaaagcttgtggaatatttaatcttcagccagaccaaaatgttcctcttgcttgtgcttacacattgcaatttatcactattgtttttattttgattaatgataatattcaatttgggtctgaacatagggaagtgaattatgctcttgtggagccttcaaaatcaagcttatcaattgttggtggcttatctgctagcagaggtgcatctagaggctacaacatggacctttctacatctcggaacctaaattctccagttagagatgtggaaaacccttatggaaccattggtgtcaccacaagaggttcatttggtggtctcattggattgctgaatcttggcaatacttgttacatgaatagtgcaatatag

SEQ ID NO: 96709 - DNA, 270 bp, Glycine max
  Peptide Sequence Number=SeqID_213487
atgtccttcagcataatattccttaacgcagttcacctagtcatctgctcccccgaacacaaagttcaagatcatcacaggatccaaacacaaacaacaaaccgggagtcactctcactaagtaagatcatagggagaccagtcagggtcacgatgttttgcgagaatgctccaaccatatgggatcaacataggcttaaaggagcactcaaacccagtgacccccaaggcctacactccgaagagtccgtcagggtctctccctcctga

SEQ ID NO: 96710 - DNA, 1725 bp, Glycine max
  Peptide Sequence Number=SeqID_213488
atggcgaaattgaagataggagggacatgggcgggggttctggaagaggtggacctccaagcctggaccctcgccacgctccgcgaccacgtcgccgcccgatcgaacactccctccgactccatcaacctcatctgcgccggcaaaattctcaaagacgacaccgttccgccccaaaccctcgcccaactcggcgtcaaaagcaacgccaagatcctcgccactcgcgcctccactcctcaacaaggacactccttcctcgcccaggaagaacgctcctccagactcgcgcgtatcagggcggctgcgaatgcaatggcagaaaggcatgcggatggtgcgttgccggttgaagacttcaatattgaagttgaggatcagaatggacagaaagtgcgtttaggctctgagactgatcagagggcagtgatgatgggactgatgcttcacgcgaaggggaagcgacttatcagacaggggaattacaaagatgccctggaagtgcttagcatgggagagtgtcggggtaacgtagatcaaacaattaagaggaactactatagggaaaagaggaaggagtcattctctctttgtgatccaaaagtcattgagctcattgacaatgttccgatactacaaatagacatggtatggtgctattttatgatacgagacatcaaatggctctcggatgcagggaagcgtcttgaaatggccagggaaggtattgaacgtgctcatggaaaggattcttttcgcctcaggctcttgcaaggaggtcgctatccagaacttgcattacatttgagactagagctacttgaaggggtggtggcgtatcatactggccaatttgagaaatccaaacaaacattagcctcagcaaggacaaagtttatccagctgcaagtgccggatgaagccttatcacttgttatgagcatgggttttgctgaacgtgatgcaaagagagcattgagaatgaacaatcaagatgttgggggtgccattgatttccttgctgaggagaagacaaagaaactgcgaaagagggaggaggatattcggaggagaaatgaaattaaggaacaaaagcgatatgggatgacacccttaaagaaagctgtggatctagagagattgaaggaattggtctctattgggtttgacaaggagcttgctgctgaagcccttagaagaaatgaaaatgacactcagaaagcattggatgatttgacaaatccagaaactaattctgctttacaggtcaatatcgagtccaggaaaaggaagagacagaaagcagcacgagattctgaaattgaaaaagttgtgcaaatgggttttgaaagatcaagagtggttgctgcttttgaggccggaggtagtttagatgaagtattgcaaagactgacagcacaacctgggactgaccccatgcaacctcgagaaaattcagcttctgcttcccatggtggtgcaagttcatctgctcctttgccagacaatgttgatgctgatttagcgatgtataaggttgaagatcacagtaaaacagaacaacgagatgtagagatggaagatgagctctctgcagatatagcgaaagcagatgccttggctgattatgacatcgaagttactgtagaaggggaagccataactgagtaccttgccctggttgagtctgcaagctgtcgtggggaaactgttccttcccagtaa

SEQ ID NO: 96711 - DNA, 318 bp, Glycine max
  Peptide Sequence Number=SeqID_213489
atggagagtaatacaccaaggagcactagcttcagaagtgcaaacagtttgtctagaaagtggagaccacgggttacaacattgagaagtttgaagaatcttgacaccatgtcccttgaagagcttgttagaactttaaaggtccatgaacaagataaaggaatcaagaagggaaaatctcttgctcttggtggccagaaagtaaagaaagcatcatcaaccaaggaatcctcatcaaggccattgtccaaaagtgcatccaaagcactgagcatagacaactcttctaatgaggaatttgaagaagaatctaattag

SEQ ID NO: 96712 - DNA, 888 bp, Glycine max
  Peptide Sequence Number=SeqID_213490
atgggaatgggtggaaatggaaaaagagtttgctggatgagaagagaacgattaactcttaggaaaaaacatggaggaatgaacttccaggatctccatgacttcaacttagtcctcctaggcaaacaagagtggagactgttaaaacaccttgactctctagtatctcgtacacacattttgctgatggttgcagatggtgcattggaaatggagccacaacaagggtctaggaagacccatggctcaggggaccttattgaccaagataagggtaactggaacctggatatccttaacagtatcttagactgggaggacgataatgcttatttagtctgcacaacataccatggggatcgtgccttgattgatatgcattacttaaaagagattgtttacccaccaggctacatctccaacatagaggtattccttgctttgccacttgtgtcacttgtgaaacaaacctggagaattagtatgtggaaagctttagggaacttattttttgttttaataacagcagctgataacaaccaggttgcgcggctaacgagatgtatagtcagtggaggaatgcgcaaaaagcccagcctcaagctgagtagtcttccattgttgcccaacctcaagcccattggccccttccagctcctggctttgttgaaatgcaatgttgatgcgactttttttgaggaccgcagagcttttggcatggtgttctgcttgtgcgatgacaatgggtctttcgtccaagcttgcattcagacagaaaatttccttcttttcgttgcagaaggcgaggccatcgcggtgctggaggcaatcaaatggcttctcaacctgggtgtggagaatgtcatcgtcgagtctaactgcatttag

SEQ ID NO: 96713 - DNA, 279 bp, Glycine max
  Peptide Sequence Number=SeqID_213491
atggagggtggcgccgccgtcagagtcttcatcgaaaccgatggcgagggaggaggtggaggaaggggatgtggcagcggtagcggcggcggaggaagaggggcgtttggggccgaggaattggctgagggtttgaatgggtttgatgattccactgaagatgaggcggaggatgttctagaaagggccgccatcggaggcggcagaggaggaggaacagtcgccgtcgaagatcacgtagtcgacgcggatgacgacgttttcgacctgcgggactag

SEQ ID NO: 96714 - DNA, 624 bp, Glycine max
  Peptide Sequence Number=SeqID_213492
atggctcgtgcacgagaaggaggacacatgccgcaaaagggcgctggcgcatttgagcctactttaaaaacccgcacaaacctaactcgtggctctaccatttttcgtagctgttgttcttgcacatatgcggactttgcaaggctattaacatcatgcaactttggtgtctatgcaatggactggatagtgctgatgtttaacaatgcttgttgcagggaacacgcaggtcatcaatcagttggtggtgaacaacaactgcaaccttcaatgttgcttcaagaagttggtgttgttgtgttagtgttacttggttttgcacctccttccaccttttttgctgccagctcatccaaggttattgaaatcattagtgatgttctatttttgctggaagtaaatggaatcaatgataaagttggcattgaacttccagatgaaactgatgtttctgtggtttctttggatgagcaactggaagactggactgacaaagaaattagtgatttttcatctttgataggtgggtcatatgctcctgatgcccttgagccattaaatggagtccttaccattccattgacaaatgatgcctcagtgaatctccatatgtcaaaggtatag

SEQ ID NO: 96715 - DNA, 291 bp, Glycine max
  Peptide Sequence Number=SeqID_213493
atgaagatccaaaatgagaaatgcacgcaacattgcaatgaagcaccaaagagaaaaaagagaggtgagagttacctgaggcttgctcacgtgcaagaacaacagctacgaaaaatggtagagccacgagttaggtttgtgcgggtttttaaagtaggctcaaatgcgccagcgcccttttgcggcatgtgtcctccttctcgtgcacgagccatcgccgcctcaaatgcttctttggcgaaggaggcagcccaaccgcggtggagaggcggcaccaatgagggagaataa

SEQ ID NO: 96716 - DNA, 357 bp, Glycine max
  Peptide Sequence Number=SeqID_213494
atggcattgatgtgcactgcttggcaggcttggtttagagaactaccaactagagtattggaccctttttcgccagagcaggtgatgcaatcccagtcagaagaagaatgtgctcagcttgtgaggcttcttcctccaacagaagttgctttgctagattgggcaataaatttaatggcagatgttactcaaatggaaaacttgaacaacatgaatgcacgtaatattgcaatggtttttgcgccaaacatgactcaatatacagttttgctcttagctccaatttttgttattgagttcataccagtcaaattcatcttattggatatagcatcaatgagtaaaaaaacattttga

SEQ ID NO: 96717 - DNA, 390 bp, Glycine max
  Peptide Sequence Number=SeqID_213495
atgattgatacctcaaatccctacactggggcaatgaggggcactgtgcatgagcctcaggcgaacctaggggcagagggatgcacgccctcgccttcagaaagctgcatgccctcaccttcaaaggactgtgcatcctcgccatcaaagggctacaccccttcgcctttagagggttgcacgccctcgcctttagaggactacatgtcctcgcctcaagagggctgcacatcctcgccttcagagggttggacgtcatcgcctttacaaaactacatgtcatcgcctttagagggctacatgccttcgcctttagaggaccacacgtcctcgccccaagagggctgcacgtcctcgccttcagagggctacacgccctcgccttcatag

SEQ ID NO: 96718 - DNA, 372 bp, Glycine max
  Peptide Sequence Number=SeqID_213496
atgagagttccaaatatcaactcccagagtcatctgctagcagcttcttcacttgctcgatctggggcagcgatttcaattaatgagggcaagaggaggtgtgtttgcattgccgcaaatgggaggcctctttgccaaattagcgaaagctattgcatgctttgtcataaacgtcttgtgctctttctcgtttcatcgtcaacaccagctcccatgtgcactatggggacccttacgagaaagagaagagagagtatgagagggtcagctgagtggaggcaggaaggttcaagaattagggttcgcgaaaggagaagggggaggacgcattttgcctttttttgtttctcaattacgatgggtttttattaa

SEQ ID NO: 96719 - DNA, 483 bp, Glycine max
  Peptide Sequence Number=SeqID_213497
atgcctttcaacaaaattctcacaccggaaaccaaaaacccagatctaaaaaacccaagtcgagaggaggaggcttgtgatggcttccatgttgtggaggaggtttgcggtgatgaactcggacgcaagatcatgcgcttgaggatgtcatggtgcatcgggagtaggaccttgctggcgatggaggtagtggtagagaaggaggttccaaaagaaggggagcatgaacccctgatcgccccatctgtccttggtcactgtccttttcatcattacaagactatccattttgttgtttggctaatgagggagtttagagttgaaaaatcctggactcagttgctgaatgtcagttatgagtatcttcaaactcctggacgttgtctatgtccaatgagacttttgtacatgtctgaacatgataattcctgttgctggcaaacaattgaagctgaagaattcgttctctataataagagataa

SEQ ID NO: 96720 - DNA, 702 bp, Glycine max
  Peptide Sequence Number=SeqID_213498
atggtgttccaagaagcaaccagtggtggcattgtcaagcttgaagtagaatacattgttggaacctatgcatcatgtcaagcaatttggcttgattttctactgaaggagatcaaagttgaagtgaagagacctctgtacttcatgattaacaacaaatttgcaatcaatcatgcaaaaaatcttgttgcacatgggagaagtaaacacatagaaacaaggttccatttcctaagagagcaagtgaagaaaaggataatcgaagtgacccattgccccactcaagatcaaccagctaatgtgcttaccaaaccaatcaccattaaccatttccttcaattggttctaacaaatcccaggcctaggcctatccaagatgttcatgccgctgacaacaactccatgaatgtgggaagaatgatgggtcaatttgcgaaattgagatccaaagagatgaaggagacagatgggatgaaactgtcgagttacaagggagataatgtgaatggagatgctttcgaggagaaaatgagaattcctgatcctgaaaggctgatcagagcgtacaacaaatctgttgtgactctaagtcttctgaaggcatttgctatgggatgccaatggaatttggacttctcacaacacaacgagcaaggagacaagtactcatgggtaattgaaattcacacagatctaaaataa

SEQ ID NO: 96721 - DNA, 1406 bp, Glycine max
  Peptide Sequence Number=SeqID_213499
gtgtgcttgatgtttttgagaaaggaattaaagcactgagtgaaagtgcgactaaggcacaaataacagcttacatggaagaattaaagattgatggaagagcattgtttctgatccaccaattgtgcttcaagggtgacgaaagagtcaagaaagtgcgacttcaatcactaaggaggaaggtgcaatgttccaattgtgaaaaatatggtcactatgctaatgagtgttggttcaagaaagggaagacaagtagaaataacagtgaagaagccaatgttgcccaggagcatgagtctaattctgatccagttttgttgatgatgacaaccagtgaaggtgaatcacatagtgaaaactggtatcttgacacaagatgttcaagccatatgactggaaaagatgacaaggcttcaatgattgaggaagttctgtttgtaccagatatgaagtgtaacctaatgagtgttggacaattaatagaaaaaggatttccagtggtgatgaaggataacgacttagaattttttgactcaaggcaaaggttaatgctgaagtctccactgcccagaaataggaccctccaaacatcaatcaaatatgcacaagtggagtgtcgtctagtagctaaaactgatgaaggtctgcctagaatcacatcacttgataaatcatgtgaatcatgcatgcttggtaagcaagcaaggggaaaccagtactttgtgacatttgtggatgattatagtagaatgatgtggctctacatgatcaagcacaagagtgatgtgtttgagattcttcagaagttcaaaactatggctgaaagacaaagtgagaagaaattgaagatcctcaggatagatggtggaggagaatacacatctagagaagttgaatgtttttatgagaaaatgggcattcaacatgaagtggttgcactctatactcctcaacacaatggacttgtagagaggagaaataggacaatcctcaaattatgcagaagtatgatgaaacagaagcaattgccaaagtccttttggggtgaggtccctaaagaggtctggaatggaaagaaaccaatgatcagtcatctcaaggtgtttggttccctatgctacaagcatattccagatgctaagaggaagaaactacattataagagtgaatgcatgattttgattggatatcatagtacaggtgcctacaggttattcaatccaatcaaaaagaaggactgggagaaacaaaagggccaattgaaatcagtaattcctgaagctgactcgcatcaggaagttgaaactagaaatgaagaacataatgacttagacattgaaggagcaaatgataccaacctaatgcctgagagtagtgaagtaattgagggaactagtgcaaattag

SEQ ID NO: 96722 - DNA, 927 bp, Glycine max
  Peptide Sequence Number=SeqID_213500
atgataatggtggcgacagctgccattaatagcaacggtcggtggccacgatggcattggctgtggcagtgtggccattggctggtgttgtggtgggtggtggttatgacatcaatgatgattggtagctgtgggacaatggttacggtggtttatttagtgggaaactctgttgttaagatttttgttgaaggaggactggaagcttcactttacggtttagggacagagctagagtttcacagtctgttggatgaagccaattcccctctcagtaaacacattcctaatgttctggccagtggaattatttatcttgaaaatggatcttatactaatttaagttgggatggaaaaggaatccctgatgtcattgtggaaaacaatatgatcaggaagaaatgcagcattgacggtttctcatttggagtatggggcaagaaacagttagagtataggaatgctgggatgccggtggatggatcagttagcttagctggtaactcaagcatatggccatatatgataacaaaacgatgtgaggggaatatgtttgcagaattaagagacagactaacatgggaagatacaactaacttggcctccttcttgggggaacagctgtttcaccttcatcttttatcatatccacctctaaatgtttcatctttctctgatattgaacatgaattaagcttgggtgaggctaatggttgcattgcaactgttcactgtaaatcaaactctgcagcagaatggaggctcttcaccagaaccttaacaaagatgaggaaggatgtgtcaggccgtttgaccaagtggggagatccaattcctagcaaactgatagagaagattgatgaatatatcccaccagattttgctgaactgctaaatatatctgaggtgctattgtatcttgcatga

SEQ ID NO: 96723 - DNA, 300 bp, Glycine max
  Peptide Sequence Number=SeqID_213501
atggcaagagggatgacggtggttgcacgagggaaaggccatgatggtggtggtgtgatggtggtgacgcaatggtggtgttgcgaagatgaacacaaagagaatgagggaagtgaaagaggcatgtgggtgtggcggagaaaagagagaagaagggtgtgcatgtggaggtctggcggagaaaagagagaagatgggtggggtgggggtggagagtgtgtggggaagtgggaaagacaacgtgtggggaagggggaaaattctagagaagtggcaaaattaaatggagaagtggagtaa

SEQ ID NO: 96724 - DNA, 376 bp, Glycine max
  Peptide Sequence Number=SeqID_213502
gtacctagagcttgctcaccgaattgataacacccttggattcatggctgctgcaggcctcacggtggaccatcctataatgaaaacaactgagttttggacttcacatgaatgtttgttactgccctatgagcaatcactcactaggttggattcaacttctggtctctactatgactgctctgcccatatgctttgggttggggaacggaccaggcagctcgatggtgcccatgttgagtttctaagaggagttataatccccttagcattaaggcttaatgcttcacaatctcttgagcttgctttcaacatttctgaacgcctcaaaaagaataggatcggatctgatcttaacagtatcttttctctgtag

SEQ ID NO: 96725 - DNA, 249 bp, Glycine max
  Peptide Sequence Number=SeqID_213503
atgaatgtccaaatatttgcccctaataaactaagattggagtatctagaaccaccagattctatggtagaggtgaggtcacttcaaatgatggaaaatggggtagaagtagatgaaatggtggctgaaacaccattgacgtatatcatgggttcgagcttcttatgtcacaaatcaagttttaatgattgcaacaacttgaaagcagaaccgatgacatttagtaactcgcatacgaggtccaagtag

SEQ ID NO: 96726 - DNA, 297 bp, Glycine max
  Peptide Sequence Number=SeqID_213504
atggggaaatttgccggcgagggaaccatgacggtcatgttggtggcgacgacagtggccatggtggcattcacgatattggtggtgatggtggtaatggtagcaacgatggtcatgttggtggcggcaacagttgtcatggtggcaattacagtgttggtggtggtggtggcagtagttgacggtcatggtggttgttgtagtggtggccatggcaggtttggtgaaaacgatcatgacaatgatgatggtcatggtgatgataggtttgagatattttatgatggtataaattaa

SEQ ID NO: 96727 - DNA, 903 bp, Glycine max
  Peptide Sequence Number=SeqID_213505
atgggggagggatgttgtacgcagccttacccttgcatatgcaaagaggctgtttccggattcgaacccatgaccaacaagtcaccaaggcacaactttaccaccgagtcaacgagttatcaatggattcttacaagtctacaagttgagttcacgagtcaagtttatgaaactcttacgagtaatggacttctttatactggtggggaggaccgaaatatcacggcatgggacattaagactggaaaagttgcatattgcttggaagaagcacatactgcccgtgtgaaaggtattgttgcgctcacagatagtgatggtgctacaggggatgataacccttacctagtggcatctgcatcatctgatggaattatacgagtctgggatgttcgaatggctgctagagagaagccactaactgaacataacacacggtcaagactgacatgccttgctggatcatctttgaaattttgtcttatttcacttcagaaaaccaagaaatcaaacgaccccaggatggaaagagttaaccaaaggtggtcaaacaacaatgtgcctagtctggaaagagtatatcaaaggattatgatactgatacgctccccatcctttgctcccctcgttacatccaatgttggtattgagtcatttttatgttgttaccctcacaaattttgttcatacttcagtctggcatatgacctatttttgaacaagtattctgagttgaaacaggaaatggtcatcactaaacttgcaagcccatcagctctcataatgagtttcccaagcctcgacatgccaaaatccttccaaacttgtgtctaccttaatggtacttccattcagcttcattggtgtcttggcaaggataaagagaacatgaaacctgaatga

SEQ ID NO: 96728 - DNA, 696 bp, Glycine max
  Peptide Sequence Number=SeqID_213506
atgggggattcgatccacgacctatccctcccccttctccctcaagcatcaagccaacctagtaacttcctaaaacttcaaggagtcaatgtaatttactcactaatcaatgatgcaaacttggtgttcaacaagtgtagcacagagaacaggcttggggcattcaaattcgaacagaatcctcgcatcctcggtctggtggacggagaccttctccttcaccaccatgaagaactgatccccagtggcatcaaactttaccaaacttgcctccttgccgaggcgcagacagcagttccggcgccctctgacgagattgacgacggcgaggcaatcgtcacgggcgacggtgagggcgcgctggccggaggggtggagggcaaggtcgttgatggcggcgttgcggtggacggagatggtcgtgaggtggacgaagccatcggcgtcgaagatggagacgttgccggcggcgtcggcggagacgaggttgcgggggaaggggaggtggggaggggcgtagaaggagagggcggtaacggtggcagagtgggtgtggagggagccgagggaggcggcggcggcgaggtcgtagagctggatggtgtcgtcctcgccgccggaggcaacgacgggaccggagatggcgacggatttgatggaggagaggtgggaaggataagaaaacagaggggttag

SEQ ID NO: 96729 - DNA, 375 bp, Glycine max
  Peptide Sequence Number=SeqID_213507
atggcgagtttgctgtgcaacgcccacgtggcatggaaaccgccaccacgagtggcgagttgcttgcaggtggaaaccgccagcatgactggcgagtctgctcctggttttggaaaccgccagtcaaactggcggatttttccgcataagcaaaccgccagccaggctggcggttccttctcaaaccaattcgccatccgtattggcgattctgctgctgctgcacctccgttctgcaccattgctgcacctcctgcgcgcctagtgcctagccctcagcctaggaactcgccagtcaaactggcagttccctatgcatggtcatatcgccattgcaagcagcgattccttcagaatgaccaaactcgccaatga

SEQ ID NO: 96730 - DNA, 365 bp, Glycine max
  Peptide Sequence Number=SeqID_213508
cacccaaaccgcaaaaccccttgtctcccttctcgtcaaacccacttgccactgattatctactctcgggcttcaatgcggcactagagtcatggggcgtggagggactcgagctgaagaagctaaacccaatattcgcagcaggattcagagaagatctgcatcacattgtggaagaaggaggcggtgaagagtggttagaaatcgcagtaagaggggaaaggaagattggggagagagataggcgtcagcaagggacaaagtgggaaaagggggaaaaatggaccaaattggatggatacgtccaagatagaatgaatgaaggtgtaacacctaatgggcaaatggggaattttgggatttag

SEQ ID NO: 96731 - DNA, 864 bp, Glycine max
  Peptide Sequence Number=SeqID_213509
atggataaaagctgtgatccctctgcagactctactagcacatcccttcctgccaaccccaacaacaatagcagggatcaatatcttcgccacctcaacaagctttctcaaaagatctccaaacccctcattaagaaacccaccttcgaccctcctcaggcccaagcccaagccccaaacccaaacaatcaggtgcaggcgcagcagaacctgcaacatcagccgccggtgtacaacatcaacaagaacgacttccgtgatgtggttcagaaactgacgggctcacctgcgcacgaccgtatctcaacaccgcctcccattcagccacccaagccaccgagttcgcgtctgcagcggattcgtcctcctccgttgccgcaaattactaaccgcccacccccgctactcaaccccaccaccctcccccgccctcaactccctaacgccgttaccttcaacaacttctccgtcttttccagaccccccgcgccgttatctcctctgccgccgttccccaccgtccacgcgcctgctgagtcacccatctccgcctacatgcgcgatctgcagactctcgtcgattcaaacgccagacacttttctggcttttctccctttcctccaccgcctcagcctcaacaagagcaacagcagcagcaagcgatgcttccgtcgcaagcaccgtcgtcgtttcagctgccgtcttcgcctgtgccgtttgggtgtctgaattcgcagctggcgtcctaccctcttctgtcgccggggcttctgttttccccaacttctggtcagttagggtttccgcagcttccgctttcgccgaccgtgccggttcctagccctcgctggaagggaatttga

SEQ ID NO: 96732 - DNA, 342 bp, Glycine max
  Peptide Sequence Number=SeqID_213510
atggccaaatttggaatgtcttcatcaatagacatgtttgctacaattggggatgaggatggtgtcgatgtaggtaccggggacagtccacacgcatcaattggggatgaggatagtatatatgtaggtatcagggatgatccacgtgcatcaattggagatggagatggtctaacttcagttggaggtggagatggtgtaggtgcaatatcggaagatttgactggcacatatacaatagacagggatgaggtagatgatggtagactatctttaggtgatagtagtttaaccacatcattttttcttcccacttgtcccttttccactagagtcatgtga

SEQ ID NO: 96733 - DNA, 207 bp, Glycine max
  Peptide Sequence Number=SeqID_213511
atgccaaaattgatagaaacatttggtgtgaccgtaaaaccttatttgccaaagtcggtgttgacgtttcaaaacaaagccgtggacgagagccgaataattcaaaagggggacgatggtcagatggcagatttcacccctaactttgtctcaccaagacaggatattccatcgccacaaaacacagttgtaccattcatacaataa

SEQ ID NO: 96734 - DNA, 321 bp, Glycine max
  Peptide Sequence Number=SeqID_213512
atgaagaatttaaggctagagtatctcaagctagttgtgggaccaaagcgtaagggatgcctttacggtactggagatcttggtcatacttataaatgtggagatgacaacttcgtgcaacatatgcaagaatcttctagtcgcgctcaagattcaacgaagattaaccaactaagggaggagcttcgtcaatcaaaggaggagatgcatcgcgaaacattattcatcaacatcaacaatttcaccagtagcaacaacaagacaatgaccaatcaaatgaccaacaacaagacgatgacagtagagacactctcccaatga

SEQ ID NO: 96735 - DNA, 1266 bp, Glycine max
  Peptide Sequence Number=SeqID_213513
atgagtatgactaagggaataactccaagagattctcttttgctgaagcccaaccctttatcttctcttagttcactccattctctccagcatggtaacaatacgattagagttcctgtgactataagaattcaaccagagaggttttgtcatggtgcgctaaccatcaggaatgaagtgccgcaaaatgctgattttcctcgacagtattccagaaaagagaagaaaccttttccagttcccattgtagaactgcgacgagcagctagggagaggatgaagaagatgaaagatgagccgagaaaaccaatgtcagcacctaagaatgggttgctggtgaagagccttataccgactgcatataatgtgtataatgctaggatcactttgatcaacaatctgaagaagctgctcaaagtagtgcctgtacatgcttgtgggtggtgcagtgaaatccatgtaggacctgttggacatccattcaagtcatgtaaaggcacacaggccaacatccgcaagggcctccacgaatggacgaatgcacatgttgaagacatattaattccaattgaagcttatcacctctttgatcgtcttggaaagcggattactcatgaagagagattctctatccctcgaattccagcagtggttgagctctgcattcaagccggtgttgaaattccagagtttcccaccaaaaggagaagaaagcctatcatccgtattgggaggaaggaattcatcgatgctgatgaaagtgacctaccagataaaatctcagagggccctttaaaaccattactagctgaaatacatgattcagaaatagtagctccattagacaatgaagtagcccctcttgccgaggaaactctccaagcatgggaacggatgaggaaaggtgcaaagagactaatgaggatgtacaatgtgagggtctgtggatattgccctgaaattcatgttggtgcccagggtcacaaagctcaaaactgtggagcccataaacaccaacaacgcaatgggcagcatggttggcagtctgcagttctgaatgatttgatcccaccaagatttgtgtggcatgttcctgatgtaaatgcaccgctagaacgagagcttaggaatttttatggccaggcgcctgcagtagtagaaatgtgcattcaggctggtgctggtttaccagaacaatataaatcgaccatgcggctggacgtggggatcccatcaactttgaaagaagctgacatggtagtttga

SEQ ID NO: 96736 - DNA, 4338 bp, Glycine max
  Peptide Sequence Number=SeqID_213514
atggccgaccacgcgactaggaaaaccactaccgataggctcgaggaggccattaatcgtctctccaacagccaagccactcttctagataaacatgccgacctctttgataaatactcagaactctccggcaaggttgacacgctcctcgatcatctccacctacggtctccagcaagggaacaccatggctcttcctctcatttccaccagcgcaactctgtcaagctggacgttcctaggttcgatggccgggatcctatggggtggatcttcaagatctctcagcttttcgagtaccaaaacactccagaagaagaacgaataacagttgcctccttttaccttgatggtgccgcgttgagctggtaccaatggatgttccggaatggttttattacttcatggtccggcttcctacaggccctcgagtccaggttcgcaccctcctattatgatgacccaaaaggagccttattcaagcttacgcaacgaggcacagtcaatgaatacttaacggagtttgaacggttagctaaccgtgttattggcttaccaccacctttcctgttaagttgttttgtttcaggcttaacacaggatatacggagagaagttctggctctccaacccatttcactcccacaagcaatggctttagccaagttgcaggaagataagctccgtgatcgccgccaagctccaccacgaaaccacaatactccatcagcatcatacgctcctcctactcgaaaaccacactctacgtatgttcagagaaccccagatgaaatggctctccgtcgggaaaagggtctctgttacaattgtgaggaaaaatggagctccacccacagatgtaaaggacgtgtccttctgttcatcgccgataacccttctccgacatcagatgaacccatctctgaaccccccttactcccactcccagcaccaacaccagcatgtccccctgaccttgactcaacctcagaattaactcctcctcacgtgagccttcacgccctctccggccttccctcctccgagacttttcggcttgtcggaatcatcaaccactctcccctcaccattctcatagatagcggaagtactcataacttccttcagccccgacttgcccagttccttcgactaaagactcaaccaacaaacccactaaatgtcctagtaggtaatggatctgtcctcaagtgtgaccaagtttgccatgatatttcactcctcttacaggaccatcactttctggtcacgttccatttgctgcctatcagtggggccgatgccgtattgggcatagagtggttaaagcagtttgggcctatcattactgattacaccgcgttttccatgaagttcacccatatgggccagcccattgagttacacgctgatgtctctactgggccaacaccaatctcggcccctcaagtaaaacggttactacaaaccggagcagcttcagcactctttcatttaaaggtgatacccaacccacaacccgacccactacttcatcttccccacccgataccagcagtccaggctcttctcacccagttccatacccttttccagcaaccctcctccctccctcccccgcgatcaatcgtccaccacataacacttctccctaacaccgccccaatcaatgtacggccctatcgttacccacagttccagaaatcggagatcgaaaagcaagtctcggagctcctcgaatccggcttaatccaacccagcatgagtccctactcctcaccggtactactagttaaaaaaaaagacggaacctggagaatgtgtgtcgattaccgagctttaaacgcagctacagttcgtgatcgttttccgattcccacgatcgacgagcttctggacgagttaggaagtgcgaattggttttctaaactcgacctccggcaagggtttcatcaaatacgtatgcatggtccagatgtggaaaagactgcgttccggacacaccaagggcactacgaatatcgtgtgatgccctttggattgtgtaatgcaccgtccacctttcaggcagcaatgaataccttgctaaagccatttttgcgaaaatttgcagctggccagtattacctcaaaaagacgaaatgcctttttgctcagaagcacatagagtatctagggcacatcgtatcgggccaaggagtcaagccggaaccgtccaaagtccaaaccatggtgcagtggcctacaccgtcatcagccaaggaactccggtccttcctaggacttacaggtttttatagaaaattcattcaaaactatgctatgatcgcggcccctctcacttctctcttcaccaaagatgttttcgaatggtctctggacgctcaatcggcatttgagaaactgaagacagcaatgacatctgcccccgtcctcgcattacccgatttcgatgaaccatttacgatagaaaccgacgcttccggtaccggcatgggggcagttctaatgcagaagggccatcctcttgcattcttcagtaaacaatttggtccacgaatgattcatgcctccgcttacgtcagagaacttcatgcgatagtggcagcagtccgcaaatggcgccagtaccttctgggccatcccttcaccatttttaccgatcatcagagcctccgcgagctcatgtctcagtacaagaaaggatcttcaaacgcagtcgcggatgccctatcccggtcatctccctccggccagttcctcctattatcagtccctcaccttgacttcatgcatgacttacgcaacactctcctttccagcaacgcattccaggaactgctcactaagatccgggacaaacctcatgactatcctgactatcgtattcaccagggactcatcctcttcaagaatcgcatttggctcaataatgatcacccatcaatacccaacctcatgctcgagtttcactctactccgttaggcggacatcttggggtgagtaaaaccactcaccgattagagtccaacttcttctggccctcactacgaaaggatgttaagcgcttcgttaaggaatgcactatttgtcaacaaacaaagcccaccacacaacgccccgccggacttcttcaacctcttccaccacccaccggagtctgggaagacatctcaatggatttcataacccaactaccctcctctcacggttatactgttattctggttgttgtagacagatattcgaagggggtccaccttggcgctctcccgacaaaccattccgccttcaaggttgcttccttgttcatagatatcgtctgtaagcaccacgggttcccaaagagtattgtttccgatagggacccgatcttcctcagctccttctggcgtgagctttttcgactcagtggaacacgactccgcatgagtacggcttaccatccccaatccgatggtcaaaccgaggtaatgaatcgagttcttgagcaatacctgaggtcattcgttcacaatcaacccgctacctggtatcgctacctaacaatggcggaatggtgttataacacctccattcactccagctccggaatgacaccattcgaggtcatctacgggaaaccacccaccacacttcctcagtaccttccaggagcttctaccaacgacgctgtcgactccatgctccactcacgacaagaaatccaccgaaagctgcaacaccgtcttcagaaagcacaggattccatgaagaaggcgacagacaaacaccgccgtgacgtcaactacaatgtcggccaatgggtctatgttaaattacggcccttcaggcagcgttccgtagcaggtcccatacacccaaaactatctaagaggtactttgggccatttcagataattggatgcgtagggcacgtctcgtataagctggaattacctgaggcggcaaggatccaccccgtcttccactgttcgttactacgcgagcatcacggccctccaccaccccgacaagatacttggccattggaattcataacccatcagcctgtcccacgtcccttgtgtattttggactctaaactcgacatctcatcatctccgccaaacaaactcgtcctcgtacagtggacgggccaaccccctgaggatactacctgggagccatggtcagaaatacgtgacctttaccacctcgaggacgaggtggtcctcgcgggcgacggtattgataacagtaaccaggaagataccaagattgagcccacaactacaaagacaaagcccaaacgtaccacatcaagaccctgctacttgaatgactacgagacatga

SEQ ID NO: 96737 - DNA, 654 bp, Glycine max
  Peptide Sequence Number=SeqID_213515
atggaacctcaaacaacacctatcaacttgtcaccaacaacaccaaatcttagaatgtcctctaagactcataaaaatcctgcatacttagatgactttgtatgcaacacttcttatccaataaaatcccaccttacttacaccaaactatctccaacatatcacaattatatcctacaggtttcatcaatttatgaacctcaattctatcaccaagattgcaaatcagttgagtggtgtcaagctatgcaagaagaaatcagtgcacttgaagccaacaacacttggtctatacaaccactgcctgcaggaaagaaaagcattggatgtcggtggattttcaaattcaagtacaaagctgatggaagtttggatagatataaagctagacttgtagctaagggttacactaaaaaacttggtttagactttgtggacaatttttctccagtggcaactctcaccactcttccgctagacattaacaatgttttcctcaatggtgatctatttgaggaagtgtatatgcagctgccccttggttatcctaacaagggaaataacatggtgattaaggaaatgacagatggcggtgttgattattgcttcgagtgcataggctttggcttattaatggcggatgcttttaattaa

SEQ ID NO: 96738 - DNA, 333 bp, Glycine max
  Peptide Sequence Number=SeqID_213516
atgtatgaaaaacgtgggcaacccggcccaacccgtgatgatgcaacagggttggaaaaccctagttgcctcacgcagaaaatcgcatggccaaaggggaaccaccacggagggtggtgcgccgcccctggcaccgctagtactaggcccgacaatacgagatcgccacaggggcggcgacagcgtgacgatggtggaggtttcaaggtggtgcaaacaaaaaagagagaaaagaaacaaaaaaaaaacaaagatggtagggctcttaatgccaccaatgaaggcctcacgagtgcgaagctaccacaggttagcggcaaatggtggcggtaa

SEQ ID NO: 96739 - DNA, 795 bp, Glycine max
  Peptide Sequence Number=SeqID_213517
atgaagaaggccagaagggaagagttgagtagaaaaaggttccaaggggctttgttaggcagtagtaacgagctcaagcttagaaaggccgagagagacaaatcaatgatggagaacataatgttgaaggatgagttaaggaattgtcgggaatcaaaggacatcttgaaagggcagttgagcaagacaaaaaagaatatgttgataatcattgatcaatataaagagaaggcaagggaagaagtgataaagttattgcatgaagaaggcatgaagtggatggacaggttcgctttcactctaaatgaaagtcaagagcttccaaagctgctagctaaagctaaggcgatgaatgatgtatattccactcccgatgaaactgcgctttatgacacccttaccagacatgtcaaggcaaggataatgagtgacatagagcaagtacaagagcaaatgaaggatgatatgaaggccatgaaggagcagatgacaacaatgatagaagcgatgatgagcatgaggaagatgatggaggtcaacgttgttacaactgttgttgccagtactgctactgagatggacccgattcaccgcccgatctcaatcaataagtatacttttccaccatacggtttgcctcctgattatacaccacttactgttgtatacactcctggtgagaatatcgctccccaagaccatactctggcctgtttcggggtttatccgagatataccactgaaggacatgcattttctggtgtccccatgctaaacgctccggggggaccttag

SEQ ID NO: 96740 - DNA, 294 bp, Glycine max
  Peptide Sequence Number=SeqID_213518
atgaattatggaagagaaatacacagcaaacttgaaggaagtgcagcacgcacacactcagtgaaactcaacaaaggagaaaaactcagcttgaagaagagaagtgtacataaaacgttgatggaggtgagaccttcttcacgtatctcgccaatagagaaggcgagaccttcttcacgtgcctacgtggcctgggtcgcctatctcgccaaaggaagaagcggaactctagcgtgtatcgccagtggcaatgacagcaccgtccacgtcatcacgtatcgccagtggaaatga

SEQ ID NO: 96741 - DNA, 1644 bp, Glycine max
  Peptide Sequence Number=SeqID_213519
atgatgggcttacatggttgtactctcaaactcgcttcagttcccaatttctcttctccaactttccttttcaaaactccaaccctccgttttcagaaatctccattgtcacgccccatcagagctctatcttcctccgccctcgtccaaacatctactaccaaggccactgaagaccaaggtgtgaagcctcaatggaaggccacgatagacttcaagtggataaaggataacaaggaagctgttgctgccaacttaaagaaccgcaactctgatgctgatttgaacctcgtgctccacctttatgacaaaatgttcactcttcagaaggaagttgagagggttcgtggtgaaagaaatgcagtggctaacaagatgaaagggaaactagaacagtctgagcgtcaaagattgattgaggaaggtgcttttggtgcaaagtttcagccaattggcattttaagtaagaatttgaaggagggacttgctgctttggaagaagacttggcgaagcttaatgatgagcttcaacaggaagcgcagtgtataccaaacatgactcatccagatgttccaataggaggggaggattgttccaccataaggaagatggttggtagctctcccaaatttagctttcctgtcaaggatcatctccaactaggaaaggagcttgatctatttgattttgatgcagctgcagagtttggatgttcaaaagaactagaatattattggcacttgacttcagttttgtctcagatgcatctaacatatgctgcttcacaggtcagtgggtcaaagttctactacctgaaaaatgaagcagttttgttagagatggctcttgtaaattggacactctctgaagtgatgaagagaggctttactccattaacaacgcctgaacttgtgcgatcctctgtggttgaaaaatgtggattccaacctcgtgcaaataatacccagatttattccatcgctgacagtgaccaatgcctcattggcactgcagagattcctgtcggtggccttcatatggattctatactctctgattcattgttacctttaaaatatgtggcattttctcattgtttccgtaccgaggctggtgctgctggcactgcaacaaggggtctttatcgagttcaccaattcagcaaggtggaaatgtttattttctgccgcccagaagagagtgaacattaccaccaagagcttattacaatcgaagaagacctcttctcatccctgggattgcattttaaaactttggatatggcttctgaagatttaggtgcacctgcctatcagaaattcgatgtggaggcttggatgcctggtttagaacggtttggtgagatctcaagcgcatcaaattgcacagactatcagagccgtcgtttgggaataaggtatcgtcctgcatcagaagcacaagccacaagtgcaaaaaaatctaaaggcaatcttgccccacctcagtttgttcatacattaaatgcaacagcttgtgctgtaccacggatgattatatgtttgcttgagaattaccaacaagaagatggatctgtccttatacctgagcccttgaggcccttcatgggtggccttagtgtcatcgccagaaaatcattatga

SEQ ID NO: 96742 - DNA, 1026 bp, Glycine max
  Peptide Sequence Number=SeqID_213520
atggattactatgagaatgagattgctgccttgtgggataatttcaaagtaattcgagcttccaaatctgattctcggttagcaaataacaacctgcctccagagattcagaagcttcgctgccgtgcatgttatgatgctcttcgtttctctccacacattgaaaaaatgggaaaaatattggtggagaggatgaggtcattcggcccttatattgcattacatttacgttatgagaaggatatgcttgcatttagtgggtgcacacatgaattatctgcagttgaggctaaagagctatggattatcagacagaatactacttattggaaaagaaagtatattaatcctatagaagagaggtccaaaggtttttgccccttaactccaaaggaagttggaatttttcttactgctcttggatacccatcaaacacaccaatatatattgctgctggggagatatatgggggtgagtcccatatgactgacctgcaatcccgctatccattgttaatgagcaaggaaaagttagcatccattgaggagcttgaacccttttctagtcattcgtctcaaatggctgctcttgactatattgtatcagttgaaagtgatgtatttgtacattcttaccctggaaacatggcaaaggctgttgaaggccatcgtcgttttcttgggagtggaagaacaatatctcctgataggaaagcgcttgttcgtctgtttgataaactggcaaatggatcaatgactgaggggaaaacattgtctaataaaatcattgatctccacaaaaaacggtatgtgatagaagaagcattaattatatgtgaagcttggcttcagaaagagaaaaggacccgtttctggaacaaagggcttggacaggtaggccaagataaagcaaaagctttttcctttaacagatctatattggtgaaagaattgccgcatgcatcttccctttaccaacgtttcaacactaatcagctggaaggtgctaaaaggctgttggcatag

SEQ ID NO: 96743 - DNA, 279 bp, Glycine max
  Peptide Sequence Number=SeqID_213521
atgtactgtccagggtccataaaatacacgtgtcaagctacatggcactctgagacacatgttaaccctccttgtcagccatggcacaagagcacaaatgttacgcccttaacagtcaagctcttaactgacaagtactcaattatctataagggttatgccctttggcatgaaaaatacaggcgctacatatcagagattgatggaccagattttcaaatagcagattggacgaaatgtcaaggtccacatcgacaacatggtcatcaaattccatag

SEQ ID NO: 96744 - DNA, 195 bp, Glycine max
  Peptide Sequence Number=SeqID_213522
atgtcacaaatgccaggcattcgcagacaatgtcaacgctccgcctttgcccctgaatatgtgattggggccatagagcccaaagctgcaaatgggcatcatttcatcctagtggcgatcgattacttcactaagtgggtcgaagccgcgtcgtacgctagcgtcaccaggagtgcggtggtcaggttcatttag

SEQ ID NO: 96745 - DNA, 492 bp, Glycine max
  Peptide Sequence Number=SeqID_213523
atggatgaaatagagaaggtgcaagagcagatgaaggccgacccggaggccttgaaagagaaaatggccacaatggtagaggccatgatgagcataaaggagatagtggtggtcagtgcggcttaccaaacccgtgctagagctaaaataatggatgaaatagagaaggtgcaagagcagatgaaggccgacccggagtccttgaaagagaaaatggccacaatggtagaggccatgatgagcataaaggagatagtggtggtcagcgcggcttaccaaacccgtgctagaactaaaataatgggtgaagtagagaaggtgcaagagcagatgaaggccgacatggaggccatgaaagagcaaatggtaggcaaagatttgggaagtacgggcggccccccattatgcgcaaattcaaaacaagcatgccttcccaccatatggctggcctcccaactatacaccacccaatgtggcatacattcccaatga

SEQ ID NO: 96746 - DNA, 591 bp, Glycine max
  Peptide Sequence Number=SeqID_213524
atgaagtccaagagatggccagaatcaaagaagaagctaccgagctccgagcatcaagaagttctaatacaaaagttcaaccacgagcctttcaacccgatgaccttgtatggcgagtctgagacgaagctagaaaagatccccgagcaggaaagcttggacctaactgcgctcaatgcgaggcataggcttagtaggaacaacacgcttagcaccagtaggataattcaggaaagaaggctaattcaagaaagagtcccgcttagctcaagttatgtgctaagcgcgaggcgtactgccatacttgctaagcacaacaagcgtgctcagtgcaaaggctcgaataacccaatgtctgcccttggtgagtctcgcttctccaaaggctcgtcaaatccaagttctttccttggtgagtctcgcatctccaaaggctcgcaaaacctaaggtccatccttggtgagtctcgcatctccaaagacttatcaaacccaaggtttgtccttggtgagactaacttctccaaaggctcgtcaaacccaaggtcggcccttggtgagcccttctgccgcaaagttccatctccatag

SEQ ID NO: 96747 - DNA, 495 bp, Glycine max
  Peptide Sequence Number=SeqID_213525
atgaagaaccccacactccgagaaagaagaggaggatcaatgcagaggcgcaacaacacggttgttccattgggcatgctcagaaggtttctcggcgcatcagtgttctcaatagttgtcacttctttcttctttgttcatgttcacgtttctccttcaccttctgatcacaagttcaatgataagatcctctcgtttcgtgacccgcaaagctggactcgagaactcgttccgcctcatctatccaaggctccactctctgttcccaagttgaaggattcaagaaaggattcagactacgagaaactgtggaagcctccatcaaatcatgggttcataccctgtacaaagcctactcctaattactcaatccttaaatcaagtgtaactgttcatccagctcctggaaggtcacgtggttacctttctgttcatacaaatggagggctaaaccaaatgcgtactgggatgttagaaagttctccatctgtttag

SEQ ID NO: 96748 - DNA, 1329 bp, Glycine max
  Peptide Sequence Number=SeqID_213526
atgacttctgaaagcactttcgttcaacctgcaattcctaagtttaatggtcattatgatcattgggccatgcttatggaaaatttcctttgttcaaaggaatattggagtctggtggagaatggaatccctgttgcagtagagggagaggagtttaccaaagcccaaagaaagtcaattgctgagcagcaactgaaagacttgaaatctaatgacttagacactttaaccattgatgaattgcagagtagtatgttagtgcatgagcagaggatgaaaaggcatggaggggatgaacaagccctgaagcaattggatcattttcaatacgaatgtcctaggtgggaggagaaagctaactatgtagaacttgaggaggaaggggagatattgttaatgtcatttgtggagcctaatcagtatgacaaagaagtgaaggaaaaggctttgacttgttttcaagcaacccttgaggacaacactcacctttggcatcgtaggtacgagcatctaagctacaaaggtttgagaaccttgcagtataaggagatggcgagagggctacctcatttgaatgcgtcatctaaagtatgcactgattgtatggtgggaaaacaacatagggatgcaatctctaagaaaagtttatggaaagcatcacaaaggttgcagttggaacattctgacatttgcggaccaatcaaaccagtctccaacagtaagaaaatgtatttcgtaagcttcactgatgattacagttgtaagatgtggatatacttccttgttgaaaaaggtggagaatgcatgtctcttgagttcaaagatatttgcggagttaatggtattatcagacaactcactacagccttcactccccaacaaaatggagtagcgaaacacataaatagaaccatcatgaatatggtcagaagcatgctattaaagaagcaaataccaaagagattctggcctgaagttgcgaactggatagtgcatgtgcttaatagaagtcctactttggcaataaaagacaggacccctaaggaagcatggagtggagttaaaccaaatgttgattattttcgtgtctttggatgcattggccatgttcatgtaccagacagcaagagaacaaagttggatgataaaagctttaaatgtgtgttgttgggggagaaggttggaattgggggatcagcattaaagaagcaaaatttgattttcttaagtgggaaaaaatcaacattgatgaaagtggagaataagttgaagaatgagtcgagcatgagggggaagaagctgaagaaggagccgagaaggaaagggtag

SEQ ID NO: 96749 - DNA, 660 bp, Glycine max
  Peptide Sequence Number=SeqID_213527
atggccagaaagctttttgatgaagagaaaagtatccatagagatataattgcttggaactctatgattaatgcatactctaaacatggcgagtggtttatatgttttcagttgtacacgtacagtcaaatgaaaatatcaaacattaacccggaccaagtaacatttctggggctgctcacagcttgtgttaactcgggcctagttagtaaaggcaaggagattttcaaggaaatggtggaaatatatggttaccaacctagtcaggaacaccatgtttgtatggtttatctactagaatgcgctggccaaattgatgaggccaatgaaataataaaaactgttccattggagtcagatgccagggtttatggccccttgttgagtgcctcaggaaagtgggacaaagttgctaaattgaggagttttcttagagatagaggactgaagaaaacaccaggttgtagctggcttgagttaaatggacaagttcatgagtttcgggttgcagatcaatctcatccaagatgggaggatatatattcaatattaaaagtgctggagttggaagcaggggatatggaggatgatcttgaactctttgacccttctgttgttaagggatgtgaattgcacatgaatcaactcaaccaaatttaa

SEQ ID NO: 96750 - DNA, 1368 bp, Glycine max
  Peptide Sequence Number=SeqID_213528
atgtcttctttcatctctggctttgccataggtatgggcggtagcgactccgagggttcgattcaacaacccctggtggaccgagaggtcatttccatcgatagttccacgtcgaaggagactcgtcatggggcttctgataacgagtcttcttcctcggagaggttgagggtattgtgtcgtgctggtggagacacttctcacctccataggagggtgcaaccttctattgcttttccgattagggaaactgttccgtgctgggtcgccatcgtcccccctactattgctggctttgaatgggtgagcgacgatgttttgaagtatcgatcttccattacctctacgatgaagttgacaagcaagattggttgggtctccttgaacaatatgtccaagaagctattcgagtgtgactcgaacgtgtttcactgtttcaaggaaaatttcttcaaggtccaggctactgacatcatggctgatggcttaccattaatgttcaacgaggatggggagccccgcttcccgttctactggcagtctaatcccaccaggtttaagtcatttaacaaggatttgttaacccttgtaaagaaggttgacaaggctatattggagcaattgtcggtctcactggatgcgtgggcaattttgtctcttccttcgcctaacacttgttgtgttattgctgtttgttttgcaagtattatgggtgacttctcttggaggcccttagtgaagaaggttggccctactactgaagttgttgaggtctcccctagcgttccttcctctgttatggctaagaggaagcaagatgacaacattgaggctgtagggttgacacctggttcaggtcacccctcaagtttgcaagatctacctccaacttcatcggccatccaggcttctactcctaatgctgctactattgttgttgcttctacttctccacctccttctgttgtgtttgttcaggaggtcgctcctactgctgaagttagtgcaccaatcgctttggttggtcctgttgtggctccttcatccactgtcgttgcatccttgctgagtgccagtgtgacgaccgcaagtgctcccaagatttcacctcctccttctttagctctgccagttcccctttcagctaaggctattgattctgccaaggctgaggttgccaaatggagggtcactactcgtatagtttggagagtggagtgccctaaggtggccaatgccactgtcaccttcgttgaggtcgtgaagtcgaatcatcaactgtccttcaagattgggggtatttttgccaagttgttgtgcatcaggttagatggtgatgagctatttgagcactacaagggcttatag

SEQ ID NO: 96751 - DNA, 1146 bp, Glycine max
  Peptide Sequence Number=SeqID_213529
atgccatcaggtgctaagaagaggaaagctgccaagaaaaagaaggaaaaggaaactgaaattaacaccaacccttcaacaaccaaccctcaagatgggtatcttttaattgttctcttcttgcattcaggggggaatattcagcttgcaaatctttttcattcaataaagattagattttactgtgtaactgtgaatgatttaatgattgattgtgttttgggggggaatgatgaggtgaagtcacagtctcaggacgagaaaggaagtgatggtggtgagggtggttcaccagcacatggtgaacatgatcctgcattcaatgaagaggaggaggagagggacccttcagctgctcaaccatctcatgctgcttcttcttccaaggacttggaggaagcccctggtgatgctaagatcgatgaaactgaaggacgaaaagaaggtattgttgtgatacagtgggatatgaaatctgagggttctgagagcaaagatgtgattgttggacatgttgagtctgccaaggaatctgatcatgggaacgggaataggaactacagcagttcaagttcaagcgatgaaaccggaaccttaaagaactcaaagaatgagtcccataattcagtaaatgagacagttggatttgatgagttggttaaaaccatggactctttgcatgccaaaatgacgtcgattactcaaaatgtgctggttgaggagactggtgattcggttgtggaatcttctgctgatatagctaaagtagtggctgctgtacctgaggtacaaaccattgataataataatgctttattggagaaatctacaggatctcaagtagaggcaacttatcttgcggtggagaaaaatgaggataaagaacattcctcctctgatgaaaatgtaagaacaataagtttggaggaacctaagccaagggaatttgacagtgaagtatcagcatcagtgtctcagagtcctatccctgaatctactattgatgcagaacatgttaaagattctgatactccagaatgctctgataatcagccacttgtagcatcagttccacctgtggtgcaaaagacttcctggttgagttgctgtggactgtttgatgttctgtcaggttccaacagataa

SEQ ID NO: 96752 - DNA, 414 bp, Glycine max
  Peptide Sequence Number=SeqID_213530
atgtctaagggtactaaccatgttggacccaaaaagatatgggtaccaaaatctcagatagtgcttgttgtagatatccttggtaggaaaaggccaaggtttaagctgctattgcacatggatctatttggaccaactagaacattgagtttgggaagaaagaagtatggttatgtcatagttgatgactattcaagatatacctgtgtatacttccttgctaataagcacgagtctttcaagatatgtagggaagatcattcgtacctcctaaagagaagaagatcaaacagtctaaagaaattcttcctcagactgaagtatcttcagatcataagcctcaaacgaaggactagaagtttcttcatcatcatccacaagatcatatcattagagatcagactgaaggagtga

SEQ ID NO: 96753 - DNA, 381 bp, Glycine max
  Peptide Sequence Number=SeqID_213531
atgcctctgggactcatcttaggaataggaagggcatttcgaaggaagcggccatcttcactcgatattctatcatcaaaacgtgctcctcgtggttattataagggaaagaattgcaagcctactggtttccacactcgcaaaggtgggtatgtggtgatgcaagaaaaattgccaaattatgtagttcctgatttgactgatttcaagtactcctctttaattccagagtcattattcctagcctcaccattccttggcaactctgtaccatttagagggctgattcatataatcccttcttttatgcagctcaaaccatacgtatctcagtgtcctatagaagcgaatacctctgaagcttcccaaacggctaaataa

SEQ ID NO: 96754 - DNA, 600 bp, Glycine max
  misc_feature (443)..(443): n is a, c, g, or t
  Peptide Sequence Number=SeqID_213532
atgactcacattccaaacgacaatgtagccttcaacattattatggcaagccttagaattagaccaccttcgaaggacaaagacatcattgggaggttcatgcccaataatggttgctgcaagaagcaccccaaccaccgccaatctcctggtgtctgttctctttgtttgagacacaagctttctcaactatcctcagcttctatgcgtaaaacaacattgatttcttcgtgccgttcgtcttccacctcttcttctttgtcctcctattgctcctcttcctcctcttcttgcgcctctcctacgcttcccttcccttttcacaaagattctaagagtggctccaattctgtttccatctttttattgagcgcaaagcatggtggagtactcaaaactgggtcaatgagcgttcttgcaacaaggagaagaacaaaaggtgntgttgttggtgatggtgatggtgatgatcgtaataagaagaaaactgggttttggtccaagttgcttcatcccaaaaccaaaagcaagagaatggatgagatcaaaggcactaagctggttcattctaggtctctaatagaaactagacatagctag

SEQ ID NO: 96755 - DNA, 315 bp, Glycine max
  Peptide Sequence Number=SeqID_213533
atggatgaagctattgaactaattgtagacagcaaatcagctatagatttggccaagaatccagtagctcatggaagaagcaagcatataggcactaaatttcatttccttatagatcaagtaaatggaagaggagcagttgcagcgaaaaacagaacatttgacccagaggaggtcattgtcgatgacaaggaggaggcattggggagggagccaaggcagaggtcaacgaagtactggccagagccagtggcggtgccgaaggtgaggggggacttggcagagaggtggtggaagtcaatggcaaggaggtag

SEQ ID NO: 96756 - DNA, 360 bp, Glycine max
  Peptide Sequence Number=SeqID_213534
atggatgttagaagactagatggaagacaagcaatgatcacagatgtactctatgttcctgggatgaagaataacctgataagtatgggtcaactcctagagaagggattttcaatgaaaatgagtaatagatctctggaagtctatgatacaacaaagaaaatgattatgaaagccccattggctagaaatagaacatttaaggtcaagagtgaagtgttcaatacctttaagggattcaaggctttagtagaaaatcagtcaagaaagtgcatcaagactttgaggactgatggaggaggagaattcacttctagtgagctagaagattttttgcaaggagcatggaattgtgcatga

SEQ ID NO: 96757 - DNA, 1146 bp, Glycine max
  Peptide Sequence Number=SeqID_213535
atgagggaaggatcattaggaacaataaagggattgacaaatagccagcttgaggaaattggttgccaaataatacttggaaatacatatcacttggcccttaggcctacttctgagcttcttgatgaagttggtggtcttcataattttatgaattggaagcgggctttgcttacagactctggtggctttcaaatggtttcgctgttgcatcttgctgatatcacagaaaaaggtgtgacatttcagtcaccagtagatggaaaaccaatgcttctaacacctgaggaatcaattcaaatccaaaatagaattggagcagatatcattatggctcttgatgatgttgtaaagaccaccattactggtccaagaatagaggaagctatgtatcgaacacttagatggatagacagatgtatagcagctcacaagagacctcatgatcagaacttgtttggtatcgtgcaaggtggtttagatcccatattgagggatatctgtgtcaaaggtttggtggagcgcaatttgcctggctatgctattggtggtctttcaggcggtgaagataaaaattcattttggcgagttgttgctcagtgcactgctgctttgccagaagataaaccacgatatgttatgggagttggttatccacttgatattgttgtttgtagtgctttgggtgctgatatgtatgactgtgtttatcctactcgcacagcacgctttggcactgctctcgttcctgagggagtattgaaactaaaacataaagcaatggccgatgacacccgtccaattgatcccacttgcccttgtatggtttgcaagaactacagcagggcttacatccattgccttgtgacaaaagatgcaatggggtctcaacttttgtcatatcataatttatactacatgttgcagctcagtaggaatctacactcttcaatagttgaaggaaggttcccagagtttgtatgcgactttctacacaaaatgttcccgaaaggtgatgttcctgaatgggtctgcgatgctatggaggtggctggaatcgacatttcttcctgctgtgctccgtttccatcatgccaagaagatgattccaaaaacatgcccgaagaagttagtttggtgaggtaa

SEQ ID NO: 96758 - DNA, 636 bp, Glycine max
  Peptide Sequence Number=SeqID_213536
atgactgctgcccatgtcctcaatagatgtccctccaagaggttgaacttaatggttccagaagaagcatggtctggcaacaaaccctcagtcaaacactttataatctttggctcattgtgttacagacatgttccagaccaaaagagaaagaagcttgatgataaaaatgaaccaatgatctttgtaggctataactctacaggctcatacaagctatacaatcccaagactaaagaagttctcttcagcaaagatatctattttgatgaatcaaaatcatggagtgaacgacaggccataactgaaacaattccaagattgcagcttgattgggaagaatttgactcaagaaaagaagccacacaaggtacattgaatactgagcaacagattgtaaacaacagacctagaagaaacaaaagtttcctctcaagactctcagattatcatctctatcctgataatgccatctttgatgatggtgacttggttcaacaccttgcactcatggccgatgcagaacctattgatcttgatgaagccattgcaagtgaggtatggagatcagccatggaagaagaattaaagagtattgagaagaaccaaacctgggaaatggcagaattaccttag

SEQ ID NO: 96759 - DNA, 435 bp, Glycine max
  Peptide Sequence Number=SeqID_213537
atgaggcgtcaatatgaattgatgcaaatggagaacaatgagaagataggtgatttcttcaatagaatcatcactcacataaatgctatgaagaactgtgaatccaagaaacttgaagaaataacagtagaagaacttcaaggttctcttgaagcacatgaacagagactcattgaaagagaaatagagaagctaggagatcatcaggcattgcaggctcatacatcaaagaaagtaggcaataactccaaagagtgtgtagccgcaccaagtagcacaaatcacagggggaatcagtcacacagtgattatcaagcacatatggtcaaagaagagaatgaagcaaaatctgaagaacaacccttgatactgatgatgattaccgattcagaatctcataataatgaaatctggtacatagattttggatgctga

SEQ ID NO: 96760 - DNA, 237 bp, Glycine max
  Peptide Sequence Number=SeqID_213538
atgattgctccaccttcacctctcatcctccctaaaacaacagttcgaaaaagtgatgtcgtcgagtctggaggcagcactgcaaaaactggcgtgatgaccatcaaggagcatcaccatgaccttctcgactacgccattttgtccttgctcgcctccatctcgtattttgtcttacaagctttggccttcttcaccttttttagcaccaaacataaaccatcctctgacaattga

SEQ ID NO: 96761 - DNA, 186 bp, Glycine max
  Peptide Sequence Number=SeqID_213539
atggaaaactttgaagtgaatgctaatagagatgtgattggtgagcttgctaaaattgtccaatgggatcttgatagtaagctgaagaaagatatttttgttcttaaggacaaagtgtgtggatactactatgacatgtactttgtgggagacatttgctcaaaggctgaaatcttatttagatag

SEQ ID NO: 96762 - DNA, 177 bp, Glycine max
  Peptide Sequence Number=SeqID_213540
atgtccttccacgtcgcgatatctatgtcggttatcaaaaaccgatgtaagaaatatgctcatgaggaaaaaagaggagcgtcatgtgaggttgctggcagagaaggacgcagaggaaggcccgccgttgtggtgttgtcagagaagaagccgtcaaggccccatgacacagaatga

SEQ ID NO: 96763 - DNA, 648 bp, Glycine max
  Peptide Sequence Number=SeqID_213541
atgtggatgggcaggcagccgagctgcgagatgcacaacgaggaatgcgtgcgccgggcctacgcggccgggcgcggcatcatctttctgacgccgcacctgggctgcttcgagctgtcggtgcagcatgcggcacggcaatggtcggccgagcatggcgagatcaccattctctaccgccccgcgcgccagccctggctggcccgcgtcatggagacggcgcgcaaccgccccggcgtgcaggccgtgccgaccacgctggctggcgtgcgccagatgatcaaggcgctgcgcaagggcgcggctgtggggctgctgccagaccaggttccgcccgaggggcagggtgtctggtcgccgttcttcggccgtgatgcctatacgatgacgctggcggcgcgcctggcgttgcagacgggggccgcggtgatcgtggcccgttgtgagcgcttgtcctgggggcggggctatgcgctgtatcttgaggagttgcccgtgcccttgtccgagaatctggaagctgcggtgcagcagatcaatgaagcgatggagcagaccattcgccaatgcccgcagcagtacctgtggggctatgcgcgctacaagcagccgcgccgtgaagcagctgccggcgaggtgggtgcatga

SEQ ID NO: 96764 - DNA, 636 bp, Glycine max
  Peptide Sequence Number=SeqID_213542
cacgtgggtctgcgcatcgcgcagcatctgcaggcggttttccagccggcgcaggaacaggtaggcctcgcgcagcgcgctgccatcttcgggggcgatctgcccggcggcgaccagcgcgtccagcgccaccagcaggcggcgttcgcgcagtgccggttcgcgaccaccgcggatcagctgcagcgcctggcacaggaactcgatttcgcggatgccaccggcgccacgcttgatgtcctcgtgcagttcacggcgcgcgacttcggcggtgatggccgccttcatctcgcgcaggccatcgagcgcggtgaagtccaggtagcggcggtacacgaacgggcgcagggtctgcagccacgcttcaccggcctcgatatcgccggccaccgcgcgcgccttcagccaggcgtagcgttcccagtcgcggccttcgcgctggaagtactgatccatcgctgcgaacgacagcgcgacgcggccggcgctgccgaacgggcgcaggcgcaggtcgacgcggtggctgaagccatcgacggtggtttcgtccagcagcttggccaggcgctggccgagccgggcgaaatactcttcggcggccagcgcgcgcgcgccgtcggattcgccgccgtgcgg

SEQ ID NO: 96765 - DNA, 309 bp, Glycine max
  Peptide Sequence Number=SeqID_213543
atgaaccatctgttgcagaagcttcaccagtttgatccacggaagagccatgtaaagagaacgtcatgcattcgctcaccaataggccatatattgtgcatgatgatcaagatacatgtgaggaataaaacacggcttaaaaaccaaaggagaaatggaccccagagaggtcaggcaacagagaggaaggaaaagaaatccaggagggaactgtatggtcacctgagaatgatagatcatgcatatctagctaatgtgtcaggcgccacagccacttatttgattcacaaaattcatggtgccatgtga

SEQ ID NO: 96766 - DNA, 645 bp, Glycine max
  Peptide Sequence Number=SeqID_213544
atggaaccatggcagatttataaaaccgtaaaggggggtatttctgggaattcgcgaaattcgaccgttggttgcacaaagtcaaaaaaccacaccaacacaccgttatatataactattcctctctcggactctgaatccaacctttctctctctctctctctctctctctgcaacgctccgaatggccaacaacagcgaagaacaacagaacaactcaacaagatcatcgatcatggagtggaagcagatgcatccacttcaccaaatcgcagaaacacccacccacaagctcctcctgaagcaatggctgaaggaggaagaactcatcaacagccgcatagcgttgaaagagacccaaatagattcaacccgcaaagagatcaccaccctctacatcttcttcttcctcttccactccaccaccctcatgctcctcttcaactcctcgtcaccctcttcctgtcacagatcgtgggtcccttcgctgtgctctctgttattctcgctgggcctaatatgggccttgcgttacaagagcgacgtggaggcccacgtggagaagatgctgcagcgggagaaggaggacaaagggttgctggggaagtgcgtggaggagttgaagaagaaagggttggagtttga

SEQ ID NO: 96767 - DNA, 357 bp, Glycine max
  Peptide Sequence Number=SeqID_213545
gggcacacagtggatgaggttaaagagagcgagtacaagtcgtgcacagcagggaattcgattagcacagacagtagtggtgagaccacaattactcttaaaaccgcaggcactcattacttcatatgttctgttcctggacattgttctggcggcatgaaacttgtcgtcactgtcaaatcaggaaaagccactgattcttcttcaacttcaactgggaaggcttcaccttctgatgtcacacccaacaccactaaatcaaactcgtcttcagcgagtggtgtctcaccaattgttgctatgtttattgtttcgtggatctcttacaatgttttgtatgatttatctgagtactaa

SEQ ID NO: 96768 - DNA, 1104 bp, Glycine max
  Peptide Sequence Number=SeqID_213546
atgaatgcacagtttaatgttatagaccagaaaatgggtcgtgcaagaataaccttgaaactcatctcaaatgagagatctcgtaggttaactttcaagtccagaagggaaatacttatcaagaaaacctctgaattttccaccttgtgtggagttgaagcctgcttgattgtgtacgataatggcaatggagatgttgcaccagtaacttggccaaaagaacctgtattggtacaccccatccttcaaaagtatgagtctcagaagaatgagagacctcccaagacctttggtattgaagactttttggagaataggaagaacatggttgaagctgacatttccaaagtgcataaacagatcagtaacatcaagtatccaacttgggatccaagtttcacaaacatggaagagaagcaattgaaggctttcattactcaggtgaatgctaagattatggcttgtgatcatgtgttgcaaaacaagcatcaaagtaaagccaacaacatcatgcaaaacatggcttggggaagtgcttcctcctcccatattccaagccaaatcaccccaactcctaacaataatgggagggtgtatgttacaaatccaataaatcagtttgatggagctagtaatcatggaatgaacatgcaacaagttgatgcttgctatggttacattcccacaatggctcaagaaagtactaattctacctcctcatatccaaggcaattcaattgcttgcaaaacatccctcaaagccaacccatatttgaagatttaaagccacttgattataagaatgagatggtagattttagttatcaagttgatgtgccactagattcaactaatcaacttggtgtgtatgcggactggactaataatcaattcggtgactttgaggactggattaatcgacctattgatgggtctaatcaaccagttaatggtgatcttgtgggtttggacaataaacctaatgaatctatcttgcaaaatattcctgttcaatatcagaataagcaacaaggaggagctttgcatgtcttgccaccaccattgaatggatttcaaacagattgctataatgtgaatttctga

SEQ ID NO: 96769 - DNA, 609 bp, Glycine max
  Peptide Sequence Number=SeqID_213547
atggggatacctgtagaggtggatattgactggggaagtgtgataacggttgcgagaaggagatgcgaatgtggaagagctcactcgcactctgggtttgaagtaaacgtcgtaattggggaggactcacgaccaagaatgcatgtcggaatttcccttgagctcgacaaattggccttcgtgaatgaacttcatcgtgcgaccctgggtattgacttggactgccacgcaaatctgagagcactccacttcactaccattgccgacgaggaccctgagtgtcccatgggtcatcatctgcaatcaaaaggaagaagcgtgaggagcagcggtggtcgcggaggaggtggcttcgcgggggaagggagtaagggtaaaggcgagggaggtgagggagccgaaatggaaagcggggttgacggtgaagaaggaaaggatggagcttggacttcacggcgaatagcagggttgagaccggaaataaagcaactcagaagcgaggaagtggataagccggtgattcgattcgccaaggcttcaaactgcggaaccctgtccatgtgggtagctggtgatttctggccatccactggaaccaggcaagcgcgg

SEQ ID NO: 96770 - DNA, 246 bp, Glycine max
  Peptide Sequence Number=SeqID_213548
atggcttcttgcagcaagggaaacttgtcaagaagcataggcagagcaatatcattgaaagcaaaaaagctttcaacgaatgccaaattgaggatttcctataaccatcaatccgaaagctattccttcactaagagagcaacaagtgttcctccagctaatagtaacaagcttccggatgctaacatccctgctccaaataaagtttatgatccatccttccacttccttgagcaaagctcttga

SEQ ID NO: 96771 - DNA, 108 bp, Glycine max
  Peptide Sequence Number=SeqID_213549
atgtcggaggaagagcttgaggaatgtcagggaacctttagagatgtcgttattgctgctggaacacatgtgagcccgcttagaggaatccgtaggagatcaaattga

SEQ ID NO: 96772 - DNA, 984 bp, Glycine max
  Peptide Sequence Number=SeqID_213550
atggccgactcccaatccactcgtgccttacggggattcttaggcttatccggattctatcagcgtttcattaagggatacgccacccttgcggctcccctaacagctctcttggccaaagataaattcaattggacccctgaggctgatcgcgcctttcatctcctcaaagatgctctgtgtcaagctcccgttctgagattacttgactttaattcagagtttgtcattgagactgatgcctcgggaattggtatgggggccatcttatcccaacatcatcatcctctcgccttctttagtaagccattttgctctaagctacttcgagcttcaacatatgtcagggagctcgccgccatcacgacggccgtgaagaaatggcggcaatatttattggggcactggttcgtgattctcacagaccataggagcttgaaggagctcatggcgcaagcggtgcaaacccctgaacagaaagtctacctcgcacgattaatggggtttgattacaccattcagtatcgggccggcaaggctaatggggcggctgatgccctctcgcgactaccagaaccaccatctgatcagctttatggacgcatttggcttccaccacgacttaagctactccccaccatcattgctaagttccactctacccctaccgacaggcatatgggagtgatgaagacgttagctcgagttcgggagaatttcgtctggccctctatgaaacaagacattcatcagttcatcatgagctgtgctacctgtcagcaaatcaagatagatcaccgccgttcaccagacctcctttcccctctccccattccggcgcaaccatgggaggacctctcgcttgactttattgtcggcctcctatcctaccacgtcactcagttatcttggtggttgttgaccatttttcgaagggtctccacctcggttcacttccacagcaccacaccgtcgccggtgtag

SEQ ID NO: 96773 - DNA, 1623 bp, Glycine max
  Peptide Sequence Number=SeqID_213551
atggaaacacaaatgacatcgagggagaagagtgcttacctcgacaatgtcgacgagctgaagaagaagaagaagaagaagaagaacaaagcaacgggccaagaagcagaggagaagacaacgccacataatggaactgggccacagggtcgtagaagaaggaagaaggtcgcggaacaagaagaagaagcacaaaagaagaatgaaggaataatggaaagatttcatgaggaagaaattgaagagccagtgagtccaacagggcaatacttgacaagctcttcactaagtgtgtacattcttggtgtcttggaaagtgaggttcccattgatgactctcaaaccgtgccacttcttcagaatctcttccttcccatcaactcacgtttctcctccatcatgattagggacaaaaatggggagaagaagtggaagaaagttgaagttaagctggaggaccatatcaaagttcctacatttcccaatggcaagtcatccaacttgttcttatatgatgaataccttgatgagtacatgtccacaatagctgtggaacatttaccacaaaataggccactatgggaacttcacattataaaatacccaacaagcaatgctaagggtaccttggtgttcaaactccaccatgcccttggggatggtttttctctcatgggtgcccttctttcatgcatgcaaagagctgacaacacctctcttcccttcacactcccatcaagccaaaggcccaaagcatcatcaatttccaacaccaaagggtttttcaagaaattgccctccattttcttccaaactatatccgaatttggatggagtttcttgaaaagtaagttgattgaagatgatcaaacaccaataaggtcttgtgcggaagacttcaagactcgccaaatgaccatctcagatgtcaccttctcattggatcttatcaaagacgtgaaatccaaacttggagtgagcataaatgatgtgcttgctggagtaattttttttggcattcggctatacatgcaagaaattaatctgaaatcaagccaaacccaatccacagcattggtgttgctgaacacaagaaacattgaaggttacaagtctgttaaggagatgattgagaagaccaatagtcgttctgcatgggggaatcaatatgcctttttgcatgtttcaattccagagcttagtgactccaaatatgcaaacccacttgagtttataagggaagcccataaggatatgaccaaaaagaaaaattctttggccactcctctcactggcatgcttctagatatgctcagaaaactcagaggtcctgaggctgcagctagctacttacgcagtactttgagaaactcaagcacaacaatctcaaacatcattggaccagtggagcaaatggctgtggctaatcatccaattaaagggttttacttcatggtagctggttcacctgagagtctcaccatgacgatcatgagctacatgggaaagataagaattgcatttggagtagagaagaacttcatcgacaagcaattattcaagtcgtgtttggagaattctcttgagatgataaaggaagcagcaaaaaagatttccgcataa

SEQ ID NO: 96774 - DNA, 255 bp, Glycine max
  Peptide Sequence Number=SeqID_213552
atggcattctctagtgctttggttttgggctcattgctagcaatcaacatgggcctgccaaccctcgcaaccgactacaccgtgggagatacttcaggttgggcaattggtgctgattatagcacatggactggtgacaagacctttgtaataggtgatagtcttggaaagctaaggagaatactgatattgcttcagagagaatcctttctaacggtccaggatctttgggagaatgcttctagatggtgctga

SEQ ID NO: 96775 - DNA, 552 bp, Glycine max
  Peptide Sequence Number=SeqID_213553
atgaaggaagttgcagaccgccgacgccgggaattgcaatatgcggagggagatcagacatcagcttcgggaactactcattccaaactcgccaagagattctatggcccttttcagatcaccaaaaggattggtagcgttgcctatcaattgcaacttcccccagattcccgcatccacccattattccattgctccctcctaaaactataccttccttcaaatgactcagtgcccctttctctacctcctaagtctattgataatcaaccctgcattttcccacttgcaattctagacacaaaatgggatgagactgcatcaaggaaacaattgatggttcttgttcagtgggcaggactattcccagaagatacatcgtgggagctgtgggatacactcaaacaagattacaaccttgaggacaaggttgtcttggaagcctgcagggatgatatgaatagagaagcaacagagcacaatgcaggaattataaaaggaaaaagaagaagtattaaaccaagatacttggaggattatgtggcaaaataa

SEQ ID NO: 96776 - DNA, 348 bp, Glycine max
  Peptide Sequence Number=SeqID_213554
atgatcaaggaaaccaagcctatcaagtcctcttctagtgttccttataggatgttggtgactgtgattttcagacacattggagtacctatggaggatgaaccaaggggtgataagctgcttcagaaaaaggagttttctgagcagattaagaaggttgttgaagaggcaagagaagaggtatcaaaagaagatccttctaaggagctactggattttggctctttttatgataactcaaaacatcattatgaggaagagaagaaagatgaggaaactattatgagcctaaaaatgaggagtttgcaactgatgaaggttgctcagaatgaggttgatttagaatga

SEQ ID NO: 96777 - DNA, 288 bp, Glycine max
  Peptide Sequence Number=SeqID_213555
atgacggatgaacctgattggaccaagaatggctatacggttgtaccaattctgccaaaaagccacttggttgaaactgtggtaaagatcatgcctgagtgtttgctgatacctatgggtttcctaccaaaatcatttggccttggtttagttggtctgtatacccatgcaagtactgatgacctagcagaattttctccaaatttcccatgtctagctattctcaaattctttaacctgatgaaattcgttgtgaaccatatgatcaattctgtatcccgatgttga

SEQ ID NO: 96778 - DNA, 274 bp, Glycine max
  Peptide Sequence Number=SeqID_213556
atggcttctccaggaatagtggacactgcactattcaaaaaagctcagaaaggatatttgcttattatacaaatctatgtagatggcataatctttggtgcaacctcaaaaaggatgtgcaaggagttttctaagctaatgaaagagaaatacacaaaggatctacttaagaggtttagaatggatgaagccatacctatggctacccatacgcatccatctactatcattggcaaagatgagaaaggtaatgatactccagaaaagtacaaag

SEQ ID NO: 96779 - DNA, 291 bp, Glycine max
  Peptide Sequence Number=SeqID_213557
atgaaggtcagaccgggctttgttttcaaccgaaactatgaggcaagtttggaagattccgcttcggttgaagggttcctcttgaagcttggcacgttggaaatggttttggaagaaagaaggagaaggaaatggcgtttttccaaggctacacgaaaagcaaaggctgaaacactcaagtgtttctgctcacgggaaaggaagcgttcctcacacgctagacgttgtatcgaagatcgcaacggtcagatcgtgtacaagtgctctgtgaagctgcagaccaaatgttga

SEQ ID NO: 96780 - DNA, 404 bp, Glycine max
  Peptide Sequence Number=SeqID_213558
gggaggagagaagggtctgacaagggattaaaggtgaacatggagagagaagacgcaaaggatggtgaccgtatggggggaagctcatcaaacacaggtgatgataaagtgaccaatatgcatgatgatggggtgtttcgtggtgccacaaggaggggagaaggcaagataatggtggatagattaaaacaaaaggaggataaagacgaacaaggattgaggaatgctaggggagaaggggaagattgtgagaagattagtgcaacaagaagaggtacaagttatgtgtattcaagagaccaagaaagatatggtggacaaggggctttgctcaatgttgtgggaagatggagacatgtgttgggtagattcgccattgacgcatgcatcgatgggacttcttt

SEQ ID NO: 96781 - DNA, 369 bp, Glycine max
  Peptide Sequence Number=SeqID_213559
atgatgagggtggagagagagagaggggaggatggaaacactttcgggagatggggaatagtgtggggaatttttatttcaaccaaaagggacaagaggggtaatagttatggcttcgtcaagttccttgtggttcagaaaaaaagattcctggataagcaattcgatgggatatacataggaaaaatgaaaatagacgtcaatataccaaagtttttgaaatttgatgggtataaactagatgacccaggtggaggtagggaacgaacaataggaagtgttggagaggggaagagaaacagggttaataggggtcaaggaggtggggatcgaaatgaaggatttgtagcagagataagtttgacttag

SEQ ID NO: 96782 - DNA, 294 bp, Glycine max
  Peptide Sequence Number=SeqID_213560
atggaacaagccactttgacaagaatgataactagagaggaaaggatattatggtggaagaaggtagctgtgactggctggaaaattgctgggttggaagatgtagcggggaatgtgaagcttaagtatgttggtgacaatatagtgttgttacatgggatctcgaaggacatggtaatggaggagctgaaaagtgaggaggatggattgttgtctatctttcattttgtgtacgagtggaataaggaaagtattctgcggtggataaagctacaacaaatagggagaggctag

SEQ ID NO: 96783 - DNA, 150 bp, Glycine max
  Peptide Sequence Number=SeqID_213561
atggcaccacagacccagacgagcacttggacgtgtacatcacctagggtcaggcccttcattggttcacacgactaccctccccccccccccccccccgcccaaactgtggactcgttcaacaccgtagtctcccgctttagaacatag

SEQ ID NO: 96784 - DNA, 429 bp, Glycine max
  Peptide Sequence Number=SeqID_213562
atgtctagctatcttagagatgaaaagtccctgaaatgtgaaggaggctcaaagactagccggcaagatagcctccttgtcaaggtaccaagaattttcgagagggctaaacccattatgaacctcttcatgaaggccaaaaaatttctctgggatgaagactatgaagaggcctttcggcagctaaaagtaactttggcaacaccttttgtcttgtcaaaaccggatactagcaagaagttgattgtctatctttcagtcttaattgaggtcataagtgcagtgctagtacaggaagaagggagtgagttgaggtcggtgtattttgtgagtcgggtactacaagatccagagacgaggtaccaagtgatggaaaaggtagcccttgcacatgttaatgttgttcatcatcttctccaatacttttag

SEQ ID NO: 96785 - DNA, 276 bp, Glycine max
  Peptide Sequence Number=SeqID_213563
atgagagatttgggaagcaatatccccttcaaagttagaatcagacaagttgacatgcttattagagagaaacttgctgagctttatgaatctgagaaacaatggtcaaaagcagctcaaatgcttagtggtattgaccttgattcaggaatgagtcttaaagcatgccctacctgctcttgttctacatctgcatattcaagaagcggttataagttcttcactagaggcaagggcaagaatgaagagatagttgcagaatcaaacaaggcttga

SEQ ID NO: 96786 - DNA, 1305 bp, Glycine max
  Peptide Sequence Number=SeqID_213564
atggttaggaccagaggattaggtcgtgccttaggtcacgttactggcagcgtccctgtgactgcggcgcacgatgagtcagtggtccctgcgccagatgttcaggctgacgtatttctggatgacccgatggcaccaactgatgtagaggacattgtggcagacattcctgctgaggatgagcatgagggatttccgggtggtccgagcgacccatctgtgctgacccagtctgtccttgccattgagggactagttgctgggacaggactaagttctttgatcgcgtgtttggtagacaccggcgatcggggacttttgtcctcgtttgtcgagcggtggcactgggagacgtctagtgtccatctcccggtgggagagctcacgatcacgttggacgacgtctcctcgcttctccatctgcccgtggttggcgacttgcactcctttcagcccttgcacgtggatgatacggttcagatgctggtggacatattgatggtctctgcagagtctaccaggactgagacagcccagtgtcgtggacttgcaaccaatgtgcatgttgtgtacttggaggcccttcgtgacctcagtcagaccgggaggtacgcctggggagtggctgctctggtgcacatgtacgaccagctgaacgatgcctctatcagcagcagccgacagcttggcggttacatcacactgcttgttggattttcgagcactttccctcagtcgcagagtccattgctgatcaggaatatgacaaggattccctacgtgcgtggagctcctggattgacttcggattccggatgtctgttggatcccgggcctgttgctgtttattaccgaccagagagggtcgtgcggcagtttggatacacgcagaccattcctgctccgcctgttagtgtgccagtgactaaatggactggttcttccgcatctcgcatctcgcatcctttcatgacaccagaccacgcattagatcctctgccagatggtcatgccccgcagccccgagtcgtccctcaggccccacagacggatatctctcacgtactggagccaggagcactgtcgacatctgcgaggcccgctgtggaggagcctagacatgcagtggaagtttgtgatgagattgctgagaggttggagcgccatctgagtctaggggtggtcacgtctggctcatcgacacatgaggcaagtcgcgaatggatgcagcactcgacgccatggaaccctacggcttccccaacagactcatccgaacaaccgttaacagtctcctcaaagtaa

SEQ ID NO: 96787 - DNA, 720 bp, Glycine max
  Peptide Sequence Number=SeqID_213565
atgttgttcacttggggttggaaccaaagggccacacttgggcaccctgctgagaccaagtctgagaacaagactgagaacactcccagccaggtcaaggctctttccagtgttaaaattgttcaggcggctattggggggtggcactgtttggccgttgatgatcagggcagagcttatgcttggggtggaaatgaatacgggcagtgtggcgaagaacccgagcgcaaggatggcactggtagacctttaaggagagatatagagatccctcagcgctgtgctcctaagcttgttgttcggcaggttaaatttatgagatgtgctctacccataggtagggttgctgcaggaggaactcactcagtggtacttacacgagaagggcatgtttggacatggggtcagccatggccgcctggtgacataaaacagatttcagtccctgttcgggttcaaggtcttgaaaatgtgaggctcattgctgttggagcatttcataatttggctcttcaagaggatggaactttatgggcatggggtaataatgaatatggacaacttggaactggagatactcagcctagatcacaacctattcgtgttcaaggactttctgatcttaccttggtagatattgcagctggtggatggcattctactgcattgacagatgaaggagagttttggtggccactgaccaactatcaagccagatga

SEQ ID NO: 96788 - DNA, 459 bp, Glycine max
  Peptide Sequence Number=SeqID_213566
atgaatctccctcgagacgtggacgactacttcaaacaaaccctcgacgatacattagggattcccgtatcgtcgcgaaccctagaatccaagcttcaagcttcccaagagtcgcaatggcgcctccgcgaacacctcctttcccttttcccccaattgaagcggaaagaccaactcatcgaccgcttcaagtatgaagcgggaatgaacgcgcgagctctgaagaagttcgttgaggagaatcagagactggcgacggattgtgagaaattgttggctcgctgccatcagttggagaatgatcgcgccctgtatgataaagacagagaagcgttgatggagtttgggaacgacgctgacgaacgggcacgggaggctcaaacccgagttcttgatttggaacgggatttgctctttatggggaatgaattgaacaaatataagaatcagcatcaattg

SEQ ID NO: 96789 - DNA, 429 bp, Glycine max
  Peptide Sequence Number=SeqID_213567
atgggcttcaatctcgagctggccaagggtcccaggctccctgtgcagaaacaacctgagagaggaatgcctttggtgtcatcactggctactagaaagataatcagtgaaggctctgggccaagagatatttgccatggtggaggctctacaacatggggaagaactgctttggttgagaagaagaaggccagcatcctgagtggctctgggctgaggaactcgaaagtcaaagtatctaagtcaaccccctgggcatcacaaagtgtcataatcagagcgggaaagccgagtctggacgcgagcccgatccatgttgagggtggacgtgtgggaggtaagagcgaggttaaaataggaaagcatgctctatctggatatggaggtactaggagtatgaggtcagctgctccacctccgggacgatga

SEQ ID NO: 96790 - DNA, 478 bp, Glycine max
  Peptide Sequence Number=SeqID_213568
actgaggctcttcccaggtaaacttaagcccaaatggtttggtcctttcataatcaaagaagtgaagccttatggagcagtggagctggtagatcctgccttaagtgagcctgagcgaagctggattgtcaatggtcagcgactgaaaatctacaatgatgactacattgaaagactgaccaccgtcatccaccttcaagacccgtatgtaagacgtgctaagccacatcatctcgctaagcgcgagtataaaattatgagagggaagaccaaaggacttcgtcctttgggtgctaagtgtgtcatatggcctcgaggaagcgccaagcaagatctaatcagtcacaagggggatttcacttgggattcctcctgctttgctttacagatggagttctactccaacatctatgatccagaggatggttctctgaagcagtgtcgggtgtgggggcagaccatcaaattcaacgcgtag

SEQ ID NO: 96791 - DNA, 540 bp, Glycine max
  Peptide Sequence Number=SeqID_213569
atgaagaacctatatgggatagatcctggaagagaacactatggttgcatgcttgatcttcttggaagagctggaaagcttgatgacatggttaagttaattcatgaaatgaattgtgagccagatgttgtgatgtggaggactttacttgatgcatgcagggttaatcagaatgtggatttagccacgtggaatgatgttgcagaagttcggagtgctatgaaaaaaaggggcataaggaaagaacctggatgtagctggattgaagtcaataagcagatacatgcttttattttgggagataaatctcatcctcaaatagatgagatcaatagacagttgaaccaatttatttgtagactagcgggtgctggttatgttcctggcacaaattttgtaccacaagacttgaaggggaacagagagaagactctcttcgataccacattaaatcaaggggaaggcgcgggtcctgctcctgcactgtatcctgttttctgtgtcccaacctcagttttttttaccccagtaactctgtaa

SEQ ID NO: 96792 - DNA, 222 bp, Glycine max
  Peptide Sequence Number=SeqID_213570
atggaacatacgaatttggggatcccacggtcatgtggctccgcatgccaccggtctcttgggacacgcacttcgtttctaaacgaccatttagaggaaacactgggtccaacaaagataggagaaaatcactcaaagtgtatcaatctcacacagtgcgtggcgagaaagtcgctagcgcacaggattttgtcagcaatcaaagggagaggaccactttag

SEQ ID NO: 96793 - DNA, 1001 bp, Glycine max
  Peptide Sequence Number=SeqID_213571
gttcttacaagtctacgagtcaagtttacggagctcccacgagtctacgtaaactcttgagtttgataactttggtagactatcgtggctatgaagtgacagtggaaaactttttacgggtacttactggacgtcatgagacatctgttccaaggtccaaacgacttcttagtgatgagggaagtcatattcttctgtatatgacagggcatggaggtgatgagtttttgaagtttcaggattcggaagagcttcaaagtcacgatttagctgatgctgtgaagcaaatgaaagagaagcgcaggaggataatgagtcctccttatgcttatgcattggaagaggaaatcactggaacaaagctaatcgtgtccttgacaaatagactcacgaacaaggactctgatttcttatgcttatgtattggactaagaactcatttttggctcatactcataatgggaattgttaggtttaaggagcttctgataatggtggacacctgccaagcctctactcttttttcccagcttcattcaccaggtgttttggcaattggaagtagtatgaaaggagaaaattcatattcacatcatttggattcagatgttggcgtttcagttgttgatcgttttacattttacactcttgctttctttgagaggctgaatatgtatgacaatgcttcgttgagcagccttttcaattcatataatccaaatttgttgatgtcgactgcatattacagaatggatatataccaacgctatttaaaggaggtacctgtgacaaacttctttggttctgtaatgaaaacgatacatactgattcagcctacagatcccggtcaaataaaaaaattgaggaagctaaaagcaatatgtctttggatgaatcaatctctgacagtgactcggatgacgaggatcaatttaataatttaactgctgagtgttggaccactatggagtgctattctcagcaatgccaatacttctga

SEQ ID NO: 96794 - DNA, 195 bp, Glycine max
  Peptide Sequence Number=SeqID_213572
atggttaggatgtttgtagtccatgaaacctggtggttgatctacatacgcttcttcttcaatgagaccattgaggaaggaaaggtcctttgtgtctgctttggtcaagctgcaagtcttacggtggtacgtcggcaagtggtggttgtggtggtggttggtgtggctgttaacggtggaggtatagtttcataa

SEQ ID NO: 96795 - DNA, 408 bp, Glycine max
  Peptide Sequence Number=SeqID_213573
atggcattaggtgtttcaaagctccctatgaatatgatcatggaagtattgctgctgatatttctgagctactctgtagcatactcctcatctgcgtttgagtctacaatgcacactaataattgggctgttttggtctgcacgtctcgcttctggtttaattatcggcatatggccaataccctgtcattgtataggacagttaaacggctaggaataccggatgagaggattatactcatgctagcagatgacatggcatgtaatgctagaaacaagtaccctgcccaagtttttaataatgaaaaccatatacttaatctgtatggggataatgttgagactattatagagaagatctttattgttaagcttatctctgcctcgtggctctctgtgcaaacctag

SEQ ID NO: 96796 - DNA, 624 bp, Glycine max
  Peptide Sequence Number=SeqID_213574
atggtgaaacaaagaaatattcttctcacgttgaaggagcacaatgttaatagttatagaacaatcaagcaagtatacaatgcaagaaatgcatatcgttcttccataagagatagtacctacaaaacaaataggtacaaactgtcattacttgacattgttggtgtgacaccaacaaggatgacattctttgttactttttcctatttgaagagagaacgtctaaataatgttgtttgggctctagaacaatttcgagggtctcattctgagcattttgatatatatatatattgcctactttcgaaaacgggccctgacgggtgcagagaaacgcgaggaactggaaccacagaagtggcacgcaaatcgaggtacgatttcagcatccagaaaggttcaatttttttcttccttatggctgagtatgatgtcaaatcaaaggaaaaagaaatttcagcagcttcttcctcccttccacgttgctttttctcttcttcttctccaccattgttgcctccattgaagctccaaattcctcttcctttctaccccaaattgcaaggaaaagccattttcggagtcttggagcatacctctacttcgtggggctttaaatttcag

SEQ ID NO: 96797 - DNA, 933 bp, Glycine max
  Peptide Sequence Number=SeqID_213575
atgtcctccgccatcagagggctgcacgccctcaccttcagaggactacacgtcctcgccttcaaaggactgcatgtcctcaccttaagaggactgcatgtcctcaccttcagagagttgcacacccttaccttcagaggactgcacatcctcttcttcagaggactacatctccttgccttcagaggactacacatcctcgccttcagagggttgcatgccctcgccttcaaagggctacatgcccttgccttcagaggactacacgtcttcgcctttagagggctacacgccctcgccttcagaggactacacgtcctcgccttcaaagggctacatgcccgcgccttcagaggactacacgtcctcacctttagaggactacaggtcctcaccttcagaggactacacgccctcgctttcagagggctacacgccctcaccttcagaggactacacgtccttgccttcagagggttacacgccctcgccttcaaaggactacacatcctcaccttcagaggactacacgtcctcgccttcagagggctacacgcccttaccttcagaggactacatgtcctcaccttcaaagggctgcacgaccttgcctttaaaggactacatgtcctcgccttcaaaggactacacgtcctcacctttagagggctgcacgtcctcgctttcagagggctccacatctgcgccttcagaggacttaaggggccagtactttccctttataattcccttggtcacccccctgatctcagaggagggccaactatgcaagcacaactagagggaggctatcgtgcagccactatgcatactggggcaagatttctcccgtgccgctacaaagagatgagtgtggatcatgcgcaccaacatgaccactcttacacagatatggatgacactgctacttag

SEQ ID NO: 96798 - DNA, 342 bp, Glycine max
  Peptide Sequence Number=SeqID_213576
atggccggtgaaggaggcattgtggagcgtcttcatgtggcacaacgaaaccttaaacatttggacgtatcagagtttaccacaactcactatcctgttcgaccaaatgagctagaccgcttggcatttggtcggattttttatttttgcggcgatgatggtgcttggaggttgtctgtcgaacaagttcaaggcaccggcgatgaagttgctcacgatggggaaggaaatcaacggttctcgtcctgccaccacgggattcttggtttgtttgtttgttgttcgttcttatttatttatgattctctgattctgaaaactacaacagggacggtggcatga

SEQ ID NO: 96799 - DNA, 136 bp, Glycine max
  Peptide Sequence Number=SeqID_213577
attcccttatcatgctaagcacgctgaagttgcacttagcagtggatgcacgctgagcccaaatggtgaggttaccatggataagtggatgaatataaccgacatgggttatgtgattgcatcaaggtatttctga

SEQ ID NO: 96800 - DNA, 327 bp, Glycine max
  Peptide Sequence Number=SeqID_213578
atgaattcgttgtctttcagattaaggaaaaggggaatcacgttttgtgagaaggtggagaatgaggtttttgtgaacgaagaaaatgattatggtttgggccaggctttaagcaggattataaaaaatgccttagggagagaagttagtcgtgatgcagatgaagccccccagtggcaaaagcccataggatctacacgtagacaacgagaagctacacctgttgctgagggtgttcagcatgtggatcatgcagctgatgagatctacgaacaacttgaagaggtagctgctgctgatgtagttaatgatgctgagggtttctaa

SEQ ID NO: 96801 - DNA, 708 bp, Glycine max
  Peptide Sequence Number=SeqID_213579
atggagatgggtagaaaacttccttctgaagaggtggggcttgagctggttcctagggactatgaaatggatacagcatctccttttagaaagacagatattcatgtagcttgttcatctgctgatggccgcacacttttggaatcatctaagacttccttggataaaggtaaattggaggatgctgtcaactatggcacaaaggcactctcaaaattagtgtcagtttgtgggccttaccatagaatgacagcaggagcatatagtctcttggctgtagtgttgtaccatactggagatttcaaccaggcaactatctatcagcaaaaggcactagacattaatgaaagagagcttggactggaccatcctgatacgatgaaaagttatggggatcttgctgttttctattatcgactccaacatacagagttggctttaaagtatgttaatcgtgctttgtatcttctgcacttaacctgtggaccttcacatccaaacactgctgccacctatattaatgttgcaatgatggaagaaggattggggaatgtccatgttgctctcagataccttcatgaggctttaaaatgtaacaaaagattacttggagctgatcatatacagtttaaatttatacaacaacaacaacaacaacgccttatcccactaggtggggtcggctacatgaatcaacttccgccataa

SEQ ID NO: 96802 - DNA, 417 bp, Glycine max
  Peptide Sequence Number=SeqID_213580
gattcacatttgagacacatattggtacaacccatcattcatgagctgagagatgatggtgcaaagacaattcctatatggccatggttcgttttcttagctggaggaatgggctgtttggcttctagtgtcattcctgctgttcacactctagcaacccattacgaccacccgcatgttgttgttgcgctcgggtatgagcttctaatggcaattctatacactaccggagctgtgttctatgttactagaataccagagcgatggaagcctggggcatttgatattgcaggccacagtcatcagatttttcatgtttttgttgttcttggggcgcttgcacacactctagccacactacttgtaatggaatttcgacagggatcacccacctgtaacactcaacattgtcaatag

SEQ ID NO: 96803 - DNA, 150 bp, Glycine max
  Peptide Sequence Number=SeqID_213581
atggctcccaaaactgggaaaaccaagccgcacaaggccaagggagagaagaagaaaaaagaagagaaagttttgcctaccgtcatcgagattacagtagaaacaccagacgaatcacaagttaccctcaaggtatgggatacggagtaa

SEQ ID NO: 96804 - DNA, 567 bp, Glycine max
  Peptide Sequence Number=SeqID_213582
atggatcacgtagctgatgaggtccacgaacagcctgaagaagcagctgttgatgatgaagttgttgatgccgaggaatgtcctgagttgaagctaccttcccatggaaggaaggttcagaaatttggcaggcctgctgcagagattgaaggattagttgtgactatcaccctcgatgatgtggcatctttgcttcatctgcccatcacaagtgtcttctatagcttcaagactcttcatattgatgaagcggtgttattgttagtcgaattacttgagattgtaacacacgtgcatgtggtgttcttgaatgtgtttcgcgacctcacccaaagtggaagttacgcatggggaactactacccttgtccatatgtacgacaatttgaatgatgcgtctaaaagcagtgtcagacaacttgcaggatatatcacactattacaggctattgatgttgaagattatcatgagaggaaaccacgtgtctgtcgctggaagtctgatcaatgtaagcggaatggagaaggaggaaaggtgattggagacgccacttcaaggagaagatga

SEQ ID NO: 96805 - DNA, 2031 bp, Glycine max
  Peptide Sequence Number=SeqID_213583
atgaaacaagcatgtgcgaggcgcaggctgaaagacacggtggaaatcgtatccttgaaaccctgccatctgaccatcgtccaagaggactacacggaagagctcgctgtcgcacacattcggcgactccttgacatcgtggcctgcaacacctccttcgcctccgcaaaaccccccgccggcaagtccaaagaccctaccgaacccggttcagaaaatggatccgaaactaacccgaaatccaaacccgtggatccgaattcggatccggccaatgccaaaagcgacaaagctgacgctgacatctctatgtgtccacctcccaggctcggacagttctacgatttcttttccttttcgcaccttacgccgccgtttcaatacatacggagatcgaatcgtcctttccttgaggataaaacagaagatgatttctttcaaattgatattagggtttgtagtggaaaacctactacaattgttgcttctagaataggattctaccccgctggaaaacgtccgctcgtgactcatactttggtgggtctccttcagcagataagcagggtgtttgatgcagcctacaaggcactaatgaagacattcacagaacacaataaagatgtttttaccattatagtggtgtcatttcagtttggcaatcttccttacggttttcgtgcaaacacatgggttgtccctccagttgtttctgacaatccatcagtctttccgccacttcccatggaagatgaaacatggggaggaaatgggggtggacaaggcagagatggtaagcatgaaaatagacagtgggccagagattttgcaattctagctgcaatgccttgtcaaactgcagaggagagacaaattcgagataggaaagcttttctacttcatagtttatttgttgatgtatcagtcttcaaagcagtttctgcaataaagcatttagtagatattaagcaaaactctttcagtaattcagctttgccaacttcatatgaagaaagaattggagatttaactattaaagtgacaagagatgtatctgatgcaagtttgaagttggactgcaaaaatgatggaaatcgagttcttggattgtctgatgaagaactagctcagagaaacttgctgaaaggcataactgctgatgagagtgcaactgttcatgatactcctactttaggtgcagtgcttataagacattgtggctacacagctgtggtaaaggtctcaggtgacagagatttggaggggagtcctaattccttggaaattgatattgaggagcagcctgaaggaggtgcaaacgcattgaatgttaacagcttaaggatgctgttgcataggccatctacaccccaatcatctaatgcaattcaacgaatccaaagcacagatattgaatgttcacattctactcggtcattggtaaggaaagtcctagaggaaagtttactgaaattgaaggaagaaaccactagacacagtaagtctatcagatgggagcttggggcatgttgggtacaacatttacaaaatcaagctactgggaaaactgagccgaaaaaggcagaagagggtaaagttgaaccagctgttaaaggtcttgggaagcaaggtggattactaaaggaattaaagaaaaagattgatatcagaaactccaaagctgaagtaggaaaggatatttccccatgtaatggcaatgacataaacaagccagaagccactaaacaggaattagagagacaagatgaagaaaaggcaactatatggaaaaaactgctatctgatgctgcatatacacgccttaaagaatctaaaactgatcttcatctgaagtcacctgatgaattgatggaaatggcacataaatattatgttgaaactgcacttccaaagctggtggcagattttgggtcccttgaactctcacctgttgatggaaggacgttgactgatttcatgcataccaggggcttgcaaatgtcttccttaggacgagtggtacgattttag

SEQ ID NO: 96806 - DNA, 432 bp, Glycine max
  Peptide Sequence Number=SeqID_213584
atggggaggggggaaggttgttctgatgtgaatgtggagagagtagctgccaagaacagtgtcataatcacagtagaggatgttgctcaaatcttgttgaatgtggtgcaagtcaccaaagaagatgatacaattcacaactaccaagttcaattcaagttctttggcttgtcccctaaggttgatggtgtccttgggaggacttatagggatgattttgagaacccaacaaagcctggtgtggcaatgcttgttgttagaggagaggacaaacacaagaccacctctttgctttctccaaattgtgcttcttgtgtcttttcacaacaaaacttacataagaatgagcccactaaagtaagtgcaaaattaatgggcacccttgattgctccaagttttcttatggcttgggaatcgtttgcaagaaatga

SEQ ID NO: 96807 - DNA, 150 bp, Glycine max
  Peptide Sequence Number=SeqID_213585
atgtccaaaaacataagcccgtcgaaaaaggaagcagcttttgctctggttgcttccgtggagattccttccaatataaagcaaccatggaatttggaatactcagattataatagcatactagttttgattcattttggtgagctttaa

SEQ ID NO: 96808 - DNA, 684 bp, Glycine max
  Peptide Sequence Number=SeqID_213586
atggggactttgcaagcattccgcgcctcatgtagatttttctgcatggagtcgacgattggactattcctctaccattttatgactaggccgatagatcaggcgagctatagtcctatcatttggcatggacttgactttgccaatgtttaccgagaggtcagtgatactgctggaaatgccttcgtgattcaacctacggatcctctacctccaccgtgctcttcgcctatcgatgttgtgccttttactgataagaacaagaagaagagagatgaggttcaacctccaaggaagctacaacaaccgacccttcatcagttatttccttctcctttcgggtcattggatgctttgcccatggtgttgggcgatgtacttcaatctgcgggcttggttgatgaccatcgctcaacaaatgatcctttccaactcctcgaccgaccgagaggtaatgaggttgtagcggacgtgaaattttttgaaggccgtgaagcttcatggggtcgaaagtttaagaaggagaatgattcggtgattgccctaaggagtgaggtggctaccttgaaggaatctatgatgaaggctaaaggagaaattaaacacaggcaagagcaataccaaattctgatgtgtggtgctcgggataaggtgattgatcgaggccgtacccgaatcacataa

SEQ ID NO: 96809 - DNA, 242 bp, Glycine max
  Peptide Sequence Number=SeqID_213587
tttttcttaacaatttggtgagccaacccaccaacccatggtgggtcaggttgggttggtattttcatgactcacttaaaggtgagtcaggttggcttgacccgtttaactctcaacccatggtgggacaacctatgtggactgggctaacccattttgacacccttagctttgtgagtcaagtagcaagtgctcctaagatttcgaagcttgagaggctttttgaaagaatacttggatag

SEQ ID NO: 96810 - DNA, 678 bp, Glycine max
  Peptide Sequence Number=SeqID_213588
atggtagcaaaagggttgttatttacaacctcattcactaagagaaaagagatgaaagcaaggtggtgcatcgtgggagattttaatagtgtgagaaataggaatgaaagagtaggttcttcaaataatggtggtggaaatagtggaaacaaggaaatagaggaattcaatgcttttactgaaaactttgaagccttagatgttcctatgatcggtcggccacaaatggaagaaagaagtttgagtgaggaaggaaagacaagaaaaatacatcctcaaggtgaatttcagagattagcgaaattgaatgagtccttgctaattcaaaaatcaagaattacatgggctaaagaaggagattgcaactcgaaacttttccactccaccatcaattcgagaaggagaaagaatggtctcaatggaattaaaatgaatgaggaatcgattgaggaaccatgtagagtgaagaccgaagtaaaaaagtattttgagtggcactttcaagaaaaaatttatggaagacctaaattgactggattggaatttccttcgctttccaatgaggataatgcaatgctcatacaagactttgaggtggaagaaataaaaaaagtgattctagattgtgaaagttctaaatctctgaggccggatagctattcattcctcttcatttag

SEQ ID NO: 96811 - DNA, 828 bp, Glycine max
  Peptide Sequence Number=SeqID_213589
atggagaccaatccaaaaaaacaaactatcacaggttcgcaaaaggaatggaactgtcgatctattatagccactttggaaaacaaacatctattgttaaattgttgggtaggaaccttggttgacccaaaaatgcatgataaaatagatgatctatatgtcatggaagaaaaccgacaagtttttatgagatatatgggtggagatttggttttcagtctatgcgtagaacatgaagaaaacttcctttcaatctttaaatcagtgcagaaatgggaagaatcaactcacacaactaatagattgacatggattagatgctacaatgtctcgctctttgtatggaacacaaattgcctctcaagtttaatttctgactttgggaaggtccaggacattgacgaagattctctatcactcaagggagttaagttcatgagagtccttgtcatgacctctacccaacagacaatctcaaaaaacttcaaaatcaccatcaatggactcattacactagtcaagcttgtggaggagatgaaggttttcaaaaatcattgttgttgtaaagaagatagaattagaaatgaggaagatgcttataatcaagatagtgaaatgggtatgcgtttgggatctttaggctcaaagtgctcttttgatgcttggcatgcgtcaaagcatgatgtcattcagagacaggattgtagacaagcgaaggaggataatatggtgcagaactcattggacaataatcgttggtcaaaatctaccaacgataacacccatgatgagtctacgaatgcaaggcctcaaaaggaagaggaatag

SEQ ID NO: 96812 - DNA, 769 bp, Glycine max
  Peptide Sequence Number=SeqID_213590
atgggggagacacataaaatgccccaccacaatctagccgacttcgagccttgcctcggatatgccactgaagggcaagcagttggtgatatacccctgcaaaacactttggaaggccctcagtatcacccacaaccacaccccttgcattccacagcgggtacaaaccctcatgctatggcagaaatgggaaagttggattatctagaggaaagactcagggccattgaaggaggcaaagattgtgcttttgctaacctagaggagttattcctagtacccaatatcatcacccctcccaagttcaaggtgtcagactttgacaagtacaaggggactacttgccctaagaaccatctaaagatgtattgttggaagatgggaacatacacaaaagatgaggaactactgatacatttcttccaagaaagtcttactgaggtagctattacctggtacaattttgatatggctccggataggatgcaactacaaaacatgtgcaaaaaggggcaagaatctttcaaagaatatgcccaaaggtggagagacctggcaactccagtggcacctccaatggtggagaaagaaatgatcacaataatagtagacatgttacgagtgttttactatgaaaaaatggtggggtacgtaccttcaatctttgtgaaatcggtctttgccagcaaaaggatcaaagcgggtttgaaaagaggcaaatttgatcatcctgctttgatgaatgagaaaactggtgcaaatgaagagg

SEQ ID NO: 96813 - DNA, 486 bp, Glycine max
  Peptide Sequence Number=SeqID_213591
atgaaagactatttagctgaaaccgcctcgcagactgccgggccttatgtgcatattggtctggcgccggacgctgcagggtttcatattttcgaaaaaaacttcggccccaacttagtgagcgcggaaaccaaaggccaacgtattacgattgaaggccgggttttcgatggttccggaacgccggtacgcgacgtgctgctggaactctggcaggctaacgccgacgggcgttataaccatcccgacgaccgtcagcagagtaaggctctggacccaaacttccgcggctgggggcgcacgtgttcagactttgcatccggcgtctggcgctttcaaaccatcaaacccggcgcggtcgtcggccgtgacggacgcatgatggcgccgcacctcaatctgtgggtggtagcgcggggtatcaacatcggcctgaatacgcggatgtattttgctgatgagcaggcggcaaatgaacaggatccg

SEQ ID NO: 96814 - DNA, 432 bp, Glycine max
  Peptide Sequence Number=SeqID_213592
atgtacctggttgagcgatacatgaagattttaaaagggtatataaagaatctacactgtcctgaagcttctattgtagaaagtaatgaagttttgccatacatagttcgccacaaaggtttagtgaaggaaaataatccaaaaacatcaaagaatagggtgttgaaagagcataacaagaatttcctaaattggtttaaagatacaatctttggtgatgataatgcttctgaaacattaagaaagctagaagatgggccaaaaagaaatgttataacttggcaaggatacaatataaacaagtattccttctatacaaaagcacaagacgagaaaagtacaatgcaaaaaagtgggattactctaagggctaagtctcaacacttcgcaaatgtaaatgttgacaatccccgtgtagctttcatcgcttag

SEQ ID NO: 96815 - DNA, 174 bp, Glycine max
  Peptide Sequence Number=SeqID_213593
atggaacttaggggaagcagcaatgggatcatcggcatgcctcaagtaaggaagaggctgaaaccccggaggagagtgaggagccgaggcattagaacgggaaacaaagagggcccgaaaggaagaatggggtcgaaagaagttttgaggggcgttgtggggcagcaacaatga

SEQ ID NO: 96816 - DNA, 236 bp, Glycine max
  Peptide Sequence Number=SeqID_213594
agaatgacaaggtggtggagtcttgggatgcgtgtaaatcaaaggggagggagaagaaaaaggaggatgaagggggtgcgcctgaggctgggtgttgggttaggttgaggttcattttgggagctgcatttcttcaagatccaaggttgatacctcagtcagtgacactggcaccagcactcattatggatccaagcgccacgaatacagagaaatttctagtctttttccgatag

SEQ ID NO: 96817 - DNA, 348 bp, Glycine max
  Peptide Sequence Number=SeqID_213595
atggtgagtattatggaagatacagtgaaagtggacaacatcccaatccacttgctaagttccttgaaaggcgtggtacttgtgctcaatacacaatgccagggttcctatacaagaattgttgaaactggaaatgccaggttcattgagaatggtgaaactagtgagagtgaagcttcacaaaatgtggagattaaggaagttagagtacaagttcctttaactagtgcttctacttcaagaatttttgttccttatactgttgaaccccacaacaatcaagaagaacaacaaattaatgatcatgaggttaacaatgaacctatagtagaacaatcacaagaaatg

SEQ ID NO: 96818 - DNA, 216 bp, Glycine max
  Peptide Sequence Number=SeqID_213596
atggacaagggactggctgaacatggatggatagaacgagagtcgaactcgcatgtctctcttgctatccccttcccctgctatgcttccttcctccctacctatcatctcccagacccgccttctgtacttggaaacgagctaacaaacgttagcgagcatataagagggcatgaaatagctctaccgggacttctccttatatatagcttttag

SEQ ID NO: 96819 - DNA, 276 bp, Glycine max
  Peptide Sequence Number=SeqID_213597
atgaagcgtctagaagtagccacctctcctaatctctttgcccgcgatggcccattgtcataccctaatttcgtccggggaaaatcaaaaggaagcaggctagcgcaatccgtgaaattccgtgatgtggcggaaatcgaaaagaggggggtacaaatagcaatctggcccacttgggccttccagatccttcctccagaaggctgttgcttctggaggaagcaaccttgctcgcctgggcgagcaacccctgcacccaaaggaggaggagacatg

SEQ ID NO: 96820 - DNA, 135 bp, Glycine max
  Peptide Sequence Number=SeqID_213598
gagaccttggggacgtcaggtggggtgctattgcccaaaaccaagcatgaccaatcccgacccaacccgggcataagtaacatggcactggtaatcgattaccagttgggtgtaatcgattacacagggagatag

SEQ ID NO: 96821 - DNA, 324 bp, Glycine max
  Peptide Sequence Number=SeqID_213599
atgatcactcctcaaactccgcgcatctttcctcctttggaaagcgcacccgtgagcctcgccctcgctcgcccgcgaagggcacgttgcgacactgacgtttccagctatggaatgcttcttttagagatcattggtggcaggcgaaatcttgacatgtcctttggtgctgaggactttttctatcctgattgggcttacaagtggggcttctatggaggctggatctttgagcttcaatggggtcctttaatagtgattttccaccatggagatgcagctgaagataaaggggaagaggtgagaggaggcgtcatccattaa

SEQ ID NO: 96822 - DNA, 942 bp, Glycine max
  Peptide Sequence Number=SeqID_213600
atgggactgagcgaattttatggccagacagacgacaccgcttcactgcagctgttacacacgcttatcgacctgaatatcacctttatcgacaccgcggatatgtacggtcggggccataatgagcggctgatcggccactttcttgccggtctggataacaccacgcgtgagcagtttaacattgccaccaagtgcggaatcgatcgccctgcggaccaggcttatgcccggacgatcaacaaccaacccgactacatcacccgctgctgtaatgagtcgcttaaaaggcttggcgttgagcgcatcgatctgttctatcttcaccgcgtgagccaggttacgccgattgaagagagtatggaatgcctgagccgcctcgttaaagcgggtaagatcaaccacattggcctgtgtgaggtttctgcttcaaccctgcgccgggcccatgccgtccacccgatcgccgccctgcaaaccgaatattcactgtggacgcgcgatatcgaagctgagattctgccggtggtgaaagagctgggtataggtttagttccctactctccgctgggcagagggtttctgaccggaaagtatcgtcataacagcgattttgcggagggtgatttccgtaaaaataatgcgcgctttagtcaatccagcctcgaccataacgcccagcttcttgacgcggtgcacccgcttgctgaaaagtacagctgcacgtcagggcagattgcgctggcctggcttctggcgcagtacgacaagctgatccccattccgggaacgaaacagacccgctatctggcggaaaatgcgcaggccgccgatatcgtgctggaacaggcagatatcgccttactgaacgctatccaccagcatattgagatcaagggcgagcgctattctcaggaagggatgaaaagcattaatgcctga

SEQ ID NO: 96823 - DNA, 531 bp, Glycine max
  Peptide Sequence Number=SeqID_213601
atggcgacggcagagcaccttatcagcaaccatctccccagcgtgaaacagcttcaatgctttcttgcggttgcgcacgagctgaactttcgccgggccgccgaacggctcagcatgactcagcctccgctaacccgacagattaagcgccttgaagccgtgctggagcagccattgtttagccgcagcacccatgacgtcagtctgacggacgctggccgggcgctggtaatcaaagcggagaagatccttcaggcgctgaatgaactcaagccaggcccgctttcttcagaaaagcgcctgcgtatcggcctcacccgcacgctgaattttgcactgattgcgcccattcaccagcaactgctgaaactggacgccgccgacgatgtggaaacgcccgatctgacgtctgcgcagttgctgcagtgtctggcaaaaaaccgcctcgacctggtactgacgggcgaaaaagcaaccggccacgaagataccgttcagtaccagtggatcggtcgtgagccttgctggtag

SEQ ID NO: 96824 - DNA, 839 bp, Glycine max
  Peptide Sequence Number=SeqID_213602
ctctattggtgttcggggttgtcctctttccaaatgtggatgggctagtggatctagcggcaatcgacacttttcttgcttatcaccacaacaaggaaagttcggtcgttgctgttttggtagatgcctatgacacgttcgactggagatgcgagaagagcagcacgagaattgtttgttgtacacctgctctttatgtatggctgggttgtccgttaattggttccctcgatggaaggaaggaggggccggggttctgtgctcatgtgaaaggggtgccatcggaagatagtatcgcgtctttcatcgcacgaggcttcagtgaccccaatgcaaaaatgcttcaaagagtccgaaaagcatggaatacggtgcaaagaaaggataaggagcttagaggaagcaacaacggtgttattggcagatatcataaatggttgaaggctcgaatgcaagggataacttggctcccgaagctaaagagttcaggtggggaagaggctgatgtccctgaggagagcgaagaagtgcaagccttgaaagcggaacttgaaagaacacaagtggtcaaggaaaagttcaagacaatagacatcagggtcaggaaagagtggcagcaacaacgaactcaagctttgaagggccgaaagggacgagtcaagggtggaaagtatgatattagaggacaagttgaaggcttgtcaaaggttgaagaggagcttgaccccccccccttgagtaggacggaagaaaacatgtggacaatcattgaccagtataaagagaagctagatctagctgctagccatgagctaagactagaggatgaacatgcaaaa

SEQ ID NO: 96825 - DNA, 854 bp, Glycine max
  Peptide Sequence Number=SeqID_213603
atggccccagcgccttggccgcctgctgcaggcctttcggccgccatgaacgtgtgggcaatgccggtcgggcaggaggtgacggcgacgatgcgcttgccggcattcgtgccagcgttgctcgacagtgtggccgcgagtggtgcgagcgccgcaaccgggtcgtccagtacctcgcccaggctggcatgcgcgacttcggcattggcgaagcgcgcgatgtccgcctcaccatcccccaccagcagcaggtgcgtcgcggcggcggcgttcgatgcaggcagtgcgccggtcacgccttggtcgctgcggatctcgatcatcagctcgagcccgcgctggcgggcggcgcggcgcagcgcttcggcggcaagaaccgcctcgatgctgcgctcgccagcggcgatgactacggtggaagcgtgcatgggaactcctggaattcttcgggttcgtccttgccgagggcgctgcggttggcgtgaagccagccgccgtgcctccggcaggaggggtcaatccaaccgctcgatcagtacatcgccggcccatgcgcgtacctgcgccgggtccagccgtcgtgcgtcaccgctttgcagccggctcatcgagaacgcggtcgccagccgtgcgcaaccggccagatcgagggaggactccagcatcgcggcagcgatgccggcgaccatggcgtcgcccgcaccgaccgtgctgccctgggccagtcgcggcggtcgtgcgaccagcgcgccgctgcgatcaatgaacagcgcgccgtcggtgcccatcgagatcgctacgagcgcaacaccgcgttcgaccaacgcctggccagcgacacgcagggcgctgcg

SEQ ID NO: 96826 - DNA, 1380 bp, Glycine max
  Peptide Sequence Number=SeqID_213604
atggttgaagagttttacagggcatatcgggcattggctaagagatatgatcatgcaactggagtgatccgccacgcccataagaccatggctgaagcatttcctaatcaaaaatgcgacacccagcagggtgcatttcttgatctagatgaaccacaaaaggatgcttctgctcatttccatgctatcaaaagaaatggtggttatactggtgaacccgattctcctttgaacaaaaccggtttgaaacagctcaatgatctctacatccctagagaacaagaaaatcttccaaagtttgctagaagggggttcaatttttttgagacgcgagaggagagtaatgagcaaaacagtggaagcaacaacactttgtctgagtctgaacgcgtgacaaaagatgagacagaaattttggccttgaagaaagccattgccaaattagaagatgaaaaggaagctggcttgcttcagtatcagcagagtttggagaaaatgtctaatctcgagttagaagtgtctactgcaccagagaattctcgaaaactcgatgagcgagcaagtaaagctgaagctgaagttcaagccttgaaggaagcccaaatcaaattacaggctgaaagtgaagctagtcttcttcagtaccaggaatgcttggagaaaatatctaatctggagaaaaatatttcttctttgcaaaaggaagcaggagaacttaatgaacgagctactaaagctgaaactgagtctgagtccctaaagcaggaacttgctagagtagaagctgaaaagaaagctacccttgttcaatataaccagtgcttggagacaatatcaaaactggaggagagaataaaagaagctgaggagaatgcaagaaggattaaggagcatgccgatatagcagaaaaagaaatcgaagctttggaattacaagttactaaacttaatgaagaaaaggaagatgctgctctccactatcagcaatgcatggagataatttccagtttggagtataatctctcttgtgctgaagaggaggtgcataggctaaattccaagatagttgatggggttgaaaagttagagttcagaacagaaatgtcttctcttggagacatcaaatcacactctgcagaattgggtagactttggggttgcatacaaaaggagagactgcgattcattgaggctgaaactgctttccaaactcttcagcagttgcattctcagtctcaggaagagcttagatctcttgcttctgaacttaacagtaaagtggaaatactggggaatgtggaatctcgtaagccggatttagaggatgaagtacacagggtgagtgaggaaaacaaaattctaaatgaggatatattttga

SEQ ID NO: 96827 - DNA, 235 bp, Glycine max
  Peptide Sequence Number=SeqID_213605
aacttgtaaagggtttttacaagatattgaaactctcaagcgggttgcttggggactggacgtaggcacaaggagagtggtcttcagcggcctgtactggagcatccttcttcacccaagagccatccctctatttgtggtattcgaaagaggacactacattcgcaccgatagagaaggatctcttgactttgacaaaggactcagagtcaagagggacattaaaatgctgtag

SEQ ID NO: 96828 - DNA, 177 bp, Glycine max
  Peptide Sequence Number=SeqID_213606
atgtgggatcaacacgagcttaaaggagcattcaaattgggtgtatttacccctaagacctacactctgaagagtctgttagggcctctccctcctgattcaggaacctacactttctctttaacactgggcatcaacacttttctcaagataaacactggtcgggttattgtataa

SEQ ID NO: 96829 - DNA, 531 bp, Glycine max
  Peptide Sequence Number=SeqID_213607
atgactacaggtgatccaccccaacagaagacaagtcaaggaaatgagaaaaagaaagatgagaatattactcaaggtgatccacctcaacaggagagaagtctaagaatcaagatagaggaagaactcaagaatattacagaaggtgatccacctaaacataagagaagtcaaggaaatgagaaaaagacagaagacaacaatattactcaagaagagctcaaaatgatcctagattttaagagaggtgaggactctattgaggttctttgtggagctacaaacaaaaaatatggagattatgttgggaggctaaaaattaataacgaaggtcaatatttcatcacttgtgagtgttgccctgagtgtcccttggttaatgtcactctagaagcatttgaggaacatgctttaaggggagggagtggaaggtggaagagaaacatctgggatcattgggaagacgaagacagagttccactctggaagacacctctgataaagtattacacaccagacaaatgtgactaa

SEQ ID NO: 96830 - DNA, 333 bp, Glycine max
  Peptide Sequence Number=SeqID_213608
atggataaatttgacatctttgtccctcatcctctcgtaattacatctttgcttccagtagaatgtgggtgcaagccattggtttgttttctcaagcgacctacgctcctgagtttggacttccaagaccgttcaatcagaaattattcgtgctacacatttggtaagggtgctgtgagtaaagcggaaaaaaaaggttgtgaaaacaaaacaacgatggatacctcagagccctacactggggcaatgaaaggcaccatgcataaacctcaagcgaacctaggggcagatgagaagttctcacccaataggttcccagctacaaggtcatga

SEQ ID NO: 96831 - DNA, 261 bp, Glycine max
  Peptide Sequence Number=SeqID_213609
atgtcctcctttcgcgatttggagcagaaatgggcaccaaaggttgaagctttgttgggcaacaatggtggaggaagaaaagaagaagaaggctgcgtgagagagagggagagagagctgtctgaaatttttcggctgagtgaggagagagaatacagctttttgctatgccacatgtctccatctgagtggagcaaaaagggcccactttctcttttgattgtgacccatactcagccacaaaaagtgagaaaaacctga

SEQ ID NO: 96832 - DNA, 396 bp, Glycine max
  Peptide Sequence Number=SeqID_213610
atggccaggagcccgaccttctttgtgggggataatgaaagttttacagcccaggcacctcaacaacatgagctagaaccagaaaatgatcactcatctgaagccaccatctctggagctgttgattttaaaaaaagaagattagagacaagatccaatgaggctgctcatcatggaccagtgccagcgtcagctgatgcaccatttctaggagttgatccatcttcacctcaacacgtagcagactcttcaattcctatcttagagatacatgagggccagaccataccagtcctgcctttggacacttctcttccagctactctagtatggcatctaacaaatgagaaggatgttcagatagaggacaatcaagaccagtcacaggaattttaa

SEQ ID NO: 96833 - DNA, 654 bp, Glycine max
  Peptide Sequence Number=SeqID_213611
atggatgaattagagaggcgtaacttccataagcgcctcaccaatttagctggcactagcattgacctagcattggtgaaggagttctatgccaacctctacagtcctgagggactttcaccaaaacaagtcagaatacagggccacttgataagaattgaagcagacagcctcaatgtctttttagaaacacttgtggtgcttgctgagggtgaatctttacccgcttactcaagatactgcagggtgactactggcataagggaaattgaggttgctctgtgcatacccgaccaaaggtttatttttaatgctgaaggtcgccctgggaagatcctcaaaaaagatctaaccactcttgctcaggtctggagtgttctctcatactctaacctagctccgacttcccacacctcggatttgactatggatagagctaggttaatctttggcctagttactcagctggacatgaatgtcggagatctcatctctggacagatcacttcaatggcccagtctaactcctctagactcgggttccctacttttatcacagctttatgtaggtccaaaggagtcgtttccgatagcttagcctttgaacgtttgagtccggtcattaatttggcctacattaggaaaaactgttag

SEQ ID NO: 96834 - DNA, 207 bp, Glycine max
  Peptide Sequence Number=SeqID_213612
atgtcgcagaatatccataacttgtctctgcgtgccatcggactcgatcgtctccggacagcaaaaagttgcgaaataaccataatttgtctccgcttgtcatcgggtttgccgcctctggatgaaaaaaggcgcagaattaccataatgtgtctctgtgtgccatcggacttgatcgtctccggatggcgaaaaggagcggaatga

SEQ ID NO: 96835 - DNA, 826 bp, Glycine max
  Peptide Sequence Number=SeqID_213613
agagctacacgctgtcaccttcagaggactacacgtcctcgcattcagagagttgcatgccctcaccttcacaggactccacgtcctcaccttcagtgggctacacgtcctcgccttcagaggaatgcatgccctcgccttcagaggacaacacgcccccgcctttagagggctacacgctctcgcctttagagggctacacgccctcaccttcagaggactacacatcctcacctttagaggactacgcgtcctcaccttcagagggctacatgctctcacctttagaggactacatgtcctcgccatcagagggttgcatgctctcacctttagaggactccacgtcctcacctttagagggctacacaccctcaccttcagaggactacacgtccttgccttcggagggctgcacgccctcgccttcagaggactacacgtcctccccttcaaaggaccacacgtcttcacctttagagggctgcacgccttcaccttcaaaagactacaagtcctcgccttaagaggattacaggtcctcaccttcagaggactgcacgtcctcgcctttagagggctgcacgctctcgccttcagaggactacacgtcctcgccttcagagggctacacgccctcaccctaagaggactacacgccctcaccttcagagggctccatgtcctcaccttcagaggactacacgtcctcgcctttagagggctgcacgcccacgccttcagaggactacacgtcctcaccttcagaggactacacgtcttctctttcaaagggcctcacgccctcaacctgagaggactacac

SEQ ID NO: 96836 - DNA, 258 bp, Glycine max
  Peptide Sequence Number=SeqID_213614
atgcgtttcacggaagtaatttgggcattcccttctttcagaaccattttgttaaacagatatcccgacatacatcatgtcccgccatttgcaggccttttgagccaaaacgtcaactatttggccattaccttgacctacgatggaaatttccaaccttaccctaggaagagagaacaggaggatcttctaagcgaagcttctcttgttggacaaaactcaaccaggaccgcattaagacaaacatactataactaa

SEQ ID NO: 96837 - DNA, 363 bp, Glycine max
  Peptide Sequence Number=SeqID_213615
atggtagcctggcctggggcccaaccttctcttgatagggaaggtgaaggtcccacagcctgggtaccccaacatgtacgggatgcttcctccaagaccaccattccagagccattcactcttcatcctgaggcaggggaagaacaggtgagaccagagactgctgttactcctgagagatcccttgagggcacatcagagcctcgtactccagtggcagacctctcctcaccgcagcctatagctgacccttccactcatttacttgacataccagaggaccagaccacaccagtcctggcactgaacacctctcctccagctactccagtacttcatctaatagatgaggaggatgcttag

SEQ ID NO: 96838 - DNA, 500 bp, Glycine max
  Peptide Sequence Number=SeqID_213616
ttcatattcctaccaagaagagtttattggagctttcatcacaagatgccttgttggccctaaataagttgttgtccaagaaacttgaagctttaaccgaaacactaagttgcacactttgtggtggagctcatgggccaggcttgtgtattcccactgaagaaacatctcatgaagttaattacatgggaaaccagcctagacaaaactttaatgtagttggattttctggatttcaacatggccaaccttaccagcagcataatcaatggagaactcaccctagtaatcagttcaataaagaccagggtgggccacctaataggccacaacaacaagggcctagcttatatgagagaacaaaaaagctggaagaaactcttgctcagtttatgcaggtagggcaactagccaaacagcttatagaaaaatcttctagtacttttggagctaaaactgagcagaatccaaaagaagaatgcaaggctgtgatgacctga

SEQ ID NO: 96839 - DNA, 414 bp, Glycine max
  Peptide Sequence Number=SeqID_213617
atgaaagatcttgtgagcgcggaagatgacgtaaatctccgcgtgtcaacgggcttgttggccgcgattgacgaggggcgcaggagacgacatagcaaaaaggtttatacggatgaccactcgggtatctccgcccgccagcgtgactcaaaagtcagtatgacagatcttgtgagcgcggaagatgacgtaaatctccgcgtgtcaacgggcttgtcggccgcgattgacgaagggcgcaggagacaatatagcaaaaaggtttatacggatgaccactcgggtatctccgcccgtcagcgtgactcaaaagtcagtatgacagatcttatgagtgcggaagatgacataaatctccgcgtgtcaacgggcttgtcggccgcgattaacgaagggcgcaggagacgacgttag

SEQ ID NO: 96840 - DNA, 528 bp, Glycine max
  Peptide Sequence Number=SeqID_213618
atggaagggttagtggacctagcagcgattgacgctttcctcgcctttcatcatggcaaggaaagcccggtcgtcgccattttggccatgtatgacacgttcgaccggggatgctcgtctatccgctacaaggtcaccgctcgtgcgtcgaaaaagaaaaggattctatcttcatgcgaaggatgtccaaatgttcccttgatgggaacaaggggttgtattaattataaatcccgtcctcgccataagacagcttggctaccccatgagaggagtgccatcagacgaaagcatcacgcctttcatcgcacgggggtttcagtgaccacaatgcgagggtactccaaggagttcgcaaggcatgggatgcggcgtgaagaaaggacagagagcttaggggaagcaactgtgagagacaatgaggttaaagcttcggaagaaagtgatgaggtacaagccctaaaggcaaagcttgaaagagcccgggtagtcaaagagaagttcaagtccatagccatcaaagtctga

SEQ ID NO: 96841 - DNA, 630 bp, Glycine max
  Peptide Sequence Number=SeqID_213619
atgtccgaaaaacactggtccaacaccgagctgctgcatcagacggtgaccaacccgaacattatcgtcaaaggcacccacagctactacagcgactgttgggataacggcttcgaacgctcggtagtgcgctatctgcacggcgacgcggtcagccggcaatggcagccgctgggcgacatagaccgcctgctgatcggcgattacgtgtgcatcgcggccgaagcggtgatcctgatgggcggcaaccatacccatcgcatcgactggctgagcctgtatccgtttatggcaaccatcaagcaggcgtaccgccccaaaggcgatacccggctgggcgacggttgctggatcggcatgcgggcgatgctgatgccgggaatctctataggtgagggggcgatcgtcgccgccggcagcgtggtggccggcgatgttgagccttatgccatcgtcggcggtaatccggcgaggtttatccgttggcggttcgcgccggaggtcatcgcgcggttgcttgccttgcgcctctatgacttgtcggaggcggactttacggtgattcagcccctgctcgccgatggcgatatcgatgcgttggaaaggggaattgcggccttgcgccgttaa

SEQ ID NO: 96842 - DNA, 563 bp, Glycine max
  Peptide Sequence Number=SeqID_213620
ggcaagggcgacatccgcggcgtagcggcgccggaagcggccaacaacgcctctgcctgcggttcgttcattccgatgctgacgctgggggtgccgggttccggcaccacggcggtgatgatgggcgcgctgacgctgtacaacatcacccccggcccggcgatgttcaccgaacagccggatatcgtctgggggctgatcgccgcgctgctgatcgccaacgtcattttgctgatcatgaacctgccgctggtcggcctgttcacccgcatgctgaccatcccgctgtggttcctggtgccggcgatcgccgcggtttcggcggtgggggtttatgcggtgcacagcaccaccttcgacctgctgctgatggtcggattgggcgtgttcggctacatcctgcggaaaatgcacttcccgatgtcgccgctgattctgggcttcgtgctggcagcatcgcgcaaacgctgctggtgctggcggtcgcggtactggcgctgccgccgctgctgcgcctgatgcgcaaacgccgccaatcggcgatcgaggccaaggccgagtaa

SEQ ID NO: 96843 - DNA, 1148 bp, Glycine max
  Peptide Sequence Number=SeqID_213621
ggcgtttcggtcggcggcgtgtttctgctcgatcagaagcagctcaccctggcggcgctgtgcgtggcctgcgtcgcggcgatcctcaccggctggtggctgaccaaaggcacaccgctgcatgccgttcgtcagtcccgtcgtcttgtcgataccatcggctgggcggtgatcctgccgcagatgctggccatgctcggcggcgtgttcgtggtggccaacacgggcgactcggtacagaaggtggtgagtctgtttgtgaacccggatagccgctttatgctggtggtgatttactgcgtgggtatggcgctgtttaccatgattatgggtaatgcctttgcggccttcccggtattaagtgccggtatcgccttgccgctactgcggcacgttgatgacgccgatggccgcgaacttcaatatcgttcccgccgcgctgctggagctgaaagacaaatatcaggtgatcaagatccagatcccgaccgcgttaaccctgctggtggtgaacgtgttcttaatgccgacgcgtttgcccgcatgcctttgacctatttgcgccaggaatacccgaaccacatcatgcacctgcttaatgatgatggtgacgtactgccgccgcgcgagctgcatcccattttctacggctgttttgactggcactcggcggtgcacggctactggctgctgctgcgctgcgtgcgcctctatccagaattaccgtgccgggacgcgatcgtcgcgctttttgacgagcacctgaccgaagagaacgtggcgagggagttggcctatttcaccgcgccgttccgcgcctcgtttgagcggccgtatggctacggctggctgctggcgctggcccaggagctgaaacagtcgtcgctgccgcaggccacaggctggtaccagacgcaggcgccgctcacccaggacattcgcaaccggctggtggactacctcggcaagctcacctatccgatccgcgtcgggacgcactacaacaccgcgtttgccctcgcgctggcgctggattatggtcgcgcagtgggcgataaggcgcttgagcaggcgattgtggcagcggcggagcggttttatctcgccgacacgcgctatccggctcattatgagcccggcggagacga

SEQ ID NO: 96844 - DNA, 114 bp, Glycine max
  Peptide Sequence Number=SeqID_213622
atgaagtgtttcactcaatttggagtgcttcttattccaatagctcttaaggtggttggccccatgcttcttgacttaaattcttcaagggatggcatcaatccttctttctaa

SEQ ID NO: 96845 - DNA, 903 bp, Glycine max
  Peptide Sequence Number=SeqID_213623
tcgtctgcgtctccgacgcagaaggcacgagcaccacggactgggtggcacccgaagacgcggaggccgaaggaccaaccgaagcgcccgctgtgacagaggagacgggcgctctcgatgcgcccatcaccctctcgaccgacatggtcgtcacgatcgacaaggtctcgacgatgaccgtcaagccggagacgccaggggagtacgcgggttccgccgtcgtcgtcgaggtctcggtcgtcaacgactcgaagcgcacgcagagcatcgactccgccgtggtcaacctcgtcacagacgacggagacgtcggcgtcgcgacgaccgccgggccgaacgagccgctggcgggagatgtcgccgccggtgcgaaggcgaccggttcctacgtcttcatgctggacccggtcaagggccgccaggtgaagatcagcgtcaactatgccgcgggcgagccggtggcgacgttctccgtggcgcgccacgacgcggatcacgcggatctatcacagagcactttcgcaatttcacattcaaagaagaagtctcaggcggctggggagtcactcatggggaactcaacgaactcgcggcgcgtgcttggcgcgatcgcttcggtcgtgacgacggcgttgctcgtcgcgggcatgaccacactgggcgcgcaggccgcgtcggcagacgttccgtcgccgccgccgctgctgcagcgcgacgacgacgtcgtcacgtccgatccgatcccgacggtgcagatcgacaacgggtacgtctggtcgcagacgatgatcgggtcgacggtgtacgccgtcggcaagttcgacaacgcccgtgctccactcgccgcgccgggtacgagcctgacggcgcagctccaacgtgctggcgtatacatcaacacgg

SEQ ID NO: 96846 - DNA, 429 bp, Glycine max
  Peptide Sequence Number=SeqID_213624
atgaagaaggctacagctagaggtagcaaggctgagcagaaagctaagaagaagcaagtggaagaagaggtttgtcaactttctgctaagcttaaggggaatcatgccaaagaactggttgcattaggctatagcagtggtaatggaaatgaaaagagcaatttggacagtctggtcaaggccatagttggagtatctgttactagtcaacctgaagatacaaaggtttaccaggaatccattggagcagtttgtatcctagattgggcaaaggaaacaatggttctacagtttgtatccattgaagtagatgcccaacagctcatgaaggtagaagtgcataacctagcttttactagtgtaaaacctggcttttatacagtttcatacagaggtgtccctagtgtaaaacctggcttttactattaa

SEQ ID NO: 96847 - DNA, 231 bp, Glycine max
  Peptide Sequence Number=SeqID_213625
atgaacagaccatccaaagcaagtgttagtagagtttgttttcctgtttctgtatccatctcatctgacaaagacacgtcgaccaagcctcttggaaaatcgtccaaggtgaagcctaaaggagagagtataaatatcatcaggaaaagggaagctgacctccccatccactttaaaccaccatatttgctgcaaatatgctacagtgttgaacctgaaatgaacaaataa

SEQ ID NO: 96848 - DNA, 209 bp, Glycine max
  Peptide Sequence Number=SeqID_213626
tcttgtctcttccttaccctaccctacatgtccctaacttcaaaaccgcaacaacaaaaagtgagaacgaacacatgaagcttacctcgacaccaacatcgacaatggcaacgagttggcttcgactgggagtgagaaagaagagtcatgacgtggagaggaataccagagctgcgacagagaggaagaaacattacagacgtgactga

SEQ ID NO: 96849 - DNA, 138 bp, Glycine max
  Peptide Sequence Number=SeqID_213627
atggtatcttcttccacgaagacctcgtgtagaagcatgtttgttagattggtgggaacttggaagaaagacaaggatagatatatagcaaatagtaatacaaagggtgaagcagctggtttggttatgttagtttag

SEQ ID NO: 96850 - DNA, 738 bp, Glycine max
  Peptide Sequence Number=SeqID_213628
atgtctgctgcaaacaattctcctgtcatacagagctgtatgcagacaaatggtggttccatgaggttgactgattgtcatttgaaatctattgataaaatgaaaacagtggacaagttatctccctccaacagaattagaatatattctaaattatccatcaaaaaccggttaaaggcatcctcacttacccttggtgatgcggctcttgccctacattatgcaaaaatgattgtattgattgagaggatggcgtcatcacctcaccttgtggatcttgcagcaagagatgatctgtacaatatgcttccaactactgtaagaactgctctaagggctaagcttaagcgccatgtgaaaagtaaatcatcttccaatggtcatgatgcaaaccttgctgccgaatggagtccggtgcttgcacagatattggattggttggctcctctggcacataacatgataagctggcattctgagagaaattttgagaaggagcaatcgattttcaacacaaatgttttacttgtccaaactctttactttgcaaatcaaccaaaaactgaggctgcaataattgatcttcttgtagctctcaactatgtgtgcagggttgatacaaaagttggcacaagagatacactggattgtgctaatagcactagatcttttaatggtgttcgtttgagaaagaatggaatgtacaacgaatttttatatactgacgttgacacttga

SEQ ID NO: 96851 - DNA, 2025 bp, Glycine max
  Peptide Sequence Number=SeqID_213629
atgaaacaggtttgtctttgtctcataatcctgacactggccttgtgcttgtgcatcctctgtgtttctgcagaggctgcagggcagaacgatacactcgcacttaccgaattccgtctccaaaccgacacccacggcaacctcctcaccaactggaccggcgccgacgcctgctccgccgtatggcgcggcatcgaatgctccccaaacggcagggtagtgggcctcacccttccttccctcaacctccgcggcccaatagactccctctccacactaacctacctccgtttcctcgacctccacgaaaaccgcttaaacggcaccgtttcacctctcttaaactgcacaagcctggaactcctctacctctcccgcaacgacttctccggcgagattccgccggagatatcctccctccgcctcctcctccgcctagacatctccgacaacaacatccgaggccccatccccacacaatttgcgaaactaacccacctcctcacgctgaggttacagaacaacgccctctccggccacgtccccgacctttccgcttccctccaaaacctcaccgaactcaacgtcaccaataacgaactccgcggccacgtctccgattccatgctcaccaaattcggcaatgcgagcttctccggaaaccacgccctctgcgggtccaccccgctacctaaatgctccgaaacagagccaggcacagagactacaataaccgtccctgcaaaaccgagctcgttcccgcaaacaagtagtgtaaccgttcccgacactccgagaaagaaaggattgagcgccggtgtaattgtggcgatcgtggtggcggtttgcgtggcggtgctggtggcgacgtcgttcgtggtggcgcattgttgcgccagaggttccacctctggctcggtggtggggagcgagagtgccaagaggaagagtgggagtagcagtgggagcgagaagaaggtgtatgggaacggtgaaaacttggatagagacagcgatgggaccaatactgagacggaaagaagcaagcttgtgtttttcgataggaggaaccagtttgagttggaggatctgcttcgagcttcggcggagatgctcggaaaaggaagcttggggactgtttacagagcggtgctcgatgacggctgcaccgtggctgtgaagagactcaaagacgctaacccctgcgagagaaatgagtttgaacagtacatggatgttgtagggaagctcaagcaccccaacattgttagactcagagcttattattacgctaaggaagaaaagcttcttgtctatgattatctccccaatggaagcttgcatgctcttcttcatgggaaccggggaccaggaaggattccgttagattggaccacaagaataagtttggtgttaggtgcggctagagggttggcacggattcacgcatcaaaaatacctcacgggaacgtgaaatcttccaacgtgcttctcgataagaacagcgtcgctttaatctctgactttgggttatcattgatgttaaaccccgttcatgcgattgcgaggatgggagggtacaggacgccggagcaagttgaagtgaagaggctgtctcaagaagccgacgtgtacggtttcggggtgctgctgttggaggttctgacggggagggctccgtcgacgcagtacccatctccggcgcggccgcgtgtggaggagctggctgaggtggatcttccgaagtgggtgaagtcggtggtgaaagaagagtggacttcggaggtgtttgaccaggagttgctgaggtacaagaacattgaggatgagttggtggcgatgctgcacgtggggatggcgtgcgtggcggcgcagccggagaagaggccgtgtatgttggaggttgtgaaaatgattgaggagataagggtggtggaacagtcgccgctcggagatgattatgatgaggctcgctcgcgcacttcgttttctccttcacttgctaccacccaagacatccaatga

SEQ ID NO: 96852 - DNA, 855 bp, Glycine max
  Peptide Sequence Number=SeqID_213630
atggggggtgaaacggtgaacgggtcatggttcagtgttttgtggccagtctctcgcaagagtgcatcagataacaaggcagtagttggagttttggcattagaagttgcagggttgatgttgaaggtggttaatttatggcaatctttgagtgatgcggaggtattgagtctgagggaagggatagtgaactcagttggagtcaaaacactggtatcggacgatgacgattacttgatggaacttgcattgaacgagatactggataactttcaatctctagcacggtctgtggctaggttgggtaagaagtgtgtggatccagtttatcatcgttttgaacattttgttcataacccggctcagaattatttccaatggtctgggtgggagtataggtggaaaaagatggagaggaaagtgaagaaaatggaaaaatttgttgccgctatgacacagctttgccaagaggttgaggtgctagcagaggttgaacagactttcaggagaatgcaggcaaatccggaattgcacaagttgaaattgcttgagtttcagaagaaggtcatgttgcagtgccaggaggtgaggaatctgagagacatgtctccatggaatagaagttatgattatgttgtccggttgttggcaagatcactatttacaatcctggagaggatcatacttgtctttgcaaataatcacccatcaactgttcaagaacaaaatgattatcagcatatgaatgctaacaatcttctgcgaagtcattccttttctgttatacattcttctgtacatccttcggagcatgatctctgtggcttcaattcaggacctgttggggggaggcca

SEQ ID NO: 96853 - DNA, 402 bp, Glycine max
  Peptide Sequence Number=SeqID_213631
atggcaggaaagaacaagagtatcaagtttagtgattctgaagacgagtatgattatgaaaccgacgactcggggactgacttgaatcttcatttggagaaactgaatcttggaccacgaaagaagttgcttattatgaaccttaacgggttactgctccttagagttcatcgttgttctaaaagtgaaattccgaagtctcgtgcagctgatgggcactacagaggctatcttgtttttaagagaccatttagtcaagagtttatgaaattctgcttggaaagatttgaagttggtatttggtcatctgcaatggattttcgctatgaaaacaggcacaacatagatgctgccttgaattatgccattggatctttaagaagcaaactgttatttgtttgg

SEQ ID NO: 96854 - DNA, 597 bp, Glycine max
  Peptide Sequence Number=SeqID_213632
atgcatgaagacgcaccgcgcgttcgccacgttcgcgaaacgctcttgtccgataactggtacacgctgaaaaaatatacctttgagctgttgcgccgggatgggcgctggcaggagcagagccgggaagcctacgaccgcggcaacggcgcggttattctgctctataaccgccacaagcagagcgtggtgctcatccgccagtttcgttttccggtgtggatcaacggtcacgacggctttctgatcgaagccgccgcgggattactggataacgcctcgccggaagagcgcattatcgccgaagcggaagaggagaccggatttcgcgttacccgcattgagccagtattcaccgcgtttatgagcccggggtcggttaccgagaagctgtacttctttattgccgaatactccgcggacgatcgccgtggcgatggcggcgggctggcggcggaaggagaggatattgaagtgctggagtggccgctggcgcgggcgttacaggccattcgcgatggcgaaatcgtggatgcgaaaaccattatgctgctgcagcacctggcgttaaatgccgatacgctccttgccggttaa

SEQ ID NO: 96855 - DNA, 282 bp, Glycine max
  Peptide Sequence Number=SeqID_213633
atggtaatcgattaccagtgccctatcaccctgtgtaatcgattacacccagctgtaattgattaccagaggtcatttaacatcttgtctccatttttaagccctgtaatcgattacccacgaatggtaatcgattaccagaggccattttacatataccacccaagatacatggctggccagccgccacacaagcttccttgctttgtggaatttgttcttttatcggttgactgccaggagctctcctgtttaggtacgtcacaggttctcactgactga

SEQ ID NO: 96856 - DNA, 180 bp, Glycine max
  Peptide Sequence Number=SeqID_213634
atgtcgttctcgactggcgatatcccacaccacatgaacaaagaggaaaagactgaaacactcagctttctctccaaaaacactaccctcgagaaaatcctattggtccgaaatcgtgtgcaaaacaaagtcatggtgcagttatggtttgggaatagggtgaaacacttgcctgtgtga

SEQ ID NO: 96857 - DNA, 1575 bp, Glycine max
  Peptide Sequence Number=SeqID_213635
atggcattcaacggttatttccttttgggcctcatagttcttgttcttgttaggtcttccaaagttacatgcgaattagaaacagatacagtttcacctattattgacatttcactgagtcggaagagtttcccagaagggttcatctttggggcgggatcttcctcgtaccagttcgaaggtgcagcaaaggaaggtggtagagaaccaagtgtatgggataccttcacccataattatccagaaaagatcatggatagaagcaacggagacgtggccattgactcatatcaccactacaaggaagatgttggaatgatgaaggatatgaatttggattcatatagattttccatttcttggtcaaggattctcccaaaaggaaaactaagtggaggtataaatcgagaaggaataaactattacaacaatcttatcaatgagctagtggctaatggtatacaaccacttgtgactctatttcattgggatcttccccaagccttagaagatgagtatggcggattcttaagtccacgcatagtgaaagattttcgggactatgcggaactttgcttcaaggaatttggtgatagggtgaagcattgggttactttgaatgagccatggagttacagccaaaatggctatgcaaatggacgaatggcaccaggacgttgttctgcttggatgaatttgaactgtactggtggtgattcttcaacggagccttatttggttacacaccatcaacttcttgctcatgcagcagttgttcgtgtgtacaagaccaagtatcaggcctttcaaaaaggtgtgataggcataaccttggtagctaattggtttttgccgctcagagataccaaatctgatcaaaaggctacagaaagagcaattgacttcatgtatggatggtttatggatccattaacatccggagactatccaaaaagcatgcgatctcttgtgagaacaagattgccaaagtttacaacagagcaatccaaactacttatcggttcatttgattttattggcttaaactattactctacaacatatgcctctgattcacctcagctaagcaatgccagacctagctacttgacagattctcttgtcactcctgcatatgaacgtgatgggaaacctataggaataaagattgcttctgattggttgtatgtttatccaagaggaattcgtgaccttttattatataccaaggaaaagtacaacaatcctttgatttacatcactgaaaatggtataaatgagtataatgaaccaacattatcacttgaagaatctcttatggataccttcagaattgattatcattatcgtcatctcttttatcttcaatctgcaattaagaatggcgtaaatgtgaagggatattatgtgtggtctttgttcgacaattttgagtggtcttcaggctatacatcacgttttggaatgatttttgtggattacaaaaataatttgaagagatatgagaagctctctgcacagtggttcaaaaattttctcaagaaagaaacaagactttatagctctactaaataa

SEQ ID NO: 96858 - DNA, 1320 bp, Glycine max
  Peptide Sequence Number=SeqID_213636
tttgaaggtgcagcaaatgagggtggtaggggactaagtatatgggataccttcacccataaatatccagaaaagatacaggacaaaagcaatggagatgttgccattgatgcttatcatcgttacaaggaagatgttaagattgtgaaggatatgaacttggattcatatagattctcgatttcttggtccagaatactaccaagtatacaaccattggtaacgctttttcattgggatcttcctcaatctttagaagatgaatatggtggcttcttaagtcctcgcatagttaaagattttcgagattacgcggaactttgcttcaaggaatttggagatagagttaagtattgggttactttaaacgagccatggagttatagtcagcatggttatgcaaatgggggaatggcaccgggtcgttgttctgcttgggtaaatccaaattgcactgggggtgattctggtacggagccttatttagttacgcactaccagttacttgctcatgcagctgctgttcgtgtatacaagaccaagtatcaggtatcacaaaagggtttgataggcattaccttagtagctaattggtacctaccattctcgaataccaaagctgatcaaaaggcgactgaaagagcaattgacttcatgtttggatggtttatggatccactaacatctggagactatccaaaaatcatgcgatctcttgtgagaacacgattgccaaagtttactacagagcaatctaaactacttattggctcatttgattttattggcctaaattactattcttcaacctatgcctctgatgcacctcatctaagtaatgctagacctaactatgtaacagattctttggtcacccctgaatttgagcgtgatgggaaacccataggtataaagattgcttctgattggttgtatgtttgtccaagaggaattcttgatcttctattatatacgaaggaaaagtataataatcctttgatttacattactgaaaatggtataaatgaatttagagacgaaacactatcattagaggaatctcttttagatacatttagaattgattatcattatcgtcatcttttttatcttcgatcagcaattaggcatggtgtgaatgtgaagggatattacatatggtctttattcgacaattttgagtggtcttccggttatacggtgcgatttggaatgattttggtggattacaaaaataatttgaaaagatatcataaactctctgcaatatggatcaagaattttttgaagaaaactagcctttatgattctagcatatga

SEQ ID NO: 96859 - DNA, 588 bp, Glycine max
  Peptide Sequence Number=SeqID_213637
atgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttaccagatga

SEQ ID NO: 96860 - DNA, 564 bp, Glycine max
  Peptide Sequence Number=SeqID_213638
atgaaggcaaagatattagagaatattataatcatgtgtagactattacgatctttttcccgtatctcttttcgctcaaactcctcctcatcatcttcttcaagaaactccaatttattaaatgatcaagataaccagacccaagaggtcgccccaaaacacaatctcttcgatgaggaagtccgattcgaagatatcaatcaaaacatggatgactggaacattccagaaatccctcaggatcaactatacgttcctgaaacaataaaggataaacacaactttgattacataatcaaaacagtagaaaacaatattcctctaggacaagatataggggaagaatttcatttactttcaaaaaattcaatttatgaacatagccgtaagtataaatatctacacatcggttgtgtacaagtagtcatcaagcccttaattgatatgggcatagatgcggcagttttaatgtgtctaagagacattaggcataatcaatttgaagactccctaattggaacagtcgaaaccagcctaggacaaggtccaatatatcttaactga

SEQ ID NO: 96861 - DNA, 163 bp, Glycine max
  Peptide Sequence Number=SeqID_213639
aaaaaggcgccccacttcttctgctgcttcgtcttcttctcctctcacatctccttccgttccgccatttccttcctcgcgcaagcttcttcctgcattttggagctgcatttatgtggttggacttgcgcaaacttcttccgtcgagggtaaacgccattga

SEQ ID NO: 96862 - DNA, 1578 bp, Glycine max
  Peptide Sequence Number=SeqID_213640
atgacatttaaaggctattatttccttttgggactcatagctcttgttgttgttagcacttccaaagttacatgcaaaatagaagcagatacagtttcacctattattgacatttcactcaatcggaacagtttccctgaaggcttcatctttggggcaggatcttcctcgtaccagttcgaaggtgcagcaaaggaaggtggtagagaaccaagtgtatgggataccttcacccataattatccagctaagatcaaagatagaagcaatggagacgtggccattgactcatatcatcactacaaggaagatgttaggatgatgaaggatatgaatttggattcatatagattttccatatcttggtcaaggattctaccaaaaggaaagctaagtggaggtataaatcaagagggaatcaactactacaacaaccttatcaatgagctaatagctaatggtatacaaccactcgtcactctttttcattgggatcttccccaagcattagaagatgagtacggaggcttcttaagtccacgcatagtgaaagattttcggaactatgcggaactttgcttcaacgaatttggtgatagggtgaagtattgggttactttgaacgagccatggagttacagtcagcatggttatgcaaatggaggaatggcaccaggtcgttgttctgcttggttaaattcaaattgcactggaggtgattctgcaacagagccttatttggttacacatcaccaacttcttgctcatgcagaagctgttcgcgtgtacaaaactaagtatcaggcatctcaaaagggttcaataggcataaccttagtagctaattggtttttaccgctcaaagataccaaatctgatcaaaaggctgctgaaagagcaattgacttcatgtatggatggtttatggatccattaacaacgggtgactatcccaaaagcatgcgatctcttgtgagaacaagattgccgaagtttactacagagcaatccaaattacttattggttcatttgattttattggcctaaactattactctacaacatatgcctcagatgcacctcagctaagcaatgctagacccaattacataacagattctcttgtcactcctgcatatgaacgcgatggaaaacctatcggtataaagattgcttctgagtggatatatgtttatccaagaggaattcgtgaccttttattatataccaagaaaaagtataataatcctttgatttacatcactgaaaatggtataaatgagtacgatgaaccaacacaatcacttgaggaatctcttatagatattttcagaattgattatcattatcgtcatctcttttatcttcgatctgctattaggaatggcgcaaatgttaagggatattatgtatggtctttgttcgacaattttgagtggtcttcgggttttacatcgcgatttggaatgacctatgtagattacaaaaatgatttgaagagatacaaaaaattctcggcattatggttcaggaattttctcaagaaagaaaccaaactttatgggtatagcaaataa

SEQ ID NO: 96863 - DNA, 1494 bp, Glycine max
  Peptide Sequence Number=SeqID_213641
atggcatttaaaggctatttcgttttgggcctcatagctcttgttgtcgttggcacttccaaagttacatgcgaaatagaagcagataaagtttcacctattattgacttttccctcaatcggaacagtttccctgaaggcttcatctttggggcggcatcatcctcctaccagttcgaaggtgcagcaaaggaaggtggtagaggaccaagtgtatgggataccttcacccataaatatccagataagatcaaggatggaagtaacggtgacgtagcgattgactcctaccaccactacaaggaagatgttgcgatcatgaaggatatgaatttggattcatatagattgtccatatcttggtcaaggattctccctgaaggaaagctaagtggaggtataaatcaagaaggaatcaactattacaacaaccttatcaatgagctagtggctaatggtatacaaccacttgtcactctttttcactgggatcttccccaagcattagaagatgaatatggtggctttttaagtccacgcatagtgaaagattttggagattatgcggaactctgcttcaaggaatttggtgatagggtgaagtattggattactctgaatgagccatggagttatagtatgcatggttatgcaaaggggggaatggcaccaggtcgttgttctgcatggatgaatttgaattgcactggtggtgattctgcaacagagccttatttggttgcacatcatcaacttcttgctcatgcagtagctattcgtgtgtacaagacgaagtatcaggcatctcaaaagggttcaattggcataaccttgatagctaattggtatataccgctcagagataccaaatctgatcaagaggctgctgaaagagcaattgacttcatgtatggatggtttatggatccattaacgtccggagactatccaaaaagtatgcgatctctagtgagaaaaagattaccaaaatttactacagagcaaaccaaactacttattggttcatttgattttattggcctaaactattactcatcaacatatgtctctgatgcacctctgctaagcaatgctagacctaattacatgacagattctcttaccactcctgcatttgaacgcgatggaaaacctataggtataaagattgcttctgatttgatatatgttactccaagaggaattcgtgaccttttattatataccaaggaaaagtacaataatccattgatttacatcactgaaaatggtataaatgagtataatgaaccaacatattcacttgaggaatctcttatggatatttttagaattgattatcattatcgtcatctcttttatcttcgatctgctattaggaatggcgcaaatgtaaagggatatcatgtatggtctttgttcgataattttgagtggtcttcaggttatacagtacgaggtcctattggacttagagggaaaatagagatgtag

SEQ ID NO: 96864 - DNA, 1551 bp, Glycine max
  Peptide Sequence Number=SeqID_213642
atggcattgaatttgagcatgttaccattgctctgcgttttgtctctttttgttacctcggccatcacaattactctttccaagagcgttgcacccattcatgacgtttcttatctcaaccggagcagtttcccgcaaggctttattttcgggtcagcatcctcagcatatcagtatgaaggtgctgcaagggaaggtggaaaaggaccgagtatatgggatactttcactcataaatacccagaaaaaataaaagatggaagtaatggagatgtagcggacgactcatatcatcggtataaggaggatattggaatcatgaagtatatgaatttggatgcttatagattttccatttcatggtctagggtactaccgaaaggaaagcttagtgcaggtgtaaatcatgaaggagtaaactactacaacaacctcatcaatgagctcatggctaatggtctgcaaccatatgtgacccttttccattgggacgttccccaagccttagaggatgagtatggtggttttttaagtcctcacattgtagatgattttagggactatgctgaactttgcttcaaggaatttggcaatagggtgaaacattggattactttgaatgaaccgaggagtgtgagcaagaatggctatgcaaatggcaggtttgcacctgatcggtgttctgattggctaaaactgaattgcacaggtggtgattccggaactgagccctatttgacttcgcacaaccaacttcttgctcatgctgcagcagccaaactgtataagaccaagtatcagacatctcaaaagggtttaatagggattaccttgaattctgactggtatgtgccggtttctaaagagaaatctgatcaagacgctgcacgtaggggccttgacttcatgtttggatggtatatggacccactcacaaaaggtgagtatccaaaaaccatgcgatctatgttgggaaaccggctaccagagttctccaaagaagaagccaggcaactaaaaggatcatttgattttctgggcctaaactactactcatccttttatgctgcccatgcaccccaccaacgtggtgccagaccaaccttacaaactgatgctcttgttaatgttacaaatcaccatgacggcaagccccttggtccaatggctgcttctaactggttgtgcatttatccacgaggattccggcaactgttgcttttcatcaagaagcaatacaacaaccccttaatttacattactgaaaatggttatgacgagttcaacgatccaacactatcacttgaagaaagccttttagatacttacagagtcgattacttatatcgtcatctttattatcttcaaactgcaatcaaggatggcgtgaatgtaaagggatattttgtatggtcattgctggataatttggagtggaactctggctatactgtgcgatttggactcgtcttcgtgaatttcagggatggcttgaaaagatacccaaaactctcggcacattggttcaagaatttcctcactaaatcttag

SEQ ID NO: 96865 - DNA, 895 bp, Glycine max
  Peptide Sequence Number=SeqID_213643
atgaaatccaatcttggaaacacagcataccacttttttttactacccaaaggttttgatatatttcgaaatcgagaaatttcaagtggagcgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattag

SEQ ID NO: 96866 - DNA, 179 bp, Glycine max
  misc_feature (83)..(83): n is a, c, g, or t
  misc_feature (173)..(173): n is a, c, g, or t
  Peptide Sequence Number=SeqID_213644
atgtttgcacattcgattaaaggctgccgtcccttgggacgggcgtgtggggtgctaataccttccccgtgcgtaaatacaantcccgaacctttcactaaaaagttcgcagatcgccgcgcgtattcctttcgtggaacacgcatcccgcgagtcatgcgtcgccctcccgncgaagg

SEQ ID NO: 96867 - DNA, 309 bp, Glycine max
  Peptide Sequence Number=SeqID_213645
atgggagatcgcctagagaatatgatttgtgatcttggacaagagtcttttcagcaagcacatgtccctatgtatgatacattgcaaactgattcaaaaaagctgttgtatctggggtgcaacaatttgttaatcctattgttagtggtattaagtctagttaatctcaaggctagatatgagtggagtgacaaaagcttcacttcagtgcttcaagtagtgcacaatatgcttccagaggaaaactcactgccaaaaagttactatcaagcgaagaagatactatgttcgatgggtatggagtattag

SEQ ID NO: 96868 - DNA, 156 bp, Glycine max
  Peptide Sequence Number=SeqID_213646
atggctctcctggctgcttctcttgttcctgcttgttttttgggaaagagtggtgtgtctctcaaggactccaccttgtttggtcttttattgtcagaacctatcaaagctaactttagctcttccgcattgaggatcaaggagttgtcactataa

SEQ ID NO: 96869 - DNA, 435 bp, Glycine max
  Peptide Sequence Number=SeqID_213647
atgaagatcttaaaaaggtatataaagaatctacactgttctgaagcatctattattgaaaggtacattgcagaagaagctattgagttttgttctaagtacatggaaaaggcaaaacctgttgggattctggagtctcgccttgacgagagagtgagagatataatcttcggtgaccataatgcatctgaaacattaaggaagttagtagatgggcctaaaagaaatgttacaacttggcaaagatacggtatcaacaagtatttgttttacacaaaatcacaagacgacaagagtacaatgcaaaatagtggttataagtgggtagatagaaatatcggtgtgcaaaccgatgattttggatttactttggtagatctgaagaagcttgcttatcagaatgatcctttcatcatggcagaacaagctatatag

SEQ ID NO: 96870 - DNA, 381 bp, Glycine max
  Peptide Sequence Number=SeqID_213648
atgcagagttcaaaacgtgatgtctatcttggagcctacctaaatggcggacactggcagatggtggtcatcctgcccaaggaacacctagttttctggttttgttcattgtataaaaggccaggcaactaccttaaggagattattaacagtgctttaaaatgtcttgatgatgctccacagcctaaatcaaaggctcctgctaggtggattgtcgtcaagtgtaatagacaaaaaggaagtactgagtgcggatgctatgtcatgcactggatgtccaccatcattttaggaacttttaggaataactgggaaacgagattaaaggaattgcgaatccagtgggcacattgttatctccgagttagagatcagatctag

SEQ ID NO: 96871 - DNA, 141 bp, Glycine max
  Peptide Sequence Number=SeqID_213649
atgtccattggagttaatgatgaaatatgtgcaatttcagccaggcttagtgcacaactggcactaagctcaaatccacttactcgcgctaagcgtaagggtcgcgctaagcgcaacatcacgaattcagagcctatttaa

SEQ ID NO: 96872 - DNA, 546 bp, Glycine max
  Peptide Sequence Number=SeqID_213650
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggacccatgcttcgggcttccggaatacaatgggatctccgtaaagtggataattatgaatgttacgaagaatttgattgggaagttcaatggcaaaaagaaggagattcctttagctcgttatttagttcgaattggtga

SEQ ID NO: 96873 - DNA, 1340 bp, Glycine max
  Peptide Sequence Number=SeqID_213651
ctcgcagccctgcgcggggccgaggtatgggcgacgtgtggcgcccggaacgccccgctggtcgagcgcctcggagcggtgcgcaccttcgatcagcgcgtgtcgccgccgagcgacatccccgcggggcgcttagatgccgtcgtcgacatcgccggggggatacccctgcgcgcgatgcagcgcctcaccgcgcaccgcggaaccatcgtcctcgtcaccggggacggcggccatgtgctcggccccgttccgcggatgttgcgcgccgcggtcctgtcgatcggctcgcgccgcatccgaccactggcggagacgccgcggcccgaggtgctcgcgaaactgctggagctcgtggccgaggggcgcgtggtgccggtgatcgagcgcgaatacccgttcgccgaagggtccgccgctctcgcacagaacgaggcgggacacacggtgggcaaggtcgtgattttcgatatgaaccctgtgtggccgatgccggttccaaatccgagcgacgttgtgatgatgcaacaggtgctacagcactggaattccgggaatcaagcggcggcatttgacgccgttcggcccagagctgaggaaggccaggcatgggcagccgcgcttctatcgtggctccacatgcagcagggatatccggggatagacgagagcgttacctgggccattgccgcagcccacggtgggctccccggacaactggttcacgcatacaacagtttattggcgcatctcccctccaatcctgctctggtcaatcgtcttcccgagatatttcaagtgggctctccgtggggcaacggcacggaccacgtcgggcaaggctggaatcttgtcgccaacggccaggcggagttgggcctccaagtaatgatgcttcccacgccatatcccactccggagccgcagctaagcgcgctcgtagctcaagcgaacgatcgagcaatcgagctcgacaacgttatggcggccctgcgtgagcgcgaagctgaggcaggtctcctggtcaccgcgacaacatcggatgcgacgaacgcgctctttatggccgacgctcggcgcaataccgaagagtcgcgcggcgcgtggagatggggtcttgtagtgcttggcggcgcggccctcgtcgctgtcctacccgtggttcttcactatctgcagctcgggcccgactacttggcttttgagcaaatcgccgtacacctcgtttcgacggcggcactcgggaccttcgcgggagtgttgctcgctcgcgctcgatcgcgtgatcatgcagcccagagagcaaacgatctgtccaccgcaatgggaaccatgatttc

SEQ ID NO: 96874 - DNA, 826 bp, Glycine max
  Peptide Sequence Number=SeqID_213652
ggcgcgcatcatcgtcgcggcgggcaacttccacggccgcacgacgacgatcgtcagcttcagcgacgacgagcaggcgcgcgacgacttcggtccgtacacgccagggttcgacgtcgtgccgtacggggacgcggaggcgatcgcggccgccatcaccgacgacaccgccgccgtgctggtcgagcccatccagggtgaagcaggagtggtgatcccgcccgaggggtatctgcgtcgcatccgggagatctgcgacgagaagaacgtgctgttcatcgcggacgagatccaggccggtctcggtcgcgtcggcgagaccttcgcgtgcgaccgtgagggcgtcgtgccggatctgtacctgctcggcaaggcgctcggcggcgggatcctgccggtgtcggccgtcgtcgggaacgcggatgtgctgggggtcatccggccgggcgagcacggatcgacgttcggggggaatccgctcgccgcggcagtgggactgcgcgtggtcgagatgctgcagaccggcgagttccaggagcgggcgcgggcactgggcgcgcacctggagcaggccatcgcaccgctgatcgggcagggggtcacggcattgcgcatcgcggggctgtgggccggggtcgacatcgacccgacgcacggcacgggccgcgagatcgcggagaagctcttggcgcgcggcgtgctcgtcaaggacacgcacggccagacgatccgcatcgcgccgccactggtcatccgtgcgaccgaactcgactgggcggtggagcagctggcgctcgtgctgcggggcgagaccgcggggcgttag

SEQ ID NO: 96875 - DNA, 558 bp, Glycine max
  misc_feature (545)..(545): n is a, c, g, or t
  Peptide Sequence Number=SeqID_213653
catgacttttggactgagacagaaagcgcggtgaagagagcttaccttgaaacagatgagaaaatattggaacaagcacttgtgttggggcgaggagggtcaacagctgtgactgcaatacttattgatggtcagaagcttatagtagcaaatgttggtgactcaagagctgttatttgtgagaatggaaaggcaagacaactatctgtggatcatgaaccaagcaaggaaaaaaaatggattgagaggcgtggcgggtttgtatcaaaaattccaggagatgtccctcgagtagatggacagctggcagtagcaagggcttttggtgacaggagcctgaagatgcatcttagttcagaacctgatgtgcttgtagaggaagtagatccacatacagagtttcttattctggctagtgatggaatatggaaggatttcattggaaatcatggttatgtcaaacgaagaagcagtggaatctattcgacaaataaaggatgctcaagctgcagcaaagcacttgatagaagaggcagtttccaggnaaagcaaggatga

SEQ ID NO: 96876 - DNA, 204 bp, Glycine max
  Peptide Sequence Number=SeqID_213654
atgaccccttcacagcaatatcatggcccaattccaacacctaatgccccgttaggaacacaatggaatgtaccgggacaaatacctaatacgggtgacttattcggtgttgatttgcgtcacgcattttctgcggaggctgacgaagaagaagcggggaggcattggggcagaagaaatccttatcgtcaagcacgaagatga

SEQ ID NO: 96877 - DNA, 514 bp, Glycine max
  Peptide Sequence Number=SeqID_213655
atggcttctccacctgcctcacctcctcctccttgtcctccttctcctcgtccttctgctcctccttcagatgcattagcttcaccgtctgccgtgaagcggacacgcaaagcctcacgtctacgatccttgtataccagaccacctggtgcagacagaccagtggtccacgttgatcctactaccggcaaggctggcggtccccacatgaagaaattaaaaacatatttggggattgtggtgcgtgataaggtggacctcacgtacgagaacaggaaggaggcagaatttgaaatcccaaaggcttctgacaataggacaaaaaagaagttgcttcagactgttgccgatcaggacgatgtggacgacactgtctgtgagaaatacggcataaacaaggaaaaatggacccagttttgccagactcgcagagacccttcttgggaggatgtgcgcaaaaaggcacagaccatccagaaacagaacactaccgcccatgttttgtctcgtgggg

SEQ ID NO: 96878 - DNA, 291 bp, Glycine max
  Peptide Sequence Number=SeqID_213656
atggtgcagcgcctatttatcgttctcgctcgggagccaaaacacgcctgctacctactgtactggaccttcgaccaggcattctacccttgtcgaatcggaaccaaccaccactgtattgcgctcgaacagttgagcggccgccggccagcaacttccgtaccgtacacagatatagattcattcttcgtacctggtccaacttcacaacccttcgcgggttggtcagaagctttaaggcgaacgaaccgtatggcggccggaaagaaagacgacctcaccttctcgtag

SEQ ID NO: 96879 - DNA, 552 bp, Glycine max
  Peptide Sequence Number=SeqID_213657
atgtgccctcctctagaaaaggtaaagagcaaaggtgctccaaaaaacccactgatcaaacaacaaaagtcaacaaaacgtgatctgtcttattgggagtatattgatgtgttacactttgtgcaaaatagtaattcttctgtgaaacgtaatgcatcatcattcgagcaaccaatacagagacaaaatattcgaatgttggatcaatttcatatgtgcatccaggattctattgaaaatattattgatgtcaaagcggatggtaactgtggttatcgaggaatagctgctgtcgcaacctacccttcaataggagggcgacaacagactcacgggtgcgtcttccaagaaaggaaaatgcgcgaagtcgccaccaacatttattcgaggaaaacttcggaaaaactggaaaaggggaaaagagggaggtggttgccgcccagctcgcccaggcgagctgggttgcttccaccagaaggcaccgccttctgttggaacaccctggaaggtccaagtgggcctggttgctatttgcacaccgttgtttactaa

SEQ ID NO: 96880 - DNA, 840 bp, Glycine max
  Peptide Sequence Number=SeqID_213658
atggcaaaagtggtcaagatctcagaacatgagctagacaggttgaagcaaaatagaaatgaggtagttgggataccgaggaagcgcttggaggagaaagcaaaagctttggcaaatcaaagggagtggacctcgttcattgacatattagcgttgttggtgtttgggactatactatttccaaatgtagatgatctagtggacctagcagcgatcaatgcctatcttgcttatcaccatagcaaggaaagcccggtcatcgtcgttttggaagatacatatgatacactcgacttgaggtgcgagaagagtagtgcaagaattgtttgttgtacgcctgctctttatgtgtggttggtctcccatgttctttgtcatgaaagtaggtctgtctatcctctacaaggtcatcgcatgtgcccaaaaaatagaaaagcaaattgggaagaactcttagcaggtatgagaatccgtaaagcatggaatatagtggaaaggaaagataaggagctcaggggaagtagcaatggtgccatcaacagctatcataagtggttgaagtctaggacgcaagagataaattggctcccaaagctaaaaggcctaagtgggaaagaagctgaagtccctgaggaaagcaaagaagtgcaagctttgaaggtagagctcgaaaaaacaagagtggtcaaggagaagctaaagacggaagtcactagggtcaagaaagagtgtgatgtgctgagagatgtcaacatgactacagtcaaagcattagagtgggaaacaaaaagagcccgacaggaagaatggagcaggaacatgttccgaggggctctatga

SEQ ID NO: 96881 - DNA, 539 bp, Glycine max
  Peptide Sequence Number=SeqID_213659
atggcagaatcatccaagaagcgcaaggtttcatccacctccactgcggcacatagaacatcacgtcccggagccaccggagcatcccaggcaccaattccaccatccttgtcatcctctacactgttttcatcttatgaacagcgtatccggaactcctctatctttcaatctcatcaaattcttgatcccaaatatctagacctagaattctttgatggagaaacatttgattgctatcaagtgtttcaaaacactggtttgattccttttatgtcattaaaattaccatatccagagctagtacgagtcttttactcaaatttgaaaattcaggatggaactttaatttttgaggtgcatggtatccctatgattattgatgagtctcttttcttttctctgacacaactacctagtcagggtgcaccttttgagggtacccttgttgaccaatggaagtttgattactccagccatgatgctcgccgcatggtctgcattgaccaagcggatatggccaacagactgcttgtcgg

SEQ ID NO: 96882 - DNA, 360 bp, Glycine max
  Peptide Sequence Number=SeqID_213660
atgttagccatcatcagcaagtaccaagaagaactaaatctagccacggcccaagagtatagagtggcggacgagtatgcccaagtgtacgcggaaaaggaggctagaggaagggtgatcgactggaaaaacaccataactaaacgcaccccaaggcatccctatcgcactagatccaaatctagaacgatgggtgatcaagaggagacacgggaacaaatgaaagctgacatgtcggctttgaaagaacaaatggcttccatgatggaggccatgttaggaatgacacaactcatggacaaaaacatggccaccgctgccgctgttgctcggatgccgaagcagacccaactcttctag

SEQ ID NO: 96883 - DNA, 294 bp, Glycine max
  Peptide Sequence Number=SeqID_213661
atgactccttcacccttagatcgcaagactaaggcaaacgatgcggaacctcggtggcgtgataggctggttctcaccagggtcagtcctatcacaaaattggagtttctaacctcactctgcttgctattctatcactcagggatccagaatggagcaactgggggtgacgcggaagccacccgggtggggctggtaagagatgatatcaagcggtctagaatagaatcgaaagctcaaaagggaagtgaaggatcagttcctcccatgcaatgtggcatggctcgctcgtga

SEQ ID NO: 96884 - DNA, 369 bp, Glycine max
  Peptide Sequence Number=SeqID_213662
atgattcaacaaggtagaccgaagcaactcgtcgatcagctatcaccacatcgttgccgagaatggcatagcgatcaaactagtgactgtctacggcttatgccttcactcgggggagagcacccatccaaaaagcagaaaagtgaagaagtgacgtccaaaccctcggatggacctaaactagactcagtccgagctcctgcaagagggtccaaagatggtgtgcttttcgctcctttggctttctttctcccggagaccatgccattcctcgacaccgaccttcaaacaaagtcagatgaggagctggcttccctcaaagttgctctggctgacttgcccgttccgcttctctcccgcttttggcag

SEQ ID NO: 96885 - DNA, 300 bp, Glycine max
  Peptide Sequence Number=SeqID_213663
atggggatcgcacccacaaagacacccagtggacctgaagaaatccaacagggccctagggtttccagctctgggattgtgcccgcaagacacctagtggacccgaagaaggccaacagtgtcttggagttgccagctctaaatacgggtctctatcagttcaagggagtgcctgttgcccccagcagggcaggcgcagggcgagacaccacagcagcattgggatggacggtcggtgaccgacaagtcataaggcgtccagctaaagacgttaaagaagcgctactaggaggcaaccta

SEQ ID NO: 96886 - DNA, 234 bp, Glycine max
  Peptide Sequence Number=SeqID_213664
atgcggtcgctgggcagaatattgctaagtagcaatgtcatctatgtaagagtggtcatgttggtgcgcatgatccgcactcgtctctttgcagcggcacgggtgaaatcttgccccagtatgcatagtagcagtgtgatagcctccctttctagttgtgctcgcacagttggccctcctccaatatcggggggtggccccggaaccgttaaaacgaaactactggctccttaa

SEQ ID NO: 96887 - DNA, 180 bp, Glycine max
  Peptide Sequence Number=SeqID_213665
atgtgcattttcagagcatcagcatcaaggctgcgcgctaagtgcaagattagtgtgctaagcgtagcaggtgtcttcagccaggctcaacgcacgactagcactaagctcgaatcacttacatgcgctaagcgcgagggaggcactaagtgcaacttcgcgaattcagagcctatttaa

SEQ ID NO: 96888 - DNA, 210 bp, Glycine max
  Peptide Sequence Number=SeqID_213666
atggggtttgttacctggtgggaaaaatattattcgacccgttcaattggagacactactatcatgatctccaggcttgagagtggttttacacaaccaacggtcgagaatattcgctcaaaccttcaagctcgagagtcaaaaagaaagatgacagtactgagactaccacgacttccaaacgctcgaagcatgcgggcgtcgaattag

SEQ ID NO: 96889 - DNA, 312 bp, Glycine max
  Peptide Sequence Number=SeqID_213667
atgaaacctgtagatatgccagatcttgacgtcgatttgatgtacctgatgacattgatcattctgcaacttttcttgaggccgttgcagatgtcgtgggatgctagcgtgtttggggtgtataatgataacttcccattgcatatgactgagacaaacatgagagcggagaatgcttatgtgtatggattccttgagccacagtatatacaaagatctagacaatcacaatttgaatcagaagattatattaagaaatggatgtacaatttacaaagagacgtgtacctagaagcctacttgaatggataa

SEQ ID NO: 96890 - DNA, 842 bp, Glycine max
  Peptide Sequence Number=SeqID_213668
gcatgatgcggtccttggccatgaagcgcaggccgggaccctgcaggtagtgggtagtgaagccggcctggcgcaactgcgctggcaggcaggcctggttgcgttcgttctgggtcagcagttccatgcccttgggcgtgccgttggccagcttgtcatagtcaccgcagagcatcgcgtaaaggccacggatggtctggtgggtatgcagcacgtagtccggggtgttcatgccgcgctcggcccactggctgagctttggcatcagctcttcgtcgaagcggctgtgcagggcctggcggttgggccgcaggtaggccccggggatgccttccacggtgatgatcagcaggttgcgggcgttgcctggcccggcgagcagccgctggccatgcaggtcggactgggtcaggccggtactggccagaggggtgaaggtttgtgtgcggcccatccagccttcgacctggcgctgcaggttgccggccccggccgaaagcaactggtgggtgaggttgtattgccgccattggtcggcgtcggaaggtaccagttgctggctgccccaatgggcgccaaacagcagcagcggaatggcccaggccttgcgtggcagcggttggctgcgttggctacggctgcgccaggcgatggccagccagcccagcaggccggtgcccatgatccagggcagccaggcatgggccaggccgccaccggtcgagttttccatgaactgcgggtcgagcaggtatgtcaggtcagcgctggtgggcaaacggccgaccgcgctgaccagttcggccgaagccacccagagggccgcccaggccagcaatacg

SEQ ID NO: 96891 - DNA, 462 bp, Glycine max
  Peptide Sequence Number=SeqID_213669
atgtggtactggctgtgggagaatccttacccgcttactccagatactgcaggatgcccactgatatcagagagattgaggttgctttgtgtatacccggctgagggagctctcatctctggccagatcacatctatggcccagtctaactcctctagacttgggttccctactcttatcacaactctatgtaggtctagaggggttgcttctgacagcctagtctttgaacgcttgagcccggtcattaacttggcctatatcaggaagaactgctggaaccctgatgatctgacagttactattaaaggggctaggagagcgagggcaaggctagctgaggctccttccacatctgcaactcctcctccagcacgtaccttagcagctccttctaccccatcttctacagactctcaacatcttgaagccatgcttcgaagcatacatcaggggcatatt

SEQ ID NO: 96892 - DNA, 697 bp, Glycine max
  Peptide Sequence Number=SeqID_213670
agggctacacgtcctcaccttaagagggctgcacgtcctcacctttagagggctgcacaccctcgccttcagaggactgcatgtcctcgcctttaaagggctccaggtcctcgccttcagagggctgcacgccctcgccttcaaaggactgcatgtcctcacctttagtgtgctgcacgtcttcaccttcagagggctacatgccctcgcctttagaggactgcacgtcctcgccttcagaaggctccaggtctttgccttcagagggctgcatgccctcgccttcagaggactacatgtcctcaccttcagagggctacacgccctcgccttcaaaggactgcatgtcctcaccttcagagggctccaggtcttcgccttcagagagctgcacgccctcgccttcagtggactacacgtcctcgccttcagagggctgcacgccctcgccttcagaggactgcacatcctcaccttcagagggctacacgccctcacctttaggggactgcacatcctcgccttcagaggacttcatgtcctcgccttcaaagggcttcatgtccttgccttcagagggctacacatgctcgccttcagagcacggcacgtccttgcctttagagggcaacacgtcctcactttcaaagggctccacatccgctcctttagagaactcaaggtcctttgcccttaa

SEQ ID NO: 96893 - DNA, 123 bp, Glycine max
  Peptide Sequence Number=SeqID_213671
atggactacggtctagagttgaattcaatggatgctattcatgtggacaaatttgcgtgtgaggcttgtgtgatatgtgaggagaatagagggcacgacatggactggatatggagatcatga

SEQ ID NO: 96894 - DNA, 183 bp, Glycine max
  Peptide Sequence Number=SeqID_213672
atgtgttgcatgttggtctcgtctttcgtcacgggaagctggaaggtccatatcaccttcttaactgcacacatggggcactgcgcctccgaatgcgcaaaggcaagcttcatgatgatgaatcaagttgattcaagaagttttgataatgacaaagatgttgacaaaaagcccaaagaatga

SEQ ID NO: 96895 - DNA, 300 bp, Glycine max
  Peptide Sequence Number=SeqID_213673
atggagagaggaagaacccacggaagaaccttctttcgtggtaactcacggaagaaccttcttccgttgactctggcagaagaagttcttccgcgtagttctacggaagatggttcttccgcagttcttcttccattgacactcgcggaagaaatgttccacgggcatccacggaagaaccttcttccgtcaactgcggaagaaggttctttcgcggatgctcgcggaacatttcttccgccagtgtcttcgaaagaaattccgcataagattgatgggccatttagctactatgtgtaa

SEQ ID NO: 96896 - DNA, 963 bp, Glycine max
  Peptide Sequence Number=SeqID_213674
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcgacagtgacgaacacaaactcgaatgggaactgttgcgaactcgaactcgaactcgaacaccaactcaaacgggaactggtgcgaactccaactcgaacacgaataggaatggcagcttcaggaggacatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 96897 - DNA, 432 bp, Glycine max
  Peptide Sequence Number=SeqID_213675
atgataaaacttgtttctacagccccaccatcttcagctccccttatcttagctcattcttcatcagctccttctacctctctccctccagcaccagcagctccagttcttacagagcctgcatcagggctagctcttgatcatgcagagcttgcaaaatgtggtccaccagtggccgcctggacaggagtccaaccttctccttcaggaggaggtgaggcctccgcaacccaggagccacaacctgtacaggaggatgcttctactaacatctctgagccctctccacttgagcctttcatttttgaggatgattcaattatatcttctcaggcagagccatctacaccagtgccaaagttgcctatttctcaggatccaccatctgcaccagcactggacctgaacgagcatgcagaggatcattcatag

SEQ ID NO: 96898 - DNA, 625 bp, Glycine max
  Peptide Sequence Number=SeqID_213676
gcgcactgaccggaacttgaaacaaggcggagctcacccctccgccttttttcgtacgcccgcgttactcgccgggccggctttgctgttgcatcgtctgtctgagcgccgcaacaaacacgctgacgcgcgccggcaggtggcgggtggtgggaaacagcgcccacacgcccagcatctgcggctgcgcgtcctccagctccagcgccaccagttcgccggatgccagctcttcccgcacgtcccactcagaaagctgcgcgatgccgctgccggccacgcacagcgcacgcaccccttcgacattgctgccgctgaagcgtccgtcaacgctcaggctggagagatggccgtccaccataaaactccactgcaccacattcgacaggcgcagacagtggtgttgatgcagctccgccagatgacgcggcgtgccgaagcgttgcagatagcccggagccgcacacagccggcgcgggttgtcggccagacggtgtgccaccaggcgggaatcgcgcagcggggcgatgcgaatcgcgacatcaaagcccagcccgacaatgtccgtgacatcgtcgctgagctgaaactcaacgcgcaacccggggttttgctccatcagtga

SEQ ID NO: 96899 - DNA, 569 bp, Glycine max
  Peptide Sequence Number=SeqID_213677
atggaaagatacactgatgttattgtgcctaggaagcttttgccagagaggaatgtggtggtctactatatagagtttgatgagttcaaggaggaacttgaaagacgccactgggatgaggagttgactgatttcattgacggcaacattgatgttgccattatgaaggagttctacgcaaacctctatgagcccgaggacaaatcacctaagcaggtgaaggtgagaggtcatttgattaaatttgatgaagatatgcttaacacattatttaagagccctgttattgtggaagaaggggaatcactctgtgcttattctagatttgcactcctgaggcctaatcctcaggagttagctgctaagctttgtataccagggagcggattcgagcttaatgctgatgggcaacctctgaagattttgaggaagaacatgaccacgcttgctcagacatggagtgctctttccttcactaacctgatccctacctcacatacttctgatgtcaccctggacagagccaaactcatttatggcatcattatgaagatggacatgaatgtggg

SEQ ID NO: 96900 - DNA, 300 bp, Glycine max
  Peptide Sequence Number=SeqID_213678
atggcacgaactgcggagtgtggagagggtgttgctatggctacaatgattgacatagcagataaaaatctaattagcatgagcaaagctgctcgtgacaattgtgtctttttcgaattccatactaatcgttgctttgtcgaaagtcaggattccaatgaaatccttcttcggggagatgttgttcctaatgattggggcgggagggtgaatttcgtagcttttcctcttatctgggtgattgaggcatttttcataggctttcatgccccccacacatcatcagaatggtgcggttga

SEQ ID NO: 96901 - DNA, 428 bp, Glycine max
  Peptide Sequence Number=SeqID_213679
gaaaaggtagaagggtagtctttaaactaaaggacttgagccagcaattgctatcttgcactttgtgggacgattattgcttgcagtttttaaagttcttagatgatcatgaaggtcatggcccaattacagttctatcgacccatggtagaataaaggaagctcagggatcttatctgccatcggtcagcaattctttcaaggcttcaaagttagttattaaccaaccggtgatggagattcaagaattcaatgaagggcttgcagagttgggcattgaggcccggtcagtttttaaatcccatggtgaaggcagttcacagctttcaggttccatccaattatcatcaaaggaattattctttggaaaggctgaggcaaagactattgctgagattaacaccatctctgaagtaatcatcttatag

SEQ ID NO: 96902 - DNA, 423 bp, Glycine max
  Peptide Sequence Number=SeqID_213680
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggttgaattgcatgcagacgatgccgacgtgagcaccttcctggcacgtgcggacgccgcttgctaccgcgccaagaacgaaggccgcggcgcgatcgccagcgactga

SEQ ID NO: 96903 - DNA, 301 bp, Glycine max
  Peptide Sequence Number=SeqID_213681
gatcagggagtcggcaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttgtga

SEQ ID NO: 96904 - DNA, 423 bp, Glycine max
  Peptide Sequence Number=SeqID_213682
atggttagactattaccacctcgagatagtcggacatcatctaccccatccccatcttctgtgtctatcccaattaggcctcccgatgttgcacctacaccatctcgaccttcgactaaagctagaccatcttcatctcatgttaatgcgcgtggaccatctccggtacctgcatccacaccatctccatcctccgttgatgtacagggaccatccccaatacctacatccacaccttccccatccctacttgtgggcaacatgactacagatgaagatgctataaatttggcaatggaagacccccttaatgatcgtcctatggttacactaattaatggagtgtttcatccatctaaggttgtggcaaaggctctcactttatccattaggcaacaatttggtcagccttggcctacatga

SEQ ID NO: 96905 - DNA, 219 bp, Glycine max
  Peptide Sequence Number=SeqID_213683
atgggtgagttagcatctctatctctcactgtcacaccgaccaatagtgttcattcattggattttcctccaatagtcagcactgggcctcttcccaagaccaccacttttattgcctttgaggacaaagttgtagaagcgagcttcatgatgatgaatcaagttgattcaagaagttttgataatgacaaagatgatgacaaaaagcccaaagaatga

SEQ ID NO: 96906 - DNA, 306 bp, Glycine max
  Peptide Sequence Number=SeqID_213684
atgatttcctatcgaatcaaaagattacatgcgcgatcacggaccaataggattttctcgagggtagtgtttttggagaggaggctgggcgcttcggtcttttcctctttgtttatgtggggcgggacatcgtcagttgggaacgaccttgaatggaaatcccaaaggaagaaccacttcaaatatgggttttccctttgtcggcgcattcgttattcgctctcccttgaggagattttgctgtccaagttcttcggggggaaggatgaggattctcttcatgcgccaaggttcaaggtagcttaa

SEQ ID NO: 96907 - DNA, 228 bp, Glycine max
  Peptide Sequence Number=SeqID_213685
atgaatagcgctaggcaatcaattcacggggctccagacttgatggtggaggatgcacgaacagcgcaaggtaatcaattcatgggaatccggactcaatggtggaggatgcatgaacaacgcttggcaatcaattcatggggctccagactcgatggtggaggatgcatgaacagcgctaggcaatcaattcatggggctccggacttgatggtggagaatgcatga

SEQ ID NO: 96908 - DNA, 648 bp, Glycine max
  Peptide Sequence Number=SeqID_213686
atgaacagagaagaaaaagatgggttttcactcttcataaatgctggagattggctgggaaactcaccaggaaaaagatgggtcactgatggaaaatcacgaaccaggttgtggatgtcaagtttggccagacaagatctctgtcagcactgggctgtgttaggcagtgctgttcggagttgcaacagcgatgggagctcagaacagagtgcaatgagaagtgaggaagttagggctgggtcatcgaagaagaagagccaaccaaccccacctattgggatgaggcttcttgtttttcaagcattgcgttcaatggtgcaatccaatccacaaattctacagcctgtgcttcaggaacttggtaagcagaatcccggtcttttaagactgattcaagagcatcatggggagtttctccagttgataaatgaacctgttgagggttctgaaggtgatatgtttgagcagcctgagcaagacatgccccatgccatcaatgtgactccagctgagcaggaggcaattggaaggcttgaggctatgggatttgatagagcctcggtgatagaagcatttttggcatgtgaccgtgatgagcaattggcagccaactatttattggagaatgctggagactttgaggattaa

SEQ ID NO: 96909 - DNA, 1116 bp, Glycine max
  Peptide Sequence Number=SeqID_213687
atgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 96910 - DNA, 360 bp, Glycine max
  Peptide Sequence Number=SeqID_213688
atgtactataccggaacgcagaggtcaccggagaaatggccgtcggatagattctggctaccgacatcagggacggtattggggtcggagccagagaaggaggaggagttgcagctgtcaacgacggtggtgacggtggaagagtcggtcgtgatggagtcgaaggtggcgtcggtgatgacaacgtcgtcgttggagaagtccaagaggtcctccacaatgaagttgtccgggttgttgttgttcttgttggtgtcgaaggtgaattgtgggaaaattggggaagagttgggtgattccatggctaagaagaaaaaggattcttctaggttaggagggaaaatggcgatgacgacgtaa

SEQ ID NO: 96911 - DNA, 246 bp, Glycine max
  Peptide Sequence Number=SeqID_213689
atggagacaaaggatagtccaaaagtgctatctatgaaggaggttgttgcgcgagagactgcacagctgttggaccagcagaaacgtctgtcggttcatgatcttgccagtaaatttgagaagggtttggcagctgcaggggagggaagagcaacagtgaaagggaaaatggtccttgccttgccacataatattgctgacttggactcaaacctgccacattggatgcttacatttgccaaatag

SEQ ID NO: 96912 - DNA, 528 bp, Glycine max
  Peptide Sequence Number=SeqID_213690
atggtgattttcaaccatggagttgtagcgaaagataaaggagaagaggagaaaggagactccatccactatggaataagccacggaaggagaagcttcaccaccaagagagtgccttggataagaagcttaaagaggaagcttcaatgggggaagataatgagagagagaaggtggcatggaaaattgaaggaagaaagggagggtggaaaccttacaaacctaaaagaagaaaaacctattctaatatttatagagaaaagcggacccaaccttggcccatgggctcagaaatctaccctgagggaggattgcatcacacctattggtagatttcttgagtaccgaattaatcgactcagcaagattggtggtcatttgcccccatcgttagccaccatcccatgcgagaatccaattttcttgtggaacctcgctgagccaattaatttcttggttagcatctacttcctccctcagcatgttgtagtaatgattgaacgtaggctccgtccttgcatatgctga

SEQ ID NO: 96913 - DNA, 195 bp, Glycine max
  Peptide Sequence Number=SeqID_213691
atgcgtgttagcagctcaacagtgagtgacctttctttcttaggagaccccaccgttccttctttcgagggaaaggatggaaattctcatcttgggtcaaggtttatggtgagttcggattttggctcaaggcttgtagaacggctggacatgatgtatgtcagggtgttggtttggccagcggttcagggataa

SEQ ID NO: 96914 - DNA, 279 bp, Glycine max
  Peptide Sequence Number=SeqID_213692
atggccaaaatacatcatcaagcatggtcaacaaaaacatatcatccaatgaaacgtacctcccccatcacacttattcccaaaacacttccaaagctccaaaattccttaaaggtaggaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagtaa

SEQ ID NO: 96915 - DNA, 871 bp, Glycine max
  Peptide Sequence Number=SeqID_213693
ggcacgttgcgacacagaggctacgaccattcaagtgattctacatcaaccatttatccttcatcctcctcttagaaagcctagtgcaactaaggagtatttcccattgctctttcgagttacttctgggttcacgaggaaggaaagtgaatgcattttcacgcaggcctttttgtgtgagactcattttgtgtacgccctagacccgaatccccccatatttattttactcgacaaagggttccaagccaagaaggttgaaaaggccaaggccgagaaagcccgggtggagaaagacaaagggaagcaaaaagagaatcctcaacatgaatgggtcccttctcctcctcctcctattgcagctggcgttaccatccgagacgacctggccttcaggtggaggtccgttaaagaggtagaggttgacgctgataccgattttaacccaaaggctttcattcaagcattcatgcttagtcagcttgatagagacatggtgagggagattggtcctcatcatcaatggattccattgctcgttttattgcaaggtcttggggaatcattgaattctgggatgaagagtttgagagggcggacactaaatctcagaaggcatagactaattgtgccaaggctgaataggctttcgttgaagccgcccgttctccaagaagagattgagctccttaacaaggaattccctcttttcaaggtgaatgttgagaaggttgcagaaaaattgaagatttattttggtgaagccgaagtcgagatcctaaagacccatgaagccaggtttaacaaggctttccctcaggtcaagtacttttccaaaaatgttgacacttcccttttcaatgttgactag

SEQ ID NO: 96916 - DNA, 447 bp, Glycine max
  Peptide Sequence Number=SeqID_213694
atggcggaaaatcttcacggaatcacccacggaaacgtttcagacgtgttacggaagaaaatgagggaggagcttgccacccagctcgcccaggcgagcgaggtgccttctggaggaacatcttggaaggctcaaatcgtgcaacaatgctctcttttgacttctggcacgtcatggaactttacgtattgtgcaacaatgggtgccaagtacctcgaagtggtcaagcaaaggttgcatgccatcaaacaatggtccccggatgaaattagggaaccgattgggaaaataacaaaaaaaccgtattttcccctcaccggaggctccgtacttgataacggaggacgcatgaacagcgctaggcaatcaattcacgaggctccgaataagatggtggaggatgcacggacaatgctaggcaatcaattcgtggggctccggacttga

SEQ ID NO: 96917 - DNA, 141 bp, Glycine max
  Peptide Sequence Number=SeqID_213695
atgttccctcgtgggaagatgtccatgaaaggggtgtcgagggaaagagcccagagtatgaagaacctcgggagccaagtactttggagcggtcaattaaaggttgtatgccatcaagcaatagtccccggacgaaattag

SEQ ID NO: 96918 - DNA, 879 bp, Glycine max
  Peptide Sequence Number=SeqID_213696
atgttcaatgaattttacggagagctccaatggaggcaatggcaccgggttctcaccaaaatcctagagaagcagatctacattgctttggtcaaagaattctactccaacatctatgacccagagggcggcgctccaaagtactacaaagtgcaggggcatgtcatccggttcgatacggagaccattaatgacttccttgacaaccccgtcatccttgctggtggagaagaatatctgtcgtactcccagtaccttcacacgtacccagaccatgaggccatcgtggtagcactatgcacacccgaaggtggattcgtcctgaatgtcaatgggaccccatggaagcttttgcggaaggatctcacctcgcttactcaggcgtggactgtactttattactttaaccttgcccctacctctcacacttttgatcttaatgttgacagggcaacgttgatatatggcttagtgatgaagatggacatggacttgggtagcttcattttgggccaaatcacacagatcgcccagtccaacacctctaggaccccgccatgcccgtgccaaagtcgttgcaccagatgcctcacctctaggacagcctcctccaccacctgttgcccgccgccagtcgccatccatcttagtctcgacagacacgcatactcagatgctttagtccatctaccaaggcaagcagatcattgttcagagtcttcacagaccctcagtctacctggggatggatccaccactgatgaccccaaaagccttcatctaccctctaaggtcagagataccattgaagccagacttggggatgacatcattacatatttggccactaattggaacccatggccaaacttaggttga

SEQ ID NO: 96919 - DNA, 288 bp, Glycine max
  Peptide Sequence Number=SeqID_213697
atggctccgaggaagctttcctcgaagagatctaggaaggacgccgtggacgaaaggactagtgccgctcccagttcgatagccatcgtttcagaagcgctgagcactagcagcgtttcgaagccatcaagggatggtccttccaccgagagagacgcatccagctcagggacgacgaaggagggcgtacgggacatgcggtcatgggtaaggggccagtggattcctttcgatgcagacgccctcagtcagttcctgggatacccgctagtattggaggagggctag

SEQ ID NO: 96920 - DNA, 514 bp, Glycine max
  Peptide Sequence Number=SeqID_213698
tttgtgtgggagtcgtacccatcaaccgttatatcactgttgcctcccgtttgtttagtcggaagtctcgcgtggcgaaagacaaagatgtttgttgacccacaaaatgcaaagacggctacattggctaaagttgcagagacattacaatacatggtgtctcctcaagggaggaatacatggacagttgatgatctcgtgccttatgtggaaaaaattacaattttatccgaagagcaagagagagtcactgagccagtgtcacatggtcctgcatctgagcgtcaatttcccacacaacagtttcacatacttcagtcaagtgttgaaactcagggcatagacagacgaagggagactgttgaaagggaagaatattcccaaaaaatgccggagcgtggccatggaatgtattacacgccacaaacatttgctgagcatccgacacagatgtatcagtatccttttcggggtcatcacattgatacttctgcaagccagcaatcgttcggtg

SEQ ID NO: 96921 - DNA, 186 bp, Glycine max
  Peptide Sequence Number=SeqID_213699
atggcgaaactgatgacctatccaaaatgcccgagccaagaaattttgggactcatgttccattcacttcattggccaaatcaattaaagagattgattgtgttgatggaatctaagtgttgtgccagccaagccataggtcttttggataaggactactctaacctccacaagtgggcaaaataa

SEQ ID NO: 96922 - DNA, 341 bp, Glycine max
  Peptide Sequence Number=SeqID_213700
ggtgagcttagctattatgaggggaatcttctcaaggaagcttctcaaggaaatttctcaaggaagcttctcaaggagcatcctctccaagcttcttatccaaggcacattcttggtggcaaagctccttcttccatggcttattccttagtggatgggaaatcgtcttgtgtcaagggagattgctcggtgtcgagggtggtaacctcgactagtgtaagggttgcagcttttgatcttgcaagcaaaattagacgtgtcaggcgagtgcaacacacacatattactcttgcatatgtgtcactcatggagtgggcatgtactgaagacgcaatacgtgg

SEQ ID NO: 96923 - DNA, 465 bp, Glycine max
  Peptide Sequence Number=SeqID_213701
atgttgacatctctgaaaagggtgcagatgaccacattggcctctgcttgtcaatcagacttggggtctccgaatgacaaggtgcggataaccgtaaggtgtctccgtatgctaccggactctcaagtcatgatagcaaaaggtggggtggtcgacaaaagtggggcttttgctcctacgtatcctcaatttgtgatgaggaactcagacctacatagtgtctccacgtgccattggactctcaagtcacaggatagcaaaaagtatgcacggataaccatcgggtgtctccgtgtgccaccggactcacagggtgttagcaactcaacagtgagtgactcttctttcttgggagaccccattgttccttccttcgagggcaaggatggaaattctcatccggggtcaaggtttatggtgattcgaggtcttggttcaaaaggcttgcagaacggccggacatga

SEQ ID NO: 96924 - DNA, 153 bp, Glycine max
  Peptide Sequence Number=SeqID_213702
atgtttagaaacctgaagtatgtgattaagcatagagttgttacagtttatcatccccaaactaaagggcaggtggaggtctttaatagagatcaagcaagtgttgcaaaaggtagtgcagcccaacaagaaggattggagcaagctagttga

SEQ ID NO: 96925 - DNA, 678 bp, Glycine max
  Peptide Sequence Number=SeqID_213703
atggctccaaaacgtgctgagaagctagtggtcagatccaccaagaaagttgtggaatcaagtgtgctggtttctgttgtaggcaaaagactaacccgtggaaaaaaagatactcaaacaactgatggagaagaagaagtaggtagccaagagcatctggtggtcattcctattcaagaagtgactcctcaagcacaaaaggattcacctaactctgccatcaccacagaaaacaaagctgagcaagagaacaatactcaagatggtggagtcgaaaataatcaagaggaagaggaagagcatgaggaagtgaaagagaagaagaataaggccaagaccccaaaagggaaaaatgggaaggagaaaaaaagagggagaaaaaagggtaggagaagtgttgaagggtaccagaggtatgtgtatagggtgttgaagcaagtgcaccctgaaatgggaatttcttccaagtgcatgactgttctgaacaacttgatgaatgacatgtttgagaggctggcttttgaggcttctaagctgaaggactacactggacacatgacattgtcttcaagggagattcaaggagcagtgaggctggttttgccaggagaacttggaaagcatgcaattgctgaaggggtcaaagctgttaacaactacacatcctatgatgcttga

SEQ ID NO: 96926 - DNA, 375 bp, Glycine max
  Peptide Sequence Number=SeqID_213704
atggcgatttgcagagccattgggaaccgccagtcaaactggcgagttccaacagctgagggtgcctgccatggcagtgaagggcagagcgcgtcgcgtcagtcaaggccaaatcgccaatggcaatggcgatttgccttgggcatggatcgccagccatgctggcgggttgctcctaaatatgcttcttccattataaaagctcagtccgagagtgcaccagctacgcttccttcgtggctcagtccgagagtgcaccagctagcttccttcgtgcctttgcttccattgatccttccattgctttgcttccattgctgtgctattttcttcataagtttctcagtgcgtttttgttattttgatatatgttag

SEQ ID NO: 96927 - DNA, 357 bp, Glycine max
  Peptide Sequence Number=SeqID_213705
atgttagctactaaagggtcaacaacagagcaaccaattcctccacaagtggaagaagaatcaagtgtttgcaaacaagaagaggaaggagaagatgctaagataagggtggttatagcacaagagggaattgaagagtgcaaaacaccaactgggtcaggctacaagattcccatagttcaaaaatgcccacttgccccaagaaagaaaagaaggccagtgccacctttttcttcacaaatgaaaacatcatcatctagtgggttgagctatgtagtaaggcatgaagaggtagagactttcttccaatccatgttcgagcttactagagttaacaagagatgtaggagtgtatga

SEQ ID NO: 96928 - DNA, 297 bp, Glycine max
  Peptide Sequence Number=SeqID_213706
atggcaaagttaataaaattctttgagttgaacacaggggccaagattccttctgttgggttaggcacttggcaagctgagcctggtgttgtagccaaagctgtcaccacagccattctgaatactaattcaactgaagaatatttctccactggttttagtttttcttatgatttgagtttagttctaattcttgttggatacaggcatattgattgtgctcaagcgtataacaatcaagcagagctggtgctattttacctcagtatttattggatttgctactatgtgatataa

SEQ ID NO: 96929 - DNA, 742 bp, Glycine max
  Peptide Sequence Number=SeqID_213707
aacctgccccaagacacaacaaacacttgtgcatacagcccttacccctaactatgttttgaagagtttgattgctttgtggtgtgaaagcaacggtattgagctaccaaagaggcaagggaactgtagaacaaagaaatgtggtggcagcagtctttcagattgtgatcgaactgctattggtgctttattggataaactaatgagtaacgatatagaacagcaaagggcagctgctggtaagaaggatgctgctactgctctaataaagttactttgtgaaggtactcctgcaagtaagaaggatgctgctactgctatcttcaacctatctatttatcagggaaataaagcaagagttgtaaaagctggtatagtagccccactgatacaatttttgaaggatgctgggggtggaatggtagatgaagcactagctattatggcaatccttgcaagccaccatgaaggcagggtagcgatcggtcaggccaagccaattcatattcttgttgaggctatacgaaccggctctccacgcaatcgagagaatgctgctgttgtcttgtggtcactatgcatcggagatccactgcaattaaaactagcgaaagaacatggtgcagaagcagcactgcaggagttgtcagaaaatggaactgatagagctaagagaaaagctggaagcatattggaactcttgcagcgaatggaaggggttgataatctgcagagttcatag

SEQ ID NO: 96930 - DNA, 312 bp, Glycine max
  Peptide Sequence Number=SeqID_213708
atgttgcattcagttcctcctattgctgctccgatggtttatgatcatagggctgaaagtggagctagcctgggcatgctttcttcaagcagtctttatggtggatatggatctttttcggcatgttgcatttttttcttgctatggggggataatggctatggatctatgtcctcgtacgccaccaagctgtatggtggtttgcctcccccatcaactctggatatgttgattcctgctaatgttgttggtaaagtgttgggtaaaggaggggcaaatatagccaatatcaggaagttcatggttgattga

SEQ ID NO: 96931 - DNA, 189 bp, Glycine max
  Peptide Sequence Number=SeqID_213709
atggactacgggaatgggctgctagttgcaactgaaaagacagaaggtacgggtcgttcaactactactctcgcattgaagcaacttcataacctttttctcattgcccagtgtgatatgccggccagctactacttgatgggtgctctatactactaccgtcacaaaggactaacagctccaatgtaa

SEQ ID NO: 96932 - DNA, 247 bp, Glycine max
  Peptide Sequence Number=SeqID_213710
ggctaactatatcctctgggaagcttttgttgttgttgttgggaaaatggtatatttaggaggtgttgaaaactatgccccaagaggattagtgatccttttagtgtacatgggatggattattgttgatagtaaaacttggatctttgagatagaccatgagaaggcactcagcctagtgctagaggttttcgtggtggctaacgccgaatggacctatagaatagatggttgggcaaatccctag

SEQ ID NO: 96933 - DNA, 444 bp, Glycine max
  Peptide Sequence Number=SeqID_213711
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaggagctctgaaatctgaaataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcagaagtggatgatggacaaagatacactgagtgtagtgggtggagaggtttgaagaacctaggggaattagcgagtggtgacgacccgacatttggtgcactcatttag

SEQ ID NO: 96934 - DNA, 2022 bp, Glycine max
  Peptide Sequence Number=SeqID_213712
ctgagaggactcctaggcctcactgggtactatagaagattcattaaaggctatgcaactatagcttcccctttaaccaatttattgaagaaggacaattttttgtggaataaaaccgctacaacagcatttacaaaccttaaatctgctattactcaagctcctgttctcggtcttcctgatttttctcaaacttttatccttgaaacaaatgcttcaggtttgggaattggggcaatgttaagccaaaaccaccatccaattgcatttttctcaaaaaaattgacccctattatgcaaagacagtctgcttatgcaagagaattttatgctattactgaggccattgccaagtttagacactatttacttggccataagttcatcattagaactgatcaacaaagcttgaggggtttaactgatcaggctattcaaactcccgaacagcaaaaatggttgcataagctattaggatatgatttctctattgaatataagcctgggaaagaaaatatagttgttgactatctatcaaggtccttctttatggcttggtctcaaccacaattatctattctctctaatcttagagaggctatactagtcgatcctaagttgaaagccattgttgacttatgcatcacaaatcatcctcctaatcccaattattctgttcatgatcaccttcttttttggaaaggtagactagttctccctgctgatcatgagatagttcagaaaatcttgcatgaatttcatagttcaatgctgggtggtcatgctgggtttgctagaaccttggccagaatctctgctcaattcttttggcacggtatgaatagggatattaaagcatatgtgcaaaattgtcttacttgtcaacaagctaagacagaagcaacccttcctgcaggtttactacagccattacctattccagatcaaatttgggaggatcttgtaatggactttataacaggacttccttcatcgggtggctatacagtcatacttgtggtgattgacagattatctaagtatgctcatttttctcccttaaaggaagattattccagcaaggtggtagccgagaccttcatgaaatttgttgtgaaattgcatggtttccctaagactattgtttcagacagagacaaaatcttcacaagtcagttttggcagcatctttttagattgagtggcacttctctcaacatgtctactgcataccatcctcaatttgatgggcagtctgaagctttgaacaaatgtcttgaaatggatcctcccacactagtgaaatatgttcctactggtaatgatccaatatctattcatgatcagctcttgcagagaaattatgtccttgctcgattaaagcagaatctccaaaaggctcagcagtatatgaaaaagtatgtagatcagaaacgtaggttggaagaatggaaggttggagacatggtactggtgaagctccagccttataaacaacattccattgccttgaggaagaatcaaaaactaattctaagatattttggcccgttccaaattattgagagagttggtccagttgcatataagttgttactgccatctactgctaagattcacccagtctttcatgcttctcagttgaaactttgcagaggtgatcacattcatccatatgttcctttacctattaccactaacgacttttctccggttatcaaacccactgctattttaaaatctagagtggttatcaagggttctcaacatgttcaacaggatttaatccagtgggagggcatggatgagtcccaatcaacttgggaacatcacagtgcattgcaaaaagcttaccctgacttcaaccttgaggacaaggttgttcttaatgggggaggaattgtgagcaagtcggttagagcaggggtaaaatgggcagaaaatggaatgactgaagatggacacgtggcagttgatccattgcatcaggaaaggaggaaaagttcaaggcccccaaaataa

SEQ ID NO: 96935 - DNA, 417 bp, Glycine max
  Peptide Sequence Number=SeqID_213713
atggaggaagagacacgcctccacgcacattttggatacatccaatgccatgttttactgctagatgagccccatgtgccactgatcaccataaagacaaatgcttcatatcactactcattcgagcatacctctcagtgtgatactatctatagcatttcctactacgcttactttggacttcagttcttcgggcatgatgtcaacaggaggcctactagatctacctttcgcaaggacacgaccgttgaagttcacgagaatgtgggagatttcagtgacgataaggattttacgcctctgagattgccttctaccgggaggttattggtgaagagatacttaagggagagatgctttcatttgatgaggaatgcgattccttgggagacaagagtgacctttccaaggatatga

SEQ ID NO: 96936 - DNA, 588 bp, Glycine max
  Peptide Sequence Number=SeqID_213714
atggcccttctgttgtacacttacaaagaggttttctccataccttccggcttaccccctccaagagctcaaaatcactccattccattgattcaagggtctggttctgttaaggttaaaccttacaggtatcctcatagccagaaattacaaattgaatccatgatacacgacatgttgcacgaaggaattattgtccctagcactagtcctttttcttctcctatagttttggtgaagaagaaggatggcacttggagattctgtacagattatcgggctttgaatgccattacagtgaaagatagttttcccattcctactgttgatgagctcattgatgagttgcatggagctcaatatttttctaaattggacctccggtcagggtaccatcagatactagtgaaggaagaagataggcataaaacagcctttagaacccatcaaggcctctatgaatggctagtaatgccatttggcctctctaatgcccctgccacctttcaaagtctcatgaatgagtccttcttgggatttacatctgcatcacttggaggtagtattaaaattactgctccaacatag

SEQ ID NO: 96937 - DNA, 330 bp, Glycine max
  Peptide Sequence Number=SeqID_213715
atggttaggtggatggttatggagaacctcgtgctagaggacgctgggacaccgtgctatgataggatggtaaagagtgtcacaatatcaacatacttgtacaaggcacaatccgaattgctaaacactccctttctgaatgttctgttgctcgtcccacccaacaaagctcaacaactcaatcctactcctctcctcctaccaagtggcacaaaccgcaagagggcttcttcaagtgaaacactgatgcaacatttcactcacaagaagatcgttggttttggaggacgaggcttttggcttgcttcaggctctccaataggcatctga

SEQ ID NO: 96938 - DNA, 911 bp, Glycine max
  Peptide Sequence Number=SeqID_213716
atgctgtatggcgtgaagatcggccaggtcatttcgcgccggctggatgaaaacggcatcagctttgtggcggccatcaatccggagcaccgccagctggtgcacgccgacagtaagttcatcgttaacagccgtctcgacgttaaatttggcctcgacggcatgcaggtgctgggcgccagcgcgcgcgaatgggtcgacggcggtatccgtcttgtgccgggggcgaaaggtcagccgtccagccgctatccgctgtacgccgactcagagcgcgcggcggaaggcattaccggcgatcagccgccgaccacgctcaaactgaccgccaacagcctgccggatgtgcaggccggctcggtggtgctgtaccgcaagttccaggtcggtgaggtggtggatgtggtgccgcgcgccgatgcgtttgagatttcggtccatatccagccgcagtatcgcaagctgctgaccagcgaaagcgtgttctgggccgaaggcggtgccaaagtccagctcaacggcagcggtctgaccgtgcaggcttcgccgctgaaccgcgcgctgaaaggcgcaatcagctttgataacctgacgggcgcgcaggcagcgaaaggcgttaagcgcgtactctatccgtcagagaccgccgcgcgtgcagtcggcagccagattaccctgcacacctttgatgccagcaaactgtcggccggcatgccaatccgctacctcggcatcaacgtcggtcaggtggagtcgctggcgctgagccaggataacaaccaggtggtggcgaaagcagtgctctatccggagtatgtgcaggacttcgcgcgcatcggcagccgcttctctgtcgtctcgccggagatttcgcccgccggcgttaatcacctggaaacgctgctgcagcc

SEQ ID NO: 96939 - DNA, 1651 bp, Glycine max
  Peptide Sequence Number=SeqID_213717
atcaagcagctcaatgccggggtaaaattggtcatgacgccggagaacgcgctgatgttcgccaactccacagcttatcgccaacaggcggaaaaacagggcgatgtcccgctgcagaacgcggtgcgcgaactggcgcgccgctatggcgtgtagttgctggtgggctcgatgcccttgatcagccgcgaaaacccggagcttatcaccaccagcagcctggcgagatccgcgcccgctacgacaagctgcacatgtttgatgtggacatcaacgacgcgcacgcccactaccgcgagtcggatacctaccagcacgggcagcatctgacggtggtggatacgccggtcgggcgtttgggcatgaccatatgctacgatctgcgcttccccgcgctgttccaggcgctgcgggcgcagggcgctgaactgatttcggtgccggcggcctttacccgggtcaccggtggggcgccacgggccgacccgccgcacctggggccacacgctggctgtcgacggctggggcaaggtgctggccgagaacccggacgccgtggcggcgctgaaggtgcgcgtggacaccacaagcctgcagcccctgcggcaacagatgccggtgctgcagcacaaccgattccagacgtcgctgacggcgccttactcgctaccaacaagctgagtcatcaagacctgtaccaggtactgggtcaactggcagaacgccgtatcgactacgccgatctctatttccagtccagctatcacgaagcctgggtgatcgaggacggcatcatcaaggatggctcttacaatatcgaccagggcgtcggcgtgcgcgccgtcagcggcgagaagaccggtttcgcctatgctgatcagatcaccctgaatgcgctgcagcagagcgcccaggcggcgcgcagcatcgtgcgcgagcagggcgacgggcgggcgcacaccctgggcgaaatcggttaccgggcgctgtacccgctgctcgatccgctgcaaagcctgccgcgcgaagagaaaatcgccctgttgcaccgcgtcgataaagtggcgcgcgccgccgatgcacgggtgcaggaagtgaacgccagcatcaccggcgtttacgaacaggtgctggtggcggctaccgacggcacgctggcggcggacgttcgcccgctggtgcgcctctccgtcagcgtgctggtggagcaggatggcaagcgtgagcgcggctccagcggcggcggcggccgtttcggctatgactacttcctggaaaccgtcgacggtgacgtgcgcgccgaggcttacgccaaagaagcggtgcgcatggcgctggtcaaccttggtgcagtggcggcgccggccggcaatatgccggtggtgctgggggccggctggccgggtgtcctgctgcacgaagcggtgggccacggcctggaaggcgacttcaatcggcgtggcacctcggtgttcagcggccatatgggcgagctggtagcttccgagctgtgcaccgtggtggatgacggcaccctgcaagggcgccgcggctcgctggcgatcgatgacgaaggcgtgccgggccagtacaacgtgctgatcgaaaacggcgtgctgaaaggctacatgcaggacaaactcaacgcgcg

SEQ ID NO: 96940 - DNA, 1092 bp, Glycine max
  Peptide Sequence Number=SeqID_213718
atgggtggttctgccaagtcttggcaggaccatcgacactacaccgaagtctggtggcagccgaatgtcactagaggctttatgtggttggaacaggaacctctagttctagccaaagagacgtggccggagactttaccgccatataaagtctctggtgtcacatcatcattcatgtacacgaataaggtagggttgcaatttgcaatccacttggcacgaattctaaaggagactttccagttagggctagaaaacgtgaggtggtttgtgatgggagacaatgacactgtatttttcacggagaacctagtcactgtgcttgcgaaatacgatcataatgaaatgtactatattgaagacaactcagagagcgtggaacaaaacgtggcacaaacctatggcatggcttttggtggtggtgggtttgccataagctaccctttggcagaagtgctagtgaagattttggatggatgcattaatcgctatgctgtgttgtttggctctgatcaaaaggttcacgcatgcatgagtgagattggtgttcaactcaccaaagagcctggttttcatcagactgacgggcttctcgcggcgaacccaatagcgccacttgtgtcactacaccacctccatgcttcagagccattgtttcgagacacaggtcgggtcgagtccttaaaaaggtttgtatccgcatataaaatggatccaggtcgaatcctccagaagagcatatgctatgacccgaatcggaattggacattctcagtgtcttggggctacaatgtggagttgtaccgttctttagagacgtccattgagttgcaaacaacgtttaagacttttcaaacatggcgtgggtatgaggacccgttcacattcaatacccgacccgttatccccgaccagtgtaagaggcccgtggtgttcttcttggatcagatcgaagatgggggactcggggaatggactgaatcctcgtataagatatatgacaatgttttgctcgagaagtctaattgttctctggaagttcaatatgtcaatgtcactgcctcatactttaggcctgagctgtggaaaaag

SEQ ID NO: 96941 - DNA, 216 bp, Glycine max
  Peptide Sequence Number=SeqID_213719
atggagttgcaacgaaaagataaaagcataagaggtgagaggaggcgccatcctctagagaataagccatggaaagagaagcttcaccaccaagagagtgccttggataagaagcttagagaggaagcttcaatggaggaagagaatgagaaagaaaaggggggcctagcacatgggaagcttccttgggaagctaaaggaagaaagcttccttga

SEQ ID NO: 96942 - DNA, 144 bp, Glycine max
  Peptide Sequence Number=SeqID_213720
atgaaatttccaaccggtgagaatgctcggaactgggttgtgaacgggatgctcaaatttcacaaagatccaacggtgaatgagtccaagatcgtcatttttctgagacagcattgtgatttttcaatcacacttggattttga

SEQ ID NO: 96943 - DNA, 258 bp, Glycine max
  Peptide Sequence Number=SeqID_213721
atgagaccaagtacattgatcacaactattggaacactacgctacctcaatcaaaacgaacaacactacactacactatgctacccattattctacttttggaaactctgccaaaactgcagtggtcacaagtattggaacatcgcactcaaagtgcgaagtggccgccatggtgctatacacattacaatagacattaagcattcaaaggtctacaaagtgagcacgacttacctcaatcaaaatgagaccctatga

SEQ ID NO: 96944 - DNA, 606 bp, Glycine max
  Peptide Sequence Number=SeqID_213722
atggaaaagaaaaagaacaaaaggataaagagcattgggcacagacctgcaaccctgagaatgaagaaggagaaggaactagcaaaagatggtccttcaaggtggctcaggagtgaaggctttgctcttctagagttgattgagtatcacggattgaagaagctattggagatgaagggcacttactacactgactcggtaaaaattttctataccataactcatattgatggtgatactggacttttggatgctgaagtgaaaggacaacagattgtgatgacacctgaggtttggttagacatcattaggttatcgtcagaaggagttatggagaaccaactaggtcttaaggaagctagatttgatttcaacaaggttgagaagcacaagtcaatgatgaagaatccttctacctatgttgttgttgttacaaaagcaatgggaaaggaatgttttggtattgaaccgctaatgcttgagcacatgcttttggcctatgcggttacttggattattactccaagggggagaaatcatgctcaattgactaaggaggatcttctccttattagtcttatgcaaggaaagctaaagatcaattga

SEQ ID NO: 96945 - DNA, 1020 bp, Glycine max
  Peptide Sequence Number=SeqID_213723
atggcttctagtttgcttctcctcgcaaagaaaatgcagaaaaaagggaacctaaaaccaaacacaatacaacacaccaacaaaaagggtcaatgctggacaaagaggaagaagtactctttgagctctagtactggttcaccaacaaacccttcctatggtgactcatgggaagaacaagcctttgcagaagatgctgctaattctcttggtggctgcatatggcctccaagatcctactcttgtagcttttgcagaagagagttcaggtcagcacaggctctaggtggccacatgaacgttcatagaagggatagagcaagactaaagcaacaacccactagcccccacaatgaaattctatgccatgaccttgaaactcagctgcacaagccagttcaaagtccttttgcttctctaggtggttatctatatccttctcctctttgtggattggcttgtaaaaaaactaaccctaattgtgatcctgattttgttgcttcaccttcttcatcaccctcgccttccaaggccttattggctccatcagctaatattggtaccttcagagaggaaaccatgattccactttatgattcctctattctccacaagatttctcctgccagtaattcttctgaatcatggccaaattcagctgaagatcatagattatattcatgtaagttccaccctcaagctgatactacgaaaccctccaagggaataatggatttcagatgtaggggtaataaggggaataatgatgatattgatggggatataaactttaattcagttgtgtatagaactcacccatctttgcagtttgagagtactaaagagccagatcatatcagttgcaagaagaggaaaacagatgcttcctcaactctattttccccaaagtcaagctcagttgataggcatcaagtgcagccaaagatgtttgagtttagccctagctcaatggaagagctagatctggagttaaggcttgggaacaggtccaagatatag

SEQ ID NO: 96946 - DNA, 333 bp, Glycine max
  Peptide Sequence Number=SeqID_213724
atgaggggttggtgtatgatgtacccgtatgtagcaatcactcccaacgtgatccacatgatttttgtaagaccatcaagacttgggaggattggtagtagtgattgggcctgtagctcgcaaagagagtgggtatggccctacaccataacacaaactacacattacagctatcatactcaagtccacgtagtgccagctgatatacatgatacagtgtgcatcgagtacacccaatggaggttaagaggaccgaggtggccatttggacatgtcattcgaggagatggaggagtaccaggaactactgaggcaattggaactgacgcttga

SEQ ID NO: 96947 - DNA, 594 bp, Glycine max
  Peptide Sequence Number=SeqID_213725
atgaaggtgaaaagtgaaaataatgccaagaaagcatccaagtatctagctttgcatcttatatttgaaattgacatgatagctcattctttatgtgaatttgcgggaggtgaagaagagaggaaagaattggaagcatatcgtgaaatccatgttcctacattgtcactgctgaagtggactacaaagagacatcaatttcaatttatgaagaaaagtcccttactcgttaaaaacaattggaatcttctgtgcatattaccttctccttctaagctcaggtctgaaggcctatgtcctttgacactcgaagaatccatccttatgcttggtgctcttggttttaaccgcaaaatgcacatatttgtagttggttttaatttgtacggaggtggctcacaattggttgctttgaccaacttgtaccctaaattagtcaccaaagagaacttgctttcttcagctgaactcgaatcttttgctaattattcctctcaattagcagcactggacttcataggctgcactgcttcggatgcattcgccatgactaattcaggaagtcagctatcatctttggtgtctaggtattga

SEQ ID NO: 96948 - DNA, 447 bp, Glycine max
  Peptide Sequence Number=SeqID_213726
atgggacaggctgttggtatggaggatttacctactcctatgtacgacttctttgctctaactgaggatgacccttacgtttctatagcctatgcggcttctgtacatgactttatgattccacctataccacctctttgttacccttatgctccaattccgtatgaggggtatggcctcattagggccaatcttttggatgatctacctagattgaagctactgatggcttctttttgcgaccaagatagatgggaggtggtttcctaccttctctcacaccttctacagttgtcctttgacagttttatagacccacaagtccaactagccattatgacaactgggtcacttctactctctcttcaaaagcttacttcaagtatgaaatgccccaagaaaatagctattggaagtggggcccttagcgctgcaaaaaattcttga

SEQ ID NO: 96949 - DNA, 670 bp, Glycine max
  Peptide Sequence Number=SeqID_213727
atgcatgaattttgggagaatgatgctattccaagaggtggtaattcctccttcattgctttgataccaaaaagagacaacgcacaagagcttgtggagtttcggcctatatccttgattggacacatgcatgatagtgtacttgtagcaaatgagatggtggatgattctaggagagggaataaagctagtctcattttggaagtggattttgagaaagcttatgattgtatgcctggagtctacatctatttcggtcttggagatcctattgctccctttctctttcttattgcggctaagggtttaagttgtctcatgaggaaagctttgaggagtggcatgtattctggttataaagttggaagacaacaggtggaggccacattactccaattcgcaaatgatatgcttttatttgcagatgaatctataaagaatattatgtgcgtgaaagctattatgagatgctttgagttggtgtcgagcttgaaggttaatttccacaagaactcgctggaaggagtagggatgaacacctatgttctccacaggagagaatggtttttgtgggagttacctttggtggagaacttcatggctgatctgaggggggtgactcttgaccaatatgtggaggataaagtgctttggaaaaatagttcaacag

SEQ ID NO: 96950 - DNA, 213 bp, Glycine max
  Peptide Sequence Number=SeqID_213728
atgtcgtcctggaagattcactcaattctgaattcgcaagaggtgtatatgatagtgatgctggggttgaactcgttgatgaaggattggaaggatgtaatggcactacatgctggagttgaacttgggacgccatgtgctgcccacctcgtagagggtagtgatgttgagcagccatgggacgatgttgtttgcacccagggaaggaggtga

SEQ ID NO: 96951 - DNA, 255 bp, Glycine max
  Peptide Sequence Number=SeqID_213729
atggtgtggaagggagggttccaaagaaggacaaaacgagggataactgaagaagatctagtagggaagtttaaggtttattgcaatgcatctaagcaaggtttaggatgcgtgctaatgcatggaggcaaggtagctgcgtatgcttccagacaattgatacaacatgaagtgaactaccctacacctgacctagaattagctgcaatagtgtttgccttgaaaatatggagacattatttgtatggtgcataa

SEQ ID NO: 96952 - DNA, 675 bp, Glycine max
  Peptide Sequence Number=SeqID_213730
tttgttgatgagagggatggacttattggttggctgcgaagtgaattcgcagctgccaatgccatcatagactccctttatcaccatttacgtgttgttggtgatcctggggagtatgatatggtcgttggggccattcagcagaggaggtgtaattggaaccaggtgctgatgatgcagcaatacttttctgtggctgacgtggcatatgcgctgcagcaagtggcgtggaggagacagcagaggcctctggatccaatgaaagtgggtgcaaaggaagttaggaaatccggttctggataccggcatgggcagaggtttgagtctgtaaaggaaggttataattctagtgtagagtcttatagtcatgatgcaaatgtcgcagttactggaggcacggagaaagggactccagttgttgagaagagtgaagaacataaatcaggtggaaaggttgagaaagtgggggataagggtttagcatctgttgaagagaagaaagatgctataacaaatcatcaaagtgaaggcagcttgaagagtgcaaggagtactgaaggatctttgtctaacttagaatccgaagctgttgtaaatgatggatgtatatctaattctaaaggttttcttcctcctgacaatgatgatagtgaagatattatatatcttgtttaa

SEQ ID NO: 96953 - DNA, 1446 bp, Glycine max
  Peptide Sequence Number=SeqID_213731
atgccttcagaggatagcacgtcctcgccttcagaggactgcatgtccacgactttagagggctacacgccctcgccttcgaagcactacatgccctcgccttcagaggactactcatcctcacctttagaggactacaggtcctcgccaatagagggctacacaccctcgctttcagagggctacacgtcctcgccttcagaggacttgcacgccctcgccttcagaagactacacgtcctcgccttcagaggactgcacgtcctcaccttcataggactacatcacatcctagccttcagaggactgcacgtcctcgtctttagagggctacacgccctcgccttcagaggactacaagtccttgccttcagagggcttcacgtcctctccatcagaggactacaagttcttgctttcagagggcttcacgccctcgccttaagaggactgcatgtccatgtctttatagggctacacgcccacgccttcagaggactacacgccctccccttcagaggactacacatccttacatttagaggactacaggtcctcgccatcagagggctacacgcctacgctttcagagggctacacgccttcgctttcagagggctacacgccctcgctttccgagggctacacgccatcgccttcacaggactacacggcctcaccttcagaaggctgcacgccctcgccttcagacgactacacgtcctcgccatcggaggactatatgtcctcgccattagagggctgcatggcctcaccatcagaggactacacgtcctcgcctttagagggctacacgccctcgcctttagaggacttcacgtcctcgccttcatagtactacatgttcttgccttcagtggaaagcacgccctcgcattcataggactgcacgtcctcatctttagagagctacgcgccctagccttcagaggattacgcgtcctcgccttaagagggctgcacggcctggccttgagaaggctaggactacacatcctcatctttagaggactacacctccttgccatcagagggctacacgcctccactttcagagggctacacgccttcgctttcagagggctacacgccctcgctttcagagggctacacgtcgtcgccttcagtgggctggacgccctcgccttcaggggactacacgtcctcgccttaagaggactacacgtcctcaccttcataggactacatgtccttgccttcagaggacaacatgttctcatctttagagggctacacgccctcgccttccgaggactacatgtcctcgccttcacaggacttcatagggctgcacaccctcgacttcggaggactacaagtcctcggcttcagagggcttcacgtcctcgccttcagaggactacacgtcctcccattcagagggatgcacgccctcgcctttag

SEQ ID NO: 96954 - DNA, 225 bp, Glycine max
  Peptide Sequence Number=SeqID_213732
atgacttttggaagagtaattgcctcagagcatcctggggattataggggcagtatcaagctttctctagttcctggactcttgcaacattatgtgctatgtgcattctgcattctgggtgtgcagaattcagtgtggggaaagctacatgttttaatgtgttacacttgtactgcaatctgcaaaccgtctatccatgatgctgattctatacttgataactga

SEQ ID NO: 96955 - DNA, 678 bp, Glycine max
  Peptide Sequence Number=SeqID_213733
atgagagggctgcaagtcctcgccttcagagggcttcacgccctcgccttcaaaggactacacgtcctcgccttcagagggctgcacgccctcgccttcagaggacgacacgtcctcgcctttagaggactacacgtcctcgccttcataggactacatcacgtcctcgcctttagaggactgcacgtcctcgcctttagaggcctacacgccctccccttcaaaggactacacgtcctcgccttcagagggctgcacgccctcgccttcagagggctaaaagtcctcgtcttcagagggcttcacgccatcgccttcagaggactacacatcctcgcctatagaggactacacgtcctcgccttcacaggactacatgtccttgccatcagaggaaagcacgtcctcgccttcataggactgcacgtcctcgtctttagagggcttcgcgccctcgcctttagaggattacacgtcctcgccttaagagggctgcacgccctggccttgagagggctaggactacacgtcctcgccttcagagggctacacgtcctcgccttcagaggactacacgtcatcgccttcagaggactacacgtcctcgccttcagagggctgcacgccctcgccttcagaggactactcgacttcagaggactacatgtcctgccttag

SEQ ID NO: 96956 - DNA, 303 bp, Glycine max
  Peptide Sequence Number=SeqID_213734
atggcttatggaatggtcaatccagaatgcactccttttttgacttctggaatgatcaatccagaaggaaaaataaaaacactccagaaaggatgtagaaagcaacttggaggtgcaggaagtaacagccatgacaatggcgaagcaaaagagagcatgctgaaaaatccaaaccccaacaatggtggttcaaagcttgagagtctccaacatgcgcccaaagctgatgggtctctaagcttcttggtggttggagactggggtagaaaaggtgcttataaccaatctcttgtcgcttttcag

SEQ ID NO: 96957 - DNA, 229 bp, Glycine max
  Peptide Sequence Number=SeqID_213735
atggatgatagatggggtgagccagatgcggggttcgatgaacacggtgttactctaccaaatatggacacacaagatacattgtttccatttatatcaccaaccaagccattattgggtagaggacatagaaccaaacaaccttcaactcgatcacaagattatgtgacaaataccaccaaaagattgagcccatccaactgttcaccctctccaaaggcagactcag

SEQ ID NO: 96958 - DNA, 444 bp, Glycine max
  Peptide Sequence Number=SeqID_213736
atgcatagagaaacagggaatgattcaatgttgaggcgtaagcgaggctgggcatgcgggatgctcatggtatatgcgcaagccatctctgccggggaagcgacctcggccagaggccagctcattcctccggagccaggtgccgttcaatcttcattcaatcaggccttgctcggccagttgactttacgccaggcagagcagttgttcgcaagcggtaaccgtgaattgctggctgccaagcgcgcggtagaaggtgctgaggcgaataccctgattgcgggccagcgcccgaatcctgtgttgtcgttaggactttccagtgtcaatgtcaatcgtggccaagggaacatgaaccaaaatggcgccaatggcgtttgggacaaaacctataactctgcccttcaagtcagccagttgtatgagcgtgggaataaaccgtga

SEQ ID NO: 96959 - DNA, 489 bp, Glycine max
  Peptide Sequence Number=SeqID_213737
atgacaaccacatatttcaaaccaaaaccaataagtcaaacccaaattcttctctctcccctaatacttctcctctcttcagcttttgaccactatcaatcgtgcaaccacattcactcttcctcctccacatttggaaaattccttcgccagcacagcaacgacttgtcgtccacgatcaacaaggggatctctacgctgaagcactccatcaacgaccaaaacgacttcaaaaagaaccaaaaagactacaactgcgtgatggagttcaacctctcggcgccaacgtacggattcgacgaggcggtggaggtggaggaggcagtggtggcgaaggagattgggagggtggttagggttttgaggcaaaggttgccaattcaggattggttgatgaagatgaagattgcgaggaactgcttcgcggggagcgatttggtggagtttctcgttcgataccatggttgtgctccttccaaggtacattga

SEQ ID NO: 96960 - DNA, 531 bp, Glycine max
  Peptide Sequence Number=SeqID_213738
atgtcccacaaccaattgattggtcatattccacaaggtataggtaatatgagatcattacagtccattgatttttcgaggaatcaactttctggtgaaatccctccaaccattgcaaatttgagctttctgagcatgctagacttgtcttacaatcatttgaagggaaatattccaacaggaactcaattgcaaacctttgatgcctccagcttcatcggcaataatctatgtggtccaccactgcccataaactgcagctccaatgggaaaacccatagttatgaaggaagtcatgggcatggagtgaattggttttttgtcaatcatggcggtatgcctattttcatttccttgatcatgtgtggttcaaacttcaatcttttcgctcaggtgtgtttcttcccaaattgtgcaaatgctcgtcgacaaatgggtgagatcaaaagctcaggtatggtggctccagcaccttttgatgctgtggagctctcagatgaacctgccgttgctccattcccgcaatactaa

SEQ ID NO: 96961 - DNA, 1236 bp, Glycine max
  Peptide Sequence Number=SeqID_213739
atgtcttggggaggaccaagacatgaacatggcaggactttgtggagtgtccaaagggttcaagatgaaaaaatggaggaccttgagatggacttgatggagtgggctatgttaacaccagaattatctttctctactgaacctaacattcagcacacttcaacaaaaatccatgaccaacacttgccacaacaatttgcaacctcagccaaaagcactgtcacttcgaagcttgtatatgacgctgacaccgaaacaactcgatcaagggatcaccaagagaacacaggcagtgcaaaaccatcaacaatctcttcagcaacctctgcaatagctgataaagccatgtcagccaaaaacacagtctcttccaagctcggatacggtcaacagcttgcaatagctgataaagccgtgtcagcaaaaaacaccgtagcttcaaagctcggatatggcaacaacactgaaacaaaaacaactcaaaccactcaatcagcaacctctgcaatagctgataaagctttctcagccaaaaacaccgtagcttcgaagcttggttttggcgacacagcaacaacaacaccacaagagaagagaactgaccatgctgctgctcctacagaatatggaaaaagtgttgctcagtctctgacagagaaactagctccagtttctggaaaagttgctggtgtaggaagtggtgtgaagtccaaagtttctggaactcaaactagtagtgtgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagaggatgatcctgagagaagaatggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagcttaaaggtatggttgggacatggtttaccaacccagcagagaatcaatcgtcacaagattcatctatgaattatgaggcaggaagggcagaagtggaacaagttaaccaaggtgcagcaggtgaaagaaggctgcaggagtcatctaattga

SEQ ID NO: 96962 - DNA, 201 bp, Glycine max
  Peptide Sequence Number=SeqID_213740
atggggcaaaacacaccgaataaaatagatgatgatggttcaatttctcaccaaggatatttggcaccctttgttgcacaatatgtgaagtcccgagacgtgccgaaaatcaaaaggaagcaggcttacgcgatccgtgaaaattccggatgtgacgaaaatcgaaagggggtatttttcgcaatccgtgagttttcgtaa

SEQ ID NO: 96963 - DNA, 303 bp, Glycine max
  Peptide Sequence Number=SeqID_213741
atgaccattgtctctcatagaggaattgtgaggatttatatgaagtacaaacaacgccatatgctttttgacctttgtgaaagtgaccttccaagggatattcctcggaggtcttctagtctcttctatgttgtccttttcttgaattcaaataagagtggacacttactgaatatagcatgttggacgctaggcaaagatttgccacaacgagatatgctttcaccacaacaaatctacaaagctaaagaccttggagttaagaaaaactcaccacagcgagtcatcaattcaccccagtga

SEQ ID NO: 96964 - DNA, 2220 bp, Glycine max
  Peptide Sequence Number=SeqID_213742
atggcggacgacaaactctccttcgagtgcttggaccgtctcgaagctctcattgccaacctcattgccgcccaactccattccatcgtgattctcgattccatagtctccaaactcaatgccattcttctgaaacgacatatctcgatcctatcttcttcatcgatcaacagtcaccacgttgacgaggaagttcccaacgacactgtggaggaacttgtctctatgggttcgtcagagttgtcttcagaggtgccccctctgcccataacacacggtgcggcgcaagcggtgtggttgccgtcgcgacccgtatcgacgtcggagttctcggccaagttgccccctctgtgtttcgcattgaccacccacactaccgccacggccacgaccactgcaacacggtccccctacggcagcgtcatctggcatagcggtgttgctaacgcgttcggcccctgcgccactactagatattcacttgcctctctcccacgaccactgtatccgccgtcgtcacccccaccacctctgaaaccaccgcctccaccacgagcatggtcggcgcgggtttgcgccttgtggaccgtgatgttcggccgtcaaggtcttggccgtgcaaatcgcttttcacaactatcactccctcttggagcagcagctagagctgctggtgtttccacgagccacaaccaagcagaggaaaggcgcagggatgggattgatgctctacggcacaggtcaccacccagcccactcacctttaggatgttggtaaccctagaggattattattggcgtgggaatgttatgaatcaaccatcagacaaacctaaccatgaggaggcaagcgctaacagaataggagcaggattgctgagctggcattgcgggattgggcccttggatgatcctgtcgggaatatgctttttctgaattctgggcctcgaactccagaaacaccagcacccataacaatttcaattgttagggtaagaaccctaaaggctggcttcgagggcaatgacctccagaaagaagagaaggaagggaaacacaaggaatattctagtaacagaattcgttttgcaaatttgcccatgagggagcaaaatgccacaagcaggatttggtgcagatcttcctatttttctcttccgaaattgccctcaaacgtagtcttcaagcgtgttcgtaacaactcctctttgtctgctatgcttccctatcactccctgccccatcaaaaacaccttgtccgcaaggcgttgggttttcagactaaggccttcaaaaacaatatcggggtcccaaggcttatgccgatgaagtgtactaggaaatccagcaataggcaagcgcgaaacacccttattgtgccgatagaggtggcgaaattagtgttggggaagaagacgcaaagtgatggcgttctcgccctgcaattccacgaagcgtccgtgatgaaagaacatcacgcagcaggtgtgggttttgggtttgggtcaggtgtgggttttgggtctggtccttcggatacgggtgtggctagcttcgggttaggttacgctgtattaagacccaatgggttgtggcacagctcgtgctcatggcgcgaggctaactcctccggggtgagacgcctgacggtcggagcctgtgacggtggcggcgaagaaggcagcaaatggggcaagggcgtgatacgaggggaaaccaaaggggctgacggtggagctaccagcggtggggtttgcggccacggtggaggtagacaaaggtccgacaactgctacttctggagcttcgcaaggccggcggcttggtccacgggggtcggcaagccgataattctattaaccaagtcttcgaactccttcaggaacaaaggtggagtggtgaggaactggtgtgggtttaggtgtggtggcgaaaggcacagaagcatggcagtgaaaaagcttgtccatgttgagggtcatagagtgcatgtgattgtcaagacgagcaatggcctcgtcgaggctggcttcgagggcaacgacctccaaaaagaagagaaggaagggaaacacaagatcttcctatttttctcttccgaaactgccctcaaacgtagtcttcaaggtatgtgggctttagtaccttcctcttgctcctggtctcttctcccttctacaccattgatgctggtgcttcctgtatttatggcattctaa

SEQ ID NO: 96965 - DNA, 543 bp, Glycine max
  Peptide Sequence Number=SeqID_213743
atgtggagagagaggggggcacggaagggtcatgactctcctattttattttcaaagagccaattcaagataccttcgactggattaggcacgtttagcgttgatcctgctattgtcaccactgccatcaaggtggggtacaggcttatcgactgtgctgaatcctatttcaatcaagcagagattggttctactcaagaaaattttgaagatggtgttgtgaagcgtgaggacttgtggatcacctccaaactccggttttattgtcttctaactcttctgaaaattggattttctccattgggatcacaaggatttctcaacagtgatgtgcttaagaatcctgttatcaatttcgttgctgagaaattggggaagacacctgcacaagtatcccttcggtggggcatacaaacaggacatagtgttctgccaaagacctctaatgaagctaggatcaaggaaaattttgatgtcttcaactggtctattcctgaagagctgattgctaagttcactgaaattaaacaggcaagtagttaa

SEQ ID NO: 96966 - DNA, 1137 bp, Glycine max
  Peptide Sequence Number=SeqID_213744
atggctgcaacgaaaaaagaagaagagaattttcaactatatgagggatcacatttagaaggaatcaaccactggtcctcaaaacatttctcaaaactaggaacagagattctcatcaaatctgttactcaagcaatcccctcctattacatgagtgctttcctgttgtcctcttccttggggaagcaaggttggaaatttttcactgaccaaaatgctatacctcatctattctttagggtggtggttaagaaaggtcttagatggccattgggtgatggtgagaagataaacgtttggaacgatccctgcttgcgttctagtgataacccttatgtccaaagtgctcccattgacggctcggaagagttgagggtttgtgacctcattgatgccacgaccaacacttggaagcaaggcattataaaagacatttttaatgagaagctgagattattagaggcatgccaatacacttcatcacgagtgatggtgtggacgtgctctaatacatggcaccacgtcagtcctattattgcagatgccgaaagcctcaatgactgcatcttttctctccttcgaaccctagatggtgatcagattgccaatgtcgcttctgttctctggtgcttgtggcaacgcagaaatgacaatgtttggaataatgtagagaagcctcctcaactatctcttaacatggcaactgggtacattcgtcaatcgcaggtagcctgcaaacattttcattcttcaaccactactcgtgctctcccgaataacacaatccctcgctggatgaaacctgagttagggttcatcaagtgcaatgtagatgcgtccatttcttctgaagcacgacaatttatgctgggtggttgtatctgcaactccaatggtgaattcatgttagctcgaacttcctttagtcatgggaacattccagcagctgaagctgaagcttcaagctttctcgcagctgcccactgggtttcacaaatggggctcacgcacccatcagacaaaccaaaccatgaggaggcaagcactaacagaataggagcaagattgctgagctggcattgcgggattgggcccatgggtgatcctgtcgggaatatgctttttctgttaggataa

SEQ ID NO: 96967 - DNA, 1476 bp, Glycine max
  Peptide Sequence Number=SeqID_213745
atgacgatggtcatagaaacgatcacaatgatagtggtggcaataacaatgacaacaaccatgttggtagtggcggtgatgatggttgacgatcatggtggtggttgtgatgacggccatgggaattgtgatagaaacaatatcacggtgataatctttcttcacccagaaggcttagtagggaaaatgatgggaaaatggaaggccgttgagtttacggtggaggaagagaatgatggtgaactcgagagctttcaaatcaaccactgcataagcatggaacgtaaaaaaagttttgatcacttgctaaatgagtgtgaaacccataaaagaggggaagaggatgaggacaacttagtgttaccgtacagggtatggatgaaagcatctctccaaaagaacacggggagtaagaaccatgaggacattgtgggggagatgacaacaactttgatggaatgcaagatcactactaaagggggagggcacattcgggaaaaggggagtactgagcaccatgaacatcttattagggggaataacctagtcatccagtggccaattgagggggttactctaggagcaaagatggatggagaggctaagaccataggagggaaaaatactagaacctggaagagaactgctagaacattcgtaccccacaagagaagatggatgaaaacatggggaaaggaaaagaaaggggggaagttaaagaaatggaagcttaaccctatgattaaggatgatgttggtaacttgttcacaaatgaagaagacataggggaggttcttataggttttttctctgacctctttacctcacccaatccctctaatatggatgatgtagcgagtatagtggacaatagagttgatgctcatggcaagaaccacttaactcgagatttcactgaaaaagaagtaaaggagaccccatttcagatgcatcccacaaaggccccaagggaggatgatggtgacccaccaactatgaacaagaacctcttttttctaatacctaagtgcaaaaagcctatgcatgagagtgagtatagaccaataagcctttgtaatgtcattttcaagatcattacgaaggctattgctaataggcttgagccaattcttcccgacattgtgaaagagaatcaaagtgtgtttgtgccaaatcgacatattatggacaatgcattgattgcctttgatatctttcattgcatgaagaaggaaaaaacggcatccgtgatctcaaacctcttctttgcaaatgatagcatcatctttgcaagggcaactttagaggaaataactcatctcttagctatcctcaagacttatgaagcagcctcaggaaaaaaggcgagagaaggatcgatgacttatttgggtatactgactatcatcgatcggtctaaaacccaagtgtttaactttgtccttgaaagagtgtggaagaagcttaaaggataa

SEQ ID NO: 96968 - DNA, 636 bp, Glycine max
  Peptide Sequence Number=SeqID_213746
atgagatcctctgctttcttgactacatccaggtgcacagatcatgctccagaagcattagatagagctttgaaagaattgcaacttgactacctagatctctatcttatacattttccagtccgcatgaaaaagggatcagttggattaaagcctgaaaaagttatacaacatgacataccaagtacatggagagcaatggaggcactcttctactctggcaaggttagagccataggagtgagcaatttctcttcaaagaagcttcaagatctgttggatatggcaagagttcctccagctgttatacaagtggaatgccacccacaatggcagcagccaaagatgcatgcattttgcgagtctaaagggattcacctaactggatactctcctctgggatcaggagatgctagtggtgacatccttaaatatccagttctcaaggaagttgcagagaaattagggaagacaccagcacaagttgcccttagatggggcctgcacgtaggtcatagtgttctgcctatgagtagtaatgaggttaggatcaaggaaaatctggatgtgtttgaccggcccattcctgaagatttgatggccaaattctctgaaattaagcaggcaagtacttag

SEQ ID NO: 96969 - DNA, 120 bp, Glycine max
  Peptide Sequence Number=SeqID_213747
atggctgcagctaccgctaaggtggctgaactggcaacaatcgtattggtatcgacgacagtgatcatggtagtgatcatgatggtggtcggtagtaatggtgacgatgagattttatag

SEQ ID NO: 96970 - DNA, 195 bp, Glycine max
  Peptide Sequence Number=SeqID_213748
atgggggatttggaatctatcttggcttgtgctttttgggtcataaggaaggagcctagtccaacgttggcaccgcctaattcccaccctaatagctggtcttcaccattggaatcccaaggagtcaagatcaactatgatgcggccatcaagcatggaatcaatggcaatagaatagagaaggaggaaaggtga

SEQ ID NO: 96971 - DNA, 921 bp, Glycine max
  Peptide Sequence Number=SeqID_213749
atggcaaagaagagtaatcaaggctgggaatccaaggaccccagtgtctgccctcaccaactgagtgatctaagaagagatgatgttgcaaaaggaaaagacattctaggacttggtcaagttggtcacggactccctccaaatcctccatggagtaccatgcgacatctagaagcctttgcccaacatacacaatttggccactatcagcgtgtggtccttggggattttcggccactggtaatacagtgtgagctagttgttggtgccctctgggtcataggtgttggtgtagaattccatcaccaatgcctcatcaatattgtccttgggaagagtggtgaatgtctcattccactttctgcgctttatctcattctagacaacatcgatctccccatatttaaggaaggcagtcccctctggacacaagtttcgcttgatggtcacattctcaaagggttcttgagaaacttgagtggcgaatatggtggaatcctactgaactttgagctttgtcccttgagtaatgacaacaccccgcttggtggcttccggagccttccttttggaagtggaagaatcaatgaacattctttgtttgtgaaaagtatttccaaaaaatgggatgaaatttcatcccaagttctcaagctatggcccttgaaagaatgtagccatttctttgcatccccgaccaaaaagaatgaaaacaagttaagaggaatcacatcatcaggcactcccactatcttgatcgtgttgcaaatttccattcttcaagtgtcacctaggttttctcctcttccaccattagtggctcctcaaaagaaggaggaggcgaagagattggtgatcgttgaggaggtgacaatggtggttgtggagaagatgaagaaacttcttgagcttgttgcctag

SEQ ID NO: 96972 - DNA, 585 bp, Glycine max
  Peptide Sequence Number=SeqID_213750
atgagtccattcatgataatgctacatggtaagattgatggaaacttggtattggggatcaatatagttccaaatcttatcattgcgatgatgccaaatgttccaaagaagcataacaaactttacttggatactctgagagagcttatggaggagtttgaacaccgaacctttgatggttttggcaatttggacttcattggatattggtggtatgatgagcggactagatattgcccattggtgctatgctttggtgctatgcttccaaattacagcatcatcaaaattagtgttgagaagagaaattgcttgaatggcttgagcatcgtgtggattgaatatttgattaatgatttcaaacctccaagaagaatttgcatgattaatgaggacacttactgggatgtgtttgagtccaggtggaggtggtgtggtgatgaaagggtagtgggggtgttggaatcagctttgagaccaaacatttatcttgtgatagtttcccaatttccattgaagaccttccttgatcaatacttgagaggcatggatgttacaccatacacagctaggattgagacttaa

SEQ ID NO: 96973 - DNA, 532 bp, Glycine max
  Peptide Sequence Number=SeqID_213751
atgtcggagtcccacttcctctctctctctcctccccagccataccccagccatacgcgtcatctactctgccaaccaaaaaaactcaaggtggcgccgaagaagctcgtcccgagggttttccgtggagacggtcttgtcgggaatcttgtgcagcttgaacacgaagtggtccatgagagagtcgatgcacgcgcgcaggtggcggtgggagccgccatgccccaccgtgaggacgacgaaaattgtttcctcggagggtggtgccgtgagggtgtgcctggtggcacgaagcacatggacacgaatagaggacaggctgttgttgacatgcatgtgcccttgctgcttatgcatatcagtaataatggagtgtgcgttggagttggtgaaggctccactatatgttatggagtggttggagaagctgcggcgacggcagaaatggcggtggcaacaatgacggtgggggttggagaagctgcggtggggattgatttaccaggaataacaagttttccaagaaagggaa

SEQ ID NO: 96974 - DNA, 249 bp, Glycine max
  Peptide Sequence Number=SeqID_213752
atgccactgccatgctttctaagacgggcctatgacaatcgttgtcaaaaccgtatcataaaaggggtagcggctggcgtagcggaggaggatggaggagctcttcatcgtgatggcgcggcactactcctcatccaggtagtccatgaagcgttgctttttctcaatgtctctctctcagatcaacgccccattgtgagttacgcttctccattccacacttcattgttcatgttcattcattcttaa

SEQ ID NO: 96975 - DNA, 1470 bp, Glycine max
  Peptide Sequence Number=SeqID_213753
cctaagaagaatttcaagaaaggagaaccatcttcctccaatggatacaatagcttcaagtgtgaaaagataggtcatattatggtagattgccccatctaccaaaagaagctacaagaagataagaagaataagggttcattcaaaaagaagaagaatacatatattgcttgggataatgatgaatcaacaacttccagcgacaatagtgaagaggatgaagaaaatttgtgcttgatgccaaacaatgaagatagaagtgaggtgatcatttctgatttggaagatgatgataagtatggagttccaagtgggaaatacaactgggatcccaagggaaataacaaggtgttcctagttgcggataaacaactatggtatcttgatagtggctgctcaaggcatatgataggaaacaagtcaaatttcatgtctctaaaatctaaggaaggaagatttgtaacctatggtgatattgcaaatggagtttctacacgacactcactcaatttgtttagtgaaatttatgaatttgtgtctatggtagaaccttcaactattgaagaggcacttcttgatgaacattgggttatggctatgcatgatgaacttaatctacttaaaaaaaatgaagtttgtgaactagtacctaggccaagttataacaaacaaaggggtacagactttggtgaaacctatgctctggtagctagattagaagttgaaatctatgtttctcaaactcctgattttgaggataataaaaatcttactcatgtgtataagcttaagaaagctaataagcaccaagacaatggggagtttgaaatctcaatgatgggagagatgaactatttccttggtctacaagtgaggcaaatgaaccatggaacttttctccatcaaaccaagtattgcaaggaaattttgaagaagttttatatggataaaaggaaggaggctgcaactcttatggctacaaattgctaccttagtatggatgaaaaagggaaactaattgaccaaacaaagtacagaggtatcattggttctttactctatttgactgctagtagacctaacattatgtttagtattttcatgtgtgctcactatcaatcatgtcctaaagagtcacatttctcaacaattaagagagttatgaagtatcttagaggaaccttagatgttggcttgtggtaccctaaaggtgttgagatctctctaaggggatacttcgattttgactttggagaatgcaaactagataagaagagtacaagtgatatttgtaacttattaggacgacatggcctagtatcttggaatagcatgaagcaagcatgtgttgccttatctatgtctgaggctaagtacattgttgcatggagttattgtgcacagattttgtggcctaaacaacaactttctgattttagattgaatttagaacatatttctttaagatga

SEQ ID NO: 96976 - DNA, 1017 bp, Glycine max
  Peptide Sequence Number=SeqID_213754
atggcagagaagaagaataagaggataaagagcattgggcacagacccacaacccccaaaatgaagaaggagaaggtaccaacaaaaggtggtccctcaagcagaggaaaatggattgcatgttctccctcacctcctactactctaaaggcaactccttgctatgcaaaaacagagatgattcaactgaagtatgtcagtttggcgtggctcaagagtgaaggctttgtatttcctgagttgattgagtatcatgggttgaagaagctggtggatatgaagggcacctactatactgacctagtaaaaaaaatttataccacaactcatactgatgatgatattgggttttcctgcgttgaggtgcaagggaaacaaattgtgatgacactagaggtttggtgttatgatgaaccaactagttctcaaggaattggatttgttttcaacaacatcgggaagtacaagtcgacgatgaagaatccttctaccaatgttgctgttgttacaaaagcaaaaggaaaagaatgttttggtactggaccgctaatgctcgagcacaggcttttggcctatgtggttgcttggattattactccaagggggagcaatcatgctcagttgactgaggaggatcttctccttatcagtcttatgcaagggaagttgaagatcaactgggtcaacattattgttgatatcatgttgaagacaaagaggattcgctctttgaagtgtccttatgttgttctaatctccaggattcttgattattttggtgttgatactcaagaggaagtcattgggattgcatggattgagaagagcagagaggatcaaacaaaacaagaagaagcagaagagaatcacattagcccctttgagcagatgatgctagcaaagatgaatgagttcatgaaagtgcacaaagaagactatgctaagcttaaggagtgttttaagtctatctcagaaaggatggatgttatgggagcaccacatgtggatgatatctga

SEQ ID NO: 96977 - DNA, 1725 bp, Glycine max
  Peptide Sequence Number=SeqID_213755
atggttgagtgcgatgaaaacgttaacgaagcagcaatgtcaatgtccatggaccctcgcgcgaggcacgcacaagccataacatcacacatcaaagaccgcgcagtgtggaacaacctcataacccactactccaaatccgacctttcttcctacgccgtttctctcttccagcgactcccttttcctcccaacgttgtctcatggaccgcattaatctccgctcactccaacaccctcctctccctccgccacttcctcgccatgctccgccacaacactctccccaaccaccgcaccgttgcttccctcttcaccacctgcgccgccctcactgccgtctctttcgccctctccctccactcactcgccctcaaactctctctctcccaacaccccttccccgcctcctccctactctccctatacgccaaactccgcatgcccctcaatgcacgtaaggtgttcgacgaaattccccaaccagacaacgtttgtttctccgccttgatcgttgcactcgcccagaattcccgctctgtcgacgcttcatcggtcttttccgaaatgaggggtcgcggttttgcgtccacggttcatagcgtgtccggggttttacgtgctgctgcacagcttgctgcattggagcagtgtagaatgatgcatgcacatgcagttgttctggggcttgattctaatgtggtggtgggtagtgcgcttgttgatgggtatggtaaagcgggtgttgttaacgatgcaaggagggtttttgaggataatttggatgatatgaatgttgtggggtggaatgcaatgatggctggttatgcacagcagggggattatcaatctgcttttgaactgtttgagtctttggaaggctgtggactcgtgccggatgagtatacttttttggcgatattgactgccttgtgtaatgctggaatgtttctcgagattgctccgtggtttacgaggatgagagtggattatggtttggaaccgagtttggagcattatacgtgtttggtaggtgcaatggcgcgtgctggagaattggagcgtgcagagagggttgtgttgacgatgccgattgagccggatgctgcagtttggcgagctttgctatcggtttgtgcgtatcgtggtgaggctgacaaggcttggagtatggcaaagagggtgttggagctggagccgaatgatgattatgcttatgttagtgtagctaatgtgttatcgagtgcagggaggtgggatgatgttgcagagttgaggaagatgatgaaggataggagggtgaagaaaaagggtgggagaagttggattgaagtgcagggagaagttcatgtttttgtggcgggggattggaagcatgagaggtccaaggaaatttatcagaagttggcagagcttatgggggatattgaaaaattagggtatgttcctgtttgggatgaggtgttgcataatgttggggaggaaaagagaaaggaggccctttggtatcatagtgagaaattagcagttgcatttggagtgttgtgtggacctgcaccaccagggaagccgttaaggattgtgaagaatttgaggatttgtaaggattgccatgaggcttttaagtacatgacaagagttatagaaagggaaattattgtgagggatgtcaacagataccacagatttgtgaatggtaactgcacttgtagtgacatatggtag

SEQ ID NO: 96978 - DNA, 219 bp, Glycine max
  Peptide Sequence Number=SeqID_213756
atgaagtggagatcgcatgtttttggaatcagtgaggaagtgcttagaggaggaaagttgagactggcattgtcaaaacacgccctcataacactgttaacagctgaagaagtgaagatttcaacaccatttgctgcccttggggaaaattactactataaaatttccaataggataattacaatgacctctgttgaagttagcggtaaatacacctaa

SEQ ID NO: 96979 - DNA, 927 bp, Glycine max
  Peptide Sequence Number=SeqID_213757
atgggaattggggatatgcacgtcttttggatcgtagtggcgttcagatcgtggggttttcgttttgcggcgattagatcgattgtcatggatgatgatgtgttgaacatgcccaattggggttattacgaacccttcagagggggacatcttggccttcagctcatgcctggtatgactgaacgggacacaaagccatttttgcctggtcgggatcctgctatgttaatgggtgctaatggaacttttcaccctcgagattgcgttgtttccgaggcaccaatgccattgaactatgtcagagatagttggataaaccagagagataggttttttcatatgcagcagcccacaaatcctaattatgctgttcttccggagacatcaggagctcctaacttgaaaattatacagccacccgatacgtcaagagatgagaaagtggatagagttgaagaggtcgttgtcaaaaaggaactgggcaagtcgaagaaaaggcacactaagggtgctctgtcgactccaaaagctaagaaacctaggaagccgaaggataatagcaatgttccagttcaacgtgcgaagccaccgaagaagactatggagcttgtaattaacggaattgatatggacatttctgacctaccaattccagtttgttcgtgtactggggctcctcagcagtgttatcgatggggttgcggaggttggcaatcggcttgttgcaccacaaatgtgtcaatatatcctttgccaatgagcatgaaaaggcgtggtgcaaggatagctgggcggaaaatgagccaaggtgcttttaaaaaggttttagagaaacttgcagctgaaggttataactttgctaaccctattgatctgaagactcattgggccagacatggcaccaacaagtttgtcactatcaggtag

SEQ ID NO: 96980 - DNA, 1215 bp, Glycine max
  Peptide Sequence Number=SeqID_213758
atgagggtatttgaaagagcgagtggagccatcaaggacaagaacagcatttgggctgcaaaattctcacgaaagggtccactccacaaccctgatttagaaaccgtggtaatcaaggcaacgagccacgacgatcaccacatagattcaaagaacgtgcaaagagtgttccagtggttacgaacttcacccttgtacctgaagcctctcgtgtgggccctctccatgcgcatgcaaaagactcgaagctgggtcgtggcgctcaaaggcttgatgctcatccatggcatttactgctgtgacattcccgttgtgaaccgcatggggaggttaccctttgacctctcaaacttctccgatggacacttgagccctgcaaaggcttggagcttcaacggtttcgttcgcgcttatttcgcctatttggatcagaggtcatcgtttgtgtcctccgaggttaagcagaagaagaatgttagtaataacaagaagacggaggaggtggaggagacgttgatggaagagcttgagaagctgcaaaagttgcaagggatgattgacatgcttctccagatcaggccaaaggatgagaatttgaacattggtttgattcttgaggctatggattgtatcatagtcgaggtttttggtgtgtatagtaagttttgcaacaagattgcaaaagttttggtgaggatatatgaggttggtgggaagatggaagcgaatattggcctccaggttcttcagaaagcatcgattcaagtggaggagatatctttgttctttgacttgtgcaaggatattggggtcctcaatgcatctcagtgccctaagattgatagaatttcaccggaagatattcaagatcttgagaggataatcaatggtgcttcttccaagaagggttgtggttttgtgggaaatgatgaggataataataaggccattgtggtgagagattgttcttccactgcaatggtttcgcaacaggaggagtcagagaatggtttaatgaccgtgatcacgcaacaatgggaggtgtttgatgatgatcatgtaatcgttggtgctaaaggaatggataatgtatctaataatggtgcaaaggatataattggcaccacaaccaacccttttgaggaatcatatagcatcgtaccttatgttcctgttcatcaccatcaagctcttcctgatctaattagttggtag

SEQ ID NO: 96981 - DNA, 3411 bp, Glycine max
  Peptide Sequence Number=SeqID_213759
atggaaaacaaccatgttcagcttttggttcatctcaccgtgacacttcttcttgtgatcactgttttgtttcctttgactgaaggtgcagcagcagtttcctccatcaagactgatgcacaggctcttctcatgttcaaaaggatgattcagaaggatccaagtggagttttgtcagggtggaagctgaataagaatccatgcagctggtatggagtcacttgcacccttggaagagttactcagcttgatattagtggaagtaatgaccttgctgggactatatctcttgaccctttgtcttctttagatatgttgtctgttctgaaattgtctttgaattcattttctgtaaattctacctctttggttaatctcccatatagtttgacacagcttgatctatcctttggtggagttacaggtcctgtgcctgagaacctgttctccaagtgtccaaatcttgttgttgtgaatctttcttacaacaacttgacaggccctattcctgaaaatttctttcaaaattctgataaactgcaggtccttgacctctcttccaacaatctgtcagggcctatttttggcctgaaaatggagtgcatttccttgttgcaacttgatctatcaggaaaccgtttgtcagactcaattccactatccttgtcaaactgcaccagccttaaaaatttgaatttagccaacaatatgatttctggggatatccccaaagcttttggtcagctaaacaaactacagactttggatctttcccacaatcaacttattggttggatcccttctgaattcggaaatgcatgtgcttcccttttggaactcaaactttctttcaacaacatctcaggctcaatcccatctggtttctcctcttgcacttggctgcagcttcttgatatatctaacaacaatatgtcagggcagttaccagattcaatctttcagaaccttggatcattacaggaactgaggctgggaaataatgctatcactggtcaatttccatcttcactatcttcctgcaaaaagttgaagattgtggatttcagctcaaataaattttatggatctctccccagagatttatgtccaggagcagcctcacttgaggagctgagaatgccagataatctcattacaggaaaaatcccagctgaactgtcaaagtgctcacagctgaagacacttgattttagtctgaactatctcaatggtacaatccctgatgagcttggagaacttgaaaatcttgagcagctaatagcatggttcaatggcttggaaggaagaattccaccaaagttgggccagtgcaagaatctcaaggatctcatactgaataataatcacctcacaggcggaattcccattgagttgttcaattgcagcaatcttgaatggatatcactgacaagcaatgaactcagtggcgaaataccgcgcgagtttggcctcttgacaaggttagcagttttgcagcttggaaacaacagcctgtctggggagataccatcagagctagcaaattgcagcagtttggtgtggttggacttgaacagcaacaagctcactggagagatccctccaagacttggaaggcagcaaggagcaaaatccttgtttggtatcctttcagggaacactttggtgtttgtaagaaatgttggaaactcatgtaaaggggttggaggtttgctagaattctccggtattcgacctgaaagactcttgcaggttccaacattgaggacttgtgatttcacaagactctattctggtcctgtcctcagcctgttcaccaagtaccagactctggagtatcttgatctttcctataacgagctccgtggaaaaatcccagatgaatttggagatatggtggctttacaggttcttgaattatctcacaatcagttgtctggagaaatcccttcgtcacttggccagctaaaaaatttgggtgtgtttgatgcatcacacaatagactgcagggtcatatcccagactcattctcaaacctctcattcttagtccaaattgatctatctaacaatgagttaacagggcagattccatctaggggacaactaagtacacttccagcttctcagtatgcaaataacccaggcctttgtggggtaccattgcctgattgcaagaatgataacagccaacccacaacaaatccaagtgatgatattagcaaaggaggccataaatcagcaactgcaacatgggcaaacagcattgtcatgggaattctcatctctgttgcttctgtatgtatcttaattgtgtgggcaattgcaatgcgcgcaaggaggaaggaggctgaggaagtcaagattctcaatagcttacaagcatgccatgctgctacaacatggaaaattgacaaagagaaagagccattaagcattaatgtggctacatttcagaggcagctgaggaagctcaagttctcacaactgattgaagcaacaaatggcttctcagcagcaagtctcattgggtgtggtggttttggtgaagtgttcagggccacactcaaagatggctcgagtgtcgccataaagaagctcattcgactgagctgccagggcgatcgagaattcatggcagagatggaaaccttagggaagatcaagcacagaaatcttgtccctttgttggggtactgcaaagtaggggaggagaggctccttgtttatgagtacatggagtatggaagcctagaagagatgcttcatgggaggatcaagacacgtgatcgacgcattttgacatgggaagaaaggaagaagattgcaagaggtgctgctaaaggactttgtttcctgcaccacaattgcatccctcatataatacacagagacatgaaatcaagcaatgtgctacttgaccatgaaatggagtccagggtctcagattttggcatggcaagactaataagtgcccttgacacacatcttagcgtgagcacactagcaggaacacctggatatgttcccccagagtactaccaaagtttcaggtgcactgccaagggagatgtctactcatttggagttgtgatgttggaactgcttagtggtaaacgccctactgacaaggaggactttggtgacaccaacttggtggggtgggcgaagattaagatctgcgaagggaagcaaatggaagtgattgacaatgatttgcttttggccactcaaggaactgatgaagcagaagcagaagccaaagaagtgaaggagatgataagatatttagagatcactatgcagtgtgttgatgacttgccttcaagaaggccaaacatgttgcaggtagtcgcaatgctgagagagcttatgcctggatcaactgatggaagcagcaacagtgcttga

SEQ ID NO: 96982 - DNA, 1458 bp, Glycine max
  Peptide Sequence Number=SeqID_213760
atgtactatgatgacttgccgatctggggatttattgggacggttgacaaggaagggaaaactgaccctagtgagtacaagtattttctttacaagcacattcagttcgatattcattacaacaaagatcgagtcattgaaatcagtgcccggatggaccctcattctgtggtggacctgactgaggataaagatgtagatgttgagttcgtgtacactgcaaaatggaaggaaacagagactccttttgagaagagaatggataaatactcccagtcttcttctttgccacatcacttggagattcactggttctcaatcataaattcctgtgtaacagttcttcttttgactggttttctggcaaccattctcatgcgtgtattgaagaatgactttatgaagtatgctcaagatgaggaagctgctgatgatcaagaggagacaggatggaagtacattcatggggatgttttccggtttccaaagttcaagtctttcttttcagcagcccttggttctggtactcaattattcacacttacaatcttcatttttatgcttgcactggttggtgtgttttatccatataaccgaggcgctttatttactgcactggtggtcatatatgctctcacatctggcatcgctggctacactgctacttccttctatattcaacttgaagggactaattgggttaggaacttattgctgacaggatgcctcttttgtggccccctattccttatgttctgtttccttaacacagttgcgattgcttatagtgcaactgctgccctgccatttggcacaattgtggtgattgtcctaatatggacattggtaacttcaccattgcttgtgttgggtggtattgctggtaaaaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgccagtgtatggggccacagaatttatacgatctacagcatactcttcattgtcttcattattctgttgattgtcactgctttcatcactgtggctttgacatacttccaacttgctgctgaggatcatgaatggtggtggaggaccggaactgacaggatagtggtggttaggaaatgggctgcgtgtgctcaagaaagtctggctagattagattttggtggttggttggatgagatgaggccatatctgggtaaaaagagagaagcacaacaaatgatattggcacatctattctcatgcattgcactttctggatttgagacttttggtgcttgtagctcaactgatgacaagtctggttgtggttataaaaaagttcactggcagtggcagacagcggcagcagatgagtga

SEQ ID NO: 96983 - DNA, 1860 bp, Glycine max
  Peptide Sequence Number=SeqID_213761
atgtctagcatgtttggaaagtcattgaaaatggaggaatcaagttgggaatgtgggacttttgccttgtactcattgctttgtaggcatgtcaatattgggatcctgccctccaagcatgttggtttgaacacaactaaggacgtccaaaagagtacttcgcttgccagattcttccaaacaagcgtggttgctcgtaggctcttgctctttgttgctatgttgggtacttgcatgcttattggtgatggtatacttacgcctgcaatttcagtgttgtcagcaatggatggactaagagcaccttttccttcagttagcaaaacgctagtggaaacactctctgcaattgttttgatcgttctgttcttgttgcaaaagtttggcacatcccgtgttagtttcctcttttctccaataatgggtgcatggacgctgagtaccccacttgtaggaatttacagcatcatacaccattatcctagcatatttaaggctttatctccccactatatattccgtttcttttggagaaatggaaaatctggctggcttttacttggtggtactgtcctttgcattacaggttctgaggcaatgtttgctgatcttggtcatttcaatcagaagtccattcagatagcttttctattcacaatctacccatctttagttctgacttatgcgggacagacagcatacctgatcaagcatcccaatgatcatgatgacggcttctacaaatttataccaacttcagtttactggcctatctttgtcattgccacttctgctgcagttgttgctagccagtccttaatatcagctaccttttctgtaatcaagcaatctgtagtgctggattattttcctcgtgttaaggttgtccacacatctaataacaaagaaggagaggtttactcccctgaagtgaactacatcctgatgatcctttgtgttgctgtgatacttatttttggagatggaaaagatattggaaatgcttttggtgttgttgtgagcatagttatgcttatcaccactatattactcacattggtgatgatcatgatatggaggactcctgctatactggttgccctatactttgttgtattttttgtgatggaaggggtttatgtcagtgccgttttcactaaatttgctgaaggtggatggattccttttgccatatcacttatccttgctttcatcatgtttggttggttttatggtagacaaagaaagattgattatgagttaacccacaagataacctttgagagacttgaagagcttttagctgaccgcagtgttcaaagggttcctgggctatgcttcttttataccaacattcaagaaggcctaactcctattcttggacactacataaagaacatgaaatcccttcacaaggtcacaatattcactactcttagatatttgttagtccccaaggttgctccacatgagaggattgtcatcaagaaatcgaatctcgaaggtgtatattgctgtgtgattcagtatggctatgcagatgctttaaatttagaaggagatcattttgttaatcaagtcatcactagtttgacacaacatatacagaactctcctgacaagctttcatctgattctcgagagattgaagagacttcatacttagaagaggcaaggtgtgcaggggtagttcatgttcgtggaaagacaaaattttacattggcctgaactgtggctggtttgataaatttgtgcttagattttatgaagtcatgcacaataactgtagatctgccttgcctgctctaggggttccaccacaacaacggattgaagttggaatgctatacgaggcttga

SEQ ID NO: 96984 - DNA, 1902 bp, Glycine max
  Peptide Sequence Number=SeqID_213762
atgttgaacaaggcattggaggcttttggtgaacttggagatgatgaggagcttgggcctgctgactggcctacagtgaagagatatatctcctgtttaaatgacattgaaggtgaatgtgttcaccctcatggagcacctgaaaatgatagtaacctagatcctatgaatttgaaagacatacgagtacgccttctgaatgcaggaggaacctcatcaggtgtacaagctgcttactgggagatgcttgatgaaggaagaatttctcaaacaacagctaatatcctaatgctatctgtcgaggaagcagtagatttggcttcatctgagcctctatgtgactggaaaggagacagtgatattgcttctgctgtcatcaatgaaagtgttgtggaaggagaagaagcacggaagttcctagaagatgttaatgttacataccctcaggttttgcgtgttgtaaaaacaaggcaagcaacatatgcagtgctaaatcatttaattgaatatgttgaaaaccttgagaaggctgggatattggaagagaaagagatgctacaactccatgatgctgttcagactgatttaaagaaactactaagaaatcctcctttggttaagcttcctaaaataagtagtatccatccaatgttgggtgctctcccatcttcagttcgtgaatcacttgcaagttgtaccaaggaaatgatgaaattgcgtggtttgacactgtacaaggaaggtgccaaatcaaatggtatttggttaatttctaatggagtggtgaagtgggaaagcaagatgataagaaccaagcactcttttaatcctacatttacgcatgggagcacattgggtatttatgaagtgttgactggaagatcatatatctgtgatgtcgtcactgattccgtggtattctgcatttttcttgaagctgataagataagatcatgtctcaaagcagatcctttgacggaaaaattcctgtgggaggaaagtgctattttcctttccaaattattgcttcctcagatatttgagaaactgggtatgcaagatttaagaactcttattgcggattccgagagatctcgaatgaccatattcataagaggggaaacaatagaaattcctcatcattcagttgccctcttactagaaggatatgtcaaaactcaaggtcgtcaagaactggtaacagcaccagcagccctgcttccttcacatgggaatctaagcttccaaaatttggcaagttcaggttctaaggaagctagttttattcatcaacaaggatctagttatctagttgaaactacagcaagagtaattctgtttgacattccagcacctgaggctgatgctgctcttgttagaaggtcaagttcactgttatcacatgccggggatcatcctcatagatctttccgtcgaaaacatagtggtcttatgagttggcctgaacatttctacaaacaagaccataagcagagatctgaaggagctgggcgacaaaccaatagtttatctgcaagggcaatgcagctgagcatttatgggagcatggtggacatccctccccggagtagaagtttgttaaccaatgatggtagaccacctcatagcttgtcctatccaaccattgtgtcacatcaaggtcgtcctcttgtttcagtcaaatcagaaggagctgcaactgccaagaaggtccatgaggtcacaagacatgttacaaatccaccttcacaaagcacagaacgaagacagcatcaccatggagataattcaagtgatgattctggtgctgaagaagaagatattattggtgaagaatcttttgtgattatttgtttgttgtgcaataaatggtgcctctgtatcaccaacattgtacattag

SEQ ID NO: 96985 - DNA, 342 bp, Glycine max
  Peptide Sequence Number=SeqID_213763
atgaagacccctgatgaagcaatggacttaattgaaagcatggctgctagtgacattgccatattgagagaccgagcccatattcctaccaagaagaatttattggagctaacctcacaggacgctctgttggcacaaaacaagttgttgtccaagcaactagagacactaacaaaaacactcagatgtacaatttatggtggagctcatgaatctggatgttgtatccctaataaagagcaaattgcacataaagtcaattatatggggaatcagcccagaggcaatttcaatacaagtggatttccaggatttcagaacaaccagcagtatcagcagtag

SEQ ID NO: 96986 - DNA, 261 bp, Glycine max
  Peptide Sequence Number=SeqID_213764
atgtacgtcggcaaggttttatcgttcgagctcaaccgaagttgtggttcggccgacaccggcatgttttcatttgctcggcaaggaaaacgatgcttttttgatcggtgttgccgtaaaaatttacaatgtacgtcggctaggttttttggttcgagctcaaccgaagttgtatttctacctacaccagcatgttttcatttgctaggcatggaaaacattaaccaacctcggcaaaaaaacatgattccccgatactga

SEQ ID NO: 96987 - DNA, 393 bp, Glycine max
  Peptide Sequence Number=SeqID_213765
atggccacagccaggtgggcactcaagcatcctgtttatggcattgtgatactacggttgggaacttacacaaacagacccaacgtttccaaattatgttctttcatcagttcaatgaatccatccattcttatctcggacgacgttcctaaaggaaaattctacaagattccgcaacaaacattatcgacaaataacgaaaaacaagataacatacaaatgataaatgatggaacatatgaatttggggatcccacggtcatgtggctccgcatgccaccggactcttgggtcacggtaacaaaatgtggggcggtcgacaaaagcagggcttttgctcctacgtatcctcaatttgtgatgaggaactcagaactacgtagttcttgttaa

SEQ ID NO: 96988 - DNA, 687 bp, Glycine max
  Peptide Sequence Number=SeqID_213766
atgatcgccgacaagattcgcgccgccgcgcgcgccaaactgcatgcgcgtgccgccacgccgcagccggtgatgctgaaagcgggaccgctgctgagcagtgaaaagctgatcgccatcggctcctcaaccggcggcaccgaggcgattcgccatgtgctgcagccgctgccggccaccagcccggcgctgctgattacgcagcacatgccgcccggctttacccgctcgtttgccgagcggctgaacaagctgtgccagatcaccgtgaaagaggcggaagacggcgagcgtattttgcccggtcacgcctatatcgcgccgggcgcgatgcacatggagctggcgcgcagcggtgccaactacgtggtgaaactgaacgacggaccgccggtgaaccgccataaaccgtcggtggacgtcctgttccgctcggttgcggtcaacgccgggcgaaatgcagtgggggtcattctgaccggcatgggcaacgacggtgcggccgggatgctggaaatgcaccgcgccggcgcgtggaccatcgcccaggatgaagccagctgtgtggtatttggtatgccgcgcgaagcgatagcgatgggcggcaccagtgaagtggtcgatctgggtcacatcagccagcatatgctggccaaaattagcgccggacaggcattgcgaatttaa

SEQ ID NO: 96989 - DNA, 1002 bp, Glycine max
  Peptide Sequence Number=SeqID_213767
atgctgagaagcaatgcgcatttccgcgcgattttctgcgcccgcatgctgtcggtgttttccctcggcatgttggcggtgggggtgccgattcagatccaggcgatgaccggctccacgttgcaggtgggcgtggcggtggcgctggacggggtgggcattctgaacgccttcgccccggcgccttcgctgttggcgctctacctgctggcggcctgggacggcttcttcggggcgctgggcatgacggcgctgatggcggtgatcccgctgctggtcgggcgcgaaaacttggcggcggcgggggccttgagcatggtgacggtgcgcatcggcgcgatcctggcgccggcgctgggcgggatcatcatcgtgttcggcggcgtggggctggcgttcgccgtggccgccgccgggacgctgggcacccttgtcccactggtggtggggtcggtggtgctgctggggatgctgatgagcatcgtcggcgccgtccgggtgctgttcccggcgctggcgcaggatgcttaccacgtcggcgcgtcctcaattggcctgatgtattccgcggtgccgctcggcgcgatgctgggcgcgctgaccagcggctgggtggggcgtttctctcggcccggcgtgctgatcctggtcgccgccatcgtcgcgtttaccgctatcgcttcgctggggctgttcagccacctggcgccggcgctgctggcgctggtgtgctacggctacgccaacgccatcgcttcgctcctgcagttcatgctgatccagagcaatacgccggatcatctgctggggcgggtgaacagcctcggcaccgcgcaggacgtaaccggcgattcgatcggcgcgctggggctcggcgtactgggcagggtgtttaccccgttgatgagcgtgctgtcgtttggcgcattcgccgctgtgctcggcgtgctgatggccttcagcgtgcgcacgctgcgccagtgccggccggcggacgcgctg

SEQ ID NO: 96990 - DNA, 489 bp, Glycine max
  Peptide Sequence Number=SeqID_213768
atgcgcatctccccctacggaaggatcacgcccacaagacacccagtggactcggagaagtccaacagagccctgaggtttccagctttggttacaggcctctgtcagtcctacagggtgcccgtccccccagcaaggtcacgccatcatgagatagggatcacgcctgcaagacacccactgaacccggagatgtccaacaaggtcctagggtttccagctctgattacgagcctttgtcaattctacagagtgctcattgcccccaacaaggtcatcaggccccctactaatcgagctttcatcaataagtactgcgcccccaggcaggcgcagggtgaaacaccacaacagcctggggacggccagcagcgggcaatagacgcaccgccgccaccttcagagcccctcatctcacctacaaaggctggagcgttgcctatgacccgtggtcgaccaacaggcaaccaagtccaaagccaaaggtaa

SEQ ID NO: 96991 - DNA, 483 bp, Glycine max
  Peptide Sequence Number=SeqID_213769
atgcaagctctaacactgaagattgaaacgctcatgggagctcaagctcaagtccctgtcactacacctccattcccaacctgtgatagatgtgggattgtgcctgggctaggagaatgcattgttgattatgaactaaacgttctcttctacgtgactggatgctccactagaatacaagagattggatggccaatacagaagaaaaagagtactggaccagacaacccacattgtcgtccaccctatctctatcgtccattgttcaacaatctaaaatctccaccatggttcaataacatttatgaattacaaatccagataatgcgtgaacttgcttgttggagcagacattgtgaacatatcaattggatgcttccttctatcaacttttgggactttgaacctcttcttagaacagatgaagtggtatatgatgtcaatatgtttagtcctctcatgatagacttaatccttggctaa

SEQ ID NO: 96992 - DNA, 297 bp, Glycine max
  Peptide Sequence Number=SeqID_213770
atgggacttgcgatttccacgcacgtgcagaaagagcttggttctacgcagtggcggcgttgtccttcgccgcctgatgggattctccacggtggtggtattgttcttcgtcgtcgtgatggggttctctgtggtggtagcgttgttctttgcctctgtgatggggttttccgtggtggtggtgctgttcttcgttgccgtgatggggctctcctcagtggtttttgcgttagtgtagcagaagtgcagaacagcaaaagccaagatccaatagaggtaaacgaaaatgacaaatga

SEQ ID NO: 96993 - DNA, 527 bp, Glycine max
  Peptide Sequence Number=SeqID_213771
gggcaaaaagttgattttggtagaagctgagtattggtgggagaacactggccaatgcttggaggctaaaggtcaagttgtgacctgggaagtcttcaaaagggtatttctggagaaatactttgctgaggatgttaggaacaagaagaagatggagttcttgcagctcaagcaggggaacatgaatgtggctgaatatgcaaccaagtttaagaagctggtgaggtactatccccattatcaaggaatagatggcaaaagttcaaaatgtgtgaagtttctgaacgacttgctacctgaggtgaagcaagctatgaattaccaagacagggcggcctattataggagtacatgtccaatgaagaacaatatgaatggacctcaacatcagggaaaaccatacttgacctctcctaagcaatatggtaatccccctaacaatcggaggacaattgctatgggctttgctagtggtagtggtcgcaaacccactactttctcaacccatatcacttgttacaagtgtg

SEQ ID NO: 96994 - DNA, 498 bp, Glycine max
  Peptide Sequence Number=SeqID_213772
catcttccggtggagactttttcaagtctcacaagttatccagaactacgtaggtctgagttcctcattggaggatacgtaggagcaagagcctcgcttttgtcggccaccttcacaagttctgtcatgctgacacaggagtcacgtgacatgcggagatacccaagtgaggcggcgagcccgatgacatgcggagacaacttatggtcattccgcacaccttctgccattcagacacagtcgtgtccgatggcacgcagagacaaattatggtcattctgcacccttttgtcatccagaggcggcgggcccgatgacatgcggagacaaattatggtcattccgcacaccttctgccattcagacacagtcgtgttcgatggcacgcagagacaaattatgtcgtgtccgattgcacgcagagacaaattatggtcattctgcacccttttgtcatccagaggcggcgagcccgatgacatgcggagacaacttatg

SEQ ID NO: 96995 - DNA, 252 bp, Glycine max
  Peptide Sequence Number=SeqID_213773
atgcagattcatatagcaccggaggaccaacaaaagaccatattcacctgtccattcagcatatttgcctacactaggatgccttttagcctatgcaacattcctggcaccttccaaaggtgtatgtctgatgagaatcctgaaactggccaaatacaggctaaaggcctaagtggagaaggacgaaggcccaagtggagaaggacaaatccccgagtggagaaggatgaaggcccaagtggagaaggatga

SEQ ID NO: 96996 - DNA, 252 bp, Glycine max
  Peptide Sequence Number=SeqID_213774
atgacgttgtcagacataatcaccgcaatacagtcatcaattagagataatgatgttacgcttttaattactgcactttggtatcattgtcccgtataccaattcaatggtcatgttgagtatatggcaattcaatttattgacgaagaagcccatgggccaaaaatctaccctaaggcttatgagaaccctagggccttcttcagcagctctggcccaatcttcttggagtcttctatccaatgcccttga

SEQ ID NO: 96997 - DNA, 768 bp, Glycine max
  Peptide Sequence Number=SeqID_213775
atggtggaagaatttgaagagatcataggatgtcctctagggggaaggagaccatacctcttctcagggttctatccctcattagctagaatttctaagatagtccaaatctcggcgcaggaattagaccacagaaagcaactcgaaaatggggtggttggaataccgagaaaatgtttggaggcaaaagcaagaatcttggcaggtagaggcgaatgggccccgttcatagacattctcgcactgttgatcttcggaggagtcctctttcccaatgtggatgggttggtgaatctagcagcgatcgacgcttttctcgcctatcatgaccacaaggaaagcccggttgtcgctatgctagctgacctatatgacaccttcgaccgaagatgtgataagagcggtacgaggattgtttgttgtactccggctctttatgtatggttggtttcacacctttttggccaagaggtgaggcatgctagcccgctagaaagccatcgttcatgcacagagaaaggaggggcaaattgggaccgactcttagcaaacaaagaaagagcgtctgtcaattggttccctcgatggaaagaaggaagaaccggggttcttattttgtgccggaggattttcaaatgttcccttgatggggacaaggggttgcatcagttacaatcccgttcttgctataagacaacttggctaccctatgagaggagcaccactagaggaaaagctcgcgccctgtcatttcacgaggtttcataa

SEQ ID NO: 96998 - DNA, 255 bp, Glycine max
  Peptide Sequence Number=SeqID_213776
atggatcaagctggtgaggaaagaaagttgcaactgagtgagttagatgagatccgcctagaagcctacgagaattccaagttctataaagaaaagaccaagaagttccatgatagcatgataattaagaaagacttcatggttgggaaaaaagtgttattgtataattctaggcttgggcttatgagtgttgagatcaaaagcaactccacaaacaagagcttttggttgttgggagggataagtaagccataa

SEQ ID NO: 96999 - DNA, 507 bp, Glycine max
  Peptide Sequence Number=SeqID_213777
atgcaattgggcattctctacttcgatccttatgctaattcgatcatctttctgcttgcatcttacgtgattccctatgttggcctcactggttatgttggtgctaattcactgctgcaaaatgctgcttccaggaagctagttgcagggcttttgggtgtagagtccgggcaagatgcagttattcgagcattattgtatgaacatcgagcatcgctggtgcatccgtacggattgagcgtggaagtgttcacagatcgcatttcaatgcttaggaacaagctaggaaacaaagatttgaaagatgaaggtcttattgtgcctaaagtggaaggtgctgagggcaatattcttgctggtgacataaattcattggcatatcctaggactccagaagaaatcttgagaataatatatggaggaggtgatgaacattttcccggtgacttctactctcgaggagcaagtggtcgcatagccacttcttacttaaattttactacctaa

SEQ ID NO: 97000 - DNA, 312 bp, Glycine max
  Peptide Sequence Number=SeqID_213778
atggcacctcacatctctagagcctctgttgttgttttggtagctttcctagtccttcccttacttttctcagacatggcaagagcaacaattccagaatcagatgttgatcttttagaatttcctttaaatttagaatacttggaggctgaattctttttgtttgggtctttgggtcatggattggatgtagttgctccaaatctgactgagggaggaccccctcctattggtggaaaattggccaaacttgacaactttgtcaaaggatgtcatcttccagtttgctttacaggaagttggacacttagg

SEQ ID NO: 97001 - DNA, 140 bp, Glycine max
  Peptide Sequence Number=SeqID_213779
atggataatccatcaacaagtagggacctctttaattcttcaaatatgtctatgccaccaaagagtttggttattggtttcttctgtgcacctttggtgttgacattctctggaggaggatacatagagtttagatcagg

SEQ ID NO: 97002 - DNA, 342 bp, Glycine max
  Peptide Sequence Number=SeqID_213780
atggagcagttccttgagcaagtagcacggcctggagctctaccttcaatggtgagacccaacgaggctgcttctcctgagcctacacctgcaagggttgaaccagtgccagctgatccacaatctccagcggcgaattcaccttctcctaagcttgaagtagttcccccatctccacctattattatcatctctgattccccatctggagaatctgttgctccccctgattccccagctggagaagctgctgatctctctggttccctatctggagaagttgttgctctctctgattcccctattttccatctgatagatgaggaggaggcccagacatag

SEQ ID NO: 97003 - DNA, 406 bp, Glycine max
  Peptide Sequence Number=SeqID_213781
atgacggaagggtgtggtgaagggttttgccttgccaaaccttcccgtttttccatgtgccccggtggtcggttttggcccgtggctaggtcttggcaagcccgttggttgaaattttgcccccccggtcaacttcgtggtttttaccccgttgttggcttggctagggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccccctcacgagg

SEQ ID NO: 97004 - DNA, 805 bp, Glycine max
  Peptide Sequence Number=SeqID_213782
atggcaattccttctttcctttgtgcaatgacctccttgactcacctcgacctctctaatactggattcatgaggaagattccatctcagattgggaatctctccaatttggtctatcttgacctcggaagttatgcttccgagcctctgttagctgaaaatgtagaatgggtatcaagtatgtggaagcttgaatatcttgatttgagtaatgcaaacctatccaaagcatttgattggctacacactctccaatctcttccttctttgacccacctatatttgttagaatgcacactccctcactataatgaaccatccttgctcaacttctcatctctgcaaactctccatctttccttcactagttattcccctgccatttcttttgtccccaagtggatattcaaattgaagaaacttgtttctcttcaattatcagataattatgaaatccaaggtccgattccttgtggtattcgaaacctcacacttcttcaaaatcttgacttgtctttcaattcattctcatcttctatacctgattgcttatacggtcttcatcgtctcaagttcctgaacctaatggacaacaacttacatgggactatttctgatgccctgggaaatttgacttctcttgttgaacttcatttgttatataatcaacttgaaggaaccattccaacttctttgggaaatttgacttctcttgtcgaacttcatttgtcatctaatcaacttgaaggaaccattccaaattctttgggaaatttgacttctcttgttgaacttgatttatcac

SEQ ID NO: 97005 - DNA, 186 bp, Glycine max
  Peptide Sequence Number=SeqID_213783
atgactcgaacgcaacatgtgcatatcatgggggagccctggggcattccattgagcactgattttcaagtgcgagccattggtcagtttgctcaagcgacctgtgctcctgagtttggacttccaagaccgttcagtaagagattactcgtcttgcacgttggtggggttgccgtaaaacaatga

SEQ ID NO: 97006 - DNA, 264 bp, Glycine max
  misc_feature (76)..(76): n is a, c, g, or t
  Peptide Sequence Number=SeqID_213784
atgccggaaatcaaaaggaagtgttgttacgcaatccgcccacttgggccttccagattattcctccagaaggcgnttgcttctggaggaagcaacctggctcacctaggcgagctgggtggtaaactcctcccctattctcctataaatagagggaggattgaagaaggaaagggttcagccctcttggcacttcgtaatcacttaaaattagtgaggaaaattgtttccgtgaagaaaatccaagccgaggcgcttccgtaa

SEQ ID NO: 97007 - DNA, 288 bp, Glycine max
  Peptide Sequence Number=SeqID_213785
atgttggatcaatttgagccatttatacagggtttcattgacaacattatggatatgaaagtagacggtaactatggatatcgctccattatcgctttattaggtatgggcaaagattcatggtcgttggtgcgcaaccaattgattaaagaacttggcaaatggtcagatgactatatcaacctctttagtggcacagagagatttgaagaattaaaggttagtgtggataagtggatggatataacggatatgagatatgaaattgcatcaaggtatataatgtaa

SEQ ID NO: 97008 - DNA, 319 bp, Glycine max
  Peptide Sequence Number=SeqID_213786
gattgagaaattcaatggaaagaatagtttcaatctgtggcgcatcaagatgcgtgctttgttgaaggaacaatgtgtttgggctccagttacttctgcatctgtgaagaaagaagtgacttctgaatcaaaagaaaaggcctctgtttcaaagacagaagaacttgcagaacaagaagaaaaggctcactcactaatcttgctttctttgcctgatgaagttttatatgaagttgcaaatgaagaaactgcaagtggcttatggctcaagttggaaaagttgtatatgactaagtcaatctgcaacaagctcttctag

SEQ ID NO: 97009 - DNA, 360 bp, Glycine max
  Peptide Sequence Number=SeqID_213787
atgttcatgacccctaggctatgcatttcggctattttgggtaaaaaaacacgtttccgcgaagaaaaatcgagtggaagtgcttccataatgcttctaagacgtttctgtgagcaaatttgtgaaaattttcctccgttcttcaccgttcttcatccgttattcgttcgttcttcaactggtctgatttcctcatcgcaattgaggatgcgtaggagcaaaagccccacttttgtcgaccaccccaagagatcgttaatggtccaatgccttaacgtttctctcctttcaaaaaccaagagatcgttaatggtccaacgccttaatgtttctctcctttcaaaaccaagagatcgttaa

SEQ ID NO: 97010 - DNA, 1326 bp, Glycine max
  Peptide Sequence Number=SeqID_213788
atgaacgcatacaccactgaaacggcacaggctgccgtgcctgccgcagaaagtgccgccgcaccgcccaataccggcaagttggcggcggccagctcgatcggcacggcgttggaatggtacgatttcaccgtctacaacatcatggccgcgttgattttcaaccatgtattcttcccatcgttcgatccgctggtgggcacgattctggcgttctccacttacgcggtgggttatgtttcccggccgatcggtggcatcgtgttcggccaccttggcgatgtgttggggcggcgctttgtactggtcaccacgctggtgatcatgggcgtgaccacggcgctgatgggattgttgcccggctatgccagctgggggatttggagcccgttgctgctggtgacgctgcgctttattcagggcattgcgctgggcggagaatgggcgggggcggtgctgttgtcgatggaacacggtaagccgcatcagcgcgggcgcaacgcgtcctttgctcaggtagggccgtcctgcggttcgctgatcggcaccggcctgattacgctggtgacgttggcgatgtcggcggacgatttccagcaatggggctggcggatcccgttcctgctgagcctggtgctggtcatcttcggtttgtggctgcgtcggggggtgggtgagacgccggcatttttgcaactggaggcgtcgaaagatgttacgcagtcgccgatccgcgaagtcttcacgcagcacatgcgcccactgctgatcgccggcggatcgcgtatcggctctgacgtgctctatgcgttggtggtcgtgttcacattgacctacgtcaccaccgtgctgaatctgccgcgcccgctggcgctgggcgccaccatgctgggggcgataggtaacgccgtcgcggtaccgctgtttggcgcattgtcggatcgcttcggccgtcgtccggtgtatatcggcggtgcattggcggcgatagcgtgggcgtttgcgttcttcgtcctgctcgacagcagtcaaccggtgttgatctgcatggcagtggtgatcgggctgttgatccatgcggcgatgtatgggccacaggcggcattcatcacggaacagttcccgacacgggtgcgttatgccggatcgtcgttagcctataccttggcggggattatcggtggcggctttgccccgctgatcatcacttcgttgtttaaatcttacgacagcacgctggcgatttccgcctatgtcgcgttggctctgcttatcacgctttgggcggtatgggcggcgcgggaaacggcgcataagccgctgtaa

SEQ ID NO: 97011 - DNA, 1173 bp, Glycine max
  Peptide Sequence Number=SeqID_213789
atggatcaacagcccgatcaccactgccatgcagatcaacaccggttgactgctgtcgagcaggacgaagaacgcaaacgcccacgctatcgccgccaatgcaccgccgatatacaccggacgacggccgaagcgatccgacaatgcgccaaacagcggtaccgcgacggcgttacctatcgcccccagcatggtggcgcccagcgccagcgggcgcggcagattcagcacggtggtgacgtaggtcaatgtgaacacgaccaccaacgcatagagcacgtcagagccgatacgcgatccgccggcgatcagcagtgggcgcatgtgctgcgtgaagacttcgcggatcggcgactgcgtaacatctttcgacgcctccagttgcaaaaatgccggcgtctcacccaccccccgacgcagccacaaaccgaagatgaccagcaccaggctcagcaggaacgggatccgccagccccattgctggaaatcgtccgccgacatcgccaacgtcaccagcgtaatcaggccggtgccgatcagcgaaccgcaggacggccctacctgagcaaaggacgcgttgcgcccgcgctgatgcggcttaccgtgttccatcgacaacagcaccgcccccgcccattctccgcccagcgcaatgccctgaataaagcgcagcgtcaccagcagcaacgggctccaaatcccccagctggcatagccgggcaacaatcccatcagcgccgtggtcacgcccatgatcaccagcgtggtgaccagtacaaagcgccgccccaacacatcgccaaggtggccgaacacgatgccaccgatcggccgggaaacataacccaccgcacggtgaaatcgtaccattccaacgccgtgccgatcgagctggccgccgccaacttgccggtattgggcggtgcggcggcactttctgcggcaggcacggcagcctgtgccgtttcagtggtgtatgcgttcatgatgtcagctcctgtgcggtcagttgccagccaagggcatagtgccaggcatcggcggcgggcatgttcagcgcttcagcggcctgctcgcttaaacgcaggccggcttcggcgtcgctgctttcgatcaatagcatcggcagcattcggcggttttctcgcgattctttcggcagcggggaactga

SEQ ID NO: 97012 - DNA, 210 bp, Glycine max
  Peptide Sequence Number=SeqID_213790
atgacgttctacaggcagcatgtttcttttctcctccaggacgatgactacgatatcgatttgccgcgccgcgttttgcgcgcagacgcaaagcgcatcgccccgcgatcggtcaacgatggcggaaatgaaatgaataattacgaaagtgtggagttacaggcagttatgatgcgtgagcgtcttagacagacaggagagaaacggtaa

SEQ ID NO: 97013 - DNA, 642 bp, Glycine max
  Peptide Sequence Number=SeqID_213791
atggaagaagccggcgtctcactgaacgagctggcctaccggcgcttcaaacaggcgctggtcacactcagctacaagccgggcgaatatctcaataccgcgcaggtgatgaacgatctggatatgggcagaacgccgatcaatcaggcaatccaccgcttggccaacgaggggttactgcaggtcatcccgcgcaaaggcgtgatggtttcaccgttgtcgatggacgatgcgttggaattgatcgaagtaaggctggctaacgagatgctgtgcatgcagctggcgagccagaggattaccgagaggcaaatcgcgacgctgaccgaactcaatcggcaaatcgaagccgcgagccaggagcgagatagagtgcgaatgatgacactcgatcatgagtttcaccaggagctggcgcagatcgccggcaataacatgctggcggatatcctgagtgtgctgcacgccagggcgcagcgtttttgggccagcaccctgtcgcgggaagggcatatgcgcgaagtgatcgacgaacaccgggcaattatcgccgcgctggccgcacaagacagcgccgccgccgccgaggccgcgcaggcgcatatcctgtcattccgcagcgcgctgctgcacgacgggtaa

SEQ ID NO: 97014 - DNA, 318 bp, Glycine max
  Peptide Sequence Number=SeqID_213792
atgaagcgcaaaaattcagccaaaaatctggcgcatagcgtactccctccgttgacggaggagcagaaagcgcaaattgcttcactgagcgcgctgccggatgaggatatcgattataccgatgtcccggccctgggtgaggagaagtggcaggctgcggttcaggggcgtttttataaaccgatgaaagtatcgaaaaccatccgaatcgatgcggatgtgttggcctggcttcagcggccaggcaagggttatcagaaacgcctgaacgctgtgctgcgtgaggcgatgttgaaagagcatgagcacgaggaataa

SEQ ID NO: 97015 - DNA, 1626 bp, Glycine max
  Peptide Sequence Number=SeqID_213793
atgagactaaccttcactttacctgaatcccgcggcgcggcgacgttgaatgttgagattgatcatctggtgatcgccggttggaccgggcgcgatcgcgaagcgatcttgcaccatattcgtgaattggccgaactgggcgtgccccagcccagtgcaatccccctgttttaccgcgttgccgccaatcagttgagccagcaagagaccattgaagtcattggcaacgcgacgtccggcgaagcggaaccgctgatttttgcccatcgcggcgaactgttcgtgtcattggcgtccgatcacaccgatcgtcaactcgaagcgcacagcgtggcgctgtcgaaacagatttgcgttaaaccggtggcgcgagccgcctggccgctgcaggaggtgctggaacattgggacagtttgatcttgcgttcgtggatcaaggaagagggcgaatggcgattgtatcaacagggcagccttgccgcactgcgtacgcccggtgatttgctggagcgttacttcaccgcgcagctgaccgccgccgctttggcgcagatcgccgatgagcggggggagggcgcgcgcgcgtttacgcgaacctacgccgagtgggcgcaacggcaagcgcaggcctccgatcggcggcgcgccgccggctcgccgctgtcggcgctggatggcgtgcctgtctcaatcaaggatctgtttgacgtggccggtgaggtgaccacggcgggctcgcgcgtgttagccgacgcgccgcccgcagaaaagcacgctgcggtagtggaacggctgttgcaagccggcgcggtggtggtgggcaaaacgacgatgacggaattcgcctattccgggctgggcatcaacccgcattacgggacgccggccaacccctgggagcgccaggcggcacgcattcccggcggctcctcttccggtgcggcggtggcggtggccgacggcatgtgcctcgcggcggtcggcacggacaccggcggctcggtgcggataccggcggcgctgtgtgggctgaccggcttcaaacccagcgccagccgcatcaatcaggccggcacgctaccgttatcggcggcactcgacagtattggcgtaattgcccatgacgtgcgcagctgctggctgctcgacagcgtcatcgccgatcggcctttgcagctgacagagcgtgatatcacgagggcgcactttgcgattccacagacccgggtgctggacgggctggatctcgcggtcagccaggcgtggcaccacgcgctggcacagctgcgcgcgcaaggtgccacgctcaccgagctgccgctgtctgaactggcggaactggaaaccatgaacgcccgtggcggcatcaccgcctgggaagcctggcagtggcatcagtcgctgctgcagtcgcacgcggcgggttatgacccgcaggtgcggatgcgcattgagcgcggcgcgttactgaatgaggccgacgcacaactgttgtatcagcagcgcgccgactggcggcagcgggtggagcaggcggtggcaccgttcgatggtctgctgctgcccaccgtgccgctgattgcgccgaccatcgccgaactcgacgacccggagcgctatcgccag

SEQ ID NO: 97016 - DNA, 2244 bp, Glycine max
  Peptide Sequence Number=SeqID_213794
atggaaaaccaccaaaaccacaaggtagaaccagaacctgacatagagaagaaccataaccaccgccaccaacagcaacaacaccgtaacgaagcgtggggcacctgggaggagctgttgctagcgtgcgccgtgaaccgccatggcttcacggactgggacgccgtcgccatggaggtccagtcgcgcaccacgcgcctcctcgccaccgcgcgccactgcgagcagaaatttcatgatctcagccgccgattcgccgtccaatgcaacgacgacgttcctccgccgcgccagaacggcgccgccgccgctatctctgatcacgtcccctggctcgacgaattgcgcaaactccgcgttgccgagctccgccgcgacgtccaacgcagtgacgtttccattctgtcgttgcagttggaggtgaagaggttggaggaggagaaagcgcaggaaaaagacttaaaggacgacgagaaaccagatctggcggtttccggcgagttgcggccggaaaacgacaaaaccggcggagaagtggaagaggctggaccggcgaattccgaaccggaggaaagaaccgcgaacaacacagacaagacgttgccaaccacgggcgacgaatcagaccgggagaaccagtcggttaacgagtccaactcgaccggttcgcggttcgagaaaaccggagatggcgacgcgaagaccggaaccggaccggatccggttcataccggttcgcaggaaccggatccggtcgagcggaagggaaagccggttggagaggaatcgaataacggaagctacgatgcgttggcgaaggtgccaacgtgcgagtcggtgcctccgagtgaggggaggaaagtggaggaagacgatgactcatccgagttacatgactcggtggctcactcgggcgaaggagggacgcgcgagagcagcgaggtgcagagctccgcgagcttaatgcgtaagaggaagacgcggcggaggaaggaggtttccggagccactgacgcctcgtgtccggcggagaacgacgaggcggcgacggtgaaatcagaaccgttggttggggttttggagttgatcaaggggcacgaacacagctcattgttcgagcgccgtcttgatagccaggatacggatagatacaaagacctagtgaaacagcccatggacttggaaaccatacaattgagactccaaaagggtcactattcctcatgcaccagtgcattcttccgcgacctcctcctcctcttcaccaacgccaccgtgttcttctcccatgactccctggaatcgcaggcggggcggcagctgcaccgccttgccaccgcggagatgaagaaccacggccaagcacaatcggatcctatcccccggaagaacgattcactccctccaaatgcaccattagctaaaccagattctctcctttccaagaacaaagcctctggtcctatattggtttgccgcaaacgcagttcaatgtcatccaaaccttcctctgccacctttggccaaaagggtgaccaacccgtcttcaatgacaagaaggaaaggccatcttctgatgcaaagccacccatgaagccctcttcttctgatacagacgaagaggagcttcccaaagctaaggaaaagcctgttactggagcaagaagcttgaggcggagcaacaagaacctcaatagtaatagtagtaataataataataagaaaccgtcctctatctccactcctaaggcagggtcctcggggaacaagccttcggagactgttaaaccggaaaagagcaaagcagaggggggggcagacaagaagaggagtgcagctgcagatttcctgaaacggattaagcgcaacacttcagcggaagcatcgaagggtggtagtggcggtggaagcgggggtggaggaggaggaggaggaggaagtagcagcagcagcaaaggtggtggaggtggtaatggtgccaaagagcagaagaaaatggtgaacaatggaaagggagacaaagggaaagaaagggcatcaaggcataataacgttggaggaggttcaggctctgcggataaaaggaataataagaatattgagaacagctctcagtcaaagaggagtgttggtagacctccaaagaaagcagcagagacaaatgcaggtagtgcaaagcgtgggagagaaaatagtgctagtgctggaaaggataagcgccccaagaaacgttccaagaaatga

SEQ ID NO: 97017 - DNA, 399 bp, Glycine max
  Peptide Sequence Number=SeqID_213795
atgcagagaagcttctctgcccgatgcgaactccaagagcgaagggaaccctgtcctccgccacaggtcgctgccgtcgatgaagcacccaccgtgcagaccgtcgacgcttctcttttgccgaggttattaagaaactacaaatccatcagcaaacaatggatatgggaaaacacagatacgcagccatcaactttagtccactcggaatggtcgaatgaatgcccccatgcctacaagtccagatcgtggaaaactgcaacaacagcaaactatttctgggtcgaatcctcccactggaacgtgaccatggtgccttcgtttctgcaaaaacactcctctttgaaggctcacctgaaccgagagaggaagaagcagttggactcttacatggcttaa

SEQ ID NO: 97018 - DNA, 150 bp, Glycine max
  Peptide Sequence Number=SeqID_213796
gtggagagggtattcaatgcaaatcatcctgatgcgcttgaaattgagcaagtcaagaaaatattgaaggatcatgagcaagctcttattgatgcaattgcaaggcttgcagatctttcggatgacgaaagtggtatttctcagttttga

SEQ ID NO: 97019 - DNA, 1017 bp, Glycine max
  Peptide Sequence Number=SeqID_213797
atggctgagcctcttgggtttctttctgagttagcaatggggcacttaagtcgtgcctcacctttacgagcagtaggaactgatgatgatcttccaccaacacatccaaatagaatccccagaggggaacgtcttgcaggaaatggaagattgccagcaggttcaattccatacccaaggatgcatggtgaaattgatatggaaactcaaattcaccaacttgagaaggaagcatacagttcaattctacgggcatttaaagctcaagctgatgccatttcttgggagaaggaaagtttgattacagaacttagaaaagaactaagattatcaaatgaggaacacagagaacttctaggtcatgttaatgcagatgatgtcatacaaaatataagcaccttgttgaacattgactttagggagtggagacaggcaggaggcaatcagcctgttgtgctgagtgttgggcaagctattcatgattcaattccaagtcccactatctctgcatctcgtaagaagctgaagataactccatctgcaccatcacaatcttttggtgggccttctgcattttgtccccaacccgtggctgcaccccttcagccatcttcagtggcaaaacgaggatccatttctggatctaagggcaagaagcacaaacctggccaagtattacctggtgtatcttcaataaagcaatacccttcatcaggactaggtggaaggaatcaagtacctaatagagttacttctggtactgtcatgggtgaggttgccaagggagcatcgttggattcattagttggtagaagagtgagaacaagatggcctgatgacaacaacttttatgaagccattatctccgactacaatcgaactaaaggtctacatgctttgctctatgacttggggactgcaaatgaatcatgggaatgggttaatctgtcagaggaatttaagggggttcagaaagaatccgatcatagattgagactaaaacctgtgcaggggtag

SEQ ID NO: 97020 - DNA, 225 bp, Glycine max
  Peptide Sequence Number=SeqID_213798
gtacgagcagttatgcaagtgggatcagcaactttcattatcagagtaatcaagcacagcggtatctgtagtggcgacagcaaaattctgcaagttgcaagtcgtttccaggatgtcaagacatctcacgtgacatcagctttctgctccccctgtctccatgctcctactgctgtgaagcagttcactttagtagcttacaacaatcatcatcagcagcagtag

SEQ ID NO: 97021 - DNA, 297 bp, Glycine max
  Peptide Sequence Number=SeqID_213799
atggggtgtacccatgggcccgaaatctaccctaaggctcataagaatcctagggccttctcttgcatctctggcccaatctacttggagtttttctatccaatgcccttgcggggtaggattgcatcaggtttccctttggagaaattgttgaaggtgaaggaaacagtgccagttgagttttccttggtgagtagcaccagaaagaaggctagggagagggagagaacaatagagatgttggaggtgaccatgactttaactgatttggttcaacaactcaaatgttatgcataa

SEQ ID NO: 97022 - DNA, 465 bp, Glycine max
  Peptide Sequence Number=SeqID_213800
atgactttgatcccaataatttgtgagaatgctcaagttatggtccttgcagcaactaatcgtccttcagaacttgatgaaccaatacttcgacgtcttcctcaagcctttgaaattggagtttcagaccaaagggagaagactgaaatattgaaagttgtcttaaagggtgagagggttgaagacaacatagactttggtcatatagctagcttgtgtgagggttacactagttcagatctatttgatctttgcaagaaagctgcctattttcctattagagcactactggatgaagaaaagaaaggaaaacgatcttctgttagtatatttaagtcattctcttatattttcttctgtctcaattttttcattttcccaataactatgttacctactgctaagttgactagaattccatatcaatttcagtttctgttaactagaaaggaacaaatcaattga

SEQ ID NO: 97023 - DNA, 297 bp, Glycine max
  Peptide Sequence Number=SeqID_213801
atggctggccgagatgacggtgccaggtttgtgtcaaacaggactaatgaagaggttgatgatggcgatcccttctcaaagcgaagaaaaatgaaacttgatgttgacatcactctagtagttaagcctatctgggaaccacgggttgttgtactaactttgagtgaggttgacatattggatgatgggtactgctggcgtaagtatggccaaaaggttatgagaagcaatcctaacccaagggaaatggttactttgttcggtttggtacctgttcaggcaagattgtggttgtag

SEQ ID NO: 97024 - DNA, 237 bp, Glycine max
  Peptide Sequence Number=SeqID_213802
atgatgatttttgtcaaaaccatcatagataggtcgtctttaaagacgggtttggataatcgtcattgtattcaatctctgtgcgccgcatcatggtggtggtttcatcgccgccatggtccattcatcaccatggtgttgttagaaaacatcgtgccaccgtccaagtcgatcagtgaaccgtacccctccaccattgtgctttcatcattagaaggtatgaatctccctcagtag

SEQ ID NO: 97025 - DNA, 462 bp, Glycine max
  Peptide Sequence Number=SeqID_213803
atggatgctttcattaggcagtatcagtataactctgatatggcttcagatagaatgcaactacagaatatgtgcaagaaagacaatgaatctttcaaagaatatgctcaatggtggagagatctggcagctcaaatagcgcccccgatgatggagaaagagatgataataatgatagtagacacattgccagtgttttactatgagaagatggtaggttacatgtcttcaagttttgcaaatttagtgtttgctggcaaaaggatcgaagtgtgtctaagaagagggaaatttgattatgctgctactacgagttctagtaatagaagacctagaatgagtggacgaaataagaaggagggagaaacccatgttgtgactgttgttcctacatggccaaatttcccactagcccttttaaatcccttgtaccaatatcctccccaacaatatcaatactaa

SEQ ID NO: 97026 - DNA, 201 bp, Glycine max
  Peptide Sequence Number=SeqID_213804
atgaaactcaccgctactatagtagggttcgtagtccatagccagtttgcaccgaaattgaagcacccagattcaggagaaaaagaaaacgcaagaaccaagattgcaacgaaatggacagcgaacgaggaacgaagagttgaagcggaagaggaatcgaaggagctcccgcccatacggccatactcaaaggcagaataa

SEQ ID NO: 97027 - DNA, 356 bp, Glycine max
  Peptide Sequence Number=SeqID_213805
gtatgccgcctactaggtacactctagacccaaataagtctaacagggccctgggttttccagcattgatcacgggtctctgccagtcgtttggggccccagacgcaccgtcgccacctcatcaggctgatccaactgggtcatttgacacggagcggtatttacgacatttggttcgccagcaggcggccaaccacagggcgcacgtgcagacctatgactgtctctaccagcttagcctcagcctgcagagccaaggtttcactcattttccatgccctactccggatcagttcagggcagaggtcgcatggcccggagattggcctgaggtccaggcaggggaggcgtcgtag

SEQ ID NO: 97028 - DNA, 774 bp, Glycine max
  Peptide Sequence Number=SeqID_213806
atggggaatcaagttaaaagattttttgaacttcctttacaagagaagaagagatgggcacagagaccaggaactcttgaaggctatggccaagcatttgtgacctccgaggaccaaaagctggattggaatgacatgatcttcctgaaatgcctcccaattcagaaccgaaaattggatttgtggccacaaaaccctcctgagtttagggaaacattagagagatattctgaagaaataagggaagtgacaatgtcagttgtgaagttccttactatgtctttggggattcaggataaagagatatcggaaagtttcagagaaggactgtatgatataaggatgaattgctacccaccctgtccagagcctgaaagagttcttggaattgcgccccatgctgacaattctgggatcactcttctgcttgactgtgctgattttccagggttgcagttcctcaaagataaaaaatgggtcaatgttgaacctatagaaggggcaattgttgtaaacattggccaaattattgaggtgatgagcaatgggatatacaaagcgccagagcatagagctgtagtaaataagttaaaggagaggttttcaatagtgacattctgctatccaagccctcatatggacattggacctgctgacaagcttacaggtgaaggaaaagtagctgtattcaagaaattgacacatgcagagtatttcaggaagtttttcaacagagaccttgatgaatcgtttattgatagtctgagagtatga

SEQ ID NO: 97029 - DNA, 2061 bp, Glycine max
  Peptide Sequence Number=SeqID_213807
atgtggagatttaagccattcagtcacaaagagcagactggtcttgaaggccgcactatagatgttggcaatcttaaaatacatgtcattaaggccattgccgaaggagggttctcttgtgtctacctagctcgagatgctgtacatatgtcaaagcaatatgctttgaagcacatgatatgcaatgacgaagaatcacttggattggtaaagaaggagatatctgtgatgaaggtgctggcaggacatcccaatgttgtcacacttcatgcacatgccatcttcgatatgggtaggacaaaagaagcattccttgtgatggagttttgtgagaggtctctggttaatgtgctagagagccgaggagctggttattttgatgagaaacaggtgcttttgatattcagggatgtgtgtaatgcagttcttgccatgcactgccagtccccacctattgcacaccgagacttgaaagcagagaatcttttattaggttcagatggcttatggaagttatgtgattttggaagcacttccaccaatcacaaacgttttgaaaagccagaagaaatggggattgaggaagacaatatcaggaagtacacaacccctgcctacagggcccccgaggttgtggtgaaagcaccacagcctcttccaagttatgggagtgcctgggttcaattcttggattgggcatgtggtgtacagatgtgggatctgttcttgagagaagttattaatgagaaggtggacatatgggctcttgggtgtctcctttttcgcatatgctacttcaaaagtgcttttgatggggagtcaaagctccaagtcttaaatggaaactaccgcattcctgaattaccaaaatacaattcacctgtgacggacttgataagagacatgctccaagctagaccagataacagaccagatatcacgcaggcaagcgctttgcttgattggccattcatctccatcagtttaggtgtgtcaatgccctcaaacagatcacctccaatgcctcgtaggaacccacctcctccaccttcatctggagaacccaaaacttcaccacagccatcccctgcttctaggggagggggaagtgggggtgcacttggtgctttctggtccactcagcatgcgaaggaatcacttgttgctgaggataagagcaaacccatttttgatgaagaaccatctagccaccatttttcactgaaacatgatagaattcgtcctgaaaacgatcaattacccaaaaatgatggtcctaacaaagtggttaacacgcaaactcatactgtgaaaagcagtacacatggaaaattacccaagcctgatacggcaccctccaaggattttgaattaaatttgtttgaggataaagatcgtgtaggtgagagtacaactaactttcaaaaccaggcttttaacacttttgttgctgaattcgatgccactaagctcaaccctggacttaataacaaacccgaaagggaacaagcattagaggctgaggtggagatactcaaagagaagctgaaggaagctaatttggaaaaagctgaaataacatcaaagtacgaaaagctttctgctatctgccgatcacaaaggcaagaattgcaggatctcaagcaagcactcgcagctaggactccttcaccaagtagagagggtttgaaaatctctcccgcagttacatcgtctgcatctgcatctgcatcttcggttgtgtttctgacacaaggttgtgtttcattgcaactgcaggataagtcatggcaagcttttccagaggaaccgcaacaacaaaggtctctttcagccgagaatacctccaaatctgtcagggtgaaaaatggtcagcagaacaagcaacctgttcctctagctactgattttgattcatggggttttggaacagatagcttcagtgctgtacctgcaggcagcccacagatgcaaagacctagcagtgcaggaacaaagtctcaggcttttggtgaggcaaacaagtcaacttctcaaccagctggatgggctggtttttaa

SEQ ID NO: 97030 - DNA, 1008 bp, Glycine max
  Peptide Sequence Number=SeqID_213808
atgggaattgcggacactgggagtgacctaatttggtctcagtgcaagccttgccagcagtgttacaaccaaaccactccattgtttgacccttccaaatccgcaacttatgaacctgtctcttgctattccagcatgtgtaattcactagggcaaagttattgctactcagatactgaaccgaattgcgagtataccgtctcatatggggatggatcacattcacaaggaaatcttgcattagacacaatcacgttgggctctactacaggttcctcggtctcatttcccaagattcccattggctgcggtctcaacaatgctggtacctttgattctaaatgttctggcatagtagggctaggaggtggtgctgtctcacttatctcccagataggtccttcaattgattctaaattttcatattgtttggtaccattgtttgaattcaatagcacaagtaaaattaattttggagaaaatgctgtggtggaaggccctgggacagtttcaactccaattattcctggttcttttgatactttctattaccttaaattggagggaatgagtgtggggtccaaaaggattgagtttgtagatgattcaacctcaaatgaagttaagggtaacattataatcgactcaggaacaacgttgaccattttgctagaaaaattttacactaaattggaggcagaagtggaagcacatatcaatttggaacgtgttaatagcactgaccaaattctaagcctttgttacaagtctccaccaaataatgcaattgaggttccaattattacagcacattttgctggcgcggacattgtgttaaattctttaaacacttttgttagtgtttctgatgatgcaatgtgctttgctttcgccccagtggcatcaggttccatctttggaaacttagcacagatgaaccacttggttggatatgatttgctgaggaagactgtgtcctttaagcccactgattgcaccaagatctaa

SEQ ID NO: 97031 - DNA, 348 bp, Glycine max
  Peptide Sequence Number=SeqID_213809
atgatgttatatgatcccaacaaccagtggctgaaccatgagcttaccctcttcacagaaacgcacgcaagccatcaggccaacgtgatccagtcagtgtgggttgattataggagaggttttggtgagaattatgacacagcctctcttaaacgaagcagctttccaaaggatttcatatttggtacatcatcctctgcatatcagtatgaaggtgcaacgaataaaggtggcagaggtccaagtatttgggacactttcactcagaaatacccaagtaagggcatctatcccttcccctttggaaatttatgtggaatggcttgttcttttgaattaggtggttaa

SEQ ID NO: 97032 - DNA, 372 bp, Glycine max
  Peptide Sequence Number=SeqID_213810
atgactttctatataggtttaaagcctttcgtaacactactccattacgatcatccccaaagcatagaagatgcatatggtggctttttgagcccaaaagtagtgaaggatttcacggactatgcagaggtgtgcttcaaagcatttggtgacagagtgaaatactggatcacaataaatgggccatcgattttctctcaacagggttatacaaatgggatatatgctccaggaagatgttccaactggttgcaattgaactgtacaggtggtgattctgctactgagccctaccttgtttcccaccatcagcttcttgctcacgctgctgctgtcaaagtttataggcaaaagtaccaggtcactaattaa

SEQ ID NO: 97033 - DNA, 396 bp, Glycine max
  Peptide Sequence Number=SeqID_213811
atggaaccactaaattctggttcgtacccacttgagatggttcactatttgggggaaagactgccaaagttttctaaagagcaatcagatatggtgaaaaattcttttgattttattggcatcaactattactctacaacctatgcagccgatgctgaatgcccaagaaaaaataaatcctacctcacagatttatgtgctgagcttacttatgagcgtgatgggattccaatcggcccaagggctgcctcggaatggatatacatctatccacaaggaatcgaagaagtattgctctacttcaagccactactaaaaaataacttttttacgacacacattctaaggcggttccttaggaccgtcttagaatgtgctttgatggcatttttgtaa

SEQ ID NO: 97034 - DNA, 360 bp, Glycine max
  Peptide Sequence Number=SeqID_213812
atgggtacattctgtttaaccaaggtggattttcataattatgctgacttttgcttcaagacatttggggatcgagtcaaacatagggtgactttgaatgagccaggatcatttgcccttgctggctacaatgctgctactttgcaccaggtagattctaaatatgccggaaattgcactgttggtgactcagccactgaaccctacattatctcccataatttaatacttgcacatggaacggctgctacattgtacaagaagaaataccagagtagctcccgtgcatttgcaatgcacggtgcacaaagcataaaagcaacttacatcaataaaaaagcaaatgcaaagcgaaattga

SEQ ID NO: 97035 - DNA, 339 bp, Glycine max
  Peptide Sequence Number=SeqID_213813
atgtcatgtcctaagccagaatgtatcctaaaaatagttggacaaatatctaatgagcagaagatgatggaaatttgcttaaggtggtttggccaagatcttaattcaccaaatgaggaaaagaatacacctcttcattgggcatgtctcaatgggcatgtggaggctgtgaagaaattaatcatggctggagctaatgttagtgtcttaaacagtcacgagaggactccaatggatgaagcagtgagtgggggaaagccagaagtgatggatgcgattaatgaagcagtggcactagttgaacttcgtggtgctatggtttttgcacaggaaacttga

SEQ ID NO: 97036 - DNA, 309 bp, Glycine max
  Peptide Sequence Number=SeqID_213814
atggcttccgccagacaaccctttcattccttcgctcctgaaagagttccactctactcccctagaggggcatatgggtaccgccaaaacccttcgctgccttcaagcgaatttcttctaggagggcatgtgccacaacgtctactgctatgtttctcagtgtcgtacttgccaacaaatgaagctcagactgccatgaagcattatatggactgccaccatcacaacgtgacattccaggtaggggatttggcttatgttcgcctatgcccatacagacagttatctattaggcctcattatttctaa

SEQ ID NO: 97037 - DNA, 381 bp, Glycine max
  Peptide Sequence Number=SeqID_213815
atgggaactactagcttagatcctttccaaattggagagttcatgttgcgccagtgtgcaaattacagttgtgatacttatggcttgattgtgaagaattttaaccatttcagtgaggatatttgtaacaagctaacggggaattctataccaaaatgggtcaatcgtcttgcaagaatagaggatatacatgagtttgggtttagcatcaaaccccaacaagggagagctcaaccactcatgggtgagaggagcaacaaaaatggtggagaagggatgaaggtgaaaaatggaggaatgggaaagttccaagcattcctacttgtgccaaaacctaggtccgagaagaatgccttgttctcttgcaaaagtcccttttaa

SEQ ID NO: 97038 - DNA, 240 bp, Glycine max
  Peptide Sequence Number=SeqID_213816
atgaagtatagatcaaagtacaagaatgagtatgagctggtgactctggtcaatattgatgcgcaactgggcaagacacccaaaaatgttatcatctggagacatcttagaccagtatccacagattatctatacttgacattttgcattattcagggaccataccttaccatctcttcactcaccgcactgtatgaaccttggttaatcttaataacatactttactactacccattag

SEQ ID NO: 97039 - DNA, 264 bp, Glycine max
  Peptide Sequence Number=SeqID_213817
atgggctcagaaatctaccatgaggttcatcagaaccctagggccttcttcaacaactctagcccaatcctcttggagcctcttgctcatggctctggtgactggttccttcctagggaggattgcatcaccctaagtttgagcttgaagtgtatgatcctccccgagcaaggaagtatgttcgaaggatttaggctaagctactcaaaatgcgggaagcacttgctcttcaagataggcactatgccgagaaacaagttatga

SEQ ID NO: 97040 - DNA, 177 bp, Glycine max
  Peptide Sequence Number=SeqID_213818
atggataatgggaccactgaggaggtgaagaagattgttactactttaaatgaagctaaaatccctggagatgatgttgtagttaaaatatcaaattgggacaatgtcaatttgtcctatgagccagtttggaccattggaacaggaaaggttgcaactcctgctcaggctcaagag

SEQ ID NO: 97041 - DNA, 473 bp, Glycine max
  Peptide Sequence Number=SeqID_213819
atggcaaaaccatcgaaaaagcgcaaaggaacttcgagtcggagtcagcggcattctgggtcacaggaagctccaattcctccctccattccctctgggttattattctcatcagaggaacagcgtatacggtacacaaatcttttttcctctcgttccattgtagacccaaaattcatagatatggagttcttctcaaatgagaattttgaatgcttccaagcatttgaaaactccaatcttattccattcatgtctctgaaattacctatctattctgagttagtcaaagctttttattcaaatttagaaattcatgaagatgttctaatgtctgaaatctatgggattaagatggtcattgaccaatccctattttatgatttaacaaaattgcctagtgaaggcatgccttttgagggtgcactgattgatgaatggaaattcgatttctctgtgcatgatgcctgccg

SEQ ID NO: 97042 - DNA, 249 bp, Glycine max
  Peptide Sequence Number=SeqID_213820
atggcatatgttagctttgggacagtggtgactccacctccacatgagattgtggcagtggcagaagcattggaagcaagtggttttccctttctttggtctctcaaggagcatctaaaggatcttttgccaagagggtttcttgagaggacaagtgagagtgggaaggctatggcttgggccccacagactgaggttttgggacatggttctgtgggggtatttgtgactgactatgggtgtaactag

SEQ ID NO: 97043 - DNA, 220 bp, Glycine max
  Peptide Sequence Number=SeqID_213821
atggcaaatcataaatcagcattaaagagaattagacaaaacgaagttagaaaagttcgtaacagatactaccacaaaactgctagaacagcaatgaaggttttgagaaatgaagaagacaaagctgctgctgcagagcaattgccaaaggttatctctttgttggataaattagctaagaaaaatattatccacaaaaacaaggctgctaacttgaaaa

SEQ ID NO: 97044 - DNA, 654 bp, Glycine max
  Peptide Sequence Number=SeqID_213822
atgccttccgtacttattgagaccggatttatcaatcatgcagaaaaaagtcactatttagcctcggacagaggacaggaagagattgcagaaagtatctatcaggcgattatcgattataaaaaagcaattgacagaaagtcaggaggtccttctatgatcgcaaccaaaaagcctgagccagaaaaacctgtagaagttgcattaaaaaatgatttcaggattctgctaatgagctcccctactaaatataatgatggagatcctgctctgaaaggattgaattacattcttcctatcaaagaaaacggactgtacaaatattattatggagtaacgaatatggcttccgtaaaagatattaaccttagaacagccaaagatgccggattcaaaaatgcatttgccgtaggatttatgcctaaccaaaaactaagtaccggatactatacgatagaggtatatgtaggagataaattaaacggtaactcatttattctccagaccctgaaagacgtggaaaggaataaagaaagtggagttttctactacacttatggaaaagtatacacattggaagatgctgtgaaaatccagaaagagcttgagacaaagggcattaagaatactatcatacaaaaagtttacagatag

SEQ ID NO: 97045 - DNA, 216 bp, Glycine max
  Peptide Sequence Number=SeqID_213823
tactccaatgtttcatcagatgaagaagaattgacagtcccagatgatctggctgagtacacattggaaggtaaatgggaaaaggttatcgacttgtacaatcaattaattcccagcgtgtcacacgtggccctagatttggacgaagaaggtgtacatggttcaagagcttgtgaaggcaattatcacgcacaagcagcaaagtgtgaagaataa

SEQ ID NO: 97046 - DNA, 354 bp, Glycine max
  Peptide Sequence Number=SeqID_213824
atgccggcgcagctaatccgtgatcgagtagagatggagatgcatagagggagcttgggagaccctcgaaggcaacacgaggtgccgatttcggggcactattcgatatacggcgacttctttatggagcccgtccaagtgatcgaggtaacgtcatccgaggaagaccctgaggaggatctggaggagctacctcctgagcctgctgtggatgcccttgacattctagagggtgatgaggatccacttcttgaggtggattctcccgaggaagtcatgtcggcatctgaggcagactctacggaggatggtggcccaggggagatggcgatcagcggaggctcttcatcctag

SEQ ID NO: 97047 - DNA, 607 bp, Glycine max
  Peptide Sequence Number=SeqID_213825
atgaaaagaaaattactttccttattttctttgttgattggtgttttcggattctcacaaaccgaagtctacttcaagtatgacgaagccggaaaccagagatacagagggacagatgtgagtggtaaaaaagcacctgaagacttaaaaaatttggctaagaccgaagaaaaacctaaagctgaagaggtaaagaccattgctgagatcaagcaacaaccggttctggatgaaaaagcattctggaaacagatcagattgtatcctgttcctgtgaatgatttccttactatagactggaccgatgaagtagacggactcatagaatccgtttctctttaccagcacagtacggttcactggaaattccagcaacagaatactccgggattaaataagcagctaaagatcaatatgtccaattacgaatggggtaccatactctatcagcaggaaagtacatcaagaacagtacaggatccgcaaaccgtggtcttggctcaagggttcaaggcctcctccggcacttcaaatccttttgtggcaaagatcgggccttctactgaaaacccaggtgggggacctacagattccggcgcgggagccg

SEQ ID NO: 97048 - DNA, 408 bp, Glycine max
  Peptide Sequence Number=SeqID_213826
atgatattagaggacaagttgaaggcttgtcaaaggtcgaagaggagcttaaccgaacagttgagtaggacggaagagaacatgtgggctatcattggccagtataaagaaaagctaaatctagctgctatccatgagcaaaggctagaagacgagcatgcaaaagtatcagtcttgcaagcggaaagggaagcaagggagagagtgatagattcattacatagaaaagctatgatgtggatggataggttcactttcactttgaatggaagtcaagaacttccaagactgttagccaaagccaaggcaatggcagacgtgtactcgtctcccgaggaggttcatgggcttttcaattattgtcattatatgatcgagttgatgtcccacataattaggaaccgctga

SEQ ID NO: 97049 - DNA, 459 bp, Glycine max
  Peptide Sequence Number=SeqID_213827
atggagcgagacggcgtcgtttcacagccagttgcggttatcgcttgcatcgcaatggccgtgttctacgtggccatcctctacgctcccaccgtgctccttcgtctcccacctcctccttccttcaaaacctacatgattcgtcgcttcctatgcgccgtcgtttcgtctgttctttcactcttcatttccgctctcatcctccccggtcatagtggtgggatattagatagtataaacgaggtgcaaactaaggaactgcgccacattcttgttgtatttggcatccggagggaccatattattgggaaacagggttactcattgctgaattttctgtatgaaacagtggcaggctgtggttcttcctctttgcttgacctctctaatgtatgctgggtctatattcctcaagtgtcttctgttgctggcttcttggaggcaacactcaagttctga

SEQ ID NO: 97050 - DNA, 525 bp, Glycine max
  Peptide Sequence Number=SeqID_213828
atggcaaggatgtcgacagatcctctaattattgggagagtcataggagatgttcttggctctttcaccccaaccataaaaatgaccgtaacttacaataagaagcaagtctacaatgggtacgagttcttcccttccacaattaccacaaggccaagggttgagattggtggaggagatatgaggtccttctatacactgattatgacagacccggatgtccctggccctagtgatccttacctgagagagcatttgcactggatggtgacagacattccaggcacaacaaatgcctcatttgggaatgtgttggtgagctatgagatgccaaagcctaacatagggatacacaggtatgtgtttgtcctgtttaagcaaaaacgtaggcagtgtgtaactcgtccaccttcttcaagggatcacttcagcactcgcaaattctcagctgagaatgaccttggcctccctgtcgcttctgtctacttcaatgcacagagagaaactgctgcaagaagacgctag

SEQ ID NO: 97051 - DNA, 591 bp, Glycine max
  Peptide Sequence Number=SeqID_213829
atgagattgaaagttttcctattatccaaccacatgccatacaaggaaagtggctccacctcaaacctctactactcatttgaggttgctagcacccacgtcatcatgttgggctcttacattgattttgatgcacacacccaacaatacacatggcttcaatctgacctaggtaagattgataggaagaggacgccttgggtgattgccttgttgcatgcaccttggtataatactaatgaggcacatcaaggtgaaggtgaagacataagacaagccatggaagagttgctttatcaggctcgtgttgacttggtctttgctggacatgttcatgcatatgagcgttttactcgaattttcgacaataagactgattcatgtggtccgttgtacgtgacaattggggatggaggaaaccgcgagggacttacattaaagtttaagaagcctcctagcccactttctttgtatcaggagccaagctttggtcatggaaggttgagaatagtgaacgaaacacatgcacattggtcatggcatcgcagcaatgacaccgatacatttgtggctgatggtgttttggattga

SEQ ID NO: 97052 - DNA, 150 bp, Glycine max
  Peptide Sequence Number=SeqID_213830
atggacgacactgtagagcgtgagtgcgaacaagagacagaaaattccaaagtgatggtggaaccttggagaaacatcgatgtggagaagcagatctcattggagcttttgcctttgaagttagggatgataatggataaggttctatag

SEQ ID NO: 97053 - DNA, 1071 bp, Glycine max
  Peptide Sequence Number=SeqID_213831
atggactcgcacaagcaactatttttcctctcatttcttcccctactacttctacttctctcagggcatatggggctgcaattaactgaggctcacttgcaacgccatgagatgaattatcccccgaaaatgttgttggtttttggggactcgtatgttgataccgggaacacgagaatagatcaagctggatcgtggaaaaacccttatggtgtaacttttcccggaaaaccagccggtagattctccgatggtagagttctaaccgacttcattgctaagtatttgggaatcaaatcgccagttccgtacaaattcaggaaactgatgctgaaacaattgaaatctgggatgaattttgcatatggtggcactggtgtgtttgacacgtcctccaaaaacccaaacatgacaatccaaatcgattttttgaagcaattgataaaagaacatgtgtacacgacctcagatctgaacaactcagtggcctatgtttccgtagctggaaatgattacaatttctacttggccacaaatggatctattgagggtttcccgtctttcatcgcctcagtggttaaccaaactgtcactaacttgcttcacatccaaaggttgggagtgagaaaaattgttgtgggtggtctacaaccccttggatgtcttccttcctccacagccttatcttcattccaacaatgtaatagcacattcaacgacctcataggtctccacaacaaactattgaaccaagccgtgaccaagttgaaccaaaaaagcaaggataactccaccttcatagttcttgaccttttcgacactttcatgtcagtgttaaaccacccatctaccaataacattaaggaccctctcaagccttgctgcgtagggttaagtagccaagatttttgtgggagcgtggacgagagaaatgttaagcaatataaggtttgtgacagtcccaaatcagctttcttttgggatctcttgcacccaactcaagcaggttggcatgctgtgtataataagttgcaaacgacgacgagtgctcttcgtcgacttcgatactaa

SEQ ID NO: 97054 - DNA, 363 bp, Glycine max
  Peptide Sequence Number=SeqID_213832
atggatggtaattattggaagcctaatgatagtggaaaattcaagagtgacgtgtgccatagggaatcagtagtaattaaggtacaactatcgttggaaaagttggggcagactgtaaccacaaaacatggttgcaaggttgtgagaaatacacaatggaaaaccaaaagaagaagctacaaggcagcaaaaccatcaccagataggaagagcaagtctgaagggctacctacaccatgcaccgccaccgcgacgtctcagtcctcagcagaaatggttttgccgcctggtactatttgttgccaccgttgtcgggtggaaatggtagtggctggcgcaaaggagtcacagattaaatattaa

SEQ ID NO: 97055 - DNA, 516 bp, Glycine max
  Peptide Sequence Number=SeqID_213833
atggcggaagaacaccgatgcgaaactcccgaaggtcacctactctgcgccaacaactgcggcttctccggtagcaccgccacgatgaacctctgctcgaaatgctacggcgcgatccgcttgaaggagcaagaagaagcgtcgacgaaatctacaatcgaaaccgcgctctcttcttcctcgttgaaaccgtcgttctccacgtcacctccaacgttggtggatgtcctcatcgaatcgccgccgccgtctttggcggaggttgcggtcacggtggcggtggaggcgtcgagttctatttccacaagctcaggttcggttgcgcaaccgaaccggtgtgccacgtgtcggaagcgcgtggggctgaccgggttcaagtgcagaggagattgcacgtgccaaccccgtgatcaaagcggagaagctgcggaggatttgatgattcgttctcggccgttcgatgggaccggatttggtgatttgatctcgaccgtccacgtgtactgcgaaagatag

SEQ ID NO: 97056 - DNA, 240 bp, Glycine max
  Peptide Sequence Number=SeqID_213834
atgtattacagaggtacatcagtagtggttgttgcggtagttggtttggttgttagcggaaatatgtcgaagatggatgaagatcaatggatgtatgacaatataatgtttgaagaagttgatatgaatgaacaaaatgaagacgaaactagtgtgaatgaagaacgtgttgattgttctgatgtgtttaatacttctcaggtgtttgttacccaagatgatattttgcagtgggcttga

SEQ ID NO: 97057 - DNA, 1194 bp, Glycine max
  Peptide Sequence Number=SeqID_213835
atggatcctcaagctccggcgacgggcaccaccgttcggagcgccgcggaaccatctcaacctcagccaccaaaaccatcccctcctctccctctccctccaccttccacatcatcaacccctccacaccctcccccaatccctaaccctaaccctagcccaggcccaggcccaggcccgggcccaattcaagccccgagccccaaaccccccactcccactcccacgcctccccaaccccgccctccccagcccttcaaccgcgctttaccacctccgtcgcagcctcagttcccgcacttctcctccccctctccgccgtcctcagctcccagcgccgccccgcctccgcggggtggtatggcgatcggtgtgcccgcgcaccaccagagcccctcccctccgttttcgtcctccttcggtcaacattttggagggctgggccgcaccgcagtcaacgtcgctgaatctacatccaattcaagcacttctcaagcgagaacgccggtgcaaggaatggggatgttagggtctcaaatgaggccaagtggaatcggttcacatcaacagaggtctgtgcaatcgtcacttagacctccaacctctgccccgaataatcaacccgctggttcacaaagcttccaagggcatggacttatgagaccctcatcagtgggatcaacggctactccatctccgagttcatcacaaagcatgcagtcacttaatcagccatggttgtcatctgggtcacaagggaagcctcctttgccatccgcagcttataggcagcaattgaacccacaatccatgcagcaaaggtcacatattcctccgatgcagcaatccacaccaacatcctcgcagcagcagcaacaacaacctttgctgtctaatcaatcacaggagcatttcgggcaacaagttccgccatccagggctcctctacacatgcctcatcagccacaggttacgaggttacaggggccaggaaatcagaaaccttcatctcttgtggcggcacaatctagtgcagcgcagccagggactcaaagtagattaacaaactcagataccgatgaatcttctaatagtattctcagcaaaagaagtatccatgagctagtcaatcaggttctatatcagatgagtaaggaattggttggtggcttacaaacgcttatagctacttag

SEQ ID NO: 97058 - DNA, 198 bp, Glycine max
  Peptide Sequence Number=SeqID_213836
atgaagaataagaaggttgttgtggctggtgtctcgctaagcaaggcttcccgcttagcgagtgaggagaatttggaagagaatctgccatgcatgcacgcgctcagcgcaccatcagctcgcttagcgagtagtttgtctcttctgatgctaagcgcgcccaactcgctcagtggaaaatcacttactcgcgcttag

SEQ ID NO: 97059 - DNA, 327 bp, Glycine max
  Peptide Sequence Number=SeqID_213837
atggcttgtgggtgttcatcaacagcaatggcagagaagatttcatggaactgtgctgtatttgtggcacttatgctggtgttgagtagctgcgagtcaaacacaagtgacttcacgactcagatgatgtttcatgaaagtgtcagcaatagcaacaacaaagcgtgtgatgagatttacgtggttcgtgagggagagacactacaaacaatcagcgaaaaatgtggggatccttatattgttgaagagaacccacatatccatgaccctgatgatgttttccctggcctagttatcaagattaatcctttcaccaatagagcataa

SEQ ID NO: 97060 - DNA, 237 bp, Glycine max
  Peptide Sequence Number=SeqID_213838
atggaagtaaaacgtcagaatttcacaacggtcccttcctccgcgccaggcttcgaagatgactgtaaattgctagggaaccttctcaacgacattctccagagggaggctggctccaccttcgttgacaagctcgaaaaaattcgagtcctttcacagtctttggttttgttcggttgtggagaaaatgggcgaaggttgaaacatgacatgcgtaatgcatttagactttcatga

SEQ ID NO: 97061 - DNA, 261 bp, Glycine max
  Peptide Sequence Number=SeqID_213839
atgatcatcgtcgtcaccatcaacatgaccatcattgtcacgctcgccttcattgtcactaatggcagtgctaacaatgacgataatattgatgacgacaacaataattatgatgacaatcaaaacagtagtgacagtgacaataataacgatcatgttggtaatgatggcggtgataatcatgataatagtggttgtagcaatagtaatgattatggtgataatattgatataaaaataatcgttctcattctcacataa

SEQ ID NO: 97062 - DNA, 365 bp, Glycine max
  misc_feature (327)..(327): n is a, c, g, or t
  Peptide Sequence Number=SeqID_213840
cggtttacaacatccctttgttgcatggacaagtgaaggttggtgttgaggaggttaaagatgcaaaggctcccgttcttgtatccactgatgaggcagctgcaaaacctccagaaagactggatcctaaggtcgatgatctcctgtatctgatgacattgaccatcccacagctttttttgaagtctctccaggttatgtgggatgctaccgtgttcgggagttcaaaacatgatgtctaccttggagcctaccagaatgggccagacaactatcttaagggaataattaagagtgcttttaaaggacttgatgatactccacaanctaaatccaaggctggtgcttggtggattgttgttaag

SEQ ID NO: 97063 - DNA, 674 bp, Glycine max
  Peptide Sequence Number=SeqID_213841
tgacggtgtaccatttgaaggtacactgaatgacgattggaaatttgatttctttgcacatgatgcccgccagttggtttgcaccaaccatgcggatatgaccggacgcctccttgccggttcattggcttttgaaagccgcatccttcattatcttattgtgcagattttgcttccacgatcttccaaccttgcccaagtttctgaggaagatcttgttatcatgtgggcctttcataccgggtgtcaacttgactgggcacatttagtcagatatcgcatgcataaggcattgcgattaaatgctcctttgccatatccacaccttgttactctcttttttcgcaattttcaaattcctcttgattctgaaccttacgttccaatcaagagatcctttttaattggtgctgctgtgattgcttcttttggttaccgcaaagagcatgatggctcttgggtcaaaaagggtgctcaacccgctgatgatgaaggcaacctaccagttgaagataattcctctcttcttcgaaagcttttggacaagttcgatggtcttcagacttttgttggtgacaagcttaatgttttgatgatgccaaaggattacatgtttctcaaagttttattcaagacaaagaaatcaaagatattcaagatggatgatcaagaca

SEQ ID NO: 97064 - DNA, 698 bp, Glycine max
  Peptide Sequence Number=SeqID_213842
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggttatcatgggggggacagggtttgtaggattctacccaccgctcgatgggaattgcgcttcaaggcgtctcgtaaggctaatccgcctcacgagggtcaccaacggcacgtgcctttggggggcctaggccccctactgctggtcggcaaacggacggcgggcgcacgcgtcgcttctagcccggattctgacttacaggcgttcagtcataatccaactcacggtagcttcgcgccactggcttttcaaccaagcgcgatgaccaattgtgcgaatcaacg

SEQ ID NO: 97065 - DNA, 201 bp, Glycine max
  Peptide Sequence Number=SeqID_213843
atggccggtacattccacggaccaccaagtggggcatttggggtcgatagttcatcactttgggtaaatgaaggagttccccttgaaggaggagaggacccaaatatgcctgccatactgtaccctggttgtaaatcatatgggtatgaatacatcggcggcatctgcgacggttatagggtgaatgcctgcggtgtgtaa

SEQ ID NO: 97066 - DNA, 612 bp, Glycine max
  Peptide Sequence Number=SeqID_213844
atggcggctttgtctgcaaagcggctggtcagggcgcagagcccagggttatggaccgacctggaacgccagaggtttttaatggaaagctcgtttactcccattgagcagatgctaaacatccgtgctaatcgccacaaagattttccgctgcaggagatcatcctgacccgtctgtgcatgcacatgcagggtaagctgctggataatcgcaacaaaatgttgaaggcgcagggaattaacgaaactttattcatggcgctgattacgctggacgcgcaggaaaaccagagcattcagccttctgagctgagctcggcgctgggttcttcccgcaccaacgcgacgcgcatcgctgatgaactggaaaagcgcggctggatcgagcgtcgtgagagcgacaacgatcgccgttgcctgcacctgcacctgacggaaaaaggtaacgaattcttacgtcagctgctgccaccacagcatcagagcctgcagtatctgtggtcctcactgactgataccgagcaggagcagctggaagccatcacgcgtaagttgcttaaccgtctcgataaaatggacgaagatcaggttatcgcttccctgtcgcgttaa

SEQ ID NO: 97067 - DNA, 243 bp, Glycine max
  Peptide Sequence Number=SeqID_213845
atgggtctccgaataagattggagaatggagaattggcgaacatcgctaggcaatcaattcgcggggctccagactcgatggcaatcaattcgcggggctccagactcgatggtggaggacgcatgaacagcgctaggaatcaattcatgggtctccgaataagattggagaatggagaattggcgaacagcgctaggcaatcaattcgcggggctcaagactcgatggtggaggacgcatga

SEQ ID NO: 97068 - DNA, 339 bp, Glycine max
  Peptide Sequence Number=SeqID_213846
atggaagaaatttcccctcttagacaacctccacattttctcctttgtaaaaagacacttgttagcattgtcacacctcttgggcttgagtttattcctcaagtaaatgagttattggatgagggtttggttcgcaagagtttaaattcttgtgctttgctggtgcccaaaatagggcttcccatggaccctgagaggataaaggtcattattgagtggcccactccaccaagtgttgaggaaaaaagcccagagtttcaagaacctcgggatttgaggtcaaatccttttcaagggggagggaatgatgcaatcctaccccgcaagggcattggatag

SEQ ID NO: 97069 - DNA, 1104 bp, Glycine max
  Peptide Sequence Number=SeqID_213847
atggctaaattcgacccggagatagtcatggagttttatgccaatgcctggcctaccgaggagggagtggccattgcccagctattatgcataccggggcaagatttcacccagaccgctgcagggagacgggtgcggatcatgcgcaccagcatgaccacccttacccagatatggatgatgttgctagtcagcaacattttgcccaacgaccacaactctgacctccccttgccaaagtgtcagttggtttatgccattctgacggatggagcctatgagacaccctatggacccgaagagggagtgactgtcgcccccagcaaggtcatctggccgtccattaccagagccttcatcgagaagtactgcacccgcaggcagccgatgcaccaccgtcacccccaaagtccatctcgactcacctacggaggttggagcgttgcctacgacatgtggctgactagcaggcagccaaccacaaagggccaggatcccagcccttacacatggcctactccagagcagttcgaggctgcagtagcatgtcctggggattggcccgactttcagataggggcggggccagcaaggacctccggaggtggagatgaagctcgagatgatgaggacatggccaatctgatagactttctcctttccttttgctatccggagaccatcaaatccgatggcatgcagagacaaacatggtcatcttcttcccttgtcaagagactcaatgtctgtggaccaaagctactgaagcctcctactatcccaagacaaattttcgccaggtcagttgagctgcttaaagacaattgtcatgcgatccgtaagccctgggcccatcaagaatcttctagaggaagcaacagctcacctgggcgagcatgttgcttcaagcttaagccactagctcgcctgggtgagctaggcggcaagctcctcctccatttttcctataaaatggcgttggaggagaaaatcaagtcgaggcacttccatgatgttttcgtgatcaatatcgtgaacattcttcgtcgttcttcattcgctcttcgttcattcttcgtcgttcatcgatcttcaaccgattag

SEQ ID NO: 97070 - DNA, 857 bp, Glycine max
  Peptide Sequence Number=SeqID_213848
acgaacgatttgcacgtcagtatcgctgcgggcttcaccagagttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 97071 - DNA, 261 bp, Glycine max
  Peptide Sequence Number=SeqID_213849
atgtcgtttctctggttccagtccctcgcgtttctcagcacccgtcggagcccgttttcgaaagatgtcacagctgcacgccgtcaccttcagatgactacacgtccttaccttcagaggactgcacatcctcaccttcagaggactagacgtcctggccttcagagggttgcacatcctcgccttcagaggactacatgccctcaccttcagaggattgcctatcatcaccatcagagggttgcacgccttcacctttag

SEQ ID NO: 97072 - DNA, 684 bp, Glycine max
  Peptide Sequence Number=SeqID_213850
atgtctagaaaaggaaacaatacagcaggtatattagcgggacttctagctggagcagcagcaggtgtagtacttggaatgctttatgcgccggaagaaggaaaagaaacgagaaaaaagattaaaacaaaagctaacgatcttaaggatcaggctaaaacaaaatacggagaagtttctgaaagagtaaaagatcagtatgacaatatatcttctacttttaaagaaacagcaaacagtgttgctcataccgtaaaagatggatacgataaatataaagatcagattgtttctaaaactacagatgtagtaaaagatatgatagaaactcttaaagaatatgcatctaagagaatagatctacttaaaatagaagctaccgaaaagtcatcactctccgcagcgttggacaactactcctacggattccttattgtagctgcattttacttattgataatgattcttgttgttctgtttaaaaagagaattgtaaataccgtagcggaccaggcagaacttgatgatttggaaaaccttcttacattcaagaatacaaaagaaagtttaagcgcatttaccaatggtttaacggatcaatatcttcaggaaaaagtagatgaagacggtgatgaaaaaatagtcctgagaaaggatgtgattgctaaacagcttacttctgag

SEQ ID NO: 97073 - DNA, 489 bp, Glycine max
  Peptide Sequence Number=SeqID_213851
atggcaaagagatttgagattttcttgtccaatttgaattatatcattgagtttaatgctaaaagaagctccccttctggctaccttcttggtctaaacaattttgctgattggagccctagtgagttccaagaaatctacttacatagccttgatatgcctacagatagtgctcctaagctgaatggccctcttttatcatgtattgctcctgcatcgttagattggaggaataaagtagctgttactgcaattaagaatcaagggagttgtgctgctggagccatagaaggaatacatgctataactacaggggagcttatcagcctttctgaacaagagcttgtgaactgtgaccgtgtaagcaaaggttgtaatggaggatggggattacttttggaagcagtatatccttataccggaaaagatggtggaaactgcaattctgacaaggttttgcttctatcaactccttgttccttcccataa

SEQ ID NO: 97074 - DNA, 168 bp, Glycine max
  Peptide Sequence Number=SeqID_213852
atggagttggtggtgggtccatggacatggggatcccttgtgtcgaaagtatttttggcgaggccaccattggatagtcgtcgattgaaaatcaagccattggaaagggagattgccatgtggaagaggctcacacttgaggaagacattgttggagaacaagggtga

SEQ ID NO: 97075 - DNA, 351 bp, Glycine max
  Peptide Sequence Number=SeqID_213853
atgattttaaaaatcctccctcctatctcatggtcatacgccactgcagtttcattcttccttcgttttgcattttgtgtcgtgtcgccgccgtcctcaacttccattgtcgttgttgaggtcgtctccaccaccgtcatgttgtttccgtcgtcgagaaccaaaggtttgggtcgtgctgctttagacagagttataggaagagctctggagagagaagataatcgtgattcagatgaagctctccagcggcgaaggcccataacattcgcacgtaggcaaacggaaactacccctattgctgaggatgttcatcacgtggatgacgcaattgacgaggtcttccaatag

SEQ ID NO: 97076 - DNA, 273 bp, Glycine max
  Peptide Sequence Number=SeqID_213854
atgggcaaccactatttgccccaaacagctaatgagactccttttcatcatacatatggcatagatgccatgattcctatagaggtcggggagcccttgacaagaaatatatttttccatactcagcagaataaggaaaacatgaaggttgaacttgatattagagaagaagtccaagagatggccagggtaaatgaggaagctaccaagcttgagcctcaagaagatacaacaccaaagtctggccttatgcctttcagcctggcgacttag

SEQ ID NO: 97077 - DNA, 1122 bp, Glycine max
  Peptide Sequence Number=SeqID_213855
atggagatcactagaataggccaatggttaagtcttctgatatgtgtactactattactgcagacagaaggggttcctgtgggaatcacttttgttgaaaatgcagtggcaaaaggggctgtttgtttggatgggagtcctccagcttaccacttccacaagggatctggagcagggattaacaactggatagttcactttgagggaggaggatggtgcaacaacgttactacttgcctttcccgtagggacactcgattaggttcatctaagaaaatggatacatcactttccttttctgggtttttcagtaacagtaaaaagttcaatccagatttctatgattggaacagaatcaaggttaggtattgtgatgggtcatcatttactggtgatgttgaagctgttgatccgaaaaccaatttgcacttcagaggagcaagggtttttgctgtggtcgttgaggatttattagcaaaaggaatgaaaaatgctcaaaatgcaattatctccggatgttcagctggaggattggcttctattctaaattgcgatcgattcaaatcactactacctgcaacaactaaagtgaaatgccttgcagatgctggtttttttatcaatgtaaaggatgtctctggagcacagcgcattgaagagttctacagtcaagttgttcaaacacatggctcagcaaagaatttgcctacatcctgcacttcaagactcagaccagggctgatcaaaaacattttggcaccaggtgctgctgatccccgtggccaatggcgtgaatgcaagcttgatatcaaaaactgctcacctaatcaactcagtgtaatgcaaggattcaggacagatttcttaagggcatttagtgtggttggcaacgccgcatctaaagggcattttatagatggttgctatgcacactgccaaactggaatacaagagacatggctgagaaatgactccccagtggtggccaagacatcaattgcaaaggcagtgggtgattggttttatgatcgaaggcccttccgtgagatagattgtgcctacccttgcaaccctacttgccataatcgtatttttgatcagaatgagcgtccagacgtatag

SEQ ID NO: 97078 - DNA, 318 bp, Glycine max
  Peptide Sequence Number=SeqID_213856
atgtatcacataccaagggaagacaacactagagcagacttactctccaagcttgcaagcaccaacaagaccggacacctcaagactatcatccaggaaacactccaagcaccaacaatagatatcaacgaggtcatggcaggggtagaaaaggaaccaaactggatgaagaagggtaattactacattatccttgacggggaactctttaagagaggggggcactccctagcaaccgaggtagtacgtgctggctactattggctgacacttaaggctaacaccctcaatttcatgaagaagtgcagaaagtgttag

SEQ ID NO: 97079 - DNA, 2031 bp, Glycine max
  Peptide Sequence Number=SeqID_213857
atggctatcgaggctacgggcagggataatggtggtgaagttaaggacgttttgaagtactgctcagggattacatcctttgtgagcgttggtgccctgtggcgtcaactccagttggccaaatcgggtgacacctacaagatgactttagtggcttgcggagaagatgggcacctgttcatgcgtcctgcccttgacggtccccttacttctatgtctaccggtaagatgtttgagttcaactcaaagacgttccatagattcaaggacaccttctttaaggtcagggcaaccagtgccatctctgatgggttacctttgatgtatgaggagaatggggagcctcccttgcttgacgcatgggccatcttgtgcttgcctttggcaagcgaccctcttcttgtcttggatgtgaagctggttggacctgccgaaggtgatgtgtcccttcctcccaacaacgccaatgaactttctggagggggaggagatctgactgatgctagggttgacctgccccgtgcttctgatgttgtcgaggttacgccagacgtgcctccttctatggcaaccaagaggaagcgcaacaaagaggctctaaagcatgccactggtccaccctcaaccccctcaaccattgaggctgctgctgctatggcgaacgctttcgatcctcctgctcctttgtctccacccactcaaatggtttatgcaccttcttcctctacaccagccacatcttcattccctctgccatgcttgctcctacattttccattgcaccgccactacgataggtggaagctgccaagtggagggccactaccaggacagtgtggcgagtggagcgccctaaggttcaaccatcagttgcctttgctgaagtgccctaagtgtggcgagtgggctaccgttgcctttgctgaagccatcgggttcaaccatcagttgttgtctagggtcgacaatgtttttgccaagtcagtgagcacaaaactggacaacgacgaggtattcagacgttataaagatgtattaaaagaaaagaatgacttggcagctaaggtggagtgctctgctgaggagaaagaagcacttaatacgatggtggcagaatctgctaagttgattgtggatcttcaagcccagctgagggattcggagctcactgcgtccaacctccaagctaagccgaaggagttcgagctcaaagtagtgaatgagaagaaaggaaataaggagcttgaggatgagctcctcacgtttaagaaagaggctatgaagcaacacaagaaaaaagacaggaaattgcttgacgaggatgagatagccaccatggaggtgtctgatggagaggagggtaaatgggttgatacttggcctcatcgtggaacactgggggtggttctttgtgttaagtattgcactgccatgcttgatggtcatctcgggtttgattttaacctggttgaaggtcttgccatggtagactctcatgatattgcacttatctcaggaacaataatcatgagtgcccactggtgcattgggtataacacgttacattggccaagtgttagattaatctggaccttgactaggaacatcatggttttaagtgaagaagtttaccaaaagatggaccttggctttgtcgagcctttggagattcgacagggacacatttgtcctgggtttggtgacactcaccaaagacgaaccttgggtttgacgagcctttggagatttgaccaggaacatatttgtcctgggtttggtgagactcaccaaggacagacctttggtttgaagagcctttggagattcgaccaagaacatgtttgtcttgggtttggtgagactcaccaaggacagatcttgagtttaacgagcctttggagatttgaccagggacatgtttgtcctgggtttggtgagactcaccaaggacgaaccttgggtttggtgagccttcagagatttgacctggagcacgtttgtcctgggtttagtgagacttaccaaggatga

SEQ ID NO: 97080 - DNA, 255 bp, Glycine max
  Peptide Sequence Number=SeqID_213858
atggattatcaactccaagcacaagtggaccccaaaacaaccaagaatctgaaagacaaataccaagcagtgtacttcagtttattaaggacattctttcctggtggagaaattcacgtggaagattctagtgtacaaggaacaactgcagtaacatttagtcgtatggagtctgaggggaaacttatcatggggtttacaaaggcaacaaattctgctgcagtacaggtatttgaacttatttcaactctctaa

SEQ ID NO: 97081 - DNA, 195 bp, Glycine max
  Peptide Sequence Number=SeqID_213859
atggctgatgaggttgttccaacttgtccatcaagcaggctgaaacctcaaatgaagacacttcaatgcacaaggagcttttttgccccaagctccttaattgttgataatgtacaagccatgcttgacttggctttgacaaagaaaaaggaggaggctcagactatgtacaagccattcttgatttggctctga

SEQ ID NO: 97082 - DNA, 300 bp, Glycine max
  Peptide Sequence Number=SeqID_213860
atgaactgggtactactgattgaagacattatgttgaagagtcatcgtctggtggattatgaatttccttatgttgtacatgcctcaagattcattgactacttcaatgttgatgtctttaatgagattgtagattttaccaaagcatctagtgagatgaccgaaaggaatttcaaaaagattggaatgaggtttgttgatcatggatggataaaggctggagagccagcagcaagaaacattgaacaaatggaagaagatgctaaagctgaagctccacaagagcctgcacatcaatga

SEQ ID NO: 97083 - DNA, 417 bp, Glycine max
  Peptide Sequence Number=SeqID_213861
atgggtcagattctacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaaggggcgttctaa

SEQ ID NO: 97084 - DNA, 258 bp, Glycine max
  Peptide Sequence Number=SeqID_213862
atgttcctcttggtgtggtggtttgacgacaagcaacgacagctcgtggtggtgaccggtggtcatgggtcgtggaggaggagctcactaagcggaagtccacttttggcgctaagcgtgacctttcacgctcagtgcaattcctctcgggttggaatttgtgctgagcgtaattcctcttgcgctaagcgcaacaattctcgctcagtgcaattccctctcgagttggaattgtgcttagcatgcttcttgcgctaa

SEQ ID NO: 97085 - DNA, 225 bp, Glycine max
  Peptide Sequence Number=SeqID_213863
atggccattgttcaggacctggtgattgccaataggaagaagaggctcattatttgtagaatcaagccagacctcaaaagagctttcaaggaaactatcaaggctacaaaggaggctcaggtccttctaacaattcttatgcaggtctctcaaataagggcccacaacaacaacaacaacaagcttaattggatatgttggatcgagtggcctcagaataattaa

SEQ ID NO: 97086 - DNA, 243 bp, Glycine max
  Peptide Sequence Number=SeqID_213864
gttaacccaaaggaacaatgtaattcaattacaacaaggtgggagactgtggttggtttgaaggataatggtgagaaaaagaataaagaaggagttgaaaaagaaaaagagaaaaatgatgaagtggtaactagtgaaaaagttaaagagaaagtgggacaaacctatctttcaggaggaggaagagcagagaaggatgaagacatgagaaatcctgttgattatgtcattggaggagactga

SEQ ID NO: 97087 - DNA, 231 bp, Glycine max
  Peptide Sequence Number=SeqID_213865
atggggatcaattcgggcaccatcgcgcaagcgaagctccctctgggcgaagtgggactcaccgagaacataatggggctcgagggagacagctacgaagttgtagaggccatacacgtggggttgcggggcatgcgatggagcgggtaccacgccagtgcattcaggtcaaacaaaaagggggaagtgattgaagggtcttctgggaagatgcaaagaaggtggtggtga

SEQ ID NO: 97088 - DNA, 245 bp, Glycine max
  Peptide Sequence Number=SeqID_213866
ggatatgatagagtaactactgttttgattcatgaagataatgatcaaactcagaatggtggcattcataatgatgagatcaaagaatatctagattgcaggagaatatttgggtttccaatacatggcagaaaatctgctgttgaaagattacacttccatcttccaggccaacatattgttctctatgaagaccatgatgatattgatgatgtattgtctaagccaagtatctctgattcaaa

SEQ ID NO: 97089 - DNA, 258 bp, Glycine max
  Peptide Sequence Number=SeqID_213867
atggcattttctgcatctatggcagtggtggaatattaccatctcaaacatttccctgttccttatgaaacatgttatttattagtcacttggtggagtattatcattcatgtcgcaacatgcccttttacgggcgtgcaaggcgaggctcacgggtgtgcttttcaaaggaggaaagatgcgcagagtcgccaccaacgtttatttgtggagaacgtcggaaaaaccaaaggaaaccggtcaaaacgaaaattctaa

SEQ ID NO: 97090 - DNA, 309 bp, Glycine max
  Peptide Sequence Number=SeqID_213868
atggcttctcccaaccatacaccacccaatgttgcacacactcccaatgaggacgtcgacaactctacacccatacccattaagagccaacaaccccaagctgatcatgcacatgtgtctcaacccatgggggagacacatgaaataccccaccataatctaactaacttcaagcctcgcctcaaatatgccactaaagggaaagcagtcagtggtgtgcccctgccaaacactttggagggcccttgcattttgaggcaagaagaatcccttttgctatggcggagaaagggaagttggatcatatag

SEQ ID NO: 97091 - DNA, 324 bp, Glycine max
  Peptide Sequence Number=SeqID_213869
atggtaatggactctaaactagttgcatactttagtgaaaagcttccaggagattgggtctgggttcatatgaggaaagaaaggttctttgctcaaagaaaattcaagttgcaaccaagaggagatttgccttttcaatttctagtaaagataaataacaatgcttacaagctggacttgcccagagaatatggtaacgaatcagattcgaggacaaatgatgtagatccatgtagagcttgtaggccttggatcttcttcatcaatggagtcctttacttcttgaagatcaatgacagcagaatggagaaggaggaaaggtga

SEQ ID NO: 97092 - DNA, 1479 bp, Glycine max
  Peptide Sequence Number=SeqID_213870
atgacaacattaccttttgggcaccacttcaccattgttacagatcatcacagccttaaggagttgttgaaccaagtgattcaaaccccggagcaacacatgtatttagctcacttgatggggtatgactatgatattcagtaccgctccgacagccacaaccaggcggcggatgccctgtcgcgcttaccagagcatgactcccccatgttaatggtcctctctgtcccatgtctaacattcatgaaagaactttgccatcaactggacaatcattccgcttaccaacactaccttcaagaggtgctcacttgtccaaccaaacaccctgggcctgaggtctcacagggcctgattctcagtaaaggtcgcatatggttacctcgcagcttgccaatagcttctactttacttacggagcatcacgcgacacccacagggcgacacatcggggttactaagaccttggcaagaatcatgaaaaatttcgtctggccagggcttcgagaagacgttgcacaatttgtggccaactgtgtcaagtgccaggtaaccaagtatgaagctaagaagatggtgggcctgttatgtcctcttcccgtgccccacagaccttgggaggatctctccttagattttattgtgggcttaccctcatatcaaggcaacattgtgttactggtggttgttgaccggttttccaaaggcatccacctgggaatgctaccttcgaattattctgctctcatgatggcatctctgttcttggacattgttgtgaagctccatgggcttcctcggagcttggtctccgaccgtgatcccttatttgtcagtcgcttctggcaagagcttttttgggcaagcggcacacaactcagaatgatttcaccatatcaccctcagagtgatggccagactaagcttctctcttgggttgaattatcgcataacgcatcttggattaggggcacaggctcgactccttatgaaatcacttttggctgcaagcccttcaattttccagagtatgttgccggaacttctaaggttgacgtcgtggaagaaatattaacagaaagggaggagattttccagagcattcgtccaggaacaagtaggaccggtagcttatcgattacgtttactggaacagctcggattcaccttgtatttcattgttccctgctcaaaccgtttcatggctccccggagaacacagatgttgcagaattaccaactcaatttgctaatcaccaaccccttatttctccacttgcaatactggactattgtcgagcttcaccaagtgcaccttgggaggcccgagggatgacacagaacagactcaacatccacaaagacaaaaagggaggtgcaaatataggacaagcccaaaaggaagctcacaaaaccagcatacctcagtggctacatatgaagaaacagacaaaagctcaggatccttgcttgccttag

SEQ ID NO: 97093 - DNA, 1221 bp, Glycine max
  Peptide Sequence Number=SeqID_213871
atgcctggacacagaaaaattagcgaggctgatttaattgaaattgagaattacataacaattggcattaggcctcctcaaatatatgttgcttttgcaaacacttccggtggctacgagaatgtacgatttgtgagaaaagacctatgtaatcaagttcacagaatctgccgtgggtacaagttagatgttgaaggtgcatttaaattcttcaaggagttgtatcaattctcggatgcaatgaaggggagagctgcatgttcggagatcacatatggtgatcttgcaatgaggaatgctaccgatgagaataattgggtggcagaattatataagaaaaggaacatgtggtctccagctcacaaccatggaaatttctttgcagcaatttcaaaggtttttaacttatttcgcttccacgaggttgaagttgattatgactctaaagttgggagtttgggtttagagattgattttcatgcaattaagaggtctggtgctgaggtcatcactaaggagttgtttatggcatttcaaagtaatcttaagacaatgatgttaagggttgatgaatgtcaagaaatgggtatgtcatgtgtttatacagttgaggcagtgctcctcctagtggacggtgggagcacccacaatttcatccagcagcacctcgtcacccaactcggactcccttttcgcaccactactcctctttcggttatggtgggtaatggccaacaattggagtgttgttggctttgtgaggcggtcaccatcgacctccagacagcctccttcacagtggacctctatgtcttgcccatcgtcggtgccaatgtcattttgggcgttcaatggttgcaatcactaggagataaggacgctaaaatggggatgatgactccacctcagcttcgacgcttgtgccgtaaactcggcaatgccacgtgcttccacgtcaccgtggttcctaaggacacatcacctacacctactactgatttctcccctgagttacgagctctactcactaagtttagctctctatttcagaatccacaatccttgccgctggcacgagacatcgaccacaacatacacctccttccggctgatacaacccaacaccaacccgttctcttcactggtgctgttggtgaagaaacacgacggctcatggaggttttgtgtagattaccgagccctgaatgccctcatcgttaa

SEQ ID NO: 97094 - DNA, 210 bp, Glycine max
  Peptide Sequence Number=SeqID_213872
atggtgaagatgatcctcaggagagccgttatagatgagaatgtcattgaaaaagacgatgatgaattgtcgaagctgttttgggagtgtccgccgcatgcatgcgaatctggtggtagccttgtaacagatctagctttgagaagcaacgcgcatcatcgagttcatccaagagctcgtcaattgtgggaatcgagaattgattcttaa

SEQ ID NO: 97095 - DNA, 468 bp, Glycine max
  Peptide Sequence Number=SeqID_213873
atggatgaaattcgttcaagcaaaaccaactgtggagatatccttctagtcttttactctaatcctcaagatattgctttgattcagattcagaacatctttgtacctggctctgctgatcccagtgacagttggcatagctgcaagcttgatataagcaactgctcacctgatcaactaagtaaaatgcaagacttcaagtcggaattcgaaaaggctgtgagtgtggtaggcgactcttcatctaaaggaatgttcatagactcttgctatgctcactgccaaacagaatcacaggagacatggtataagagtgactctccacagcttgccaatacgactattgccaaggcagtgggagactggttttatggtcgaagttctttccgtcacgtggattgcaattatccttgcaacccttcttgccagaaccgtgtttttgatctaaaagaccaccctggaatatag

SEQ ID NO: 97096 - DNA, 318 bp, Glycine max
  Peptide Sequence Number=SeqID_213874
atgaatggacatgttgagtatagggcatgtcgaattattgacaaagaaagtgtttggtgcatgtttaacacattcacaaatatgccaagtggaatatgtatggaacttagagttgaagttcatacttcaccgccaccttctcaagctaatgagctcatctggacggagatggagcagaagcggctatgcatgtattcacaagctaatgctggtgtgccacaatcagttccaaaaacttgctcaggaattcatctagtaggcaattggtggaatgtggtctatgttcgaaggactaggtggaacataatccgtgattag

SEQ ID NO: 97097 - DNA, 417 bp, Glycine max
  Peptide Sequence Number=SeqID_213875
atggcacaacaccctttgttcttgagggttcttaatatacgccttgagaacggtaacaagttgtctagtaagggattgaagagtgtcgataagggcggaacgaaggctcttcaaagcccccaagagagtgtcataaatcttagcacgggtcgggagggattcgaggttcttaaccttgtcggggccataaaacttgccctaaaaaatgatgttggtgaagtcgttgtcctcgagcttcttctccttctggaagttcctaaagggcttgatggcaaaaggaatatcccagggcatgccctccaccaccttgtcgacaaacatgttccttgccacgatcagcttcactgtttttgggagcgtctttcggagctcctagaattgcttcacagtgaagccattgtagttgatgccagctag

SEQ ID NO: 97098 - DNA, 819 bp, Glycine max
  Peptide Sequence Number=SeqID_213876
atgatgatgcatgatgcaatacagatatcaaacgtactaagatgcaacaagcaatataacaaccaatacaaattccactcaagggagttgggcatcctttggattgttcaccatgttgcccccctatctctaacacaaggaatagcaaaaagaaaggtctattccaaaaagaggtggtgtaaaaaggacttgggtcttcacgaaacaactgggcctaaaaacagacaaaagacaccatgtgttactgatggtctcaaagtgacaagattaacaagagcagaattagagctgaacaagctggaaaaagaagtgaatgataggcagctgagtgaacaagaaataaaaatgcgaaagcattggcaggaggaattatgggtagcaacacactcaaatgaatccattataaggcaaaaagcaaggactagatggattaaggatggggattgtaactcttggtttttccatttgattgtaaataggaagcaaagattcaatatgattagaggagtgtttgctgatggatgttggattaaagagccttgcagggttaaagaggaaattagacaattttttaagaggagagttaaggtgcttgagaaggaaagacctagactagatagggattttctattagatatggtgaggtggatgagattctatactaaatggataacatggattgctggctgcctgaaatcagcttccatttccatactggttaatcggagtccatcagcgaagttcacccctcaaagaggactcaggcaaggggatccactagccccattcctattcaacattgtagcagaaggcctatag

SEQ ID NO: 97099 - DNA, 192 bp, Glycine max
  Peptide Sequence Number=SeqID_213877
atgaaggaaaaggacttatggttggagttcaagaagtggggtgatgtcagggaggtgttcattgcaaagaacaagaataggaatggactaaaactacatgcgaatctcccaaaacatggaagggagtggaagatgaaagagaagaccagcaacaattatcagcacaagaagtggccactcaaggagaaccta

SEQ ID NO: 97100 - DNA, 1233 bp, Glycine max
  Peptide Sequence Number=SeqID_213878
atgggttccaatggtagcaaagccacttcttcgtctttcggtagttcttcttcttcatcgtcttcttcggggagtttaaggaaaggtcgatctaagggccttaaagtttttcaatcttgttgtcttggaacaacttctggttctcacgacagtgataatgaagaccaggtttgtgatcagaataaagtaaatggcagtgatgtaacatatgctgatggcaatggaacagactcagatgaggtgaaaacagagtcatttagaaaggttatagctggtgaaatgacttgtgtgccttctaacattgaccttgatggatggggagaaacaagcatccccaacacttcatccagaactggaagcatctctgtccattcttcttcaactcattccttgaaccctacaagtcattgcctttctcggtttagcctcattcctggtaatgtaagcttcagacttagcagaaccactagtttggggtcatcaaggcctcgtcctgtttcttctgccaatctctcaatatttgacaatgaagatgagcataatctcaatcctggatctcctggaagattgataaacagaagtgaaacacaacaatgtagtaacttgcttcccgcatctttttccaatcaaatacatgcacagtgtcatgaagacgcttctaataattcaaggtcaaatgtcccgacatcaggcgtagttggaaacttgcagagctatcccacagatggagtatgtgcaagagaaaggccagacgtgaacttattttctctgagaattcaaacagacacagaaaatgttgacaatgacacaagacatattgatcaacgaattggtgctcgagaaccagttgaacggaatgttcgttttagccgaactttaagtgttggaaggcttcgtgacagagttcttcgtcaatcaacattgtctgacctcacctttttccctttgcaacaagagagagagctgagagatgctagccttcctagccaagatattattgacaggcaagcagtggagggagattcaagagtgtcaccatctgatcatagtaccattaattcttcaacatctagatatcctccatctagtatgtctaactccatctttagcatccaagactatgaggttgagacttcacgattgagagaaggtaggtatcaggatctactggagcataggtccaatttccttgaacggagaagaagaatacggccccaggtttgtggattttga

SEQ ID NO: 97101 - DNA, 294 bp, Glycine max
  Peptide Sequence Number=SeqID_213879
atggcttttctggattggcaagcagttgtatctcagataattgcgcatactgaagaggttttcttcaagaaaaccattcataatttgaggcatgttgcatatatatgcggtaaagagttaaaggatattccatactttatttgtccttataaaccacaagagttcatggctatgatggtaagactaaacctttcacttctggaggatattagggatgatattgatttctgtttcaagcttgctaaggaggaatctgttatcattcttccaaaatcaattcctctcgtgaaataa

SEQ ID NO: 97102 - DNA, 528 bp, Glycine max
  Peptide Sequence Number=SeqID_213880
gttcatgctctccagcgattgggtagccggtttgaaaatctttctggacatgatagaacgtgtgtgttgtctggtcaacatagaaatggtcgttgtacatgccgaatcaataatcgtaacactaattcaaatgatgatactggtgctagagctaacatatctagaattgttatgcttgctgaagccctatttgaggttctggatgaaattcacctgcaatctgttgttttatcttcccgcccatctgtatcttctattggacctgttcctgcacctaatgatgttgtcgattccttgcctgtcaaattatatgagaagttgcataagcatcaagaggatgctgcacaatgctatatatgccttgtggagtatgaggatggagacaacatgcgagtactaccgtgccatcatgaatttcatagaacatgtatagacaagtggctgaaggagattcacagggtatgcccactttgtcgaggggacatatgcatatctgattcaacgccaacagagaactcgagtgactag

SEQ ID NO: 97103 - DNA, 216 bp, Glycine max
  Peptide Sequence Number=SeqID_213881
atggctcttgtagatgctgagatacatgacagagttatcaacttgatccgtatcaaccttacgaatcaacttgatccgtacgatttacagaccaccctcacacacacccagcacaaatgtgaagaaagcgcatgggtagttttgatatttttaagaaatgttgggtgcaccagcaataatgctgggtgcaccagcaataatgctgagtgcacctag

SEQ ID NO: 97104 - DNA, 981 bp, Glycine max
  Peptide Sequence Number=SeqID_213882
atgacagaccaattatcatctctcagattcaaagaagcagtagaaaacaacccttttaatgtcttggcttcttggaatagttcaactcacttttgcaagtggcatggagtcacatgcagcctcaagcatcaaagggtcactgcccttaacctacaagggtatgccttaagggggttgataacacctgagataggtaatctcacttttctgaggtatgtcaaccttcaaaacaacagcttctacggcgaaatcccacacgaaataggtcgtttgttcaggctgcaggagctgtgtctcaccaataacacattaaaaggtcgtcaaattcccaccaacttgtctagttgctctgaactcaaaggattgagtttatcaggaaacaagcttgttgggaaaattcctatggagcttggatttctagccaagctagaacttctatatattgctatgaacaatttgttgactagtgaaattcctgcatctatagggaatctttcatctcttagttttctctctttgggagtcaataacttggagggaaatgtaccggaagagttaggccatctcataaacttgacccatatctctattgcagacaacaaactatctggtatgcttccttctacactatttaatattccatctctcactttcttctcagctggagccaaccaatttaatggctctctaccttccaacatgttcctcacactccctaatctccaacaatttggcattggtatgaataagatttcgggtcctatcccggcttccatctcgaatgcaacccgtttgctgttgtttaacatcccaaggaataactttgtcggacaagttcctattggaacacacattgttcttcactcaattgcaagagatacaattcactccctcacacattcactcgtgtatcactcactgttttcaagcaaagaattgcacacctacacactaggaataacactggcaacagaaaaatga

SEQ ID NO: 97105 - DNA, 858 bp, Glycine max
  Peptide Sequence Number=SeqID_213883
atgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctgaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 97106 - DNA, 290 bp, Glycine max
  Peptide Sequence Number=SeqID_213884
gtttcaatgaccccaacgcgagggtacttcaaggagtccgcaaggcatgggatgcggcacaaaagaaggacaaagagcttaggggaagcagtaatggggtcatcagcggctatcataagtggctgagagtccggacacaagggttggattggcccccaaagctaaaggctgcaagagaggaagaggctgaagctccggaagaaagtgaagaggtacaagccctaaaggtggagctcgaaaaagcccgagcagtcaaagagaagttcaagtcaacgaccatcaaagtctga

SEQ ID NO: 97107 - DNA, 261 bp, Glycine max
  Peptide Sequence Number=SeqID_213885
atggcagaatttacccattccaaaaccattattgaacaacttgaggatgccatcaccaagctcactaatcatcaaatttcacttagtgatacgcttcacgttgtagccctaaaacttgaacagctcctccatcaaatgcctagcccagattatcattcgatgtcggaacacgaacgcctcaccattgcttctttctacatggaagacagagctcttgcctggctccaatggatgaggagcaatggccaattcagttcttag

SEQ ID NO: 97108 - DNA, 336 bp, Glycine max
  Peptide Sequence Number=SeqID_213886
atggaagaattcactagcaccatctctttgaaccagacgatgaagttgagggaggctcaagctgtggaccaagtgctcttggacaaaattatgggtgttacccctgtcactaagtatcaccacctgttggtctgtgatatggcccaaaaggtgggtgatatctggaaaaccctcatcgtcatccgcgatcaagagaaataccttggaggcacatttgtggaagatggtttgagtggtgtgggtaacaatggaggaggggtcggagaaatggaagaggggccaaatgagatggttggtgaaggcaaaggaaaggttttgtcacagaatgaacggtga

SEQ ID NO: 97109 - DNA, 360 bp, Glycine max
  Peptide Sequence Number=SeqID_213887
atgcacaacgccaagtacactggaagctctcattggcaaatgggaattaagagtatgtttggatggagaaatttaatagggatacgacagcttctcccgaaaacctccgcacttgttcagctgccggcggtgacggtgaggtttgtggtgagagggacgccggtgatgccggtgaatgagcatgggctttggtttgggagccagttcaagagcagggttgggttcgggagagagtttttgaagcttaggagttgcagagtgggaaccgaagaagaagatgcagaacacaccaagaggaagaagaggagcaaaagagagcttctgtatagagctttcattttctccagatatcgaaggtga

SEQ ID NO: 97110 - DNA, 456 bp, Glycine max
  Peptide Sequence Number=SeqID_213888
atgcagatgaagcctcccaacgacgaaggcccacaacatccacaccctgaagaagcagctgctgatgatgtggggactgatgtcgagggtttttcaggcgggccccacgacacatcagtgttgcatgactatgtttatcatgtggccatgaaagtttggaatgaagagatcaaaggcttagtggctgcaacaggattaagtcctctaatcgcatgttcactggacactggtgatcaaggacttatgtctgctttcgtggagaggtggcataaggaaactagtagtttccatttgctgatagaagaggtgactatcaccttggatgatttggcgtcgttgttgcattttcccattacatgcacgttccatagctttgagcctcttcacgtggacgatgtcatcttcctcttagtcgaattgcttgaagtgagtgctgaagaggcaagagctaagata

SEQ ID NO: 97111 - DNA, 849 bp, Glycine max
  Peptide Sequence Number=SeqID_213889
gcaagccttggagaggagttgcacaaggttttgatagctgaatcgagttccagagaagaaatgctgaaagctctcaatttgaattctgaacatgccgccctagagaccattaatagattggaagctgctacattttcatggaaagagagaattatacaagaaaatagtggaaaatccccagttcgaacctcatggtctttcatgaaggaccctatggcaggtatagataagatggaactattgctggaacgtgcagaaacacttttaaatctgcttaaagccagatatcctaaccttcctcaaacatttctggatgctgcgaaagttcaatatggcaaggatattggacattctattttggaagcatactcaagagttcttggaagtttagccttcagcatactatctagaatagcagatatattgcaagaggatgctttaagcaatcccaatacacctatttcagcaagttgctcccctgggataaatctttctgaagcttgggtggttggttcgcgtatcaggcactcattaatcgataagatgaacgaggcagatggacaatattgtgcttctagttgtggcagcacttctgatatagaactctcatctactcaggccaatgctactagctctgtacccaccacaccaagccgtggtcgattgtggtgcattgcgccttcatcttcttcattcttcattcctccttctcctcgtgctgccgccgttcgcgctacctatcctgctgtcagtgaccgccaagaccatcggattgagagagattgggcaattcgtataaggcatacaatacagattgtcaatccatatgcgttacgaatatccgtataa

SEQ ID NO: 97112 - DNA, 738 bp, Glycine max
  Peptide Sequence Number=SeqID_213890
acgtcctcgcccctcaaagggctacacgtcctcgccttccgaggactactcgtcctcgccttcagaggactacccgtcctcaccttcagagggctatgcgccctcgccttcagaggactacacatccttgccttcagagggctatacgccctcgccttcagagggctatacgccctcgccttcagagggctacacgtcctcaccttcagaggactacacgtccacgccgttagagggctacacgccctcgccttcagaggactacacgtcctctccttcagagggttacatgccctcgcctttagaggactacatgtcctttccttcagagggctacatgccctcaccttcagaggactacacgtcctcgccttcagaggactacacttcctcgccatcagagcgctgcacgcccttaccttcagaggactacatgtcctctccttcagagggctacatgccttcaccttaagagggctgcacgccctcacctatagtggactacacgtcctcgctatcagagggctgcacgccctcaccttcagaggagtacatgtcctcgccatcagagggatacacgccttcaccttcagagggctgcacgcccttgccttcagagggctacacgccctcaccttcagagggctgcacgccctcgcctttagaggactagacgtcttcgcctttggagggctccacatctgcaccttaagagaatttaaggtcctctgcccttaa

SEQ ID NO: 97113 - DNA, 384 bp, Glycine max
  Peptide Sequence Number=SeqID_213891
atggaagtagcacagttttcttgggcttatatgagccatttgaaacaagctgctgaagatatgagacccaggattgatgataaacacccaagatggttacatctgcggatccgaccatcttctttacctgttctggatcctgccaagttcaaccaccccaggaaattaaagacaaaagcttttgtcgatggaagatggacattggcgttcagggatgaggagtcttgtaagtctgctttatccatgattcttgaagagattaattttctgagtgacgaggttcatagaagactaaagcctttgctcaaccttgaaaccgcgttggatttatcaggcccagaggaggattcctctacactttcaacatctcccaattcggtgtaa

SEQ ID NO: 97114 - DNA, 1761 bp, Glycine max
  Peptide Sequence Number=SeqID_213892
atgcggccacgcagggaaacagagaagcgcagattcgatttcgactcagccaacaccaacaactcagcctcctcctcccccaaatcaccgcggcgaaggccgaagctcttggcggtgctgatggcggggcagtcgcggaaatggatgatcctggtggccacgatttggattcaggccttcacggggaccaatttcgatttctcccagtactcgtcgtcgctcaaattcgcgcttaacgtgtcgcaggtgcagctgaactatctcgccacggcgaacgacatggggaaggttttcgggtggtcctcggggattgccctaatgcaccttccggtttctgttgttatgtttgttgcggctttcatggggttcttcgggaattttccggttaaccgagcccttgcattatcgctcactgtgagtttcaatggcattagtgcagcactctacacccttgttgccaattcaattgatccatcatcggatgcactgtatctgctattgaatgctcttgttccccttctcatttgcattgcagtacttgtccctattcttaaccaaccagctttagaccctctccctcctgatgcagtaaaccgggactcagtgatatttctaatattgaactttatagcccttttaactggtctttatcttctcctgtttggctcatctgcttctggtgtgacttctgctcggttctattttggtggagctattttcctcctcatcttcccattatgtattcctggcattgtatatgctcgggcttggtttcagcataccatccattccagctttcagatggaaagctctagcttcattcttgttcatgatgatgatcttgagatgcataaagagctccatagccgtcaaaatagtattgttagcaatggagatacttacagcctgctaagcaacaatggatacatgtttgggagccaaagggaaaaagatagtgatccgtgttgtgagacgatgattgggcaggatcagttagcagtgctaggagaagagcactcagttgcagtagttgtccgcagattggatttttggttatactatgctacatacttctgtggaggtacacttggtctagtctatagcaataatctgggacagattgcacaatctgtgggccagagttcaaatacttctacacttgtcatgctctatgcatccttttctttttttggtcgcttgctttcagctggaccagactacattcggaataagatctactttgcaaggactggttggctatcaattgcacttataccaaccccagttgcgttcttcctccttgctgcatcagacagtcttctggcacttcagacaggcaccgcactgattggattgagctctggttttatatttgcagctgctgtgtcagttacatctgagttgtttggacctaacagtgtgggcgtcaatcacaacattctcataacaaatatccctattggatctcttctctatggctttcttgctgcactagtttatgatgctaatgcaccctcaatgccaggaaacttgataacgtctgactcagtagtgtgcatgggaaggcagtgttacttctggacatttgtctggtggggatgcatatctgtcctgggactagcttcaagcatgctattgttcttaagaaccaaacatgcatatgatcattttgagaagaaccctgtagaagcaggagctatgcttcgtccttgtgttggatccaaagatgctgctaccttatactttttcagtagcttttga

SEQ ID NO: 97115 - DNA, 1488 bp, Glycine max
  Peptide Sequence Number=SeqID_213893
atggccctcaataccaccaagtctaaaaaatccacttcaccttcaaatttttacttttgcaccactcttttcttcattgtcctattcaccatacctgttcttttcctcctccatgccccaaccaccacctccatatgcaccacccttgcttcctcccaagccaaaacttggtctggtgatcttcagttggttgaattcgcgtggaaccgcctctcgtttttcgaacacaacccatcaccctttgctctcaaagttgctgtcttctccaggaaatggcctattggcacaacccctggtggcatggagcgtcatgctcacacccttcacacagctttggcgcgccgtggccatcaagttcatgtattcacatctccccctgaagatgagagcatttcagtctcatcctctgaggtaaacgaaaacaaacatcaagaaggtgcaccttcttccccatacatccatttccatgaaggtgagcctggcaggtggcgctacaacaaggcgtgggaacagtttgtggaagaaaaccagcgagaaccattccacgttgtgcactcagaaagtgtggcactccctcactggctagcacgcaacatgtcaaaccttgcagtgtcttggcatggcatagcccttgaaagcttgcaatcaagcattttccaggacttgactcgccggcaagacgagcctatgtcccctctcttcaacaaaagcatacagggtgttgtgccaaaggtgctgaatgagataaggttcttcaagaattatgcccatcatgttgctattagtgatagttgtggtgagatgctgagggatgtgtaccaaattcctaacagaagagtccatgtaatactaaatggtgttgatgaggatgactttggagaagatgttgaattgggaagggaattcagaaccaaaattggcattccagggaatgcaagtttggtactcggtgtagctggaagattagtgaaggacaaaggccatcctctgcttcatgaagcttactcgaggcttataaccaagcaccctaatgtgtacttgattgttgctggttctggaccatgggagaacaggtacagagatttagggagccaggttcttgttctgggatcgatgagcccttccatgttaagagctttctataatgctattgacatttttgtcaatcccacactcagaccacaagggcttgaccttacattgatggaggcaatgatgagcgggaagcctcttttggcatcaagatttccaagcattaaagggactattgtggtcgatgatgaatatggttacatgttttcgccgaatgtggagtccctgcaggaggcactggaagcagttgtaaaggaaggaccacagaggctagcaaggcggggcaaggcatgccgggaatatgctgccaaaatgtttacagcaagaaagatggcattagcatacgagaggttattcctatgtataaaagatcgctcattctgcacctatccttga

SEQ ID NO: 97116 - DNA, 954 bp, Glycine max
  Peptide Sequence Number=SeqID_213894
atgacatataatggccttgagaattgcattccggataatcaatcttacggagatgaaagcagaactagcagaggagatggatgtataactgattcattcaatgatgatgactccagctcttcatccagcaaagatgcttttggatcattctcttcaaaatgtttgacaatgaaaagagatgatcacggattggaagagtgggaactcacggaaagtcctcaacatttttatcttaaagataagtccgcttttgacgttgtcaattgttcagatgtagaagccatgaaagaaaagtttgcaaagctgtttctaggtggtgatgttacaggaggagctaaaggcctcaatacagctttggcactgtctactgccatcacaaaccttgcagtgacagtttttggtgagttatggaaattggaacctctatctgaagagaggaagagcaaatggcgacgagaaatgggctggttgttgtctcctacgaattatatggttcagttagttccagctaagcaaaatggtgccaatggtggaatctttgagataatgaccccaaaagctcgtgcagacatccaaatgaatcttccagcacttcagaagttggactctatgcttattgaggcactagactcaatggtgcaaactgaattttggtatgcggaggaaggaagccggtcagaagggaggaacacaagtggaagacatagcaaaagatggtggcttccatcaccccgagtaccaagaaccgggctctctgacattgaaagaaagaggctgcttaatcagggaagggtagtacagcagatattcaaggctgccaaagctatcaatgataatatgttgcttgaaatgcccgtgccaacattaattaaggatgcacttctgaagcctcaagcaaattgttctccattagtgttgattaggaagcaaaatgatagcaacaaaatagggtaa

SEQ ID NO: 97117 - DNA, 240 bp, Glycine max
  Peptide Sequence Number=SeqID_213895
atggagagaagaagaagtattactaagcatgtaaacagaacaacaaatgacggaacagaagagaagagaaacggtgcatcgggtaacgtagagaagagcgtcttcgctgaatctggaccgtttgatcagccgttccatgtggctgatgacgctctggttcacacgaacggtcacgatgatggggtgcagggttttatggtgggaccgaagatagtggggcctaggggtccaatgatataa

SEQ ID NO: 97118 - DNA, 684 bp, Glycine max
  Peptide Sequence Number=SeqID_213896
atggtgacaagggagaaggtgcaaatacattacatgattgattgcaagactgttggaagaaaagaagatgggtatttgattccttgggatgaactagatggatctcttacgagtgatgtagttgcggactcaataaggctggttatggttgagaatgaaggaaggatctacagggaaaaaattaaagaggtgaaggatttatttgtcaatgttgacagtcaagaaagatttttggttcaacagcaacatcacttccgcctcattaacggaaacatggcagcaacaaagatctgcatgtgcaatcaagtagccattgtctcgatcatagctaccaaccaggggattgggtttggcttcaactcaactcatattgtcataccacagtttattttgggatcatggttacgagaaactttcaaaacaatacttttaaggtggttcacgttatcagagccaacgtgggaagacaacgagactttcgttaagacttatcctgcttttaaccttgtggaaaaggttgttttagaaggggagggtaatgatacgttgttaagggaaacatcaagcccaaatgaggtaatggaggacaatgctcgttatgggcctgccaatgaaagtgagtccacaatagcaatgcctcaaagattgaaaacaattcctttttggagaaaagtttatgtttaa

SEQ ID NO: 97119 - DNA, 714 bp, Glycine max
  Peptide Sequence Number=SeqID_213897
atgggagacttcactgttcctccactgtggatcccttttccaacaactgtggcatattggcacttcaagatcatgagaatcttcaacatcgtttctgataatgactcgggcatttctgacatataccgatttggtacggctatccaaaactatgatattgtggtaattagagggtgtattaagttcaaaccagagtggtttgaagtgctagagaacatttaccagaaatcgattctcctagaatggttggacaatcaagaacatgagagtcaggtgtatgtggtgtttggatgcaaagtgaaaccaaggcgagatgaagtcatagagatagctctagtctatgaagcaccgacacaggacacaacatggacacggacacgtgggcacctatctgttggaaataatctaagtctcacatcggctaaaagtaatcccacgttagaatatataagtgaagggcaaccctcaccccttgagctagcttttgagtccttgctttgtggtgacaaacgcccaccatttgttgttcatgtgccaagcccaggaagtgcttggcatgagggggcgacgacgtgcagcaagggaggcgtttggttcgcttgcgggaaacaacaaggagaagacgaagaagatgggaaacaacaactaattttcactaagcacgcgcgtgctcttatcaagcacgatcttatcaaccaaatgccaccaaattaa

SEQ ID NO: 97120 - DNA, 150 bp, Glycine max
  Peptide Sequence Number=SeqID_213898
atggttctacccaatgataaaagcaaaaaggcagaagctgccgaaatgctcgttgctcaaggaaaaagtgaagcaaaagatatgagagtcattgttgaagagtttctttttgaagctcgttacaaggagcttcacatgttcaacccatga

SEQ ID NO: 97121 - DNA, 420 bp, Glycine max
  Peptide Sequence Number=SeqID_213899
atgactaagaatgatctattttgtccatggaatcacatgcaattgcaaatactaggtgatggaagtagcttcctagactatggcttgagtgaagctgatcctgaagttcgcgcaattattgacaaggaaaaggaccggcaatttaaaagtcttgagcttattgcttctgagaattttacatctagagcagtgatggaagcagttggttcctgcctcacaaataaatactcagaaggattgccgggtaaaaggtactatggtggcaatgagtacattgatgagcttgaaaccctatgtcaacaaagggctttggctacatttcatgtagatggaaataagtggggtgttaatgttcaagctttatctagttccccagctaattttgcagtattcactgcagttcttaaaccacatgattga

SEQ ID NO: 97122 - DNA, 384 bp, Glycine max
  Peptide Sequence Number=SeqID_213900
atgaaggaagatgattttaggaactatgctgaactttgcttcaaggaatttggcaatggggtgaaacattggattactttgaatgaacctaggagtgtgagcaagaatggctatgcaaatggcaagtttgcacctggtcagtgttctgattggctaaaactgaattgcacaggtggtgattccggaactgagccccatttgacttggcgctaccaacttcttgctcatgctacaacagccaaactgtataagaccaagtatcaggcatctcaaaagggtttaatagggattaccttgaattctgactggtatatgccggtttctaaagagaaatctgatcgagacgctgcacgtaggggccttgacttcatgtttggatggtaa

SEQ ID NO: 97123 - DNA, 624 bp, Glycine max
  Peptide Sequence Number=SeqID_213901
atggccaccacaatgccgaaattcaagcgaaaacttgtgatgggtgcaaatggtcgcaccaaccccttggtgtggctagtggcgattatctgcaccatcatagcagtagcagtggtagttgtaggcattgtagtgttcattggttacatagtgatacaccctagagtgcctgtgatcagtgtcaccaatgcacatttagatcttctcagaaatgactatgctggtttgctccaaacccaactcaccatcgtcgtgactgcgaagaatgggaatgccaaggctcatgcatccttctccgcgatcaccttcaacatcagctaccagggccaagacattgctgtgcttgttgctgacccttttgaggtgccaaagaacagctcaaaggacctcagctatgttgtccaatcttcttctatacccttgactcctgatcaaatggaggaagtgaatgatgcttggaagaggaatgaaattgagtttgacttcaaaggggctgcaaggacacagtggagggtagggcctttagggtctgtgaagttcttgtgccatcttgattgtgacctcaagtttcgccccgtgaatgggacttacattccctcgcggtgcacctccaaatcacactga

SEQ ID NO: 97124 - DNA, 165 bp, Glycine max
  Peptide Sequence Number=SeqID_213902
atggagacaggtggaagcaacagagctttgccagggttctttgttgatcatgtcatggctagagcaagaaatgagaagcattctacggaggagaccttgaaaacatcaatgccgcggccagaattctggtaccatgactccccatttacaccaccaaggcaataa

SEQ ID NO: 97125 - DNA, 222 bp, Glycine max
  Peptide Sequence Number=SeqID_213903
atatcacttgagggcacatcagagcctcctacaccagtggtagacctctcctcaccacaacttgtagctgacccttccactcctttacttgacatactagaggacgagactacaccagtcctggcactgaacacttctcctccagctactccagtacttcatctgacagataaggaggatgctcagactcaggatacacaggatctgtcccaggaattttaa

SEQ ID NO: 97126 - DNA, 861 bp, Glycine max
  Peptide Sequence Number=SeqID_213904
atgctggaaagcaacccatttaatggtgttgctcatgaagatcctatgcaacacctgaggaagttcatcaagttgaccaactcgatgagacaaaattgtgtaccaatagagtacatcaggctttatgcttttcctttctctctaaggggaaggcatgagattggttgtgctcactacctgagaacaacatcactacatggaactagtgcacaaatgccttcttataaagtgtcctcacagaacaagacaagtttggatgttgcttgtgggggtaacctcatgttaaaaacccctgcatatgccatcatgatcattgaagatatgtgctccaacccctataataactcatgggataggaggattatgaagagaggcattaaccaggtggagaaagatgattctaaaattaaattgggaaaacgtatccaagctttgaaattgaagattgagacacttatgagagctcaagcccaagtccccttcattgcaccttcattcccaacctatgatagatgtgggattgtgcatgggctagaagaatgcactattgatgacaagctaggtgcaaccatgctaggcaacctcccttcccaacctaaaccaaatcctaagagggaggatgtcaatactgtgatgactagaagtaagaggattcaacaggactccgaggagaataaaagttctttcccaaaagctatagatgacgtccttactgagaaggaccaagcacttaggaaagttgaggttcctactgatgggaatccagtggcaaacaaggagggtgggaatgaggtatcaatacctcctcaggttcagaatattgaagatgaagattcaaattatttcaacaatgttctttaa

SEQ ID NO: 97127 - DNA, 303 bp, Glycine max
  Peptide Sequence Number=SeqID_213905
atggtagaatcatcaaagaagcgcaagggttcacttcctccaccaccactacagcacttcaacattcctcttgatgatgaaccttttgtcaaagttaaacgttcctttgccattggagctgctgtagttgcctcatttggttatcgaaaggatctagatggtcaatggattcgtaaacaagaccttccatctaatgctcctgaagaatgcacaccttctccaccaccaagggatccctcctcttctttgctaaatgatgttctcaacaagcttcaggatcttcatgcctttgtcggtgactga

SEQ ID NO: 97128 - DNA, 312 bp, Glycine max
  Peptide Sequence Number=SeqID_213906
atggagcttacatcaggtttggacaacaccacctctgatgaagaaggagaagaggaagccaacctatgtcagatgactgatcatactaaactaaaagaaatccatcaatctaaagatatcggttctttgatagaaactactcaaaacaatgaagcttatgataccttgaaaagggagctttgtctacttttaaagaatgaagtcttaaaaggtcaacctcaagatgttgtaaaacacaatgaggagattgataccttaaagaaatccttaaccaaatttgttggaggaactgaaaatcttgacaaattgtag

SEQ ID NO: 97129 - DNA, 354 bp, Glycine max
  Peptide Sequence Number=SeqID_213907
atggatcaagaggatcacattaacacaatcaacttggaagaccttgattatctcgatcgactatatgatgacttgaccctgggctctgttctcaaatcaaattggatctttactcttcaaccttccaccttttctttagtcgagggtaacaactttctcaacaacttccttgtatccaccgaaacccctttcccgatccaagtcgaagactattgtttgactaagcttcctccttatgtacaaacatggcctcacacgattcctaattgtacttcttggtatgataaggagtcaccattgcttgaggctgttgaggaatttgcaaggatggatccattgaagcaagcattttga

SEQ ID NO: 97130 - DNA, 285 bp, Glycine max
  Peptide Sequence Number=SeqID_213908
atgactaacgttgatgatgaaattaatctgctacttcataagaaggaagcattggagatcaatctgaggcttggtgaaaagggactcaccaaagacctaaagtcgtggaatgccatgagggatcaactctcccagcttgagaatgagttagcagctgatctagcgaatgctggaaccacttcatcgacaattgttctagatacttcctctattgttccaaatacttcctctgttgttctagactccatggcaactaatgatactgcctccgcttccaattattga

SEQ ID NO: 97131 - DNA, 630 bp, Glycine max
  Peptide Sequence Number=SeqID_213909
gcattagccgattttttggctgagtgtgtagaaattgaggatgttatggttgaaatgaataaagatatcaatttacagccttgggtctcaatgtttgatggatctaagacaagggaatttgttggtgtaggaatcaaagttgcagatctcgaaggaaagggtgatgattaccatgggagcacaatgtgtatatatcttgggagattcacaattggcaatgaattagcccaaagcgctttacgatataaattgttggatgaaaacactcaattgaaggaatatcctttagccaattgtcatgcgttggatgtcgataaagcgttgaaatacatgatgggcgatgatgttctttttcgaagatctgtcaatggtgtgttgctcaaatgtattaataaagaagatgctttaaaggtgataggagaagtccatgagggtacatgtggagctcatcaatctagatacaatatgaaatggaccatcaatcgatatgacaattattggccaacaatcatcaaagattattttctgtatgccagaggatgtgaggaatatcaaaagcatggcaatatacaaagagtccctgttgatgagttgaatttggtagttaagccatggccatttaaaggatga

SEQ ID NO: 97132 - DNA, 222 bp, Glycine max
  Peptide Sequence Number=SeqID_213910
atgcatgctttgttagggtcattcaacagtggaaactggtctgattctgatgaccttgataggacagggctaagttgtcgtactatcatgaggagggattttcacaccatatacctattcactgaaatagcttaccaagtaacacaagttccccgagagtttggtactcggttcttaccattttatactacttgtgtgatccggtgcacttgccggaagtga

SEQ ID NO: 97133 - DNA, 189 bp, Glycine max
  Peptide Sequence Number=SeqID_213911
atggttaccactatttctgcgataatgaacagatgtgatttcatagtagaagattatgtagacaatgagggtgagacacccaacaatacctcccctctaatatctaagtacttgggagatatcgtgaagcccacggtgttgaatgagatccaaaaggctagagaaaaggagcgtcatcagcatgactag

SEQ ID NO: 97134 - DNA, 342 bp, Glycine max
  Peptide Sequence Number=SeqID_213912
agaattcaagggactaaccgcctaagaattctttgtcctaacacattggagggtacatcctttgtggtacaagtagagggtacatctacttgggttgttatactgagaacaagagaggatacatctcttgtggatcagttcaagtggagggtacatccacttggttgttcaaagagaacaagggagggtacatcccttgtggatctttggcttgtaaaggattttacaaggttgaatgaaatctcaagaaccgttggttgcttagggactggatgtaggcacgggttgttgccgaaccagtataaatattgtgtttgtcttcttcttccctacactctttaa

SEQ ID NO: 97135 - DNA, 237 bp, Glycine max
  Peptide Sequence Number=SeqID_213913
atgatgctccacagcctaaatcaaaggctcctgctaggtggattgtcgtcaagacaaaaaggaactactgagtgcggctactatgtcatgcactggatgtccaccatcattttaggaagttttcgaaataattgggaagcgtattttaatgaccctagaccattggagcctgagagattaaaagcattgcggatccagtgggcacagttttatctccgagttagagatcaggcctag

SEQ ID NO: 97136 - DNA, 327 bp, Glycine max
  Peptide Sequence Number=SeqID_213914
atgcacatcaggccgcaaacgcaccgccaccaccttggcaggccgatccagctgggtcactgggtgtggagcgttatttatagcatttggttcaccagcaggtggccaaccaccatggacagcctcagtcagcaggggcagggttccgccccttttgtatgccctactccgaagcagtttggggctgaggtcgcatggcctggagactggcccgacgctctggcaggggaggagcctgcaggatctcccggtgaggcagatgaatcacgtatggatgaagatatgactgacctgcttggtttcttgggagggagcggagccacgtga

SEQ ID NO: 97137 - DNA, 384 bp, Glycine max
  Peptide Sequence Number=SeqID_213915
atggttggaaccaaaaacacattttataatgtgatggactttggtgctcatggcaatgggaaatctgatgattctcatgcattttcaagcgcatggcaacacacatgtggaacacaagggacatcaactctagttataccaccaaaaggagtattcttggtgacgaacataaccctgaaaggaccttgcaaggccagaagtattcatattctgcttcaggggaaaatagttgcacctgccaaggatgcatgggcaaaaggtctggatcctttgattttgatctcaaacctaaacggtctcacgattgatggaagcggaggacaaatcgatggcttcggttctacttggtggaaatgcagaagttgtcttcgaccaagggtttga

SEQ ID NO: 97138 - DNA, 159 bp, Glycine max
  Peptide Sequence Number=SeqID_213916
atggccaaaatacaaggcccaaaagaaggaaaaacctattctaatatttacaaagtagagaggacccagccttggtccatgggctcagaaatttatcctggggattgcattagaaattataaagctaaggacgttgagtcctatgaaacaagccaatag

SEQ ID NO: 97139 - DNA, 651 bp, Glycine max
  Peptide Sequence Number=SeqID_213917
tatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaaagagccgagatatccgttgccgagagtcattgtatgtaaatgttgtgtcgtga

SEQ ID NO: 97140 - DNA, 162 bp, Glycine max
  Peptide Sequence Number=SeqID_213918
atggatagatatctagttgaattgtttgattcgggaggagccacaagccaccggttgcctaccgaaacacgtatggggtttaggggaaaggttatcccgaataattgggtagctatggttaaacctgggaattctcgaaacaacaaggtctactcgacatga

SEQ ID NO: 97141 - DNA, 354 bp, Glycine max
  Peptide Sequence Number=SeqID_213919
atggtgttccaaaattgtaagcaactcagcacaaatcctatgtccgaagggtatccacaaaaggcgattcttacattagtcataaatagcttaatatggaagagctttttgctgttagagctactatcatgggatctaaagcttgttcttgtacaaatagaggattacaaggacttgggtgagtatattaatgacaaggtgcaacggtttgtagaatggtttaaatttgaatttgatctctcaattttcaaattccctttgaatcagaagccaactcaaaatggactgcaattctcaagatggttgatgggatgtggatacaaaaataaaccttcaagggatgaagatgaatga

SEQ ID NO: 97142 - DNA, 165 bp, Glycine max
  Peptide Sequence Number=SeqID_213920
atgaggcaggtggcgagagttagggatggactcgaacgttgcgagagggaggccaagtggcgaaagggagtgtgcgtcgcgaaagggagggtgaggcgtcaaatggagagaaagtcgcaagagggaaggcaggggccgagaaggatggataatgaagatatctaa

SEQ ID NO: 97143 - DNA, 162 bp, Glycine max
  Peptide Sequence Number=SeqID_213921
ttggaatgggaggaagtccagagggtaacaagccgaagatgggagcgagaacaaggatgcagagaggcagcagaggacatgtctgaagatttgtcagaaggggaaaaaggtgatagtgttgtggagatggtgcaaagtgataccccaaagaaaaaattctag

SEQ ID NO: 97144 - DNA, 306 bp, Glycine max
  Peptide Sequence Number=SeqID_213922
atgcaggtcgaaacgccggggcgcgaatccgaagaggaagccaaaccgcagcaggtggcggcggatgaacgcacccgcgtgatcatcagcgggctgggcggtgaggccaatatagaggacgtcgattgctgcttcactcgcctgcgcgtgcgggttaaagagatgaaagaagtggtggatcaaacgctgctgtcgaccggcgctaacggggttaatcgcgtcagcgagcacgatgtgcaggtgatctacgggccgcaggtcgagaagatcgctaacgaggtgaaaagtgcgctcggcgtcgcctga

SEQ ID NO: 97145 - DNA, 642 bp, Glycine max
  Peptide Sequence Number=SeqID_213923
atgcagcctgagctgattaccgccagcagcatcagcgcgctggatgcggtaggcctgactgaacccgatatcgttacgctcaaccagctagtaggctacgtcagctatcaggcgcgtgtggtcgccgcgcttcaggcgatgatgggcctgccggtgcgctggatccctggcgtcacgccgcccgccgacgccgatgcggcgctgttcagtcaggctgctgcctggcagcacgccatcaagccggttgagctgcgttatgccagtgctgaccagctggcggcggtgaccttttgtcagggtatggccggactcgacgacgctgtctggctgctggtgcacgatgcccaggcgctgtatggctgggcgacgctgcgtcagcggcttgaggcttatggtggggaagaggaacagctggcgcaggcagtcagcgcgcgcgtactgggctgccgacgccagttcgcgcagctggcgaacggctggcgcgcgcgtttgctgcacgaggtggatcaggccagcgatgacagcctgacgcagcaggtaatcgcgctgagcgcccagcttacccggctgccggagcgcttcagtgctgcccatctgcagccgctgcggtggcatttgccagctggcaggatcgactgctga

SEQ ID NO: 97146 - DNA, 133 bp, Glycine max
  Peptide Sequence Number=SeqID_213924
gatgggacatcaaagtttctcgtattcgtcaattacaaatcgcattggactacttgaaattttatgaaatagaaaggggcaatatcaatgttattaaacctggaccagttatcaacttagttgacgatgtggg

SEQ ID NO: 97147 - DNA, 910 bp, Glycine max
  Peptide Sequence Number=SeqID_213925
atgtccatcttggggaatctcctactagaaagcaaccagtcacctgatgtcacatcaaaagctaccgcctatgctgaagaagttaaccatagttcatttatcaatgaacaattgcctgaagaagtcacctctaaatctgtacctgctgcaggcattgcaagtgatggttcatctgagaatgacgaaaatgaagaaaatgtaaatataatagatgtaaaggaaggtgatctgaatgatgggttgaggaatatgtcagagaagctatctgctgcactagtgaatgtcaatgccaaagaagacttggttaagcagcatgccaaagttgctgaagaagccattgcaggctgggaaaaggctgaaaatgaagtggctgttttaaagaagcaacttgacactgtcattctcaggaattcagttctggaagatcgagtcactcatctagatggagcacttaaggagtgtgttaggcagctaaggcagacaagagaagagcaggaagaaaatatctatgatgctgttgcaaaaaagacacaggaattggaatcagccaaaattaaacttgagaacaaactcactgagctccagaacaaattagatgcttcagaagccaagtcttcttctattgactttgatatgtgtcaaaaggttgaaaatttagagagagagaacatggctctcaggcatgagatccttgttcaatcagaagatctagaagtccgaacaattgagagggatctaagcactcaagctgctgagacagctagcaagcagcatttagaaagcatcaagaaagtagccaagcttgaggccgagtgccggagactgaggagcatggcttctagagcttccttagctaatgatcataagtccattgctcagtcctcatttagtgttgaatctccaacagata

SEQ ID NO: 97148 - DNA, 264 bp, Glycine max
  Peptide Sequence Number=SeqID_213926
atgactatgaaattttgtggagaattagacattagcaatataaaactggggaaaaaggtttcgttccaaaacatactttctatgagtgaagagttcagaattcggctatcaaaccaagtggtagtcaaggtacacttaagattctttgggagaaaatccttatatcgtaaaaacaggtcttatatgcctagaaacaagattgtaggaactggtttcactccaaaattcatctcgggtaaaaatcaaagttttttgacgccttaa

SEQ ID NO: 97149 - DNA, 265 bp, Glycine max
  Peptide Sequence Number=SeqID_213927
gctaagacaagaaagagggcttcgaaccattgggcgaatcgagctggcatatggtcgaatcgaagtcaaggcaacaagatttctggacttagcgcaatttctgacaaaacttcacaaaattagttcgacttcgagcaatatggataaccgttctaaggagcagttatgtgcatgcaaggcagatttcggggtcgcaaatcatctctacaaatccttatacactcaaagtatccagcgcagagagaaacgagtacgcaaggggaat

SEQ ID NO: 97150 - DNA, 267 bp, Glycine max
  Peptide Sequence Number=SeqID_213928
atgacgagattctttggtgcaatgtttttaaatcaaagtatgggggctgaaggggattgggaaattcagatgttgtaccctcccaaacaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 97151 - DNA, 672 bp, Glycine max
  Peptide Sequence Number=SeqID_213929
agccttgagtcgccacagccttacgatcatcagggccggttttaccaggctgagcaggctttctctgccatcaaaccgctgcaacataagctgccgatctatttcggcggatcgtcaccggaggcgattgacgtggcggcgcggcatgccgatgtcttcgcgctgtggggcgaaccgttaaaaggcgcggccgagacggtacgtaatgtgcgtgcggcggcggccgcgcaggggcgccagattgcgtttaacatctccttccggcctattctgggtaacaccgaaaaagaagcctgggagcgcgccgaacatatccgcgccaccgcagagaagcagctagcggagagcggctatacctttggtttgccgaagccgcagagtgttggtgcgcagcgtctgctggcggcggcgcatgagagcgatcgccacgacaaagtgctgtggaccggcgtggcaaaactggtgcagggcggctacaactccaccgcgctggtcggcacgccggatcaggtttctgaggcgctgctggattattatcgcctcggcattcatagcgtgctgatccgcggatttgacccgctgaatgatgcggtggaatacggccgtgaactgctgccgctgacgcgtgaaaaagtggctgcgctcagcgcaactgaaaaaaggagcgcctga

SEQ ID NO: 97152 - DNA, 660 bp, Glycine max
  Peptide Sequence Number=SeqID_213930
atgacaaaagtgggcattgatattggaggtgcttttactgacgtagtggtctataacgaagaaaatggagaaataagctgggtaaaggtagagactacgccagatgatccttcaaatggtgtacttgaggcgatagacgagactaaaataaatttaggctatgtaaatactataattcatggtcagacactagccataaacacaatagtagaaaggaaaggagcaaaggtaggtctaatcacaacaaagggttttagagatatcctagaaatccaaagggctaatagaagagatatgtacaatttcagatataagaagccaattcccttggttccaaggtatttgaggctagaggttggtgaaaggataaagagcaatggtgatattttactgcctataaacgaaaacgaagttgttgaggcagttaaaaaactaaaagaggaaaacgtagaagctattgctgtaggttttattaattcttacgttaatcctatacatgaacttaaggcaggagagattattaagagaattgattctagtattatggtaacactatcccatgaggtcactagagagtggagagaatacgagagaactagtaccgccgtacttaatgcatacgtcatgccaaaaatgaatagatacttgagcaagttgaaa

SEQ ID NO: 97153 - DNA, 336 bp, Glycine max
  Peptide Sequence Number=SeqID_213931
atgaagggagggtcaagggctccactctctactgaactcatgagttggtttttgaagattctgctccgattaaagggtttcactccctgttgtggtccgatggaaaatggttgcaactcatggtggtcgccggtggccgtgggtggaggaggagcggaatggagaaggaagagagaaaggagacaccacttcaaggagaagatgagtctagaagaagctcgccaccatagaaggccatggataagagcttggaggaagaaagagatgaatgaagggagagggagagaagagcacaaaattttgtgctctaaaagagctctgaaatcggaagtttaa

SEQ ID NO: 97154 - DNA, 201 bp, Glycine max
  Peptide Sequence Number=SeqID_213932
atggcagaaatcctccaaggtaagacgatgaccggtcacgattggtcgcatatcatttggctcttacttgcaggttcaagtgggcaaacgctaacccataaggaagaaggggacatggttaatgttcccctccaaaaaaaaaaatggcaggtacagcataggagattcaaaataggtgcccaaatgcaattccaagcttag

SEQ ID NO: 97155 - DNA, 156 bp, Glycine max
  Peptide Sequence Number=SeqID_213933
atgaatttctttttcgttcatgcgtcctccacccaaagagtttggagctatgcttcatcattgactagtgaggaccctctagtgcaatcctccattctccagggtttttcatcgtcaaaaaaagaaggagtagagatgagagtcgtcatagactaa

SEQ ID NO: 97156 - DNA, 557 bp, Glycine max
  Peptide Sequence Number=SeqID_213934
atgtggtgtaaactttcatgctccattgtgactttctttttgttcttttttttgcttttaaggaaaatgcaaggcatgagcaactatgtgtcaggatcatgcatgagtgaacataacatgcgaacaatgaaaataaaatccgacttcgagccttggctcggatatgccactgaagggaaagcagttggtggtataccccttgaaaacacttcggaaggcccgcagtatcaccctcagctacacctcttgcattgcacaacaagtaaaaaccctcgtgctatggcagaaatggaaaagttggatcatttagaggaagggctcagggccattgaaggaggtgaagattatgcctttgctaacctaaaagagttgttcctagaacccaatatcatcacccctcccaagttcaaggtgctggactttgacaagtacaaggggactacttgccccaagaaccatctaaagatgtattatcggaagatgggtgcatacgcaaaagatgaggaattgctgatacattccttccaagaaaatcttactggggtagctgttacctg

SEQ ID NO: 97157 - DNA, 312 bp, Glycine max
  Peptide Sequence Number=SeqID_213935
atgaaggcagatggagagatcaccagtgaatctgaaatcagtgaagaagtggaagaagagcttgtggaagaagctttgcaaggaagttgtaccaatgttgcaagttccaggtcagtgtccaaactgaatttggatactaagcctcatcctaggccatacagacttcagtggcttagagaaaatgaagaggaatttaaagatgtctttcccaaggagattcctcatggactgccaccttcaagaagcatagaacataaagttgatctccttccaggagcttcattgcctaacaaagccagcttacaaaagtaa

SEQ ID NO: 97158 - DNA, 522 bp, Glycine max
  Peptide Sequence Number=SeqID_213936
atggcacgcagagaccaagtttggtcattctgcacccatgatacgcggagataccttacggttatctgcacccctttgctaggcagacacagttgtgtccgatggcacgcagagaccaagcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacggttatccgcacccctttgccatgcagacacagttgtgtccgatggcacgcagagaccaagtttggtcattctgcacccaagatacgcggagataccttacggttatccgcacccctttgtcagccagaggcggtgggcccgatggcaagcagagaccaagtttggtcattctgcacccaagatacgcggagataccttacggttatccgcacccttttgctag

SEQ ID NO: 97159 - DNA, 494 bp, Glycine max
  Peptide Sequence Number=SeqID_213937
gttgaccattgacttagcttatatcataaggaactattggaatgcgaatgaccaaacagttaattttccagaggcaaggaagaccaagcttagagcagctgatgttccctctttctttgcaacaataactggcatccctgcatcttctacttcatccccacttccagctttagcagacttatctgcccagagctttgagacttcagatgccaaatttcaaagcttgccaattatgagtgtagagcagttcattgagaaagtggcctggcctggagcccgaccttcttttgtgggacataatgaaagttttacagcccaggcacctcaaaagcatgagccagaaccagaaaacgatcactcatctgaagccaccatccctggagctgttgattttgcaaaaagaagattagagacgagatctaatgaggctgctcatcctggactagtgccagcatcagctgatgcaccattttatctttttgtgaaaaatggat

SEQ ID NO: 97160 - DNA, 141 bp, Glycine max
  Peptide Sequence Number=SeqID_213938
atggatgttatggactggtgtgaggatttgatttgggcaagattggatgaggggaagtgtggttttcgaaatctgcattttgtgcagatttttgctgtgaaattgtgcagcaggattttgcacagtgcagaaaaatactag

SEQ ID NO: 97161 - DNA, 424 bp, Glycine max
  Peptide Sequence Number=SeqID_213939
atgaaaatttctgttagtgatctatacaatctcgcaatagggagttcaatattaggttctggtggtggtggaaatccgtttttaggatataaaattgtcaaagcaaaaatgcttcagatgaatattgattatgttgaatatactgacgaaattgatgaagatagagatttcataataggagtaggcggtatggggtcgccattgataggtggtataaactcagttgtcccatttatggcatcgttaatgagtaagaaaccattagtagatggagattatgagggtagagcttttccagaattatatatgactactatgcattttgcaggatataaggcaacacctttgagtatttgcgatgagcgtgaaaattgctttattatagacgctgttgataacttcaaggcagagatcattgcaagga

SEQ ID NO: 97162 - DNA, 216 bp, Glycine max
  Peptide Sequence Number=SeqID_213940
atggaagcgcaatgcaaattcaaacgaccatatcttgtgactcggatgtctgtttcatgccaacaatatattgagacgcttgaaattgaacaaaggaggctctcgagaaattccaatggtcttaaattttcccttggatgttcgattcatgggcatattatatcgacatgcccgaaatttaacatggaagcacaaggcaagtgcaaaaggtcataa

SEQ ID NO: 97163 - DNA, 172 bp, Glycine max
  Peptide Sequence Number=SeqID_213941
atgaatatcttgatggcagacgatcaagggtgggaacaagagttaagtccttacaatcaatatgaagaagaaaaaactcctaatcttgaaagtgtgtttgaagaattcttggcataccatgatagctcaaaagctaatcaaaattcaatgaaaaatcatgaaattcattttg

SEQ ID NO: 97164 - DNA, 674 bp, Glycine max
  Peptide Sequence Number=SeqID_213942
atggatcgaagttggatgaaatcatcatgcattagtgatgagtatcaaaatgaggttgatgaactcctgcaatttactaaacgtaatacaccatatttgcgtggaaaatttttctgtccatgtgttaactatggaaatgggagacaccaatcaataaatgatattagatcacatcttatatgtgaggggatcattcccacttacacaaaatggatatggtatggcgaattgcctgacatgccacaagtccctcacattaagtcagttgatgaagatgtcggacatcgtatagaagacatgattcgcgaccttggccaagatggttttcaacaggcacatagtgctttgtatgacaaaatagaaaatgattcaaagaagcctttgtattcggggtgcacaactttcacaaggttgtcagcggttttagctttggtcaacttgaaggcacgatttgggtggagtgacaaaagcttcactaaattactagtgttatttaaaaatatgattcatgaagataacacgttgcccaaaaatcactatgaggccaaaaagattttgtgtccagtgggaatggagtaccagaaaatccgtgcatgtcctaatgattgcattttgtacagaaatcagtttgcagaaatgccttattgccccacatgggggaatcacgatacaag

SEQ ID NO: 97165 - DNA, 1363 bp, Glycine max
  Peptide Sequence Number=SeqID_213943
atgggcgtcggaacgtcacatcgggtgacgccggcgcaattcctgccttttcttgacgcgctgctcagcgatggcggcatgttcatccgcaatggctccggcgcgttgatgagcgcatgggcggccgccgggcgcctgattggctactatgaaccgcacatgaacccgtgggatgccttacccggtctggtgttgatgcgcgaagcggggggcgtcgccaacgactttctggcgcaggaggggattcgccatgtaacgataacgaccctcacggacgaagcacatcaatcagtcaagcctccgaccgtcggagaaactattatgtctggaattattcattttttccgggcgtcgccgccgcaagcgggcgccgcgtttgatgaaaaacgttttcgccgggtacgttggcaaacgtttattgctatgaccctggcctacgtgacgttctacgtctgccgcttatcgttcaccgtggcgaaaagcgcgctggtggaattaggcattaccccaacggagttgggaatgattggctcgacgttattctttagctacgccatcggcaaactggttaacggttttatcgccgatcatgccaacgtggtgcgttacatgagccttgggctattgctcagcgccgggatgaacctgctgatgggcatgaccaccaatgccatgctgctggctatcttttgggggattaacggctgggcgcagtcgatgggcgtcggtccttgtgcggtttcgctggcgcgctggtacggctttaaagagcggggaacgttttacgccatctggtcgacggcgcataacatcggcgaggccatgacctacatggtgatcgccgcagtgatcgcgggttttggctggcaaatgggttacctctccacggctgcgctcggcgccgctggcgtggtgctgttgctgctgtttatgcgcgattcgccacagagcagcggctttccctccattaacgtgattcgtgatgaaccgcaggaagagactgaagcgcggggatcggtgttcaaaaaccaactgctggcattgcgtaacccggcgctgtggacgctggcgctggcatcggcatttatgtatatcgaccgttatgcggtgaactcgtgggggatcttctttctggagcaggataaagcctattccacccttgaggcttcaggcatcatcggcgttaacgcgatcgccggtatcgccgggaccatcatcgccggcatgctctctgaccgctttttcccgcgcaatcgcagcgtcatggccgggtttatcagcctgctgaacaccgcgggtttcgccttaatgctctggtcgccgcataattactacaccgacatcctggcgatgatcgtcttcg

SEQ ID NO: 97166 - DNA, 204 bp, Glycine max
  Peptide Sequence Number=SeqID_213944
atgggtcgtaagcaacgctctaacctttttgtggatgagctgaggtctagaggtgatggcagtgcgtctgttgcccgctgccggccatccctaggctgctgtggtgtttcgccttgcgcctgcctggggatgcaatacttcttgatgaaagctcgattagtagggggtctgaagaccttgctgggggcaacaggcactccgtag

SEQ ID NO: 97167 - DNA, 1683 bp, Glycine max
  Peptide Sequence Number=SeqID_213945
atgtcgattcatgatgacataagctttagattggaggcttccatgatattgattattgaatctgagaagctagctgtgtcttattctgcatccatggaccagctggcatctgagctgaattctcaaacttttcaggtggataggttgaagaagcagcttaggcatgaagagaacattcatagagcattggagagggctttcaacagacccttgggagctttgcctcgtcttccgccttatctccctccctatatactagctcttctggctgaagtggcagttctagaagaggaaattgttaggcttgaagagcaggttgtgcatttcagacaggatttgtaccaggaagctgtctacatgtcatcttctatgaggaaattggaaaattcagtttcagctcctccaaacaagtcaaatccaacattagatagtcccaagttggataaattgaagtctcttacccaaacagctggtaattcaacagcaacatctgaaactaagcctaccacaacactcactgaggatagacaagggaaagagaatcaatcatgtactaattcttccaagagcaggcagcaatcatccaatcaaatgaacaaaactccaattaaaaacattgacagtcaatcattgcagaaaaggttggatcatccaaaaagaaagcaagaaccaagggtgaacaaccagcaaattgcagatgtaagaaatcatagtccacataaaaattcaccagaagctcagagtccaaatataatttcagaaaatattctgaagtgcttatcaaacattctcttgagaatgagtgccgtgaagaatccaggttctacatgtgacatggcacccttgtgggatctaaagcctcaaaactgtgatgaagaagcagatttttgggatccatatggcatctgtttggaatttgggaagagggatattggtccatacaggcaattatgtgcaattgatgccaaatctttcaatccaaaacgaactgcaaatactttatttttactacatcggttgaaactactttttaggaaagtagcctctgtcaacttggaaaacctcaaccatcaggagaagcttgcattctggatcaacatctacaattcgtgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggaaatttacgttttccaagggaacaaaaaatcatcaaatgacagcaagaagcatatatggactggaactgtcagaaccccttgtgacatttgctctctcttctggaacttggtcctctcctgctgtgagagtttacacagcatcccaggttgagaatgaactagaagtggccaaaagagagtacttacaggcagcaattggattttcaacttcaaagtttgctatcccaaagctgctggattggtatttgctgaactttgcaaaagacttggaatcattgctggattggatctgtctccagttaccaagtgaactggggaaagaagccattaaattccttgaggaaagaaaaaccgagcccttatcacaatttgtacaaattatgccatatgagttcagctttagatacttgatatgcacataa

SEQ ID NO: 97168 - DNA, 2463 bp, Glycine max
  Peptide Sequence Number=SeqID_213946
atggccctgaacgattttttcgctggggagatcgcgacggagcttctgaaaatgctgataaacatctcccggaagtccctactctgccgcggcagcgccgaccagctcatcagctacatccaggacctcctccccaccatcgaggaaatcaagtactccggcgtcgagcttcctgcgcagcgccagtcgcaactcgaccgtctctcggagattctccgctccggcgtcgagctctcccacaaggtcctcgcctccagccgctggaacgtctaccgcaacctccacctcgcaaaaaaaatggacaagctcgagaagaacgtgtccaagttcttggtgggtcccatgcaggcgcatatcatggcggacatacatcacacgcggttccagatggaggagcggttcgaccgggttgataattcggttcgccggttggagaagtacttcgggaatatgaagattggtgttggcggcggagggtgggtggaggaggctgtgaggagcgtggacgaggatgttgttgatagtagctctgctgtcgggttgggtttcgggaagaataaggttagggagatggttatcggaagggaggatctttgggttgtcgggatttccgggattggtggctccgggaaaaccactcttgctcgagagctctgcaaagataatcaagttagatgttattttaaggacaggattttgttcctgactgtgtcgcagtcaccaaatgtggagaagctaaggacgaagatttgggggtatattatgggcaatgagaggttggatgcgaattatgtggttccccaatggcaatggatgccacagtttgagtgcagaagcgaagctcgaactctgattgttttggatgatgtgtggacactctccgtggtggatcagcttgtgtgtagaataccaggttgcaagtttcttgtggtgtcaaggtctaaattccaaacggtgttgagttatgaagtggaattgctgagtgaagaggatgccttgtctttgttctgtcaccatgcttttggacagagatcaattcctttagctgctaatgagaatttagtcaaacaggttgtgactgagtgtggaaggcttcccttggctcttaaggtgatcggagcttctttgcgagatcaaactgagatgttttggatgagtgttaaaaacaggctatctcaaggccaaagcattggggaatcccatgaaatcaatctgattgaaagaatggcaattagtatcaattaccttccagagaagatcaaggagtgcttcttggacctgtgttgttttcctgaggataagaaaatccctctggatgttctcatcaatatgtgggtggaaatccacgatattcctgaaacagaagcttatgtcattgtggttgagctctccaacaaaaatcttctcaccttaatgaaagaggctcgtgctggaggcctgtatagcagttgctttgaaatctcagttactcaacatgatgtactgagagacctagccattaatttgagcaaccgtgagagcattcatgaacgccagcgattagttatgcccaaacgagaaaatggaatgcctaaagagtggttgagatacaagcacaagccatttgaggctcagattgtttcaattcacacaggtgaaatgaaggaagtggactggtgtaatctggaatttccaaaggctgaagtgctgatcttaaatttcacatccactgaatacttcttgcctcctttcatcaatagaatgccaaatttgagggcattgataattattaactacagtgcaacatatgcttgccttctcaatgtttcagttttcaagaacttgtccaacttgaggagcctgtggcttgaaaaagtttccacccccgagttatcaagcattgtcttggaaaacttaggaaaattatttattgttctgtgcaaggttaataacagtttggtggaaaaagaagtagacttggctcaagtcttccctaatcttttagagctcactcttgatcactgtgatgatttgatccaactgccctcaagcatttgtggaatgaagtcactccaaaacttgagtctcaccaactgccacaatttgactcaattgcctgttgaattaggcaaactaagatctctagagatcctacgattatatgcttgtcctgatctgaaaacacttcctaatagcattagtcacatgataaggttgaagtatatggacatttctcaatgtgttaacttgacttgcttccctgaagagattggtagtctagtaagcttggagaagattgacatgagggaatgctccatgattagaaatgtgccaaagtctgcattgtcgttgcaatctctgaggcttgtgatttgtgacgaggaggtatctgggatttggaaagaggttgagaaggccaagcctaataattttcatattcaagtttcagagcagtactttgatttggactggctcaaagagtga

SEQ ID NO: 97169 - DNA, 1230 bp, Glycine max
  Peptide Sequence Number=SeqID_213947
atgacttatctcccgcccaaaattatcaggaacacagtgtatcaagatgcagtgacagtgaacagttttagcttcaatccgaagattgaagagggatctcaaaaccataaatttttgtccagggtgtgccctgaaaataaccttctggattcacatcccttaccccttccacctagagcttcatcaccaaagcaattatctgttgtgctgcatcaatcaagaatcaagcatcacgctactgaaaatctgccttcagtgaaaggtcgatggcagaaaggaaaacttattggacgtggtacttttggaagtgtttttcatgcaaccaacatagaaactggagcctcgtgtgccatgaaggagatcagtttaattgctgatgatcctacatatgctgagtgcattaaacaactggaacaggaaatcaaaattctcggtcaactacaccatcccaacatagtgcagtattatggaagtgaaacagttggcaatcatttgtacatatatatggagtatgtctacccgggatcaataagtaaatttttgcgtgaacattgtggagctatgacagaatctgtggttcgcaattttacgaggcatattctctctggattagcttacttacatagtaacaaaaccatccacagagatatcaaaggtgcaaacttgctggtcaataaatcaggcattgtgaagcttgcagattttgggctggcgaaaattctaatggggaattcatatgatctttcttttaagggtagttcttattggatggctccagaggtcgtgaaaggttccataaagaacgaatccaatcctgatgttgtcatggccattgatatatggaccttagggtgcaccattatagaaatgttgacaggcaaacctccttggagtgaagttgaagggccttcagccacgttcaaggtactgctagagtccccacccatacctgaaactttatcttcagtgggaaaggatttcctccagcaatgtctccaaagggaccctgcagatcgaccatctgcggcaacgcttcttaagcatgcctttgtgcagaatttgcatggtcaaggtgttatagttcgttcacaatcatatacaagaggagacctaggacaaggaggtaattcagctagtcctagagacactaccaaaaatagacgtggcataatgcaagcctccaacagcacacttattcttaacaaaattcagaaatcaatcgggtattag

SEQ ID NO: 97170 - DNA, 1266 bp, Glycine max
  Peptide Sequence Number=SeqID_213948
atgagcattggcagtaggaagcaggcaaggcttcacagatttggccaaaccagttctacactcctccacgaaaacccaagctctcacagactgaaacttcccgatggatttgtgtgtcacatggagggaaggacatatggatcagtttcgttgactggtcctagtggaaaaacatggacagtgcaattgattaagcaggaaaatgatctatttctccatcatgggtggtcgacatttgtggtggatcatcagctagaatgtggtgaacttttggttttcagatatgaaggtcacttgcattttaccgtgcaagtatttgataaggatgcatgtgagaaagaggcagcgtttcattctgaatgcagtcaaagttcaaagataatgagtaccaatgagaaccaggaacttgaactgggtgttggtaaagaactattgcggtatgagatagtaagaccaattagtatgttcagagaaaacgaagaaacctccaaagcatgttcagctaatgatgtccctgtgccttttcacatggacaatagcaaagaagatgaagagactgccatcctgtatagaagtgggaaggacgatcatcgttatattctcagtggagtttcattatcaaatgtatcagcacacgatgagaaaaaagtttcccagtcatttatttcctcttttccatattttgttagaatcatgaaaagcttcaatgtcagtggttcatatactctgaatatcccttatcagttttcgatggcacatcttcccaattgcaagataaagattattcttcataatttgaaaggagaacattggactgttaattccgtgccaacaactagagtgcatactagtcacactctttgtggaggatggatggcctttgttcgtggtaataacataaaggttggagatatctgcatttttgagcttgtgcatgagtgtgaattacgtgttcgcattgctgaggttgcaaaagatgggtctgactgccaggttggaaacctagccattactaggcctagtgcaggacatgctgtaacttccagatgtatgccaatgaatcctaaagtcaactcaaaatgcataagaaaagttgatctatcggataagaagtggtcaaagattggtcaagaaactattttatccattgacttaaagaaatctagtagagcttcaaatacttctaagaagatggggctttgccctcagtcgaaagctgcccataaaaagttgggtaaggtttttctctacttgctcaataggtga

SEQ ID NO: 97171 - DNA, 1320 bp, Glycine max
  Peptide Sequence Number=SeqID_213949
atggtgggccaaaattgtggtggttgccgatcttgggaagaggacatttactggtcccactttcagttcctccacttcgtccaatttctccgtgccgattatgatcaacaccttgcacttccgaaagcattttcagataatttaaagaagaagttgccggaaaatgtgacccttaagggtcctggtggtgttgtgtggaatatagggatgactactagagatgataccttgtactttgtgcatggttgggaacaatttgtgaaagaccactgtttgaaagagaatgatttcctggtctttaagtacaatggtgaatctcagtttgatgttttaatattcaatggagggagcttgtgtgagaaggcaggttcttattttgttcgaaaatgtggtcacactggaattgaacatgcgggtggaagtctcaacaagaaaagggacacggataataattctttggaagaaggcaatatccctccttcaaatgctggtgtggaatgtgctttgcatgagaaatctgtgcatgctaatggtacaaaggagccaatagatgtacctcctgaaactcctcctactgaaaagactttcaatgctggtgttgaatcttctggtgtggagcaatttacacctgatggaggagtcactctggtagctgttccctctgaaactgctaatgggaaaaggatcaggaacattgtttctgctgttaagcatgtccagaccaagcggaggggaagaccagctaaagtgcatgttcgtgagagaacacttgactgggtggctgcactagaagcttctgaaccaatttctacgtctagaagtggaacatatgaggtatacaaatcaaatagaaggcctgtcacagatgatgagactaaaatgatcgagtcattggccaaggcagcatgcaccgaagacagtatatacgtagtcatgaaaccctcgcatgtttacaagagattcttcgtgtcaatgagaggtacatggataggaaaacacatctctccatcatctcaagatgtgattttgcgcatgggtaagggtgaatggattgccagatacagctacaataatattcgtaacaatggaggacttactggtgggtggaaacatttttctttggataataaccttgaagagggtgatgcctgtgtgtttaaaccagctggccaaatgaacaacacttttgtcattgatatgagcattttcagagttgttccggagactgttcctctcactccaatgtctcgtggaactggaagaaggggtaggaagcaagcaacaatgaagtctattcagacacaacttagtccaccatga

SEQ ID NO: 97172 - DNA, 423 bp, Glycine max
  Peptide Sequence Number=SeqID_213950
atgctatctgtcctctgcctcttcccaaccctaacaatcaaaccgtgccgccaccgcacctctgtcaaacctgcgccacaaggtggcagcgctgtcgcgcatcactgcgatggtccacctttgccgttaatgggaatactagacgaagaacaagagagggaaggagaacaatctacggtgatgcgttcgcgtttggtggctttggtgggtgtgatagattggttctatgatgcattgcgcgattgcggcgatgaagatgaggttccagtgatgattgaagttgcccggtggttcgtcgttatctggcgttttcctttggcgaaggatttaacaggggctcacgtttgcttgttggtagcgatggtggtctgcgacggggaagaagaaagagagaggaaggagaaagaaacttggctgccatag

SEQ ID NO: 97173 - DNA, 261 bp, Glycine max
  Peptide Sequence Number=SeqID_213951
atgagaatatataagaccaaaagaagagaacaaagcaagagcctatcgcctagacaaggtcacgcccataagtcacgtgagggaagccatgttgacgccgaggaatatgataaacgacagacaaatgctagcgttgaaattcttaacgttaacgttggaagtagggtaggggatgcacttctttatacaattcctacttgcacttcagctaagcacttcttccctgctccattcacaaactcacttcctgctactttatag

SEQ ID NO: 97174 - DNA, 345 bp, Glycine max
  Peptide Sequence Number=SeqID_213952
atggctccgagaaagcttcctgcaaagagatccgggaaggacaaagcggctgaagggaccagtgccgctcctgagtatgacaaccatcgcttctggagtgctgagcaccagcagcgaagagatagctcgccggcgatggacatcgctggttacccccatggccaagttcgacccagacatagtcctggaattttatgccaatgcttggcctacacaggagggcgtgcgggatatgcgatcttgggtgaggggaggaatcgggccgatgggtttgatgaggagaccatcgcccagttgctgtgcataccgggacaggattttgcctggaccactgccgggagacga

SEQ ID NO: 97175 - DNA, 231 bp, Glycine max
  Peptide Sequence Number=SeqID_213953
atgattgtgaaagtgcaaagggcaaccgctataagccctcctcctatggttaataaggaagactctgatacatctgcaacatacgattctaaagaactaagtagtccaaacaacactaatgatgaatataaagggagagcaagacgtgtgtcagtgtcaccttcattcaatgaaggaggacaatatggttatatgcattacgggattagaatggagtacaatggcatataa

SEQ ID NO: 97176 - DNA, 339 bp, Glycine max
  Peptide Sequence Number=SeqID_213954
atgctaagagacgaaagcgtgggttctagaagcgccaggcacagcgccaccgccaccgccaccgtctccaacaaggttctcgtcgccgtcaaggccgagaaggtcatctccaacaccgcattagcctgggctctcactcatgtcgctcactccaccgactccatcacgctcctcgccgtttactcttctcacaaaaccggcagaaggttctggaatttttcgagactggccggagactgtacgaacggaccggcgggaaagttgccggagcaaatttccgatatctccgagtcctgtgctcagatggtgcttcagctgcacaatcaaatcgaggattga

SEQ ID NO: 97177 - DNA, 2004 bp, Glycine max
  Peptide Sequence Number=SeqID_213955
atgttatgcgacgtcgttttagatggacaatacaggggtagcttgaaaaagaacaacaaagaaactagatccagctcattagacatacttgagattgagaactttatattacccaattgcatgaggaaattaaagcaagaggtaaagcattgcacggatgaactcaactgtagcatagtggtgatgaatggttcacaggcaaaaatcctcaggcttaacttacggtcttccaatgaacttcaaactccttttttctctgctaactcttcaccaggtatagaaattgcaaagctaaaaggcagaagattgaagcattctaccccagtgggtagccctgaagaagcaggtacttctgttacaagaaacataggagtaaattcagtgtcaagttctgactcgacaacttctcttttcctagtctatgaacaaaaccctctgtacgagggtcagggccctgagaaaagaacagacgaatcaatcaacgaaccaacaaaagattttcatgtccagccaccattatactttgatcttgaaagagatagccctcccccttcatggacacgtccagcatcatctgtggccagtgataacaagactatattttggattcctcaaaaccacaatattgtagacaagtttcagaaaactaaaaacaacagtgttatccaaagaactaaatccccaacttcgaaaactttacttgagaattttatacgttgtgatcaagagatatggacaaatgaacttgggtttgaccaagctcaaagtagaagttatgtccccaacttgggcatcagagataataactcagttcctttgggcagaactacctctatacctcctcccttatgctcacagtgtaagaataaagcaccagtatttggaaagcctccaaaacggttttcttacaaagagctagaggaagctactgatatgttctcggatgagaattttttggctgaaggtagatttggtgtagtccaccagggaatactcaaagatggtcaggttgttgcggtgaaacagttgaagtttggtggttctcaagcagatcttgatttctgcagggaagttcgggttttgagctgtgcacaacacagaaatgttgtgctgttgataggattttgtatagagagcaatttgaggatattagtctatgagtacatatgcaacggatccttggacctctacttatatggagatgagagtatgcctttggattggaactcacgcttaaagatagcaattggaactgcacgaggcttacgctaccttcatgaagattgtagagttgggtgtatagcgcacagagaccttcgacccaaaaatattctcgtaacacatgactttgaacctatggtggctgattttgggcttgctagatggcactcagaatggaatatagatactgaagatcgcgttataggaacttcagggtatcttgcaccggagtatcttgacgctggaaaccttacatataaagtagatgtatatgcatttggaattgtattattagagttaataacaggtcgaagaattagcgagttggaacagttcaatggacactcgtatctttctgaatggtttcatcccatacgcatgttagagcccggtcatatcttacaaaacgttcgttctctcaaaccatgctttgattctaaggagtcagtggaatttaatcttcagttgcaagccatggcacgggctgtttcgttgtgtctacgtgtggatcctgatgcaagacccccaatgtcaaagatcctgagagtgttggaagggggtaatccagttcgtcctatgggtttagacatcaattcagttggcaacacaagtggccatttaagtggtttgaagtcgcacactccaccaaaagctagaggatctattgttggcaatatagttctgtttgtgagctgcatagtatcagttatccatttgaaacgtggaactctctcgtacgcttatacaaactttcagacaagcacagcacctggtggaaattag

SEQ ID NO: 97178 - DNA, 423 bp, Glycine max
  Peptide Sequence Number=SeqID_213956
atgtgcctatcgaaacatcaaggggggttgggaataaaaaatatcgttcatttcaaccaagctctccttggtaaatggaggtggaggttgatctcgggtggtgaggacttgtggtgcaaagttttgaaatcaaactatggaaaagaatcatgtggaaagttttgcaggagatcatatagggattcaatgtggtggcgagattcaggccttacttgtggtgaaaatgtgggtttgataacctctgtgggtggaaagttgggtgtggaagttaagttggagatggggactgttcgagtgggagatttctttactaaccaattttttgcatggtattcaagcgacgccattacaatagattgtgaaggatgctggaatgtggaaaggggatccaacaaggctttatactgtgaaatcagcatatag

SEQ ID NO: 97179 - DNA, 876 bp, Glycine max
  Peptide Sequence Number=SeqID_213957
cagcaggctggtattgatatcgtcagcgacggcgagcaaacgcgccagcacttcgtcaccacctttatcgaacaccttaacggcgttgactttgaaaaccgcaaaacggtgcgcatccgtaatcgctatgatgccagcgtacccggcgtagtgggcgaagtgagccggcagaaaccggtctttgtcgatgatgccaaatacctgcgtcagctgacgcagcgtccaatcaaatgggcgttgccgggcccgatgaccatgatcgacacgctgtatgacgatcactataaaagccgtgagaagctggcctgggaattcgctaaaattctcaaccaggaagcgcgcgaattagaagccgctggcgttgatattattcagtttgacgaacccgcctttaacgtctttttcgacgaggtgaatgactggggcattgccgctctggaaagagccattgaaggccttaaatgtgaaaccgcagtgcacatttgctacggctacggcatcaaagccaacaccgactggaaaaaaacgctgggcactgaatggcgtcagtatgaagagatcttcccgaaactgcagagttccggcattgatattgtatcgcttgagtgtcagaactcacgcgtgccgatggatttgattgaactgattcgtggtaaaaaagtcatggttggcgcgattgatgtcgccaccaacaccatcgaaacaccggaagaagtggcggccacgctgcgtaaagcgctgcagtttgtggatgccgataaactctatccaagcaccaactgtggcatgacgccgctgtcgcgtcatgtggcttacggcaagctgcaggcattaagtgccggcgcagagattgtgcggaaagaactgcagggctaa

SEQ ID NO: 97180 - DNA, 365 bp, Glycine max
  Peptide Sequence Number=SeqID_213958
gaaacgatcctgagacgggtgactcaaacaggtgcggcttgtacattgaagcaaatcttgcccgcctggttgccctgggaagagtttatgagggatccactgttgttcataacactcctttgttgcctggccaagtaaaggtgggcaattcacaccttctttgcttagctgacacatctggcaaagcctttatcagaatggttgtgtctccggcaaaaccacctcaaaagtcggatccggaggtcgatgatccgctttatctgatgacattgaccatccgagagcttttcttgaggccttaccaggttacatgggatgccaccatgttcgagatctttaatccagacttcccgctctacatatag

SEQ ID NO: 97181 - DNA, 684 bp, Glycine max
  Peptide Sequence Number=SeqID_213959
atgattatgaggagccaagacatttatagtagccaagatgaggctactacgtcaccttcttctagtgaaagtgacgaagcaaaaggggaagaatctagtgaagaattctacccccaagaagaaggacaacctttaatggttaaggaggagtgtaaggaggtaagtgcctcctccaagaggttagttaagaaggaaagtcattttgaaataaagaaaaatattaaagaaacttcccctcttagacaacctctacatcttctcctttgtaaaaagacacttgttagcactgccacacctcttgggcttgaggttattcctcaagtaaaggagttgttggatgagggtttggttcgtaagagcttaaatccttgtgctttgttggtgcccaaaataggtattattaggcaccaaatccctacaataagtgatatgatgaatttgttgagtgttgcaaccctcttttgtaaaatcagtcatgcacccaacgtcttcatgattcatgtacatagggactcattaggtaggaataatcaacataaaaatacagaaaaaggggttcccacgaaccctaagagaataaaggtcattcctgattggcccactccaccaagtataagggaaatctggggctgccatgacttaacaaacttttacaaaaggaagcaccactcattgagttggtga

SEQ ID NO: 97182 - DNA, 261 bp, Glycine max
  Peptide Sequence Number=SeqID_213960
atggcacgcaaaccgaggcagaattttagcgtttttaagcccccacactttttcagacagctctctctctccctcacgttgccattttcttctccctcattctccattgaagctccaagcaaagcttcaacctttggccatcatttctgctccaaatcgcgaaaggagggcatttttggagttgtgaacttcgaaaattcaggtttgggtggacttctttctctcttaaatttcgtgggtatgaggttttgggagatatga

SEQ ID NO: 97183 - DNA, 408 bp, Glycine max
  Peptide Sequence Number=SeqID_213961
atggaatccttcagccagatgcagtcccagcttcagtcacagatgcaatcacaaggacttgcactgcctccggagcatgaggttggtccctcagttgctcgtgttagcataaaggggagttgtgttgatccctcaccgaccgatcctgagacgggtgactcaaacaaatgcgggttgtacatcgaacaaaatccttcccacctggttgccctaggaagagtttatgagggatccacagttgtttacaacatccctttgttgcatggtcaggtgaaggttggtgttgaggaggttaaagatgcagaggcaatcgttcctgtacccactgatgaggttattttagtggggcaggcactgaacaccttccttgcttggccgatacatctcgtgaagcgtgtatcagaacag

SEQ ID NO: 97184 - DNA, 282 bp, Glycine max
  Peptide Sequence Number=SeqID_213962
atgacaattatccacattctgaccattgggattttgaaaacaacaaatttggatgtctcactaagttcaaagggcgcgctaagcgcaattccaactcgagagggaattgcactgagtgagaattggcctgctgacgtgaaaaacacaattttcactctctcctcctctccaaaatgccacctaaaccctaacacctccttctccaccacccacgaccaccgatggctgccacgagccgccgttgcttgccgtcaaacccccacaccaagaggaacactttaa

SEQ ID NO: 97185 - DNA, 606 bp, Glycine max
  Peptide Sequence Number=SeqID_213963
atgactatggatgaattcttacagagggtagcctggccgggggcccaaccttttcttgacagggaaggtgaaggtcccacaacccaagtaccccaacaagcacaggatgcttcatttgaggccaccattccagagccattcactttccataatgaggcaggtgaagcaccggtaagacagaaggaggctgatactcctgcgaggtcacttgaggccacatcagagcctcccacaccaaggcttccagaggacctgaccacaccagtcctggcactgaacaccactcctccagccactccagtgcttcacttgacagataaggatgatgctcagactcaggatacacaagacatgtcacaagtgtcgcaacatgcccttttgcgggcgagcaagggcgaggctcacgggtgcgccttccaaaggaggaaggatgcgcggagtcgccaccaacgtttatttgtgggaaacgtcggaaaaaaccgaacgaaaccggtcaaaatgaaaattctaagttcgggagttgtatttacgcttgacgaaggtcgaaaaaagtggggcttttgctcctacgtaccctcctttggagaggaaatcagacctacgtag

SEQ ID NO: 97186 - DNA, 297 bp, Glycine max
  Peptide Sequence Number=SeqID_213964
atgaccactctagcccaggtgtggagtgttctctcctactccaaactggcccccacttcacatacatctgacctcacagtggacagagccaggttgatatttggcctggtctctcacatggacatgaacgttagagccctcatctcagggaagaactgttggaacgtggatgatctaaagttgctttccgaggggccaggagagcaagggcgaggccagctgacattccatctacctctgcagtccaacatctacttgagcacttactacagctttagcaccagcatctacctctga

SEQ ID NO: 97187 - DNA, 234 bp, Glycine max
  Peptide Sequence Number=SeqID_213965
acctagggccttctcttgcatctctggcccaatcttcttggagtcttctatccaatgcccttgggggtaggattgcatcacaaagagccacaagggatgtaccctcccttgttctctttgaacaaccaagtagatgtaccctttacttgaagcgaaccacaaaggatgtgtcctcccttgtgttcactattacaatgaagaagctacccgcttcttacacagaattcttagatg

SEQ ID NO: 97188 - DNA, 1023 bp, Glycine max
  Peptide Sequence Number=SeqID_213966
atgttgcgactcaaccgccgcgatttccccggcgcacgctatagcgaacgcgtgatccagttcggcgaaggcaactttttgcgtgcctttatcgactggcagctcgactggttcaatgaacatcagggcaccgatgccggcgtggtggtggtgcgaccgcgcaaccggatgcagacggagacgctcaatcagcaggatggcctctacaccacgctgctgcgcgggctgaatgacgctggggagccgctcagcgaaacccggctgatccgcagcctcaatcgtgaaatccagccttatcagcagttcgatgaattcctggctctggcacgcgcgccgcagatgcgttttgtgttctccaacaccaccgaggctggcatcgcgtatgccgaacaggatcggctggaggatcaacccgcgtcgtcgtttcccggcaaactgacgcagcttttgtgggcgcgttatcagcactttgccggtgccgccgataaaggctggctgatcgtgccgtgtgagctgatcgaccataacggcgacacgctgcgcgcgttagtgctgcgttactgccagcagtggcagctgccagcggcctttgcgcagtgggtgacgcagcactgcgccttttacaacacgctggtggatcgcattgtcagcggctatccgccggatggcgcacagattgcagcccaactgggctatgacgaccgctatctggtggccggggagcgcgactaccagctggtgcttcagggaccggatacgctgatgcacgaactgcagctgacggcgctggcacctgccgtcaggcgggtggatgacatcacgccgtacaaagcgcagaaagtggcgatcctcaacggggcgcacactgcgctggtgccggtagcgtttcaggccgggctggcgagcgtgggcgaggcaatgaacgatgcgcagctggccgcttttgtcgatgcgctgctgcgcgaagaggtgattccgacgctggatttgccgcgcgccgagctgcacgcctttgccgatgcg

SEQ ID NO: 97189 - DNA, 1011 bp, Glycine max
  Peptide Sequence Number=SeqID_213967
atgccgatagccagcagcgccagcacaccagcgcacagccaggggagtaaacgcctggggaaattacgcaaccctgtcattactgtgacttcccgttctgacccgcctgacaccgatgaccagcagcaccagcggcagcagcatcaggcagaacatcagctcatcttcatagcggcggaaaatgggggttttccccagcgcaaagccgagcacggtaagaatcagcacccacaggaagccgctcatccagttaaagaactggaagcgggcattgctcaggccagagaggccggcaatggtcggcagcagggtacggacaaaggcgataaagcggccaatcagcagcgcagacaagccgtggcgatggaacagactgtgggcgcgctgatgatactgcgcgggcagatgggagagccatttctgcaccgtcggcgtattgccaagccagcggccctgaatgtaactgacccagcagccgaggctggcgccggtggtcagcaccagcagggtcagcggaaagctcatggtgcctttcgcgatcagcacgccgaccagaatcagcagactgtcaccaggcagaaacgcggcgggcagcaggccattttcgagaaacagaatcatgaacaacacgccataaatcgcccacaccagcgtggggtcggagagcatttcgtaatcctgctgccacagggcatgcagcaatgcttgcaaaatatccatcaatcattcctgaacatcattgttaaacgtgcccgtgaggggcttaggcgcaggcgggttaagttatacattttaggtatgccacctgagcaggatttccggatccatccagaattgattgttaaatcagcgactttttatagccctgtcgcaaagggtaagaaaagggcgataactgtaacaaaaatcgcgggattcagacagtgtaaagtcgcggtcgcacaggagttttaccttttgacgcagatggtcaaaaggagctttacacgagctgacactattgcagattaa

SEQ ID NO: 97190 - DNA, 526 bp, Glycine max
  Peptide Sequence Number=SeqID_213968
atgcagcatgaaacggtggtgaagatccgcgtggcacacagcggcaccaatctgccggacggcttttatctctatcagcagctttctgcgcagggcgtgcggattaaaagtattacctcggcaggcgatgcgctggtcattcattttgagaatgaagagcagagcctggccgcgcagaaagtactgcgccgcctgctgccacagggctttgtcgtggcggcgggtccgcaggcgtcacagcagcgcgagcagacgacaagctgggatgcccctcctgtccggtttgcgacaggtcgtcaacaatggaaggatattcagcacgaaattgagatggcgaaacagcacgacaaccagcgccgggtcaccggactggaacgcgcactgaccgaagtccgcgccaactgcactgacgagaaactgaaatccgcccacgctgaacgcattgaagcccagcagcataaagtggctgagcgcgagcacgaactgcagcaggatcgccaggaaggcaaagaccaggagaagatcg

SEQ ID NO: 97191 - DNA, 242 bp, Glycine max
  Peptide Sequence Number=SeqID_213969
gtgctggtgcagtaacttcatttggttactgtaaggatcgtgatggacaatggctgaagaaggacgcactacctccacaagacgagcgtactcctcctcaaagagatgattcctcagtccttacgaatgaagttctttcagaattacggggcctctgcacatatgttggcgaacgtttgattccttggatggtcgctttgaaggaatggatacccgtatcatgcagcttgaagaggatgtga

SEQ ID NO: 97192 - DNA, 207 bp, Glycine max
  Peptide Sequence Number=SeqID_213970
atgcccgggttgggtcaggattggccaagcttggttttgggtaatagcaccccacctgacgtccccaaggtctccagacccccgcgacatatctccaagtggcgatcgggcgatggcgcaaatcaactctcccacttccacaaatcaaacatgaacacaccatccccagttgcccaccttcaactgagctcacgcactcctacgtag

SEQ ID NO: 97193 - DNA, 852 bp, Glycine max
  Peptide Sequence Number=SeqID_213971
atgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatcctttaaagatcagaatcccaatgttcaggcgaaccctctaccgaaccatgggcctgctgttaacatgatacaagattgtgatgaagacggtgtcatcctgaacgtccagcacgttcgaactcccctggtcccaatacatatcaagatgtgcgaggcagctctgtttgaccatgatcatgcagcgtgtgaaatatgtccggtgaatgtaaaaggatgccctaaggtacaagaggacgtacaagggctgatagacagcagagaacttatcatcacgaggaaggacaaagaagtgtgcgtcatcacccccgagtttcagcggttggaaataagctataacagtggggaatcaactactactccactggtgattagcttgccaggacctatgccgtatgcttctctaaaagcggtcccttacaagtatagtgccacgatgttggaaggtggacaggaggtgcctttgccctctctaactcctgcggtttctgtggacaacgttgctaatgacggtaaagttctgaggaatggacgtgttatccccacattgtttgcaaagaaagtgaatgatccggcagttaaacaggtgacagtgaacggccccggtacaaggaaggaagtaggccaatccaatgggactaaagagtga

SEQ ID NO: 97194 - DNA, 156 bp, Glycine max
  Peptide Sequence Number=SeqID_213972
atggttaaagcacgtcaaaaaggggggaaaagagggaggtggttgccgcccagctcgcccgggttgcttccgccagaaggcaccgccttctgttggaacaccatggtaggcaccgccttctgttggaacaccatggaaggtccaagtgaatcctaa

SEQ ID NO: 97195 - DNA, 226 bp, Glycine max
  Peptide Sequence Number=SeqID_213973
tgctttaataggtcttgatgatgctctacagcctaaatcaaaggctcctgctaggtggattgtcatcaagtgtaatagacaaaaaggaagcactgagtgcagctattatgtcatgcactggatgtccaccatcattttaggaatttttaggaataactgggaagcgtattttaacaatcctagaccattgaagcttgagagattaaaggcgcttcaaatccagtag

SEQ ID NO: 97196 - DNA, 378 bp, Glycine max
  Peptide Sequence Number=SeqID_213974
atgactaatgcaaactatccgcaagaatcattgcattcaatctcaaacgagaatctaagaggtatgatagaggtagatggaatatgtgacaaccaagaaggattgggttggtgtgtgtgtcatgagggtgtgtgtgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatcgataagagcttggaggaagaagaagatgaatgaggggagagggagagaagagcacgaaattttgtgctctaaatga

SEQ ID NO: 97197 - DNA, 255 bp, Glycine max
  Peptide Sequence Number=SeqID_213975
atggcggtgcgtctgtttcccgctgccgaccatcccaatgctgctgtggtgtttcgccctgcgcctgtctggggcgcagtacttcttgatgaaagctcgattagtagggggcctgatgcccttgctggaggactgatagaggcccgtaaccagagctggaaaccccagggccctgttggacttcttcaggttcactgggtgtctttgtggggggagattggcattgcggtcgctgggcagaatgttgctaagtag

SEQ ID NO: 97198 - DNA, 207 bp, Glycine max
  Peptide Sequence Number=SeqID_213976
atgactggagacatttttgtctttgaaatgtgtgcggattaccgtatagggcgtctccgcatgctacctgacttctcacagataaccacttggggtatttccgcctgccacctgacttcacgggtcaggattaacagaagtgtgtttgtacggataaccacttggggtatttcaaacctgccacctgacttcacgggtcaggattaa

SEQ ID NO: 97199 - DNA, 632 bp, Glycine max
  Peptide Sequence Number=SeqID_213977
ttatccagaactacgtaggtctgagttcctcattggaggatacgtaggagcaaaagcctcgcttttgtcgaccacactgctttctgttaccatgacccaagagctggtagcccgcggagacaccatacggttatccgcacctcgtcattcagtgacccaaagtgtgattgatgagcagaggccaatgtggtcgtctgcgccttttttcggagatgagcaagagccttgcttttgtcggccgccccataatctttgtcatactgaccctgaggcggcgggcccgatgacacgcagagacaaaatttggtcattctgcacccttgtgtcatctagaggcggcgggcccgatgatacgcggagataccttacggttatccgcacccttgtgtcatccagaagcggcgggcccgatgacaagcagagaccaaagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccgagtg

SEQ ID NO: 97200 - DNA, 334 bp, Glycine max
  Peptide Sequence Number=SeqID_213978
atgggtaactcctcatgcctcctcttcctcatattccaacatttgagcttagctcatcaatgggctaagcgcacatccaccgctaagcgcaactttagtgcgacagaagaatctggcagagcatcaatatcaaggtcatgcactaagcgtgagatcagtgcactaagtgtagcagttgtcttcagccaggctcaccgcacgactaatgctaagctcaaatccacttactcgaaggcagatgatttgcacagaattccagagcacaccacagtgcctatttcaggaaaagagctctggaggcagcaagaggagcagcttttgcagagatacctag

SEQ ID NO: 97201 - DNA, 249 bp, Glycine max
  Peptide Sequence Number=SeqID_213979
atgattcatgttgatcttgtcactagaaaagtcgatggtccccacagaaagaaattaagaacatatttggggattgtcactcgcgacaaggtggatgttatatatgataattgggaacaagtctttgttgctcaaaaggatctaatctgggaggatattcagactgaatttgatatccctgaatcattcgatttgaggacaaagaaaaaaaatacttcagatcgtaggagagcggtggaggtagtttaa

SEQ ID NO: 97202 - DNA, 375 bp, Glycine max
  Peptide Sequence Number=SeqID_213980
atgggtgaagtagaggaggtacaagagaagatgaaggctgacatggaggccatgaaagaacaaatggccacgatgatggaggccaagatgatcatgaagaagataatggaagccagtgcggttgcagttgtcgctaccaacactgttgctaagtacggacgaccccatgatgtgcaaattcaaaacgagcatgccttcccaccacatggcttgcctcccaactatacaccacccaatgtggcatacactcccaatgaggatgtcaataaatgctcattgagagccgacaacctcatcatatacatgtctctcaacccatgggggagacacatgaaattccccaccacaatcaagccgacttcgggccttgattaa

SEQ ID NO: 97203 - DNA, 246 bp, Glycine max
  Peptide Sequence Number=SeqID_213981
atgggttttcctttgccgacagtcacttatcttgccgaaaatttatctggtcggaaggaacccgatcttgatatctggggcaaaacaaatttgggtgtcaaggtgtcggtctcgggccgaacttccatattattccgcgcgacaatgatgatttggaaacaacgtgcaaaattagtcacggctacagccgggtgggcactcaagcatttcgtttatggcattgtgatactaaggttgggaatttag

SEQ ID NO: 97204 - DNA, 693 bp, Glycine max
  Peptide Sequence Number=SeqID_213982
atggccgggcgcgccggcccgttgcaggtaggcgggcgcggcatagacgcgcaattgcaggtcgccgacgcgccgcgccatcagggattggtcggtcagctcgccgccgcgcaccacgcagtcgacgttctcgccgatcacgtcgacgatgcggtcgctcacgcccatatcgagctggatgtccgggtagcgcgcatggaaggcgggcagggcgggcaccaggatcatgcgcgccagcggactgggcacgtcgacccgcagccggccgcgcggcacggacgcggcgacggagaggctggtctcggcgtcgtccatgtcggccagcaggcgcagcacgcgttcgtagtagaccgcgccgtcggcggtgacgttgaccttgcgcgtggtgcggttgagcaggcgcacgcgcaggcgggcctcgagctgctgcaccagctgggtgacgctggtcttgctcatgtgcagggtgtcggccgccttggtgaagctgccggtctccaccacgcgggcgaaggcctgcattgcgtcgaaacgatccatcgccactccagggatcaggggattgtttgcattttacaaacagtgatggacaggcttgcccgtttatcggcggccgcgccgtccgtacagtgcctgcatcatcaatacgggcttcaaggcccgggacaggagaatgagtatggcaacgcgtga

SEQ ID NO: 97205 - DNA, 129 bp, Glycine max
  Peptide Sequence Number=SeqID_213983
atggtaggagtaatagtgatgaaagccaatggagtggtagttagtaacaatgatatgatggtgatgttcaattgtgaaatggattatctcgactcaaagtgttctattaaccctaattataagtattga

SEQ ID NO: 97206 - DNA, 411 bp, Glycine max
  Peptide Sequence Number=SeqID_213984
atgtttttctctatttatcatcactacgggccatatggccagatcgacgttgtcagaataatagtgtgcccctttgaaaaggatgaatgccctacccatgtgatatctgctaaaggatttgtcagtgaggtgagaatttcagccctatctctccttcggggttcaacctccttaagcggtggggggggcataattgaaaaaagaaaggcactctatgttctcgttctcggtgctccggtcaagggcttgacctctgatgtatggaagtacgtggttgaagtgaattcctcggaaatgcagccggagggcaatctctcttttgacccggtctgcatatggctatggttcagatacagactaaagactttctttcgtgctttgatctcagtggaagtagagtattgctcctga

SEQ ID NO: 97207 - DNA, 599 bp, Glycine max
  Peptide Sequence Number=SeqID_213985
atgacatccttcagccagcttcagtcacagatgcaataccagggacctcctgagcctctggttggtcctggtcccttcggtcctcgggtgagcacaaaggggagttgtgttgatccctcaggaaacgatcctgagacgggtgactctgacaggtacggcttgtacatagaagcagatcctgcccgcctggttaccgtggggagagtttatgagggatccactcttgttcataacactcctttgttgcctggccaagtaaaggtgagtgtggacaaggttaaagatgcagatgctgcagttcctgtacccactgttgaggtttccttagtggggcaggcacttcacaccttccttgcttggccgacacatcagatcaagtctttatcaaaccaggttagatgggatgccaccgtgttcggggtagttaatccagatttccccctgtacataaagaacgaagacctctctgaaatcgcacacgatggtcaatgtctcagcatatcagtgttacagttgtggattctgcatctcactgaaacatgtatgcgagcggggaattctgatatctatgaattcctcgagcctcagtccattcagag

SEQ ID NO: 97208 - DNA, 621 bp, Glycine max
  Peptide Sequence Number=SeqID_213986
ggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggatcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattatgagggatatgaggcgattgcacagaggttggagcgtgtgctcaacctcaggatagtcactgcaggcacagagttatatgacattatgcaggactgcctgacgattgcgagagggggactcagtgctgatgggacg

SEQ ID NO: 97209 - DNA, 1011 bp, Glycine max
  Peptide Sequence Number=SeqID_213987
atggttaaggaggattatagagagacacttgttagcactgccacacctcttgggcttgaggttattcctaaagtaaagaagttgtcagatgagggtttggttcgtaagagcttaaatccttgtgctttgttgattatggttagaaccagaggtttgggttgggctttaggcagggttataggaagagccctagggagagaacatgtggatcatgcagatgacgaggtccatgaacagcctaaagaagcagctgttgatgatgaacgtcctgagctaaagttatcctcccatggaagcaaggttgagaaatttggtaggcctgctccagagattaaaggcttagtggctgccacaggattaagtcctctgattgcatgttcgctggacacgagtgatcgaggacttatgtttgcttttgtggagaggtggcataaggaaactagtagtttccgtctgcgagtaggagaggtgactatcaccttggatgatgtggcatcgttgctgcatttgtctattacatgcgtgttccattgctttgagcctcttcatgtggatgattttgtgtttctcttagtcgaattgcgtgaagtcagtgctaaagaggaaagagctaaaacagtacaatgccatagggcatatgtgcgactatcctggttgcgagacaatgcaacacacatgcatgtggtattcttggatgcatttcgtgacctgacgcaaagtggaagctatgcatggggagctactgtactggtgcatatgtatgacaatttgaatgatgcgtcaaagagcacggcccgacaactattacaatgttggatctacgagcattttcctactgttggttctgctattgctaccgaggattatgatgagaggacaccacttgtctgccgttggaactctgggaaggcattaccggtatcaacgtactataagaatttggatagattgacgtctgatgatgtgttctggattttgtatggggggcaccgtgcattcagagagtttgag

SEQ ID NO: 97210 - DNA, 771 bp, Glycine max
  Peptide Sequence Number=SeqID_213988
atggggtcgagtcaggcgcctccgcttaaaaagaggttctatcaagtcaaggtcaagagcctaggaatcaccagtctaaaagagttagggcagttgatgggtcagctccagcgacaagcttttcgcaaagcttacggtaaaatctgggacctagccatggcagaagtctccatagaggccattgcctccctcgcccagtattatgaccagccgttgagaaagcaagtcgaaaatggggtggttggagtatcgagaaaatgtttggaggcaaaagcaaaagcaagaatcttggtaggtagaggcgaatgggccccgttcatagacatcctcgcacttttgatcttcggaggagtcctctttctaaatgtggatgggttggtggacctagaagcgatcaacgcttttctcgcctatcatgatcgcaaggaaagcctggttgtcgctatactagcttatctatatgacaccttcaaccgaagatgtgagaagagcagtacaaggattttttgctatactctggccctctatgtatgcaaagaaggagcatctgtcaactggttccctcgttggaaagaaggaagaaccggggttcttatttcgtgtagaggatttccaaatgttcctttgatggggacaaggggttgcatcagttacaatcccattcttgctataagccaccttgcctcccctatgagagggcccccactagaggaagagctcgcccctactattgcacggggtttcaataacaccaacgtgggggcgctttag

SEQ ID NO: 97211 - DNA, 402 bp, Glycine max
  Peptide Sequence Number=SeqID_213989
atgaccaccttcggtcagggcaagctctctaggagcttcaccatcagatatctactggttgacgcgaccacatcatactttgccttaataggaagaaagacactcaaggaattgggagccatatcctccatgccccatttgacaacgaaattccctacactgacatgggagattgtaatagttaaggctgaccaaaagagtctttttatgcctcaccctatagtggctgaatgcacacaagtcatgacagtggatgaagggtctcatgttcgagccttaactgtctaccaagctagcttgggcggtgaatttgacatagatccgcgatatgacaccttcaacagaggcttgaaacccattgaagatcttgcgcagttgcaacttagacctaaattggggtag

SEQ ID NO: 97212 - DNA, 180 bp, Glycine max
  Peptide Sequence Number=SeqID_213990
atgagtgaatcagggaaagggttactttatgagaataagggcagtgctgaagatgacggaaacttagtctcgtggaaaagcacaaagcaaagcattgttgctagaaccaaagcaaaggccaagtaccatactatggcagcatcaaccagtgaacagaagtggctaaagcagttgctttag

SEQ ID NO: 97213 - DNA, 1236 bp, Glycine max
  Peptide Sequence Number=SeqID_213991
atgaaccacaacatccccaggagaccagggtttggacaaatagattttgatgacagaaacagctgggagtatctcttcaaggactactacatagatataaaaaaaaaactatctctcacatttgatgaactcactcaagctaaaaacccttggaagggatctgatatgcttctttctaaagaggaatcactggatgaaacttttgatgccactaacgatagaggatcagattcagatagctcctatgagaatgcagatttgagtcgttctaaaagaaaaaaggccaagaaacgggggaagtcccgttccaaagaaggagatgacagctcagagtgggcttcaaaagagcttttggagtttgttatgcacatgagaaatggagacaaatctgttttatctcagttcgatgtgcatactcttttgctagagtatatcaaaagaaataagcttcgagatcctcgccgaaaaagtcagattatttgtgatgcaagacttcaaaatctgtttggaaaaccaaaagtgggacattttgaaacgttaaagcttcttgaatcccatttccttctaaaagatgattctcaggctgaagatctgcagggaagtgttgttgacactgaaatgagtcattgggaaggtgatggcaatcccaattcatatacgaaagctggcaaagataagagacgaaagaaccgtaaaaagggtgatgagagaggacttcaaactaatgttgatgattatgcagccattgataaccataatattaatttaatttatctaagacgtaacttggtggaagatctacttgaagatactgagaagttccatgataaagttgttggttcttttgtgagaataagaatttctggtagtggtcagaaacaggatttgtataggttggttcaggttgtaggtacatgcaaagcagcagagccatataaagttggtaaaaggatgacagatatcttgctagaaatcttaaatttaaacaagacagagattgtttcaattgatattatctcaaatcaggagttcacagaggatgaatgcaagcgtctccgccaaagcataaagtgtggcctcataaatcggctaactgtgggtgacattcaggacaaagcattggtgcttcaggaagctagagtaaaagattggctagaaacagagacagtgcggctgagtcatcttcgtgatagagctagtgaaaaaggacgcagaaaagaatatccttttctctaa

SEQ ID NO: 97214 - DNA, 2118 bp, Glycine max
  Peptide Sequence Number=SeqID_213992
atggatccaagttatgagtctgaagaagacgaaaatgaagtggatgataaaagacaagaaaactacatgagacctagagggtctactgcatttggaaggagggggagagatattgtttctcctagaagtggttctatttcaaatgattcttggagtggaacaaggaattattctaatgtgaatcaggaactaagcagaaatttgtctaataagggattttcaatcaaaggtgataatgcttccaatgctaatgaggcactaaatgatgctcaattgcaccggggaagagatcgggaatcacaactatctaatagctgggagaggcaaaagcaatcttcaaccttggaaagtggtgctaaaaatacccaaccattggtagcatctgagtctttctctgctgctgtatcagaagcttctgcagcaccatcttcagccggaataactcctccagctgtgaaaattaatgaaactgaaaagatgtggcattaccaggatccatctggaaaagttcagggaccattttccatcgtgcaactacgcaaatggagtaacacaggatactttcctgctgatttgaggatttggagaaccactgagaagcaagatgattctatactcttaacagatgccttgacagggaatttttctaaggaaccatcaatggtggataaagctcaatcggtgcatgatttacattacccatcatcatactctaggaagtctccacaacaaggtatagaaggtcaagttggagaaagactgtcattagatcaaaatggtggatcttggaattcacatagtactctgggttctccgggacaaaccacaggaggaagttggagatctaaagataatatgaactctttagctaatagaacttctccattggcagttgaggtccccaagaaccctgcaaatggctggggttctgatgctggtgttaggaatgatgcaacaaatcttccttcacctactccccagactactcctggtggtactatggggctggcttttgaaaataaatggtcaccaacacctgtccagttgcctgggtctctcttaggaaattcattcccaggcagtcacggaggtttgcaggcctctgtggcagtgcacccagagcatgctgtacaaaatgctgaaaaaggctcaagttcacaacctggcattagttcagcttctacagataataccaagttgcatcctcaagcaacagcggtggtacctgttgtggcttcaggggttgacatcaaaatggcaggtgcaaatatgcaaaaccaggttgtgagtagccagaactctcatgctgaagctcaagggtggggttctgctggggttccaaagccagaaccactggcctggggaggtgcatcttctcaaaggatagaaccaaataatcctgctaccatgccttcccagccagcttcccatggcccctggggtgatgcttcatctgtgccaaccactgtctcgtttaacactggaaatccaactgcgagtttacccacacctggatttctgggcatgactgcacctgagccttggagaccaccggcttcaagtagtcagtcaaacatcgcagctccagctccacccaatatgccttggggcatgggcatgtctggaaatcagaatatgaactggggtggggttgtacctgccaacatgaatgtaaactggatgcctacgcaggtgccagcacctggaaattcaaatccaggatgggctgctcctagtcaggggctacctccagtgaatgcaggtggctgggttggacctggtcaaggacgttcccatgtaaatgcaaatgcaggttgggttgggcctggtcaggggctagcacctggaaatgccaatcctggttggactgcaccggttgggaatccaggcatgtggggaagtgagcaaagtcataatggagacaggttccccaaccatggggatcgtggtgcacagggtagagattctggttacggtggtaaatcttggaataggcagtcatcatttggcagaggaggttcttccaggcctccttttgggggacaaagagtagtctgcaagtattatgagagtggacgttgcaggaaggggacttcttgtgactttctacacacttag

SEQ ID NO: 97215 - DNA, 300 bp, Glycine max
  Peptide Sequence Number=SeqID_213993
atggcacgcattgtgtttgctccgtgcccctatttaagggacatatatgggagagagctaaaaagggaaaccaacaaaggaggatgtcatgataaaacattgcgcaagattaaatggcctaactctcaaaaaatagtccccagtggagtcgccaactgtcgcaacctagccttcggcgggagggcgatgcgtgactcgtgggtgcgtgttccaagaaaggaatacgcgcggagtcgccaccaacgtttatttgaggaaaacgtcagaaaaaccggaaaagacgtgatctatgaactttaa

SEQ ID NO: 97216 - DNA, 954 bp, Glycine max
  Peptide Sequence Number=SeqID_213994
atgttttttaacggatatgggtatcaagggacatcatcatttgagcagacatttcgatgttactctgcttcgtttattgaaaagcccgaaattgaaaatggtgataaaattataatgcctccttcagtccttgaccgtctagcatttctacgtatggattatccaatgatgtttgaactcagaaatggtgcttctgagagggtttctcattgtggggttctggagttcattgcagatgaaggaactatatatatgccatactgggtaggaccagaggaactgaaacattatgaataccttgttaccagtagaatgatgatgcagaatctgcttttgcaagagggagacatcgtaagagtgaaattcgtatcacttccaaagggaacatatgttaaattacagccacacacaaaggacttttttgatatttccaatccaaaagctatcttagagaccactttgagaaaattttcctgcttgactactggagatactatcatgatgacatacaacaacaaaaaatattacttggatgttatagaaacaaagcctgctaatgctataagcatcatcgagacagactgcgaggtggactttgctccttccttggattacaaggttactactgcaagcaaaacactagacaaagctattttccttgaaggcaagttcaatccattttttgggactggtagacgtttggatggaatctcaattcctcctgtttattcttcacggccttccgatgttccaaatgtcaattcattgtcttctacaacatctagttcaccaaatttcgctcgtccatctcagggaaagctagtgtttgcatcgaatttttaccgcacaaaagaaataggaaaggaaaagaatgagtcaaaacaagagccaccccatcagaagcaaccgaaatttcagcctttcattgggaacaagtattccctaaggggttga

SEQ ID NO: 97217 - DNA, 360 bp, Glycine max
  Peptide Sequence Number=SeqID_213995
atggcttcgacggcagcgtacctggctcggcgcgcggcgcagaaggagagggttcggatcctctaccgccgtgccctcaaagacactctcaactgggccgtacatcgccacctcttctacgacgacgcttcaaacctccgcgaaaggttcgaggagaacagacacgtggaagaccctgataccattgacaggctcatagcggatgctgaagcttcctacaacaagtggcgccatcctgatccttatattgttccttgggctcctggtggttccaagtttactcgcaacccaactccacctcaagggggggcattgtgtctatacctctcatcacaagcatcagatgacccaatcatttga

SEQ ID NO: 97218 - DNA, 2700 bp, Glycine max
  Peptide Sequence Number=SeqID_213996
atgggagctgttgctggagaagagttagttaaatgggagaagatgggaggagtgggaggccatgaggagaagattctggtgttagtgaggctgaggcctttgagtgagaaggaaattgatgtgaatgaaacaggagattgggaatgcatcaatgacactaccatcttataccggaacacccttcgggaaggttccacattcccaagtgcctacacctttgatagagtatttcggggtgactgttccacaaagcaggtatatgaagaaggggccaaagatattgctctttcagttgttggcggaataaactcaagtatttttgcctatgggcaaacgagtagtggaaagacatacacgatgattggaataactgaatatgctgtagcagatatttttgactatataaataagcatgaagaaagagcttttgtgttgaagttctcagcaattgaaatttacaacgaaattattagagacctcctgagcactgagaacacatcactaaggctgcgtgatgatcctgagagaggaccaattgtagagaaacttacagaggagactctccggaactgggtgcatttgaaagagctcctatcattctgtgaagcacagagacaggtaggagagacatacctcaacgacaagagttctcgatctcaccaaattatcagactgacaattgaaagttctgccagagaattcatgggtaaaagcagctcaaccaccttagctgctagtgtgaattttgttgatttggcagggagtgagcgtgcatctcaggcattatcagctggggccagattgaaagaaggctgtcatataaatcggagtttactcactcttggaacagttattcgtaaacttagtaagggaagacaaggacacatcaattatagagattctaagttgacacgcatactgcagccttccttaggtggcaattctagaacagccattatttgcactttgagccctgcacggagccatgttgagcaaactagaaacacccttctttttgcttgttgtgcaaaacaagtgaccactaaagcacaggttaatgtagtgatgtctgataaggtattggtcaagcagctgcaaaaagaggtagccagattagagactgagttgagaactccttgtcctccttccaccaattgtgattgtgcagcaatgttgagaaagaaaaatctccagatacaaaagatggagagggagattcgggagcttattgagcaacgtgatcttgctcaatctcaggttgaggatttgctgcgcatggttggaaatgatcagaaatctagaaaagaaaggatgaacacctgggaagatgatgattcaacatcagagtcatcaagcatttacccttctgatttacgcattagagaattcaacaatcctcactacaacaatgaaaacagtgaaagtagtcctgataaacaccctgatgaatgctgcaaagaaattctaagtgttgaattggaggaatcaagtagagatgaccttgaatatgctaatccatcagtaagtgacaatggggtgttggcattaacattgtatggagaggaaaatgtaataagtcaggagataccgacccctgtgaatgaggatagggaggacagacagaaccaattaacatatggtgtgttggagcagagaatcgatgattcacaattgagtaatgattctcctttgactatgtcagaaacagtgtcaaattgtaggaatcttaaattaataaggagctggagttgtagggaatattacatgactggttctccggagaaaacgggagaaatgcagaggactccggccagtagttttaaaaaatgcttccctggaagaccagatggattgcagagaaagttccttccattaacttatggctcttccacaaaattgtcaatgaatggctctccatcttctattggaagcccctctatggatgagttaagaaccaacagcatgagatcatatgctaatgaagatgttactagcctccaaactttcgttgctgggatgaaggaaatggtaaaacttgagtatgagaagcagcttgtagatgatgatcaggatcagcaagcagagacaacaacttttagatttgaaaagaatatgaaagatgtaggtgtgggttcaatgttagaggcacctgaatctcctgtagaatggcctctgcaattcaagcagcagcaaacagaaatagtggaactgtggcaagcctgcaatgtatcattgtttcacaggacttacttctttcttttgttcagaggtgatccaactgactccatttatatggaggtggagcttagaagattatctttcctcaaagaaacatttgccagtggaaatcagtccacgaacgacgctcacaccgtcacattagcttcaagtgcgaagggtgttcggtgggagagagaggtgctggtcaagctgatgcggagaaggctatccgaggaagagaggaagaatctcttcagcaagtggggcattgcattggattcaaagcgccggaggaagcagttggcgaatcgcatatggagcagcaccgttatgaaccacatcgtggagagtgctgcagttgttgcaaagttattgaggtttacagggcagggtaaggccctgaaggagatgtttggccttagcttctcaccacataggatgtcatattcgtggagaaacaccagggcgtctcttttttag

SEQ ID NO: 97219 - DNA, 429 bp, Glycine max
  Peptide Sequence Number=SeqID_213997
atgtgggcgaacggagatgttcccggcggtgttgacggcgaagtaggggccgccccagccgtcgacgttgtaaagggcggcggagagagacggcgaccaatggttgttgctgttgttggtgtcgtctgccgtggccggaggtacgccagtaaaggcgatcggcgccggaaaagagatgtcaccggcaaatgcatagccgggagggctgtgaaggtgggggctttgaaagccgccgaggccgaggccccggcttccccctcaaaagaagacagtgagagatctattgaaaacggagagaaccctctcttgcttcccgaaaagactctggtatccccacgcctaccgctcagaaggaagattgatacaaaattaatgaacccaaccctctcaccctgcaccagatctggtgcgggacagagatctaagtaa

SEQ ID NO: 97220 - DNA, 762 bp, Glycine max
  Peptide Sequence Number=SeqID_213998
atgtttccgaagtccattgatggctctaaatttgtgaagataggtgaaaagttgtctgagttgctttattcccttttagaggagattggagaacacgatgttgttcagaacctgcctcagaaaattcatctgaggaccctattgtggctcatggttaaagtaagttgtcttcaccctcatcttcatcatcaggggacaaaagcttcaagcataccaatgagaaaattggcaagtttgaagtgtctgcatcttcaagaaagggccttggatttgtggctgggaacaaagggaagttccaactcttccctttggagaaaaaataatgctgcttctaagtccaaaaaaagggggcatgatcatgaaggtgagaatgtgaagatgcggtacaaaatcaggccaaaagtgagcaccaaagttggtgcaatagataaatctgttcttgcagctcggaaattgaatttcagtaaaggaaggggaaatgtgattgaacttcagcctcgtagcaacatcatttttataataatgtcattgaagagactgcaattgttcaaagtcttcatagtttattttgaagtcaacaagattgcaactctttcagattctttgaagtatattagaaagggagaactatcaggaaaccacattacaagcgaaacctcaaagagagttgggcttcgtcctcaaaaggaaacaacaccagaaaatctagctttccatggattcaaacagaaaacacaaatgaaacatgaagcagaaacgtaa

SEQ ID NO: 97221 - DNA, 342 bp, Glycine max
  Peptide Sequence Number=SeqID_213999
atgtcgttgacccgattcacaacttcgtgtccagctaagggtttcggggcaccttcaatctcttggctttcattaaatgttttcttcaatcaccgatacggattcccatcatacacatataccctgtcaacccataattttctcaagtcttcaatcaagggtgatgtagttccatgtggagcttgtaggccttggatcttcttcatcaatggagttctttgcttcttgaagtttgatggtagcggaatggagaaggagaaagattattggagatgccacttcaaggagaagatgagtctagaagaagctcaccaccataggaagccatggataagagcttga

SEQ ID NO: 97222 - DNA, 423 bp, Glycine max
  Peptide Sequence Number=SeqID_214000
atgtcctttccgtcgtgggagggaacctttatgaggtggttcagtgaaatagatgaaaagcttgctaagaacattgacactgatggatttcgtggcggtagcacttctgtatctgtaatcaaacagggtgaccaagtaataattggcaatgtgggggattctcgtgcagttctttgcagaagagcacctgacaatcaccttattcctgttcaacttactgttgacttgactccagatattccaacttttcttcctcaatgtcactcaggagaagctatgagaatttttgctgtagaagaagatcctactgtaaacagagtatggatgcctaaaagggactgccctggactggctatggcaagagcctttagaaatttttgcctaaaagactatggtgtcgcctcagtccctgatgtgtcttaa

SEQ ID NO: 97223 - DNA, 309 bp, Glycine max
  Peptide Sequence Number=SeqID_214001
atgaaaagtgcattcaacaaaagggtgtgcctgcgtgagttcagcaagggggatcttgttttaaagaaagtatcacatgttaagaaagatcatcaagggaaatgggccccgaactatgaaggaccttttatggtaaagaaggctttcttgggtggagcagtgttactcatgaacatggatgatgaagagctaccttcgcttgcattagagcatatgccaacatatgttgagtccatgatcggatttgttcgtaatcaaagaaaaggaattatggaggatgaggtggtgaagcctcagccacaaccatag

SEQ ID NO: 97224 - DNA, 309 bp, Glycine max
  Peptide Sequence Number=SeqID_214002
atgatggcacatcaaggacggtggaagaaaataaagaaaaaaagcatgaaagaaaggcatcttctaagtggaaaacgtatcggagtcgccaccaacgtttattcaaggaaaatgttagaaaaaccaaaagagtttttagaacccctcaacctttcccatgcatggctatttataggtaaaggccatttggtacaagggaagctggcttgggcaagctggagctcacccaagcaagtggcttgcttagggctgaagaaatttcatggcctaggcgagtcagatgctagtctaggtgagtttaggtcttga

SEQ ID NO: 97225 - DNA, 451 bp, Glycine max
  Peptide Sequence Number=SeqID_214003
atggataagcgttctagagtgtggggccaatggattccctatgacacagatgctatcaaccaattcttagggcatccattgatcttagaagaggaacaagaccataggtcagctactttgctcccccggacacaattttgtacgaagcgtagcagggaagcgggcattgcacctcctacaaactcagtgcactcagaaaagtcccacagagcaccaggatttcctacattgattataggtctgtgccaattctatggagtaccggatcctaacccttacccttggcctactcccaggcattttagagccattgttgcatggcctagagacaggcctaattttcaggatgaggtaggacctgtagatgctcaaggagctacccaaggagacgaaggtggagctgaggatgatggagaaatggtagatttgcttgattactttattggaggag

SEQ ID NO: 97226 - DNA, 135 bp, Glycine max
  Peptide Sequence Number=SeqID_214004
atggcggagggcatgacggagttgatgaagggcacgatagagctgagggacgaattaggtagatatgtgcttcaaaggggacacggtagcaaaggaaataccattttctatagtcaagccaaggctaaatactag

SEQ ID NO: 97227 - DNA, 282 bp, Glycine max
  Peptide Sequence Number=SeqID_214005
atgcaactaagaacgcagtgtaaactttcacgcttcattgtgactttggcgacgaagaaaagaatgcgaggcataagcaactatatggcaggagaacctaatggaaaggatccaaaagttcactatctagtgacaactcctaagggtagtttcataacccctcaacctttcctctgcatggctatttataggaaaagaccatttggtgcaaggaaagctagctcaaacgatggttgcttaaagctgaaggtattagctcgcccaggcaagtggcatgcttag

SEQ ID NO: 97228 - DNA, 240 bp, Glycine max
  Peptide Sequence Number=SeqID_214006
atgcagtatctaggaagtgatcctaggttgtctcccagagaaaataatgacacatcaaattcccccacacttagccttttgcactcctgggcaaaatcaaaaagcagagcaaggaacaaatccagagacattaaagagagacaaacaaacacaaaaacatttacatatttctcaatgaatctcaaggaatggaaggaatgggcaacatccagcacgtatagagttaaagaatcaagatag

SEQ ID NO: 97229 - DNA, 317 bp, Glycine max
  Peptide Sequence Number=SeqID_214007
atggccccgatcactcagcctaacactgcaggagcctctcaaccccgcctgatgcaaccactacatttctccataggagggccacctccgacagtggagggaaaagaaaaacttgatctcatcgaagagagattaagagcaatcaaagggttcggtgattacgcttttgctgatatgactaatttgtgttgggtaccaaatatggtcatccctcccaaattcaaggtaccagattttgacagacagcttggccggagcagtataatcttgggtaatggtcttgtgtttggtttcttttcattcacaggtaatctcgg

SEQ ID NO: 97230 - DNA, 366 bp, Glycine max
  Peptide Sequence Number=SeqID_214008
atgtgtgatgctgattgggcttttgatgttgataacagaaggtcaacctctggctctggtgttttcttagtcagattcagtactgaggctgaatatcgcggtatagctcaaaccttagctgagttaacttgggttcaggctttgttacaagaactccaggttcccttctctactcctatactgctctgtgacaatcagagtgcagtagctattgctcacaatcatatttttcacaggaaaactaagcatatggagattgatgtcttctttgtcagagaaaaggtcctatccaaccagcttctcatttatcatattccaaccttgaatcaatggattgatatattgaccaagcctctttccttgtga

SEQ ID NO: 97231 - DNA, 789 bp, Glycine max
  Peptide Sequence Number=SeqID_214009
atggaagctatcagaaagcaagcctccaaacttcgagaacaggtcgctcgtcaacaacagatgtgtatgcctatatatacgtgcaataagtcagatcctagatgtctgaaagcgaaggtggcttgcatattttgttacttacttgaaactgcaatggtttttgactggaaacgagcttgttttgcttgcttcctttctattcaggctgtgcttaaacagtttggggctgggggatatggaggatcagataatatggttactgatgaggtagagcttcagcaacatcagaaacttgagaagctttacatatcaacacgtgctggaaagcattatcaaagggatattgtccgtggtgtggaaggttatattgtaactggatccaagcaagttgaaatagctttgatatctgtgcaggagaagaaaaaggagggtggaacaaagttatcagaagataacaggaaatatggtgcagataatacgtgtaccagtggtagtacattatcaagagctgcgctaaattatgcacatgcccgtgcacaaatggagaaggagcgtgggagcttactaaaagctcttggcacacaggtacttaaatttgagagggagagcctagttgcagtcgtaaggttgctgccttgtgacctaggtcattggttcaaacctgaggaaacatcatctccaattgtggttgcagagcccttgagagcaatggtgatgggagctccattggaggatgcccggcatcttgctcaacgttatgacagaatgcggcaggaagccgaagcacag

SEQ ID NO: 97232 - DNA, 180 bp, Glycine max
  Peptide Sequence Number=SeqID_214010
atggttggagcattctcgcaaaacatcgtgaccctaactggtctccctatgatcttacttagtgagagtgacctgacaaacccattgtgtgctaggaatgtgataactcactccctatgtgttgttgtgtttggatcctgtgatgatcttgaacttgtgttcgggggaccagatgaatag

SEQ ID NO: 97233 - DNA, 237 bp, Glycine max
  Peptide Sequence Number=SeqID_214011
atgacaacaagcattgaccatagagtgaggagggaatcttgtcctccaccatgttatctacttgtgcttgtatttttgttgttggtgaagaaaggggaaaaagggatgatggcgatggtagtaggaaagagagaaaatgagcaaagaaaggccacaacaaaggacgtagttggcggtgaaggagggaaggttgtaggtgttgcaattgtggtaggagttatagatgcgacaaaatga

SEQ ID NO: 97234 - DNA, 375 bp, Glycine max
  Peptide Sequence Number=SeqID_214012
atgacgttttgcaaacgtgcttttcatctgtgttccaatcatcgtcaatccctcgtcaagcactgcgacctcgtttctttactcccttttacgagacacctatcgcaggccggcaatgtaaagcgcgtcttcctcgtcgatacccttgggctggtaaggggcttagaggcaaaaggagttccgtccaaacaggccaaagcaataacttctgccattaccgaagttctaaatgatagcctggaaaatgtaactcagtctcttgttccaaaatcagaaaagcaaaagttagatttgctccaagaatcgaacctgtccaacttcaaatctaaagtgcaaagttctgagaattttgagaaggaaatgccttggccataa

SEQ ID NO: 97235 - DNA, 237 bp, Glycine max
  Peptide Sequence Number=SeqID_214013
atggcatacagtggcacagcagtacctctggtaactgtgcacctcctgtctttgaatggaagagaaatccacggtggatcaagtgtctcttgcggcggagaaaagactaaaaacatcgccgttggtgacaatggaagcaaaaaaatggtgacaatcacggttgaatggtatttgttgctcacacatgttgaaggtcgagacgtactattcgacatatgcgaatacgtgactaaatag

SEQ ID NO: 97236 - DNA, 504 bp, Glycine max
  Peptide Sequence Number=SeqID_214014
atggcaaagtcactgaacttggaagaggattgcttcctaaatgaatgtggagaaagagctgatatgtttctgagattcaactactaccctccatgtccaatgcctgatcatgttctcggtttgaagccacatgcagatggatccaccataacttttctgttgcaagacaaagaagtagaaggcctccaagtcctcaaagatgatcagtggtttaaagttccaatcatccctgatgctctcgtcattaatgttggtgatcaaatagagataatgagcaatggaatttttcggagcccaatacacagggcagtgataaattcagaaaaggaaaggctcacagtggcaatgttctgcctcacggattcagagaaagagattaaaccggtggagaagctagtgaacgagtcaaggccaacgttatacagaccggtgaaaaattattctgagatctatttccagtattaccaacaaggaaaaagacctattgaagcttcaaagatttaa

SEQ ID NO: 97237 - DNA, 177 bp, Glycine max
  Peptide Sequence Number=SeqID_214015
atgatatgcattggacagaagcgctttcagaaggcattggaccttctgcataatgttgtaactgctcccatgtctaccataaatgctatagctgttgaagcttacaaaaagtatatattggtttctctcattcgtcatggacagctgaggttagaaaagacagggggaagcctttga

SEQ ID NO: 97238 - DNA, 369 bp, Glycine max
  Peptide Sequence Number=SeqID_214016
atgactccccatccccgggaattgcttggagcacccagcatttttgctggggcacccaggcgatttagaagtgtatttgatctccagtggtgtacatgcctttgtgaggagtatgcggtgaattttggtcggttttcatcgtcagaaaaggagagaaatagggtacatctacttgggtattgttatactgagaacaagagatggtacatctcttgtggatcagttcaagtggagggtacatccacttggtttttcaaagagaacaagagagggcacatcccttgtggatctttggcttgtaaagaattttacaaggttgaaaagaaatctcaagaaccacaggttgcttggggactggatgtaggcacg

SEQ ID NO: 97239 - DNA, 708 bp, Glycine max
  Peptide Sequence Number=SeqID_214017
atggtaacaactagtgatgaggtaggcaatattgcctcctggtatcttggcacagggtgctccactcgtacgactagtaggaggaactggttcattagtcttgatgaatcaacaaagaacaaattcagatatgtggatgacaccacactcaaggcagaaggcattggtaaagtgctaatcaaaagaaaggatgccacagttgcaagcaaacctaagtggctttggcatcacagattcagacatttgaatttcagcaatttgagtctactgaaaaggcacaacatggtccatggtttgccacatgttgaggtcctaagtgaagtatgtgaagggttcttggaatgcaagcaatcaaggagccccttcaacaaacatgttccgacaaaggctaatgataaactagaagttgtctattcagatgtatgtggtgaaatccaatatgaatcccttggtggaaacaagtgcatgcttaaaagcaaaaggttagcaaactacttgtggggtaaagcaaccacaacaatagtatatgttttaaacatatcacctaccaagaggctagaaggaaaaacacctgaggaagcctcgactagagttaagcctaatgtagctcacttcagagtctttggctcaatttgctttaaacatgtgccagatcaactaagaagaaagcttgatgacaaatgtgaacatgtggttcttattggataa

SEQ ID NO: 97240 - DNA, 240 bp, Glycine max
  Peptide Sequence Number=SeqID_214018
atgaatacctttctccctatttggggtatatctttattaactaccatagacattccattgtgcatgcataggttgctaggaagtagctttcttactcgtgttgctcaagtcttggttgttgcatttagaaagaaaaatgcctcttttggtagtagtggtttcataggcttgtatgaggttcctggcagacagcctcctatcaagggaagtcgaaagattactcatgttgatgaggtagca

SEQ ID NO: 97241 - DNA, 315 bp, Glycine max
  Peptide Sequence Number=SeqID_214019
atgaaagaaaatgaatacaaagagaagagaagatatacttggtgtgcttccaaagagaagaatactaatgcggcatgggcagtcgcaggaaaatcaggacacgacagtgtataccactacactctgaccacagcattcagtcaacggcttctacgtgtccccctacgtccacacctgatcaatattccacgagctcagacggtgtttcttgaagaagagggtcatcggcatgagagaagagtcgcaagttcgagaactagatttcgggaactttcaagtgaaagagaggatgaagattataaaggaaatacgtga

SEQ ID NO: 97242 - DNA, 467 bp, Glycine max
  Peptide Sequence Number=SeqID_214020
gtctgtttcgggaactggtggttaacccaaggaccttttttggtttctactacaaggattggggaactcgtggtgacctgaggtttgttcctataacacatattcagttcaataagaggttgggagtgaatgagaatcaaacatattgtcctccgggagatttcatgaccgcacatacacatggctacatatcaaagcatgggttggaatatcaccaccgtatctgccattatgatttctgtcctcctcatgttgttgtccatgtgaattttagcacgcgttcaccgttgggatttgcgagacaatatttgtggatggagaaaaataaatcgcatgatgacagtacaagtggaggcttcaatcccttctctgtctctttgacgtttgggaactctatcgaagcagttagaggaaaaaaattggaggaatctcagggaaccgctagagatgctgttgtcactggctga

SEQ ID NO: 97243 - DNA, 645 bp, Glycine max
  Peptide Sequence Number=SeqID_214021
atggagttacttaacatcggttttagcaaaaccgatgttaactacttcatatttcacaagtcgcacgcgctcgaaaaccttgccctccctcttctctttgtcatcctcctacctgaaatcgctcttctctttctcctcccgcctgaaatctcccagaaaccgctccctcgacacccacattgtcctcactcgaacccacagaaccccctacattgccggaaaaactacattgtcctcgctcgaacccacagaaccccctacactgtcggaaaacccacattgtcctcgctcgaacccacagaaccccctacactgttcttggaagtgtggctcgaagaaaatcctacatacactgttgctactagggtgctgaaacactcgtgggtgctcaaagctcaaagctttctccgcgaggtactattgttgattgaggtacgaggaaagcttaaagtttcgtgccattttgttagatctcactgccattgtcactgtttgggttcgagactgcttggagcaccagtagagataactagtgataaggatcctgttattgttcataacaagttactgacacttcttgaaattattttggagtttggggcacttgtttggagtaagcttattttagggaaaattgagacatag

SEQ ID NO: 97244 - DNA, 207 bp, Glycine max
  Peptide Sequence Number=SeqID_214022
atggaggaaaactttacaatgcatttcaactattggtctagcaatctaccagctgctaaagcagaagcagcagttgctatcccaacaacaacttttatgcccaaaattccaataggagcgattttagccattgttgatcctgtggtgattgctgtttcgaaattcaaagtggtcttccagtcattgctggaaaggcatttgtgctga

SEQ ID NO: 97245 - DNA, 606 bp, Glycine max
  Peptide Sequence Number=SeqID_214023
atgtcgtttctcgatggcgtgctgctggcgctgtttctgcccatcaaaccggtgttcgccgtctattcttcgatcagtgaacagtggtatatgcgcctgctcaggccggtcatcgacttcgtgccgctcgaccccaccaaaccgatgtcgatcaaacatctggtgcgcatgatcaacgaagggcgtccggtggtgatctttccggaagggcgcattaccgtcaccggctcattgatgaaaatctacagcggcgctggcttcgtcgctgcaaaatccgccgccaccgtggtgccgatgcgtattgaaggcgcagagtacaccccgtttggccgcctggccggggtgtttaaacgccgcctgttcccgcgcattaccctgacggtgctgccggccacggtaattcccatgccggaagcgaaacgcgcgcgcgaccgccgcgtgctggccggtgagcatttacaccatgtgatgatggaagcgcgcatggcggtgcgcccgcgcgaaacgctgttcgacgcttttctcaatgcgcgcacccgttacgggttgagcaaaccctgcatcgaagacatcaacttaagccggacagctacaccgggctgctga

SEQ ID NO: 97246 - DNA, 219 bp, Glycine max
  Peptide Sequence Number=SeqID_214024
atggtgacctcaggggccaggccagaccagaccattggaccagcaccagttttgtgggaggtgaagcagaagtgtcccatttctaatctagcagggaaagtggttggaaaggcatggggccctgatggagcttcaacagtgatacatggaagacgggatgaatccgggaagaagctggcaaaagaaggcgataagcgacagggccatagtaatgcttag

SEQ ID NO: 97247 - DNA, 240 bp, Glycine max
  Peptide Sequence Number=SeqID_214025
atggcagtaataaatcaaggcgtaatagtggtagctgaaaatgagttgtccctcgtcagggtggatgtggccaaggtaggctctaagatctcgcacgtcggactgagagtagcctttgttaaaaggacaagaggggggacctgcaaaataaaggacttcgacactgaaagtggagtggaagctgcgggtccttattggttgggattgttacggtgttgtaacaacccttgtagatcatga

SEQ ID NO: 97248 - DNA, 2913 bp, Glycine max
  Peptide Sequence Number=SeqID_214026
atgtctcgacctatcatgagctcctggatactagattcaggagctacagaccacgtaacctgttccctaaacaatcttcattcatatgagccgattaacccagttacagtgaagctacctaacggccatcatgttcacgctacccattcaggcattgtgcatctttcaaaaaccataaccttgttcgacgttttatacatacccacatttacttttaatctcatttctatttctaaactcgtatcttccactgattgtgcgttgattttttcttccacttcatgtatgctacaggacacgaacaatcgtatgaagattggtatagttgaagagagacatggcctctatcaccttataccagaccaaaacgacaaagccatttgctcaaccattgttcatcctaaatgcaatattataccagtagatctttggcattttcaaatgggccatctatcaacagaaaggctacaatgtataagatcttattatcctattctgagaaataataaagactttgtgtgtaatacatgtcactatacgaaacacaagaagcttcccttttcctcaagcatttcgcatgcatcacatatttttgatttacttcatatggatatatggggtccatgttcgaaaacgtctatgcatgggcataagtatttcttaactattgctgatgatcattcaagatttacatggatacatcttatgcacactaaagccgaaacacgagacatcatcataagcttcattgcatccattgaaactcaatataacaggaaagtcaaaacgataagaagtgacaatgggtctgagtttctcatgcccagcttctatgcatcgaaaggaatcatgcatcaagcaacatgtgtagaaacgcctgaacagaatggcattgctgaacgcaagcaccaacacttgcttaatgtaacatgtgcactcttgtttcaggctaacttgccttccagttcctggtgttatgcattattacacgcagcatacttagtgaactgcatccctactccctttctacataacatatctccctatgaaaagctccatggacatataccagacatatctcatcttcgcattttcggttgcctatgctatgctagcacactcaaagcaaaccgaaagaaattagatcctagagcacacccatgcatttttatcagattcaaaccaaacacaaaaggatatttgatttatgatctacattcacatagcatcattacatcacgaaatgttgtgttctatgaaaatcattttccgcaaatcattaactcacaacactcagacatgaaacttagcacacctctcccagaacccttcttcattacccaacacgactcaatcatagaaatcacaccaacactacctccagtaaatgaacccgtaaacattacacacgcagtggaacctacttcctcacaacccagacgctcaacacgaaccaaacaagcaccaacgtacctacaagactaccaccgtgagctctcttcacacgataccaatccttcaacgaaggttaagcataaagcggatggctccatagagaggtacaaagcacgtctcgtaacgaaaggctacacgcaaatggaagggcttgattatcttgacacgttctctccagtggcgaagctaaccaccgttcgtctcctccttgttgttgctgccttgaaccattggcacctgagacaattagatgttaacaacgcctttctgcatggcgagctagaagaagaagtctatatgcaagttccacctggtttaacagttccaaacacgaatctggcaagccgccaatggttcatgaagctatcaggtctcctaacagtgcatgggttccaacagtctcactcagaccattcactttttctccgttttaatggttcagtcaccacgatgctcttggtatatgtagacgatattattttaacaggaaatcgcaactccgaaatacaggatgtgatcacattacttgatcaagcttttaagatcaaggatctcggaaatttgaaatacttccttggcctggaaatcgcgcgttcttctgaaggaattcatttgtcccaaagaaagtataccttggacatattgtctgatttgggaatgctgggttgtcgaccaaacacaactccgatggattactctactaagcttcaagctacgacaggaactccgttatcggcagaggcttcttcctcttaccggagactcattggccggctaatatatctcactaacactcgtcccgacatcgcgtacgcagtgcaacagcttagtcaatacatgtctagccccacgaatgctcatctccaagcagcttactgggtactacgatacctcaaaggcacactaggctccggcatcttcctctccgccaccgggacccctcagctccgagctttcagtgactcggactgggccggatgccaggattcccggagatcaaccactggtttcgtcgtatattttggttcttctcttatctcatggcaatctaagaagcagtccacagtttcacagagctcgtcggaggctgaatatcgagcccttgcttcaaccacctgtgaacttcagtggttaacttacctccttcaagatttccgaatgacatttgttgaaccagctaccatctactgtgataatcattcagcgattcggattgccaccaatcccgtctttcacgaacgaacgaagcatatcgagatcgattgccatgtagtacgtcaaaaggtcacctcggatcatctcaaattactcccagtatcatcttccttgcaactcgcggatattttcacaaaagctctacctcctgctgtttttcagactctttgtaacaagctaggaatgttaaatatccattcccagcttgagggggggatcttaacagcatctaatgaaaagtag

SEQ ID NO: 97249 - DNA, 192 bp, Glycine max
  Peptide Sequence Number=SeqID_214027
atgggtgccaagtacctcgaagcggtcaagcaaaggctgcatgccatcaaacaatggttcccgaacgaaattagggagggcgtaagaggcaatattaaatggaatgcccaggcccgcatccgtaaatcactgggcggaagtgccatcaaattaagatcagctagattccatgcagagagaatgatttgttaa

SEQ ID NO: 97250 - DNA, 411 bp, Glycine max
  Peptide Sequence Number=SeqID_214028
atgtccactcctttcaactactcaggccttctaattggagcaaatgcaaggaagcttagcacatggcaaccggtgattgacaaaatgagaagtaaattgacatcttggaggaggaggcattatgatttggtgggaggatttgcttggtggttccaatccgggttagggagaggagtgggaggtggaaataatgtgagcttctgggaagcaaagtggttaggagacaagaaaaaaagcaagagcattggggaggctggtgattggtgtcgtggagtgtggtcaaggcatttctcatggagacggttgtggttccaatgggaaatccccattgcatgtgcaacaattggaggaagctttggagatttgggatacaaaggtgggcgggaaagatggatgggtgtgcaaacataa

SEQ ID NO: 97251 - DNA, 453 bp, Glycine max
  Peptide Sequence Number=SeqID_214029
atggatcccataccagccatatcaaaaatcttttcgtatgtggcacaacaagaacggcaactgctaggtaattcttcttctcccaattttaatttcgaatctaaagaaatctccattaatgctgcaaagtccatctgtgattactgtggtcgaatgggtcacactgaaaatgtgtgctataagaagcatggtatgcctcttaatcacgaaacaagaaacaagagtaatggcggaagaaagacttgtacacactgtggaaagataggacacaccattgatgtgtgttactggaagcacggatacccgccgggatataaaccctttaatggaagatccacagtcaataacatggtgacgatggataacaaaaccctggatgatcaaactcagcagcatgaatcccaggatctcgttcaattctccccagagcaatataaggccctacttgcttaa

SEQ ID NO: 97252 - DNA, 480 bp, Glycine max
  Peptide Sequence Number=SeqID_214030
atggcgaaagcggagcaagaacacctgatgttacaggtgcaggctggatcaggtctgaagttttcaatctcatcccaaattacgcgcaacctagtaaagtattctgtcaccgagagggctccttgctttaatgtcgatgcttcttgctgtaaatcggagattcttagaagatctcccagcgagtatctcgacttcaggtctctccagatgtcttcggctttgtccatccagagcacgctttgtcttatagaagcagcaacggagtgcactatccaggataccaccatattattgcatcgtcgccaagctcctttcgttcatgatgaacagcaaacgcttggaagaaagaaggataggaagataggatatcgagatatgcagaaaaagattcaagacttagttctggaagatcaaaaatgcgtctcagtcttattacatgctgttaagaattacctgatggtggtggtgatggtggtttga

SEQ ID NO: 97253 - DNA, 597 bp, Glycine max
  Peptide Sequence Number=SeqID_214031
ggcaccattgttgatgactggaagtttgactattctagtcatgatgctcgccgtatggtttgtaatgaccaggctgatatgaccggtagattgctggccggatcattaacctttgattgtcgcatcatgcactatattatcgttagaattttgcttccccgttcttctaatctggctcaagcctctgaggaggacttgattttgatgtgggctttccttaccggtcgtcaggcattattggccaatgcacctcttccgtatcctcaattggtcaccccttttctctgtcattttcaaattcctcttgatgatgaaccttttgttcaagttaagagatcctttgccataggtgttggtgcagtaacttcatttggttaccgtaaggatcgtgatggacaatggctgaagaaggacgtgctacctccacaagacgagtatactccctctcatccttctcagcgagatgattcctcaacccttatgaatgaagttctttcagaattacgggacctccacacctatgttggcgaacgctttgattccttggatggtcgctttgaaggcatggatacccgcatcacccaacttgaagaggat

SEQ ID NO: 97254 - DNA, 808 bp, Glycine max
  Peptide Sequence Number=SeqID_214032
tggaacctttgacgctgctggtgacgttgaggaggcggtggccgccctcggggatgaaggcgtcggcgtagagggagagcccgcagaggcagaaggcggcggagagcgtgacgtcgacggggaacaaccgggggagcgccgcgagaaggaggcagaggagggtggagagttgggagagcgaggcggagacggagaggcatttggcctttggagcgagacgcgggcggagcctctagagggattgggggaagtatatctaatagagccatacgagggcgatctcctagcttatattaacaaatgttgggcccaaatacttgaagatgatgtcacattctttaccaaatgctgtcgtccctttggccgggcgcaagatgatcaaggaaaccaatacaatccgttgttgcagaaccctagctttcagcagcagaactccacattgaatggaccaacacctctgccctctggcttcgcaacttcttcggtattgaactctgctattctggggctttcaggtactagtttctctggaggatcgagttcacaagtgtttaacaaccaaccgcctcaatttgcaagccttttaagggacagcaagaaccaccacgtcgcggtcgcccccggaaacactttgaaccaggtcagacatctgtttctccttataaacaccgaaaggggtaaccctgggaaaacacctttatccggaggaaacaacacttctgatggtgtggtgatcagggaagatttgaacccaagaaacccctcctctgatgcaactgcattttaccattttacatttcacttttga

SEQ ID NO: 97255 - DNA, 213 bp, Glycine max
  Peptide Sequence Number=SeqID_214033
atggttgaagaagctgatattcagaaagaagagcacgagcgactgatgttggaaggagttgtctcatcttttcaaggacaggatttgaaccaaacaggttacttgaaccaatttcctaacatggaaaatgaggatatccttgcgcttcaaggtattcgtcattatgacaaacaaaagctaagcaatccattaattgataccgaatatagttga

SEQ ID NO: 97256 - DNA, 243 bp, Glycine max
  Peptide Sequence Number=SeqID_214034
gtacgagcagttatgcaagtgggatcagcaactttcattatcagagtaatcaagcacagcggtatctgtagtggcgacagcaaaattctgcaagttgcaagtcgtttccaggatgtcaagacatctcacgtgacatcagctttctgctccccctgtctccatgcttctactgctgtgaagcagttcactgcggcattctgcaagttgcaagtcgtttccaggatgtcacgacatctcacgtga

SEQ ID NO: 97257 - DNA, 210 bp, Glycine max
  Peptide Sequence Number=SeqID_214035
atgaagcgtagctccaaactcgaaggtggagtacacatgaactgcgctaggcaattacattcatggggctccgaaaaaagtggagaatggaggattgcacttgagggtggggtgggatatcgccagtcgagaacgaccttaaatggcaatctgaagggaagagacaccaaaaatgggttttcctttgccggcagtcccttaccttgctga

SEQ ID NO: 97258 - DNA, 264 bp, Glycine max
  Peptide Sequence Number=SeqID_214036
atggcaatcaattcatggggctccggacttgatggtggaggacacacgaacagcgctaggcaatcaattcgtggggctccggactcgatggatgcatggacagcgctacgcaatcaattcgtggggctccggactcgatggtggggatgcatgaatgataatcaattcatggggctccgaataagatttgatggtggaggacgcacgaacagtgctaggcaatcaattcgtggggctccggactcgatggtggaggatgcatga

SEQ ID NO: 97259 - DNA, 411 bp, Glycine max
  Peptide Sequence Number=SeqID_214037
atggctgtgatatctcccggaaagatctaccagcctcctttcccaaagtggtataaccctgacgcaacctgcacataccatgggaaaaccccgggccactccaccgaacagtgcctggcctttaaacacaaggtccaacatttgatagaagccggatggctgacgtttccagaggaccagcccaacgtaaaaacaaacccgcttgccaatcatggagggggagcggttaatgccgtcgagtcgggtaggtcgtgcaggtccaagccgttgaaagacgtgacgacccccagaaggtttatctacgaggccctacaaaaggggggcgtaattccccgcggtgggcacgaggaagattcatgtttgatgcatcctggcgcgctacataacatggaactatgtttagcagtgtag

SEQ ID NO: 97260 - DNA, 443 bp, Glycine max
  Peptide Sequence Number=SeqID_214038
ggcgtgccgggcgcgcgccagtggcgtcgccacctgagcgagaacgcccacaagccgggcgccgatgcgcgggtggtggagcaggcgctggcgctggcattcggcgcgttgacggatgcctgtcccatcttttcaattggttagcccttccgccattctggcacgcttcttgtaatccattcagcagatacgttgagttgcaaaggagcaatcatgttggaaatcttctttctcattggctttgtggtgatgctgatggtgaccggcatctcgctgctggggatcttcgctgcgctgttggcggcggcggcgttcatgctggtgggcgggttgttcgcggtggtcatcaagctgctgccgtggctgattttggcggtggtcggggtatggatttaccgcgcgatgcagaaaccgcaggccaggcgttactgattttttgctga

SEQ ID NO: 97261 - DNA, 366 bp, Glycine max
  Peptide Sequence Number=SeqID_214039
atggcttgccgacgggtgatcaatgccggttacggcagaagccgggttgccgtcccggtgcagcgtcgaatggcgcagcagaggccggatacgggcgcaacccggagtgttttgctaaaaaccgtacggtattatttctttttcttcaccactttccatttcccgccgtcggccgtctcggtaaaagaaactctaaacttgttgcttttccagtgggtcaaaccgaataaccggcgtgccttgcggttgcttttcgccttaatcatgatctcgctcctgtggttagcaaaggtcgatgctgcgccctgcagccggcaggcgccggacgcatttattcagggtgtcagttatctgccgcgcatttaa

SEQ ID NO: 97262 - DNA, 450 bp, Glycine max
  Peptide Sequence Number=SeqID_214040
atgaccatcggccataccggcaacgcggtgttcatgtcgttgaccagcaatcccaagcctgagccggacggcagcacgccggtcagcaacgtgttcgagagcattgatatcgcgctgaacgcgctgaaaaccccgctgcagggcgccgatgaggccaccaggcagcaggtgaacgatgcgctggcgaaagccaaccgcggcctggacaactcttacaacaacgtgctgagcgtgcgcgccgagctgggcagccagctgcaggaaatggatcagctggacagcatcggcaaagagcgcgatatgaccaaccaggtccagatgagcgcgttgacggatgccgatctggccgagtctatttcgtcttactttatgcagcaggcggcgctgcaggcgtcgtataaaaccttcagcgatatgcagggcatgtcgctgttccagatgaatcgttaa

SEQ ID NO: 97263 - DNA, 414 bp, Glycine max
  Peptide Sequence Number=SeqID_214041
atggtgtccaatgcttgcacctccaaagaagcttgggagattttgaggacatcccttgaaagtgttgacaaggtgaaaaaggtgggtctacaaagtcttcatggagagtttgaatccttgtgtgtgaaagggttcgagtcaattttgaattttgacaatagagtggtagtggttgtgaaccaaatgaactattgtgaggagaatatggaattgaatagtcaatggacattaagtcaaagactgtggggttcacttcaagtatatgaagaaggttcaaaagaagaaatgatgagtctttggagcaagttcttaaagccaaagcttcttcgaaagaaaatggaagagaaaaaagtcaaagaggatatggtcatggaagagagtgtggacatggccaaggaagagaggagatcgtga

SEQ ID NO: 97264 - DNA, 273 bp, Glycine max
  Peptide Sequence Number=SeqID_214042
atgggtatgactaagcctcacgtgcttatgctgctgatcatcatggttgtctcaattgcagagaaaccatcagttatagaaggaagggcactttccttaatatctggtcaagggtactcaaagatttttgcaacgcttggagttgtatgcaagtgttgtgatggggttggaggcgcctgcactagtaaatggacagaatcttgcaataacctacaatgttttccttggaaatcacattgtactaagcaacatcaaatattttatgctaattaa

SEQ ID NO: 97265 - DNA, 513 bp, Glycine max
  Peptide Sequence Number=SeqID_214043
atggctgacattgggcataggaatggatatgtaaacagtgtactgccaaataggccccctgctgcaatatctgaagtagatgatttctgcaatgccctttgcggaaacaggccaattcacagtatattaattgcaaataatggaatggcagcagtcaagtttatacgtagtgttaggagctgggcctatgagacatttggctcagagaaagccatcttgttggttgccatggctactccagaggacatgagaatcaatgcagaacatatcagaatagctgatcaatttgtggaagtacctggtgggaccaataacaataactatgccaacgtgcagcttattcttgaggtgtgttctgttgacttcatgagattttgtacttcaagtaattgtcatagcagtttttggtcaggaaagttgaaagcgacaaagtatggatggcaattatacttgaaaatgttcatttatatttttctgcttgttataaaagttattgatttgaatgccatctag

SEQ ID NO: 97266 - DNA, 1644 bp, Glycine max
  Peptide Sequence Number=SeqID_214044
atggctgctttccgcggcgtgcttcgtcacatacacataagcacgttcagctgcttcactccaccgccgcgcatacctactatggcgttgttttcaagtcagggtgccatgtggcactgtcttattccctccaaagcctccagaacagtaaaatcccgcgccggttcagagaactacaataacttagtgttgaagaaagacgagcgcttaggtgctggagagtgtgtcggcgaggttggaagtgggaccacgattgcggccatcgtaacttccgtggggggcccacctgctgccgttggaatcgttcgactttctggcccgggcgcggtgtccattgcgggccgagtgtttcggcccgcccggaagacgtggcggcccactagccacgttgtcgaatacggcgtcgtcttggactccgacggcaacgtcatcgatgaggttttggcggttccgatgctggcaccgaggtcctacacgcgcgaagacgtggtcgagcttcagtgccacgggagcgaagtgtgtctgcgccgcgtgcttaggacttgtttggaagccggagcaacactcgctcaaccaggcgagtttactcttcgcgcttttcttaacggtcgtttggatctctcccaagccgaaaacgttgcaagattaattgccgcgaaatccgtggctgctgcagatgctgcactggaaggaatccagggtggtttctcttctcttgtcagatcattgaggagtcagtgcattgagttgctcactgagattgaagctcgtttggattttgatgatgagatgccgcccctggatttgaatctgattatggataaaatccataacatgtcacgagaggtggagaatgcgttggaaacggcaaattatgacaagcttctgcaatctggattgcagatagcaattgttgggcgcccaaatgttggcaagtcaagccttcttaatgcatggagcaaaagtgagagggcaatagttactgaaattgctggaaccactcgtgatgtgattgaagcaagtatcagtgttagtggcattcctataacacttcttgataccgccggcatcagggacactgatgacattgtggaaaagattggcgtagagcgatctgaagcagttgctaggggtgctgatttaattatcatgactatgagtgctgttgaagggtggacatctgaagacaccaaacttcttgaaaggattcaatctactaagggatcaactggatcatccaccccagtcatccttgtggtaaacaagatagactgtaaaccttgtgctgagactgaatgggacaaaggatgtcagaatcatattttcagtaaacatgtgtttacatgtgctgttactggtcaaggattgcatgacttagagggggcagtattacagattgtgggtcttgaaggcattcctgctgggggtcgcaggtggactgtcaatcagagacaatgtgaacaacttgttcggaccaaggaagcacttgtaaggttacaatcatccataaaggacgaactgcctctggatttttggacaattgatttgagggatgctgcattgtcccttggacagataagtggagaagatatatcggaggaggttttatcaaatatatttggcaagttctgtattggtaaatag

SEQ ID NO: 97267 - DNA, 6363 bp, Glycine max
  Peptide Sequence Number=SeqID_214045
atggctgcattgggagataaaattggttcatcattgattgctcaagcagcagaagtgccaacccttccatggagtggttctcatgtgaaaattccgcctgaaagttccttgattactattcctgacgaaatttatcgggaagcctgtgtttataccacagaggaagcggtggcaagttgtcaagttgtaggataccctgcaatgatcaaggcatcttggggtggtggtggtaaaggaataagaaaggttcataatgatgatgaggtaagggcattgttcaagcaagttcaaggtgaagttccaggttctcccatatttataatgaaggttgcatcccagagccgacatctagaagtccagttactttgtgatcagtacggtaatgtcgcagctttgcatagccgtgattgcagtattcaaaggaggcaccaaaagattattgaggagggtcccattactgtagcacccatagaaacagtgaaacaattggaacaggcagctagaaggttggctaaatctgtaaattatgttggggcggctactgttgagtatctttttagtatggaaactggcgagtactactttttagagttgaaccctcggctacaggttgaacatcctgttactgagtggatagcagagataaatctgccagcagcacaagttgccattgggatgggtatccctctctggcaaattcctgagataaggcgtttctatggggtggaacatggtggagggtatgatgcctggagaaaaacatctgttttagctacccctttcgattttgacaaagcacaatctacgaggccaaaaggtcattgtgtggcagtgcgagtaactagtgaggaccctgatgatggttttaagcctacaagtggcaaagtgcaggagcttagctttaaaagcaagccaaatgtgtgggcatacttctctgtcaagtctggaggaggaattcatgaattctcagattcacagtttgggcatgtttttgcttttggagaatctagggccttagcaattgcaaatatggttctggggctgaaggagattcagattcggggagaaatccgtaccaatgttgattacaccattgatcttctgaatgcttcagactacagagaaaacaaaattcacacaggttggctggacagtagaattgcaatgcgggttagagcagagaggcctccctggtatctttctgtcgttggaggggcactctataaagcttccactagcagtgcagctttggtttcagattatgttggctatcttgaaaagggacaaatccctcccaagcacatatctcttgtccattctcaagtgtccttgaacattgaaggaagcaaatatacgattgacatgatacgaggtgggtctggaagttatagattgagaatgaatcaatcagagatagaagcagaaatacatactttacgtgatggagttttgcccataacagtactattcatcatagtcaacattatggcattccatgaggaagaagcagctggaactcgccttctaatagatggaaggacttgcttgcttcagaatgatcatgatccgtcgaagttggttgccgagacaccatgcaagcttctgagatatttggttgcagatgacagtcatgttgatgctgacacaccgtatgctgaagttgaggtcatgaaaatgtgcatgcctcttctttcgcctgcttctgggattattcatttcaaaatgtctgaaggtcaagcaatgcaggctggtgaacttatagcaaggcttgatctggatgatccttcagctgtaagaaaggcagaacccttcactgggagcttcccagtcctgggacctcctaccgcaatttctggtaaagttcatcagaaatgcgctgcaagcttaaatgctgcacggatgattcttgctgggtatgagcacaatattgatgaagttgtgcaaagtttgcttaattgccttgatagtcctgaattacctttccttcaatggcaagagtgcttggcagttctggcaacccgtcttcccaaagatctaaaaaatgagttagaatcaaaatataaggagtttgaggggatttccagctcccaaattgttgatttccctgccaaattattgaagggaattcttgaagctcatctttcctcgtgtcccgacaaagaaaaaggagctcaagaaagactagttgaacctctattgagtcttgttaagtcttatgagggtggaagagagagccatgcccatataattgttcaatccctttttgaagaatatctttctgttgaagaattatttagtgataatattcaggctgatgtgattgaacgtctgcgtctacaataccagaaagatctattgaagattgttgatatagtgctttctcatcagggaatcaagagtaaaaataagctgatattgctactaatggataaattggtttaccctaaccctgctgcctatagggatcagttaatccgtttctctttactcaaccatacaaattattctgagttggctctaaaggcaagtcaactgctggaacaaactaaattaagtgaacttcgatccaacattgctagaagtctttctgagttagagatgtttacagaggatggtgaaaatattgatactcccaagaggaagagtgccattaatgaccgaatggaggaccttgtgagtgctcctttggcggttgaagatgccctcgtgggtttatttgatcacagtgatcacacccttcagaggagggttgtggaaacttatatacgcaggctctaccagccatatcttgtcaaagggagtgtcaggatgcaatggcacagatctggtcttattgctacttgggagttctatgatgagtacattgaacggaagaatggggttgaagaccaaactttgaataaaatggtggaggagaaacatggtgagaaaaagtggggagtgatggttataatcaaatctcttcaatttttgcctgcaattatcagtgctgcattgagggaggcaaccaacaaccttcacgaagcacttacaagtggttctgtggaaccagttaactatggcaatatgatgcatattggattagtgggcatcaacaaccagatgagtttactgcaagatagtggtgatgaggatcaggctcaagaaagaatcaataagttagctaaaatactcaaagagcatgaagtaggctccaccatacgagctgcaggtgtcagagtaatcagctgtattattcaaagggatgaaggacgtgccccaatgaggcactcctttcactggtcagaagaaaagctttactatgcagaggaacctctgttgcgtcatctggaacctccgctatccatttatcttgaattggacaaacttaaagcctatgagaatatacggtatactccatctcgagatcggcaatggcatctatatacggttgtggatcacaagccacaaccaattcaaagaatgtttcttcgaacacttctaagacagccgacaacaaatgaaggattctcttcatatcaaaggctggatgcagaaacatctcgcacccaattggccatgtcctttactacaaggagcatttttaggtccttgatggctgcaatggaggagttggaacttaatgcacacaatgccaatatcaaatctgaacatgctcatatgtacctctatatcatacgcgagcaacaaatagatgatcttgtgccctatcccaagagaattaacatagatgctgggaaagaagaaacaacagttgaggcaatcttggaagaactggcacgggaaatccattcatctgttggtgttagaatgcatagattaggggttgttgtgtgggaagtcaagctctggatggcagcttgtggacaggcaaatggtgcttggagggtcattgtaaacaatgtgactggtcatacatgcaccgtacatatataccgagaaaaggaggatactgtcactcataaagtggtatacagatcagtctcgattaagggtccactgcatggtgtgccagtgaatgagaattatcaacctttgggagttattgaccgaaagcgtctttctgcaagaaagaacagtaccacatactgctacgattttcctcttgcatttgaaacggccttggaacagtcatgggcaatccaacagccaggatttcaaagggccaaagataaaaatcttttaaaggtaacagagctcaaatttgcggataaagaaggtagctggggtgctcctcttgttcctgtggagcgttaccctggactcaacgatgttggcatggtagcctggtttatggaaatgtgtacccctgagttcccatctggaaggacaatattggttgttgcaaatgatgtgaccttcaaggctggttcttttggtccaagagaggatgcattcttccgtgcagtaactgatcttgcatgtacaaaaaaactacctttaatttatttagctgcaaattctggtgcccgtttaggtgtagctgaagaagtcaaatcctgtttcagagttggttggtctgaggaatccaatcctgagcatggctttcagtatgtatatttaacacctgaggattatgctcggattggatcttcagtgatagcacatgagttaaagctggagagtggagaaaccagatgggttattgataccattgttggcaaggaggatggccttggggttgaaaacttgagtggaagtggggctattgctggtgcttattcaagggcatacaaggaaacctttacactgacatatgtaactggcagaactgttggaattggtgcttatcttgctaggcttgggatgagatgcatacaaaggcttgatcagcccataattcttactggtttttcagcattaaacaaacttcttggtcgggaggtatacagctctcacatgcaacttggtggacctaaaatcatggcaactaacggagtcgttcatcttacagtttccgatgatcttgaaggtatttcttctattttgaagtggcttagctacattccttctcatgtaggtggtgcacttcccattgtaaagccgcttgatcctccagaaagaccagtggagtatttcccagaaaactcgtgtgatcctcgtgctgccatttctggaaccttggatggtaatggaagatggctgggaggaatttttgacaaagacagctttgtggagacactagagggatgggcaagaacagttgttacaggaagggcaaagcttggaggaatccctgtgggaatagttgctgtagaaacacagacagtaatgcaaataatacctgctgatcctggtcagcttgattctcacgagagggttgttcctcaagccgggcaagtgtggttccctgattccgcaaccaagacagcccaagcaatattggatttcaacagagaagagctcccgcttttcattcttgcaaactggagaggcttttcaggagggcaaagggacctttttgaaggaattcttcaggctggttccactattgtggagaaccttagaacatacaagcagcccatatttgtatacatcccaatgatgggcgaactccgtggcggggcatgggttgttgttgacagtcgaatcaattcagaccacatcgaaatgtacgcggatagaacagctaaaggtaatgtccttgagccagaaggaatgatcgagatcaaatttagaacaagagaattgttggagtctatgggtagacttgatcagcaattgataactttgaaggtaaaacttcaggaagccaagagtaacagggacatcgcggcctttgaatccctacagcagcagattaaatcacgcgagagacagcttttgcctgtgtatacccagatagctaccaagtttgctgaactgcacgatacttccttaagaatggctgccaagggtgtcgttagagaagttctggactggtgtaactcccgtgctgtcttctatcagagactgcacaggagaattggtgagcagtcactgatcaacagtgtgagagatgctgctggtgaccaattgtcacatgcatctgcactgaacttgctcaaagaatggtatttacattctgatattgccaaaggtagagcagatgcttggttggatgacaaagccttcttcagatggaaggataatcctgcaaattacgagaataaactaaaggaattgcgtgcgcagaaagtgttgcttcaattgacaaatattggtgactcagctctagatttgcaagctctacctcaaggtcttgctgcccttttaagcaagttggagccatcgggtcgcgtgaagttgaccgatgaacttcgcaagttagaggatcacaaccggcatcaccatgttccatctatttatttgctggttgattga

SEQ ID NO: 97268 - DNA, 237 bp, Glycine max
  Peptide Sequence Number=SeqID_214046
atggaatcaaacctgtctgacccagatggcgattcaaacgcggcattggttcttcagcaagatgccgttccgacgccagccacgatggcgcaaaccttggactctccgagggcaatattctcgaatagaacagtgccattgattacatctggccaattttaccaaactcatgtacgtttttgctttcgcatcgaagactccctcataaaaataatggaagacaagtacaacagatga

SEQ ID NO: 97269 - DNA, 132 bp, Glycine max
  Peptide Sequence Number=SeqID_214047
atgaaggcaaaaaccatcacgaggaggccattaccgatgaaaccaccgactagatcttcgatctcccaaacaaggaacaatggctcaatgagagggagagggagcatggatgaacaacattacaacaactaa

SEQ ID NO: 97270 - DNA, 1153 bp, Glycine max
  Peptide Sequence Number=SeqID_214048
taccctcaccttcgtaggactacacgccctcaccttcaaagggctacacgccctagccttcagaggactacacgtcctcaccttcaaagggctacacgccctcgtcttcagaggactaaacatcctcaccttcagagggctacacgccctcgcctttagaggactacacatcctcgccttcagagcactacacgtcctcgccatcagagggctacacgccctcgccttcagagggatacacgccctcgccttcagaggacaagacgtcctcgcatttagaggactagacagggctacaggccctcgccttctgaggactgcacgcccttgcctttcgaggactgcacgcccttgcctttcgaggactacacgtctttgccttcagaggaatacacgttgtcgtcttcaaagggctgcacgctctcactttcagaggactacacatcctcttcatcataggactacacgtcctcaccttcagagggctacacgccctcgccttgaggactacacgtcctcaccttcagaggactacacgtcctcgccatcagagggctacacggtctcaccttcagagggatccacgccttcgcctttagaggactacatgtcctcgccatcagagggcttcacgccctcgcctttagaggattacacgtcctcaccttcagaggaatacatcatcagagggttacatgccctcacctacagagggctggacgccctcaccttcagaggactacacgtcctcgccattagagggctgcacgccctcgtcttcagaggactacacgtcctcaccttcagagggctacacgccctcgtcttcggaggactacacgtcctcaccttcagagggctacacgccctcgccttcagagaactacacgtcatcgccttcagaggactacatgtcctcgccatcagagggatacatgccctcgccttcagaggacaagacgtcctcgtctttggaggactagacgtcctcgccttcagagggctccacaccctcaccttcagaggactacatttgctcgccttccgaggactgcacgccctcgcctttagaggactacacgccctcgccttcagaggactacacgtcctcgccttcagagggctgcacgctctcgccttcagagaactacac

SEQ ID NO: 97271 - DNA, 234 bp, Glycine max
  Peptide Sequence Number=SeqID_214049
atgagtgtggtggtaagcaaggaatggggtacactacttcatgtggtggcaggaacagaccaagttcactttgtggatctgctggttaaattactgaaccctaatgacctagaactgcaaaatttcaacagaaacatggcgttttgctattctgctgcatctggaaacctgtacattgcttctctgatgatcaagaaaaatgcaggcctaccgaaaattcagggtagagaatga

SEQ ID NO: 97272 - DNA, 453 bp, Glycine max
  Peptide Sequence Number=SeqID_214050
atgcagcatttcagtgagtacaagttgacaagatacaatttgttgatgagaggcttcaggataactcttattagacaaaggatggtgccgagaatggttatggtgctaaagcagcagaaattgtcgatcaagttagaggaagtgcatgactgccaattggtggacgatattctagttgaaaagctgttaatccatgatgtaccagtggatatcatttgtactccaacacagccctttcaaagatgtaatttgtgcacaagtgttcaaccttgtaagaaatcaaagttgccacatgctaccatttttaaggcccgacaatcatacaaacggtgcatagcagacacatttaagaatttcccagcatcatccctgccactaattgagacctttctcacaatagacctagcggaacgtcaaactgccgcagctgctttgcatactgaagtaagataa

SEQ ID NO: 97273 - DNA, 519 bp, Glycine max
  Peptide Sequence Number=SeqID_214051
atggctacacgtcgtttaaccactaccgcactggcagtagtgttgtctttaacgtttgctacagcaccggtcatggctaatcctggaaacgggaatggcggtggtggtcacggtaacagtggcggacaaggtaatggtggtaatcacggcaattccggaaatcacggtaacggaaattccggtacccatggtagtaaacacaatacagacaacccgggtaaatcaaataaaagcgtcagcgatgatgtcgatgctcgtgtaagcttcgatcatgcccgtcatctggcagtgaactatggtttaaccggctatgagtcactgcctccgggcattgcgaaaaacctcgcacgcggtaaaccactgcctccggggattgcgaagaaaaccgtgccggcttctatgctggaccagcttccttcctatcctggctatgaatggcgcgtggtcggtgacgatctggtcttaattgcactcagcacggctgtggtgacgaccattattaacggtgtgttcaaatag

SEQ ID NO: 97274 - DNA, 204 bp, Glycine max
  Peptide Sequence Number=SeqID_214052
atggaagaggtttccttgtatcaattgtatgagagagtgaaacattgttccttctacaaggggcttcaatttctagatttagtggagctaaatcttcagttgcagttctacccacatctattagaatacttgttcctgatgtctcacgatgacaagcctattttacctatctatctcccaaatgtctttgcaaagactcaatag

SEQ ID NO: 97275 - DNA, 417 bp, Glycine max
  Peptide Sequence Number=SeqID_214053
atgacactgctgctccgcaatgtcttgcctagcgatcataactccaatctctctctgcctaagtgccagttggtgtataccatcctgacacggatgatcgtccacgtgtcccagggccctggggtttccggcgttgatcacgggcctctgctagtcattcaaggttcccgtcacccctataaagtgatccgaccgctgatcacccgagccttcatcgagaagtactgcacgcccaggcaggcgcagggtgatgcacatcaggctgcagacgcactatcaccacctcagcaggccgatcccgctggatcactaggcatagagcgttatctgcagcacttggttcgccagcaggcggccaaccaccatgggcaggtgcagatacatgagtgtctctaccggttcagcctcagtcagtag

SEQ ID NO: 97276 - DNA, 881 bp, Glycine max
  Peptide Sequence Number=SeqID_214054
gaagctttacttctacactgcacgcgatcgccttcggaggactacacatcctcgccttcgtagcactacgcgtcctcgcctttagagggctacacaccctcaccttcagaggacatcacggcctcgccttcagagtgatacataccctcacctttagaggactacatgtcctcgcctccagagggctacacgccctcacctttagaggactacacgtcctcaccttcaaaggactacatgtcctcaccttcagagggctgcacaccctcgccttcatagggcaacacaccctcacctttagagtactacacatcctcaccttcagaggactatacgtcctcgccttgagagggctacatgccctcgcctttagaggactacacgtcctcgccttcatagggctagacgccctcgccttcagagggatacacgccctcgccttcgaagggcgacacgtcctcgccttcagaggactacacgtcatcaccttgagaggactacatgccctcgccttgagagggctacatgccctcgccttcagaagactacacatcctcgtattcaaagggctacacgccctcgccttcaaaggactacacgtcctcgccttgagagggctacacgccctcgcatttagaggactacacgtcctcgccttcagagggctacatgtcatcgccttcaaagggctacatgccctcagaggactacacattcttgccttcagagggctacacatcctccccttcagaggactacacatcctcaccttcagaggactgcacgtcctccccttcagagggctatatgtcctcgtcttcagaggaatggacctcctcgccttcagaggactacacatcctcgctttcagaggactacac

SEQ ID NO: 97277 - DNA, 891 bp, Glycine max
  Peptide Sequence Number=SeqID_214055
atggccaaatccacattagaccaactttcctaccgggggcctcccatgagaagaagcggggtggttgtcaaagcgtttgatggatcaagaaagtctgttatcggggaggttgatttgcccgttacaattgggccgtttgttttccaaattacattccaggtgatggatatccaagccgcatacagttgccttttgggtaggccatggatccatgaagctggggccgtgacatccaccttgcatcaaaagctgaagtttgtcagaaatgggaaattgatcactgtgagtggagaggaagccttgttggttagtcatttgtcagctttttcctttattggtgctgatgaaacagaaggaacctctttccaaggcctgactttagagggtaaaaagccagagaaaaatgaagtatcttttgctacttggaagagcgcacagaaagtggtgcaggaaggaacaggtgtaggatggggaaaagttgtgcagttgctggagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccctgcactctctcccaactacgaatctcctgtctacgaggctgaagaggaggaggatgatgaaatcccgaaggaacttgctcggttattggaatatgaaaagaaaaccattcggcctcatgaggag

SEQ ID NO: 97278 - DNA, 426 bp, Glycine max
  Peptide Sequence Number=SeqID_214056
atggctgccaatgaccacacaattttgcatgatagaatttatattcctaccaagaagagtttattggagctttcatcacaagatgccttgttggcccaaaataagttattgtccaagcaacttgaagctttaactgaaacactaagttgcacactttatggtggagctcatgggtcaggcttctgtattcccactgaagaaacatctcatgaagttaattacatgggaaaccagcctagacaaaattttaatgcaggtggattttctggatttcaacatggccaaccttaccagcagcagaataaatggagaactcaccctggtaatcagttcaataaagaccagggtgggccacctaacaggccacaacaacaagggcctagcttatatgagagaacaacaaagctggaagaaactcttgcttag

SEQ ID NO: 97279 - DNA, 213 bp, Glycine max
  Peptide Sequence Number=SeqID_214057
atggaaccaccacaaacgaggttgatgatcaacgttttcatagtgagtttcttagcactacttgtgaacttggtggtgggagtgctcggcgctgataactatagcagagatgattttcctcttgactttgttttcggtttaggaacctctgcttatcaggagtctgagcgtgaaattttgtgtgattttgtgcatccatgtttatgcgtgtga

SEQ ID NO: 97280 - DNA, 804 bp, Glycine max
  Peptide Sequence Number=SeqID_214058
atgtacatttccaactgtaagcaggaacatgagcattcaagtatctctgcggcaaagctgttggccgagaatggcgtaaaggatcttgtaatcctggaggcttcaaactgtattggcggtaggattcggaaggaaaacttcggcggtgtgtccgtcgaactcggagctggttggattgtcggagttggcggcaaagagtccaatccaatttgggaactcgtcgctgaatatggccttcgaacatgcttctctgactacacgaatgtgccatacaacatatatgatcgcaggcgagactctatttctttttccatttttttgcttctgttgctctgccgattgctctgttccataattcctgttatcgttcattccagtggaaagatattttcgagtggaatcgctgcggactcgtacaaaaaagctgtggactcggcaattcgaaacttaacgaaccaggaagaagccgatcgcgaaggcaatagctccaaaacaactgaaccaccttcgtcgccattagagctagcaattgatttcatcctccatgattttgaaatggcagaggcagtaccgatatctacctttacagcgtttggcgaaagggaatttttggttgcggatgaaagaggttttgattatttggtatataaaatggctgaagattttttgttgacatctgagggtaaaatactggacactcgtctcaaactcaaccatggtaataatgggttggtccgttacattgccttaaactgttacattatctttatacgcctactccggggcttcttctctgcactctaa

SEQ ID NO: 97281 - DNA, 132 bp, Glycine max
  Peptide Sequence Number=SeqID_214059
atgaattcttcatatatgctcacgatcaaagaggctactacacattttggcaggttgtggggaataacgtttggtatcctctttggagttatctgtacaagtttcgtaatgggaactacttaccagccatga

SEQ ID NO: 97282 - DNA, 2293 bp, Glycine max
  Peptide Sequence Number=SeqID_214060
atggcgtcagcctgggaaggatttagcgccggtgaatggcagaacagcgtcaacgtccgtgacttcatccaaaaaaactacacgccgtatgaaggtgacgaagcattcctcgccggcgcgacgccagccaccaccaaactgtgggacagcgtgctggaaggcatcaaaattgaaaaccgtacccatgcaccggttgatttcgacactgatttagcgtctaccatcacctcacacgatgcgggctatattaacaaatcgctggaaaccatcgttggtctgcagactgaagccccgctgaaacgcgccattatcccgtttggcggcatcaaaatggtggaaggctcctgtaaagtttacggccgcgagctggacccggcgctgaagaaagttttcaccgattaccgcaaaacccacaaccagggcgtgtttgacgtttacaccccggatatcctgcgctgccgtaaatccggcgtgctgaccggtctgccagatgcgtacggccgcggtcgtattatcggtgactaccgtcgcgtcgcgctgtacggcatcgacttcctgatgaaagacaaagtggctcagttcaactcactgcagagtgatatggaaaatggcgttgatctcgaagccaccattcgcctgcgtgaagagatttctgaacagcaccgcgcactgggccagatcaaagagatggcagccaaatatggctttgatatctctctgccagccaccaccgcgcaggaagcagtacagtggacctacttcggttacctcgcagcagtgaaatcacaaaacggtgccgcgatgtcgtttggtcgcgtgtccactttcctcgacgtttacatcgagcgcgatatcaaagccggtaaactgagcgaagagcaggcgcaggaactgattgaccatctggtgatgaaactgcgtatggtgcgcttcctgcgtacgccggaatacgatgaactgttctctggcgacccaatctgggccactgaatcactggctggtatgggcgttgacggtcgtactctggtgacgaaaagcaccttccgcttcctgaacacgctgtacaccatgggtccatcaccggaaccaaacatgaccatcctgtggtctgagaaactgccgtatgaaaacgatgacctgatgcgtccggactttgacaatgatgactacgccatcgcctgctgcgtgagcccgatgattgtcggtaaacaaatgcagttcttcggcgcacgtgccaacctggctaaaacactgctgtacgcaatcaacggcggtgtggatgagaagctgaaaatgcaggtcggcccgaaagaagcgccaatcactgacgatgtgctggattatgacaccgtgatggcgcgcctagaccacttcatggactggctggcaaaacagtacgtcacgtcactcaacatcatccactacatgcatgataagtacagttatgaagccgcgctgatggcgctgcacgatcgtgacgtttatcgtaccatggcgtgtggtatcgcaggcctgtctgtcgccgcggactcactttcagcgattaaatatgccaaagtgaaacccgtacgtgacgccgatggtctggcagtggacttcgaaattgaaggtgaatatccgcagttcggtaacaacgacccgcgcgtggatgatctggcctgtgacctggttgaacgtttcatgaagaaaattcagaaactgcagacctaccgtaatgcggtgccaacgcagtcggtactgaccatcacctccaacgtggtatacggtaagaaaaccggtaacaccccggatggtcgtcgctccggtgcgccatttggacccggtgccaacccaatgcatggccgtgaccagaaaggtgctgtcgcttcactgacttccgtggccaaactgccatttgcctacgccaaagacggtatttcttataccttctctatcgtaccgaatgcgctgggcaaagatgataacgtgcgtaaaaccaaccttgctggcctgatggatggttacttccatcacgaagccagtatcgagggcggccagcacctgaacgttaacgtcatgaaccgtgaaatgctgctggatgccatggagcaccctgagaaatatccacagctgaccatccgcgtttccggttatgccgtacgtttcaactcgctgacgaaagagcagcagcaggatgtgattacccgtacgtttactcagtcgctgcagtctggcaaaaccgacttacatccccagagcacaacacagattgtgccgcctgctcgccaggctgaaccggagaatacatcgcaat

SEQ ID NO: 97283 - DNA, 5211 bp, Glycine max
  Peptide Sequence Number=SeqID_214061
cgccagctggcaagtgccacagccgcacgatgatgataacgctgcgctgcaggaagcccagctgcgcgacgcgttccattcgcagcagcagcagcggtacggcgacagctggcagcagcagccggcagaggaagaagatgaagaggcgctgcagcaggcccagctggcgcagcagtttgctcagcagcagcaacagcgttacagccagcctgagcaggagagcgcgccggtatttaatctggatacctcagccgcgtttgatttctctccgatgaaagatctggttgatgacacgccgagcgaaccgctgtttaccattgccgccacgccagagccggacgctccggcccagtggcagcagccagcggcacctgagccggcggtacccgcatcgctgagtgaggaaaccagcccgtggtcaacgccagacgacgaggtttacgccgcgccggctgaaacgccgaagccggtcgcccctgcgcaggacagcctgttccaccccttcctggtgcgtcacgaacagccgctggagaaaccttccacgccgctgccgacgctggatctgctgacgtcgccgccggccgaagaggagccggtggatatgttcgcactggaacagaccgcgcgtctggttgaagcgcgtctggcggattaccgcgtaaaagccgaagtggtgggcatctctccggggccggtaatcacccgctttgaactggatctggcaccgggcgtcaaggcggcacgtatttctaacctgtcgcgcgacctggcacgttcgctctctgccgttgcggtgcgtgtggttgaggtgattccgggcaagccttatgtcggcctcgaactccccaataaacatcgtcagaccgtctatctgcgtgaggtgctggactgcgataagttccgcgacaacccttcgccgctgtcggtggtgctgggtaaagatatttctggtcagcccgtggtggccgatctggcgaagatgccgcacctgctggtggccggtaccaccggttccggtaagtcggttggcgttaacaccatgatcatcagcatgctgtataaagccacgccggaagaagtgcgctttatcatgatcgacccgaaaatgctcgagctgtcagtgtatgagggcattccccatctgctgacggaagtggtcaccgacatgaaagacgcggccaacgcgctgcgctggagtgtggtcgaaatggagcgccgctataagctgatgtctgcgctgggcgtgcgtaatctggccggctataacgagaagatcgagcaggcggccgcaatgggccggccaattccggatccgttctggaaaccgggcgacagcatggacaccacgccgccggtgctggaaaaactgccgtacattgtggtgctggttgatgagttcgctgacctgatgatggcggtgggcaagaaggtcgaagagctgatcgcgcgtctggcacagaaagcccgtgccgcaggtattcacctggtgctggctacccagcgtccatcggtggatgtgattaccggcctgattaaagccaacattccgacgcgcatcgcctttaccgtatccagtaaaattgactcgcgtaccattctcgatcagggcggtgcggaatccctgctgggtatgggtgacatgctctatatgccacctaactcctccatgccggtacgtgttcacggcgcctttgtgcgtgaccaggaagtgcatgcggtcgtgcaggactggaaagcgcgtgggcgaccgcagtacatcgacagcattaccgccggtgaagagagtgaaagcggtgctggcggactggacggcgatgaagagctggatccgctgtttgaccaggcggtggcgttcgtggtggagaaacgccgcgcgtcgatctccggcgtgcagcgccagttccgtatcggctacaaccgtgcggcgcggattatcgaacagatggaggcgcagggcattgtctcggagccgggccataacggtaaccgtgaagtgctgtcaccgccacctcacgaaattaagtgtcaggaaaccatgaataaggaatcgtatcagatgaaatttcgcgttattgcctgtggcctgctggccggttttgttgcttcttctgccctggcggatgcttccagcgatctgcagcagcgccttaataaagtgaacagcttccatgccagcttcagtcagaaggtgactgacggtagcggcgcaaatgtgcaggacggcgaaggcgaactgtgggtaaaacgtccgagcctgtttaactggcacatgactgcaccggacgaaagcgtgattatctccgacggtaaaaatctgtggttctataatccttttgtggaacaggcgagcgtaagcctgctgcagaatgccaccagcaatacgccgtttatgctgattgcgcgtaaccagccctctgactggcagcagtacaacattaagcagcagggggataattttgagctgacgcctaaaagcagcgatggcaacctgaaacagttcaccatcaatgtcacttccgcaggcaccatcaatcagttcagcgcgattgagcaggatggacagcgcagcagctatcagctgaagagccagaaaaatggcgctatcagcccggataaattcacctttacgccgccaaaaggggtaacggtggacgatcaaccgacgctgcagcaatatattggtcagcagcatctgctcgccgccggtaaaccgttgccgcgcgctattgaggcaggtcagctgcactccatgatcttatggggaccgccgggtaccggtaaaaccacgctggcggagatcattgcgcattacggcaaagctgatgtcgaacgcatttcagcggtgacttccggcgttaaagagatccgcgaggccattgagcgcgcgcggcagaaccgccaggtggggcgtcgcactattctgtttgttgatgaggtgcatcgcttcaacaagagccagcaggatgcgtttctgccacacattgaagacggcaccatcaccttcattggcgcaaccacggaaaatccctcctttgaactgaactcggcactgctgtcgcgcgcgcgcgtttatctgcttaaatcgctgaccagcgcagatattgaacaggtgctggatcaggcgatgcaggataaaacgcgcggttacggcgacagcgatattctgttaccggacaatacccggcgcatgatcgctgaactggtcaatggtgatgcacgacgcgcactgaatacgctggaaatgatggccgatatggctgagctcaatgcgcagggacagcgggagctaacgccacagctgctgaatgaagtgtcgggtgaacgcgcggcgcgtttcgataacaaaggcgaccgcttttacgatctcatctcggcactgcacaaatcggttcgtggttcagccccggatgcggcgctttactggtacgcgcgcatcatcactgccggtggcgatccgctgtacgtggcgcggcggctgctggcgattgcttcggaagatgtcggtaatgctgatccgcgcgccatgcaggtagcaattgccgcatgggattgttttacccgcgtcgggcctgcggaaggggaacgtgcaattgcccaggcaattgtttatctggcctgcgcgccaaaaagcaatgctgtttataccgccttcaaagcggcgatgcgtgatgcacgtgagttcccggattacgatgtgccggaacatctgcgcaatgcaccgacgaagctgatgaaagaaatgggcctcggcaaagagtaccgttacgcgcatgacgaacccaatgcctatgcggccggcgaggtgtttttcccgccggaaatggcgcagacgcgctactatcaacccaccaatcgtggccttgaaagcaagatcgcaaggatttcaatgcattccggtggaatgcatccctccattcgttcaatcaaccttttattacacaggataagcatgctcgatcccaatctgctgcgtaatgagccagacgcagtcgcagaaaaactggcacgccggggatttaaactggatgtggatacgctgcgctccctcgaagagcgtcgtaaggttttgcaggtagaaactgaaaacctgcaggctgagcgtaactcccgctccaaatccatcggtcaggccaaagcacgtggggaagatatcgagccgctgcgtcaggaagtgaacgcgctgggcgaacgcctggatgcggcgaaagcagagctggataccctgcagaacgaaattcgtgactttgcgctcgcgctgccgaacctgccggccgatgaagtgccgctgggtaaagatgacagcgaaaaccaggaagtgagccgctggggccagccgcgccagttcgatttcccggtgaaagaccatgtagagctgggtgaagcggtcaaagggctggatttcgcctcggcggtgaaactgaccggttcacgctttatcgtgatgcagggccagattgcccgtctgcatcgtgcgctgagccagttcatgatcgatctgcacagccagcagcacggttatctggaaacttacgtgccatatctggtgaaccacgagacgctgtacggtaccggtcagttaccaaaatttggtgaggatctgttccataccaaaccgctgggcgaagaagcaggcagcagcaactatgcgctgatcccgaccgccgaagtgccgctgactaatctggtgcgcgatgagatcgttgaagaggaatctctgccgatcaaactcactgcccacacgccttgcttccgttccgaagccggttcttacggacgcgatacgcgcggtttgatccgtatgcaccagttcgacaaagtggagatggtgcagatcgtcgcaccggaaacctccatggacgcgctggacgagctggtcggccatgcggagaaagtgctgcagctgctgaacctgccgtaccgtaaagtgctgctgtgcaccggtgacatgggctttggctcagccaaaacctatgatctggaagtctggctgccggcgcaggacacctaccgtgaaatctcctcctgctcgaatatgtgggatttccaggcgcgccgcatgcaggctcgctgccgcagcaaaacggacaaaaaaccgcgtctggtgcacacgctgaatggttcaggcctggcggtggggcgtacgctggtggccgtgctggaaaactatcagcaggcggatggtcgcattacagtgccggacgtgctgcgccc

SEQ ID NO: 97284 - DNA, 439 bp, Glycine max
  Peptide Sequence Number=SeqID_214062
atgccgccccagcggggcggtgtagtcggccagcgcaggcgcctcggcctgcaccagcggatcgcagaccaccacgtgcccgctgctgaccggcaggtgcccggcgaaggtgcggtgcagggccacagcggccagctgggtgtcgtccagctgggtggtgcgcaggttggccaggtcgagatgggccatgggggctccgagtgcagtggaggccccaccgtgccggatgcgaagggcaggggcaaggtggtcttgggcaaatggccttcacgtgcgagaatacgccgctgcccgggcgaccgggacccgattggagagatggccgagcggtttaaggcaccggtcttgaaaaccggcgaagggtcaaaccttccgtgggttcgaatcccactctctccgccagttgtttcaaagagcccctggaaacaggggctttttt

SEQ ID NO: 97285 - DNA, 153 bp, Glycine max
  Peptide Sequence Number=SeqID_214063
atggagatggttgtggttgagaatcagctattgcagctaggaccacagcaaaaggaacagaaagaggagcgagaatccgatgctaagatgttaagggcaaaatccaataattatttcggctttctatctcaaggcaagcaaggagaattttga

SEQ ID NO: 97286 - DNA, 732 bp, Glycine max
  Peptide Sequence Number=SeqID_214064
atgctgtgcggcggcatcagcgcgctgatgctacagatgctgcatccggcggcgctggcgggcgtgtgggatcactccagtttccgccaggatatgctcggccggctgcggcgcaccagccagttcatcgcggtcaccaccttcggcaacaccgccgatgcgcataccctgattgagcgggtcaaacgcatccatctgcgcgtcaccggcatcgataacaccggcaaaccctatgccgccagcgatccgcatctgctcacctgggtgcacgttgcagaaaccagccgcttcctggccgcgcatctgcgctacaaaaatccgcagctcagcctcgccgatcgcgatcgttattacgccgaagcggcgcgtgtggcggaagcgcttggtgcgcagcaggtgccgaaaagcgtagaggcggttgaggcctatttacaggcgatgcgggcagagctggtttacgatgcgcgtactcacgaagtgatgcagctgctgcttaacgcgccggcacccagctggcaggcgaaaccggcgatgcgcgtcatgctgcgggctggctgtggtctgctgcccgactgggcgcaacagctgatgcaccagccgatcgggccagtgacgcaatggcggattgataagcagatcgcgttgattgccgccctgttgcgctggtcaatccagcgtggcgcctgggcgcgtgccatgcagcgcatggggcgcgatccgcgttacaggtga

SEQ ID NO: 97287 - DNA, 381 bp, Glycine max
  Peptide Sequence Number=SeqID_214065
atggcgggggcagcggcggcgaagcttcagatttttttgcgattcttttaccgcttcgcatgctattgtcagcgcactcttctgttgcggagctgtcgtcatggtgctgcaaaccctcgatctcaatctgcgcgaaatcgtgattctcgccctgctgctgtggctgtttgtccgctatacgtgggtgatggcagccctgacgctgatcgtcggtgccatcgcgctgctggtgctgctgccgctggatatctactacacgctggtgccgctggcgctactgggcgttggcctgggcatgctgctgcatcactatcagcagcgccagctcctgctgaaacgcgaggcgcgcacgccgcgcagctacaccagcaagcaggatga

SEQ ID NO: 97288 - DNA, 330 bp, Glycine max
  Peptide Sequence Number=SeqID_214066
atgggggagacgcatgagataccctaccgcaatctagccaacttcgagactcgcctcggatatgccactaaagggaaagcagctgatggtaaaatccctcctgctatggcagaaatgggaatgttggatcatctagaggaaaggctcagggccattgaagaaggaaaagattatgtctttgctgacatagaagagttgttcctagtacccaacatggtcattcctccgaagttcaaagtgtcggagttcgataagtacatggggactgcttgcccgaagaatcatcagaaaatgtactgtcgaaaaatggggggcgtacgtgaaagatga

SEQ ID NO: 97289 - DNA, 174 bp, Glycine max
  Peptide Sequence Number=SeqID_214067
atggctacagcaaggtgggcactcaagaatcccgtttatggcattgtgatactacggttgggaatttacacaaacagacccaacgtttctaaattatgctctttcatcagttcaatgaattcatccattcttatctcggtttattctgaagatacgtttgctctttacgaatga

SEQ ID NO: 97290 - DNA, 243 bp, Glycine max
  Peptide Sequence Number=SeqID_214068
atggtgctggtgctactattaattcctattgttgctgttgttggtcatgttgttacttttgttgttgtggatgctcttgctcttgttgctcttattgatgcggctgaaacatgttacatgcctcaactggtttgttcttttttcaaaccaccagcagtactgacaaatttgagtcctaaatctctcttcttcagcaggatctggggaaggatttctgagctggcaccacatggtgcagcctag

SEQ ID NO: 97291 - DNA, 1100 bp, Glycine max
  Peptide Sequence Number=SeqID_214069
atggcggcagaatcatctcgcagtagcgctaaacgcccctttatggaagaagacgacgacgaattctccaaaaagccaccagcaaaaagggttaggtttccaaagggaaagaaagtgaagccaggagatgaagtggtggtggacaaagcaaatgttgaggagggtgaagaagttgacttggtgaatgctaaaactgctaccaatgctgccaaagagcgggaaaaactcagaaggtttctaaagggaaagaaagtgaagccaggagatgaagtagtggtggacaaagcaaatgttgaggagggtgaagttgacttgatgaatcctaaaattgcggctgccaaagagcgggcaaaactcagaaatcaaattactgctgaactccttagggagagtgctggaggtatcacaaacgatttatcggctgctgaagtgacatatgaggataggcaggcagtgataggtgatatcttgtggcaggataatgagaattttgttgatgatgggattcaaattgagcctttcaacctagagaaagaaagggaagaaggttattttgatgctgcaggaaattttgttgaatatataagagagaacgagattaaggatgcatggcttgataatgttgaagttgatccaaaatatgctgcattaagctctgtagcaacagatgacgaagatgaggggcccccagacctttcctctaaagatattggaatcatgaagaggcgcattgcaaatgttcttgaacctggggaaacagtcttgcaagccttgagaaggttaaaaggtaacagtgacagaaaagcaaaaatgtctgctgagactaagattgtatttgaccagctaactgaggatgctatgaagctgatggagaatgatgtttatcatgaaaagcaagaggtttttgatcgtgaagcagaaggatatgagaagttagcccaggcaaattatgatatgtttgctgatgatgacgagcatgataccagtaagccatctacggatgaaaataatgcagttagtcaatcttcttcagatgccataaattctggtcctgagggtggagcatctcaaagcgattacgtgtatgatgaatcttctgg

SEQ ID NO: 97292 - DNA, 289 bp, Glycine max
  Peptide Sequence Number=SeqID_214070
ggaggagattctcttgagtgcgattttcctctttcttattgtcgtttggtggcgacaactatgtcgttttatggttgagttgggaattgacgacgtcatttatgatggagatgctagtggtgaagctggtggtgctgagccattgagaggtgatggaggtttgcaacaacaaactcgaatgcaagatcatgtgcttgaggtactccttgcaaatgtcgaggagtgcgaggatgtcgtgctgcatagggagttggcccttgttgacaatggaggtaggagcagagaatga

SEQ ID NO: 97293 - DNA, 162 bp, Glycine max
  Peptide Sequence Number=SeqID_214071
atgtgggtgttcttttcatatattcagcaattacaatttgaagcccagcatcgatggttgcgacctgcagaaatttgtgaaattcttcgtaattatcggatgtttcatatcacatcagagcctcataacaggccaccaagtatggttactgcatgttactga

SEQ ID NO: 97294 - DNA, 1938 bp, Glycine max
  Peptide Sequence Number=SeqID_214072
atggagaagaaaatgaaaattttcaaaggcgaagctactggatgcttgaaccgtgaggatatgatgcacatagtatttgtccattacttggaagttaagggtaacaaaaatattgtagtaaatactgaaggtgatgagatcccatcagattcccaaaaggtaacttcttcatcgtctagccttcccacacatcatagcagtgttccttctctgagtacagattccgtgagcccaacaaccagtttgatgtctttacgtgaagatgctgattctgaggatatccaccaagcaagttctgggttgcgcccattatatgagtcacaacatagtgggaatggtccattgacggaaaagattggtgctggttcgaacagttcatatcttattcatcccttttcaggtgattatgaacagtcatcaatttctggaacggattatatccctgttgttcatggggataaatttagaggaaatgatactgcttatattgatggtcagaaaacacatgacgtggcaacatggagcactgtcttgcaaagcactgccaaattgcataatgatccttctcttgcatcatctccttccattccatctagttcaatgggagatgtccttgaacaagaacataccatttttagtgaccttttaatgagcaaaagtggtctcactgaggtagcagagagctctcagtctctccaatcaaattggcagattccttttgaagacaattcaggaggcatgccaatgttaacccaaacccagacatttggtctgcaatttagatctgattatggcaccggtttactagggaatgaaactcgtaatgcatgttctgaaagtgctgcgatcctgtacagttttaatggtgaaccaaaagagcagcctatgcagcaaaactatctacaagagcttgaagatggacaatctcaacatgcactaaaatccaattctgcaaataaagttcctgatgaagaaactatcaactatggcttaacagtgaagcgcacattattggacaaagacgagagcctgaagaaggttgatagcttctctcggtggattactaaggaacttggagaggtggctgatttgaatatgcagtcctcacctggtatttcatggagtacagatgaatgccagcatgtgatagatgatacctcattgagcccatctctctctcaagatcaactgtttagtataaatgatttttcacctaaatgggcttatgctgagtccgaaattgaggtgttgattattggatcatttttgaagagtcaaccagaggtgacaacctgcaactggtcctgtatgtttggggaagttgagattcccgccaaggtcttagctgatggaattttgtgctgtcaagctccgcgtcataaggttggacgggtccctttctatgtgacatgttccaataggttagcttgtagtgaagtgcgggaattcgatttcagagagggctttgccagaaatgtagattttgcagatttttataacagttctgaaattctgcttcatttgcgactagaggattttctttctttaaagccagtggacccttcaaatcattcttttgagggtgatatggagaaaagaaacttgatttttcagctcatttcactgagagaggtggaggaatattcaattaaggatgaagtgactacagaattggatatatcccaacacatggtgaaggagcatctgtttcacaagcagtttaaagagaagctgtactcatggcttcttcacaaagtaactgagagtggtaaagggccaaatgtattagatgaggatgggcaaggtgtgctacatttagcagcttttcttggctatgattgggccataaatccaattatatctgctggagttaatatcaacttccgagatgtgaatggatggacagctcttcattgggctgcatcctgtggcaggtaa

SEQ ID NO: 97295 - DNA, 561 bp, Glycine max
  Peptide Sequence Number=SeqID_214073
atgactacttcagagattttcctgcttttttttttggttttttttcctatctttcattttttttttgtgtccctatgcacttggcacatgcttccactgactgttgaaatctgtggtgtcaaggcccatgtaagaggtcaccaagtaaggaaacagtataaaccaatcatctggtctgtgggaatcctggagaagatcatattacgttggaggcgcaagggtagtggtttacgtggatttcgaccaaatgtcattaatgaagtccccgatcaacaaaataattctctgaaagaggatgattatgattatctcaaggagggacggaaacaaaaggaagaaaagatccaaaaggccctatcaagggtgaagtccatggctcagtatccagaggcacgtgctcaataccggcgtctgctaaatgttgttgaggacttccgtcaaaccaaggcatctaacgagggtttgatcaattctgaagagacagttgatggtatggaggatttgattgatattgatatgcttttagacgatgataatttcattcctatagcatttgattga

SEQ ID NO: 97296 - DNA, 726 bp, Glycine max
  Peptide Sequence Number=SeqID_214074
atgttgccgaaactctcaaaatgcatcagcttcaccgcttcgcgggactggctgtaccgtcatttgttcgccgccgcggggctccgctcggtggccaccgacctcggcgaaggaaccatcgtgcattgctgggtacccaaaatgcacaagccatgcaagccaagcctcgtactcattcacggtttcggcgccaacgccatgtggcaatacggggaacacattcgtctcttcatggggcacttcaacgtgtacgtgccggacctcgtgttcttcggcgagtccttcacgttaagggctgagaggagcgagtactttcaggctgagtgcatggtgaagatgatggaggctcatggggttcacaaaatgagcttggtggggatcagctatggtgggtttgtagggtaccgtgtggctgctcacttccctgacgtggtggagaagattgttctttgttgtgctggggtttgcttggaggaggttgacatggaaaatgggttgtttagggtttcaaatttggatgaggcttccagcattttgttgccacagacaccggacaagctcagggaattgatgaagttgtcctttgtcaggcctgccaggggtgttcctacttggttccttcaagatttcattcaaatgtttgcgttgtgttcaatggaaaatagattatcactaattaggacatttgagatgaaggcttttgatttgatatatccaccgttttaa

SEQ ID NO: 97297 - DNA, 1233 bp, Glycine max
  Peptide Sequence Number=SeqID_214075
atgagttgtaatattctatttgtttgcggcagattcgatgtgaaagggtatgtgacggggttcggaaaccctcagtggaagaagacgcacggcgaggccgggaagactgcgattgtcatcaccgctctcctcagcgacggtgccacttgtgttggcaagactgttatggatgaattctcttttgggatttctggtgagaacaagttttatggaacaccaaccaatcctcaaatgccatcttctatccctggaggttcctccagtggttcagctgttgctgttgctgctcgactggtcgactttgctattggtactgatactacgggatgtgtgagaattccagcagcattctgtggtattcttggctttcgaccatctcatggggttatatccaccattggagttcttccaaatgcacaaagcttggacactgttggatggtttgctcgggatccttctgtcctacatcgagtaggacttgttttacttccattgacttcggtggagctcaaaagaacaaggcgtattatttttgctgatgatctttttcaattatctaaagctccttcacagaagacagcatatattattggcaaagctattgaaaatttgtctggttatcagtctctgcagcatatgaatctttgccagtatattgcttctaatgtgcccagtctaaaggggtttcatgagaaattaacacagcaacaaaatggattatctatattgaaagctctcacttcggttatgttttctttacaaggatatgaattcaaaaccaatcatgaagaatgggttaaatctgtcaaacccaggttagggcggggtgtgtctgagcgtgttaatgcagccatgaatgctacacatgataatataaaaaccttgtataaagatgatggaatactagttattcccactgttgcagattatccattaaagcttaatacagagaaggggttttcttctgagtttcatgacagagcttttgcattatctagcattgctagtatttctggatgttgtcaggttgcaattccattaggatgccacaatgattgttgtgcttctatttcactcatctcagcacatggagttgataaatttcttcttaatacggttttggatatgtattcaactcttcaggagcaagttagtgttgcttatgctttgccactgctggatacaaatggtagtatggaaacttctgagcttttgaaggagaagttcctataa

SEQ ID NO: 97298 - DNA, 477 bp, Glycine max
  Peptide Sequence Number=SeqID_214076
atgtgcatagactacactgacttgaatcaagttttcccaaaggatgcataccctttctctaacatcgactgtttggtacatggggcagcgggacaccgaacgttgagtttccttgatgcctattcaggatacaaccaaatcaagatggacctggtagatgaggacaaaactgtttttatcactgaatcagctaaccactattacaaagttataccattcgggttcaaaaatgctgaaacaacataccaacgactaatggataaagttttcaatgcgcagctcgggagaaacttggaagtatatgtgaatggtatggttgttaagtcagatgacatattggtgcacatcaaggatttggagaagttgaaggttacactttcaacccctctagtgctttcaaaacctgtcactaagaaagggcttatagtatacctcttggtattcatcgaagccataagtatggttcttgtccaatga

SEQ ID NO: 97299 - DNA, 201 bp, Glycine max
  Peptide Sequence Number=SeqID_214077
atggtcattgcacttgatggtgcccatgttcgatacgttggatgttgtgtatgttcgtggggggcgaagtgcactgaccttgtcggatggcccattcgtgggggagaagcgtgtgtatgtttatgtgggggaagtgcattgaccttgtcggatgatccatttgtggggacaagcgtggttaaagaatctaagcatttctga

SEQ ID NO: 97300 - DNA, 100 bp, Glycine max
  Peptide Sequence Number=SeqID_214078
atgtcgtcacgtcagctcggcggctcctcaccaggatcttactccctgcaccctgatattgttattctgctcccacaaacaatgttcgcgatcatcacag

SEQ ID NO: 97301 - DNA, 573 bp, Glycine max
  Peptide Sequence Number=SeqID_214079
atgacaatcctcgtctggcgtccatgccttactttggagtcattgaagaaatctgggagcttaatcatgttaaattcattgtgtgtgtttttaagtgtaagaagggttgatagcaatatcaatgtgcgaaccgatgatttcaaatttactttggtagatctgaagaagctagcttatcaaaataaaccttttattatggcagaacaagctaaatatgtgttttatgttcaagaaccttgtgatgaaagcgaaactcaaagtccacctagtcacccgcaccgactcgcccgagttcgcgctcctgagctcggcgctgagtcggacctcggtggtaggcctggacgcggagtggaagcccgtccgaaggtcgttcccgagggtggcggtgctccaaatcgcgtgcggcgactcggcggtgttcgtactggacttgctgtcgcttcccctctcttccctgtgggaccccctgcgcgagttgctgctgtcccccgacatcctcaaactcggattcggattcaagcaggatttggtctatttgtcctccactttcgcctcccacggcggtttcgataa

SEQ ID NO: 97302 - DNA, 207 bp, Glycine max
  Peptide Sequence Number=SeqID_214080
atggcgacagctagtatgggaaaggctaaaatctcttccctgatttacccttttttctctttctacttctatcgcctctccttctccccctctgtgcttctacctaaggatttcagccacgatggtagtgttgcaaacatggtgggttgcccatcatcgaaactagaaccggattgcgtcaacgcatttgacacgagctattcttga

SEQ ID NO: 97303 - DNA, 306 bp, Glycine max
  Peptide Sequence Number=SeqID_214081
atgggagtggctaataattttccaaaatatgctttgaggcatattaagaagaaggagtccaagaaggaaccacggtctatgacctctcaaccctcacctaaaccggcttcaccccctttgagcaaaaatgaagtttttgccttggaaaaatctaagaagtcttgggctgaaacaaagaagaaggccaaggtggataaatccttgaagaaaaaggaggtcttcaagctagaagaggtcattctagcttttgtagccactctatctacagaaaaaagtgtgaaaggaagcacaaagagtaaatattaa

SEQ ID NO: 97304 - DNA, 435 bp, Glycine max
  Peptide Sequence Number=SeqID_214082
atggcggacgacaaaccttcttcagaccgcctcaatgttgtcattgccgaactcgctgtagctcaactccattccaccgtgaccctagcctccatggtctccaaactcgatgtcattttcctgaaactgcttatcccgataactagtcaatacttcccatctttttcctccgaggagtcaccaccgccaccttcgttttccatgctgactccacctccatgctccccacctatgcagccaagtcccgcaccattaccagctccgcttcctatgtcgactgtgcttccttaccctacacccgtgcaaccaattcctgcacccttgtcggctccgcttcctatcccttctcctcatcttccaatctcgatcatgttcgcatcgccactcccattttcgacaaccttttcaacactgttcttcgttctggccatgtag

SEQ ID NO: 97305 - DNA, 168 bp, Glycine max
  Peptide Sequence Number=SeqID_214083
atgggtgaagcttctaccatgaccaccaataaagtgcagcaactcaatatgaaagaatataagacacaattgaggatgcttaattcgtctactgagattagcatattattctatgaaaaaattggaaacacttgggaggagtgggaaaaccagaaatttcagagctaa

SEQ ID NO: 97306 - DNA, 504 bp, Glycine max
  Peptide Sequence Number=SeqID_214084
atgtcacgaaaccttacggattatgcaatcgtcccctctttggcttccggaatgttacagaactttacggattgcgcattaacacttcctttcaactcccgacatgtcgcagaacttcacggattacctaacgatgggtgtcaagtacctcgaagtggtcaagctagggtcgcatcccaacaaacatatggtccccggatgaaattagggtatgacagttgcccctctttacttgtcttttattggagatcaaagggaacaccgaacgaccaacatcatcctgatactgctgaattcgttcctctcggtcgacgaaaggcgcggatgaccataatttgtctccgcatgtcattaggctcactgcctctagatgacaaaaggcgcagaatgaccataatttgtctctgcgtgccatcgaacaagatcatctctggatggcgaaacggtgcgcagaatgaccataatttatcttcgcatgtcatcgggctcaccgcctctggatga

SEQ ID NO: 97307 - DNA, 159 bp, Glycine max
  Peptide Sequence Number=SeqID_214085
atgactaaagcacgtcaaaagggggtacgaaaaaactgcacgaattgtgcaacaatgcttccttttgactttcggcatgttacggaacctcacggattgtgcaacaatgcttcctttcgacttcctggcattgtcacggaacttccacggattgcgtaa

SEQ ID NO: 97308 - DNA, 168 bp, Glycine max
  Peptide Sequence Number=SeqID_214086
atggggagagcaagatcagatattccctctggagttaggacacagattaaaaaggcatataggggaaaatgctcaaatggcagtcatcaagaatgcagggcatgcagtgaacctagaaaaggccaaagagtttggcaagcacttgaaagcattccttatagattctaa

SEQ ID NO: 97309 - DNA, 297 bp, Glycine max
  Peptide Sequence Number=SeqID_214087
atgaatagttcaaagcgtgccggggaagcaagactcacctgcagcggttgccaattcaagtttctagtacctacaatcacaaatccataccgttgctataaatttatatgtggagttacatacgggaaaaggaaattcaagctcgaaggaaccattaatgatgttaataacatgaaaaatctacttcttgataactttaaattcccaattgggtgcatatgtgtcctcacagtggaacaacacttgatttatgtatctttgcaaaaaggaaaagtgcagttggagttggaaggataa

SEQ ID NO: 97310 - DNA, 1581 bp, Glycine max
  Peptide Sequence Number=SeqID_214088
atgtgtgtgcttgtgctgcagtctgcaggtgttgcccaggagcatcaagatgagaggcagattgttgctgtgaactcggatgtgtctgctgctaatgaacgagagaaggaggttgccttgttggggattgaaaatctcgcggatgtgcagattcacgacctgtttgaatgtcgcaagtgcaacatgagttttgatgcgaaggatttgtacttgcagcacctgttgtcatttcaccagaggacgacgaggcggtatcgacttggttcatcagttggagatggagttataattaaggatgggaagtttgagtgccagttctgccataaggtgtttcttgaaaggcgtcgctacaatggtcatgtggggatccatgttaggaattatgtgaggaaagttgaagatttgccgggtcaggcaaatgtccaggggacagatgacaagtctcctgtcagggggcaggatgtgcctttaaggatatcaaagatggatgccctcattgaaattgctcaaaactctattatggaggattctgtcactgaaccccatagttcagctaaactgaataggattcctgcttcagatattgctgttggttacatagatcaagacagaaactctgagtctcctatcagtgaacagaaaatggaagatagcatgactggaaataatgtggatcatgatttggatgaagaattagtagaggaaattgatgatgataaccatgtgattaatgtaaagatggttacttttctggataacgtgggtttgttatctgtaaataagcaggatgttaatgtacctgagacttctaaggtaaaagatgatgtgccattgactattgaggaactggatcagtctgggatggatttggatgaggattctcacaactgtttacttcctttatctgaacatcacataataccagaatctgaaaagagtgaaaattcaggatgtgctaatactaagggtctatttatacttgatgaagacatcagtaacaagactgagttggaatttggtttaaatggcttgaaggatgtgcctgttactgtgagcactaatgtccaagagatggtaaggccagcttctcaagaaaatgtggcacactctagggtttttaactcctccatatccacagaacaatctttggattgtttacctgcattcagctctgataagggagaagaacagttttgtagtgttgaccatgaacatgataatgtgaaggggttccaggaattgagatttgatgaaatagatactgctgagtgtgattttgcaagggttcaagtttctcctcttcctgatgtaccaactgaattgacaaataacacagtggtggaagggacgtgtgcatccccagttcagtttgaatcacaagtagttatgctaaatattggtggcagaaatcagcttacaactgtgtgtgtatggtgtggaatagagtttaaccatgatgctgttaattctgaaatacaaccagattctgttggattcatgtgtccagcttgtaaggcaaaaatctctggtcaagtcaatgtgttattggactgtggatcgccaaatgctggctgtctatag

SEQ ID NO: 97311 - DNA, 131 bp, Glycine max
  Peptide Sequence Number=SeqID_214089
cagaggcttatctggtgtctctcctcttcatcttcactcttaactgtagaaaagaaaaaccgaagatgagcttgttgaatgaggagagaaaaccgcacgctgtggttactccatatccagttcaaggacat

SEQ ID NO: 97312 - DNA, 414 bp, Glycine max
  Peptide Sequence Number=SeqID_214090
atgggttggagagggatactgggttttgaatatggtatagttcaggccccattaggccctgatatctctgctcccccacttgttgctgcagttgccaatgctggtgctcttggacttcttagggcccctgattgggaatcgccggattacttgagggaactcataaagacgactaggaccttaactgataaacccttcggggttggcgtcgttctagcttttccttttgaggagaatttgaatgtcattttggaagaaaaagttgcagtcttgcaagtttattggggtgattgtacaagggaattggtgaataaggctcattccgctgggatcaaagttgttcctcaagttactaactatacgcaaattcaacaaccgagggatttaactcaattggttgagtatgttgcgtga

SEQ ID NO: 97313 - DNA, 519 bp, Glycine max
  Peptide Sequence Number=SeqID_214091
atgcaacatgcttctggaacctcctacagagataaagagagaggaaaaatctggagaatgaagatgagaagagagaagaaaataagtggtggtcagggttttgttttctctaagggcaatgtgagtggtggtggttatgcaaatgagccgcctgatggcgatgaggaatatactccacaacctaggctaaactttaaacaactctttgtgaaggaagttgtgacagatagacctaaggttgatcttatcaaagaaaaccttgagcgtattgaatacgaagaaggcaacaaacttaaaccaaaagtaattttggcagattcaattctagagggactttgtgccccatggaaggaattttttgttgtgaagctattgggaaagaatatagggtttactaccatgcatgatcgtcttgctagagcttggaagatgcctggaggttttgaggtcttgggtttgggcaatggatattttatggtcaagttcgacaaggatgaggatcgaaaaaaaagtcattga

SEQ ID NO: 97314 - DNA, 603 bp, Glycine max
  Peptide Sequence Number=SeqID_214092
atggaaaatgttccacttgaggaagtttttcagaggtgtgattcaaatgggctaacaacagaatctgttgaggagaggctggtcatctttggccacaacaaacttgaggagaagaaggagagcaaggttttgaagtttttaggatttatgtggaatcctctttcatgggtcatggaagctgcaacaatcatggtcattgctttggccgatggagaaggaaatatggttcccaaggcttcaacatttccttcaggaatcaaggctctggctcattatgttcatgatgtaagctttggtggggtcttccgttgcactactggattagcagaccaatttggtaaaaagagggttttcaatactccactttgggatggcaagacccaacaacttgggccaaaactgtgggaaatagttggagaacaacaggggatattgaagataactggaataggtgagcatgctcacattcgtacttttaccgaacactcgacaaagatattggcagaagagagctactctatagataaagaagtacacaatccaaaaaaggattatgatgaatttgttaaattcgtacttactattgacaaaaggaggatttga

SEQ ID NO: 97315 - DNA, 1727 bp, Glycine max
  Peptide Sequence Number=SeqID_214093
tagagtttgagatcatgaagcagcaaatggatgagctaaaagaaaagttagagaaggtggaagctgataaagctgaactagagatagctttgatgaacagtgaagagtgtattgaggagtcacaacatcagttgagggagacacaagagaaattggaggagttgcaaagagagctagaaaatgcctacaaatcaaagcaaagggtagaaaatcacctactggacatggtggctgaggctgaaacattatctgtgaaggttgaattcttagaagctgaggttgataaggagagggctgtgtcaagtgaaattgcaatgaagtatagggacctggaggaagagtttgaaagaaaatctgcaaaggttgatatactagaagttgagcttgataagaaggatttgtcaagtgaaattgcaatgaagtgtagggacttggaggaggagttagaaagaaaatctgcaaaggttgacatactagaagctgaggttgctaaggagaaggatttgtcaagtgaaattgtaatgaagtgtatggacctagaagaagagttagaaagaaaatctgcagaggttgacatactagaagcagagcttgataagaaaaaggatttgtcaagtgaaattgcattgaagtttagggacctggagaaagacttagaaagaaaatctgcaaaggttaacatactagaagcagagcttgataagaaggacatgccaaatgaaattgcaatgaagtgtaaggacttgaaggaagagctagaaagcaaatccacaaaggttgacttgttagaagcagaggttgctaaggaaagggatgtgtcagataaaattgcaaaaaagtgtaaggacttggaggaagagctacaaagaaaatctgcaaaggttgagctattagaagcagaggttgctaaggagagggatgtgtcggataaatatgcaaaaaagtgtaaggacttggaggaagagctacaaagaaaatctgcaaaggttgagttattagaagcagaggttgctaaggagagggatgtgctggataaaattgcaaaaaagtgtaaggacctggaggaagtgctagagagcaaatctgcaaaggttgaattattagacgcagaagttgacaatgagagggctgtgtcagatgaaatttcaatgaagtgtaaggacctggaggaaaagctagaaagaaaatctgcaaaggttgacttgttagaagaagagcttcataaggagagggctaattcagaagaaattgcaatgaagtgtagggaattggaggaagaattgctcaggtcaacagctagctcatatggagaaaagaagattaagcaggaggacctagcactggcagccggaaagcttgccgagtgccagaaaacaatagcatctttgggaaatcagctaaaatccctggctacactagaagatttccttattgacactgcaagcattcctgcaagtccatcactcattggtcaggctggtggggagttgtggaagttgcattcaaatggcacatttttgcctaaaagagattccatttgttcaaggttggctgatggtagctcttatccatccttaaacaaaaatgaggaaacctcgccgctttcgtcgtcttcatcaacttcatcaccagccttgcaaaatcatgtcagttctgagaggagtagaaatggctttgcaaaatttttctctagaaccaagagtgggatccgggtttatgtcttctga

SEQ ID NO: 97316 - DNA, 408 bp, Glycine max
  Peptide Sequence Number=SeqID_214094
atgggtgttaagccttctaaagtgatcaacaacggtccctggatgaaattagggaatgatagattccctactaaaaggaaatctaagcttagccctagaggggatggaccttttcaggtcttgaagaggatcaataacaatgcttataggttggacctcccagaagagtatggagttagcaccacttttaatatttctgatttaattccttttgtaggtggagctgatattgaagaggaggaaccaacatatttgaggtcaaatcctcttcaagggagaggggatgatgcaatcctccctaggaagggaccagttaccagagcaatgagcaagacactccaagaggattgggctagaggtgttgaagaaggccctagggttcttatgaacctcaaggtagatttctaa

SEQ ID NO: 97317 - DNA, 132 bp, Glycine max
  Peptide Sequence Number=SeqID_214095
atggagagtcattttggttatgataggcaccatgagcgagccttgagcaaacctagaggaagatgggaaatgctcgcccggttaggagagcaagggtgttttcgatggggatttctatcatttggtggctag

SEQ ID NO: 97318 - DNA, 273 bp, Glycine max
  Peptide Sequence Number=SeqID_214096
atgatagtgtcatacaaagattggcacgagatgctaccattcacattgcatgattatcgaacttatgtgcgcacttctagtaaggcaacctcgttctctttggtagtgtatgggatggaagttgtgctcccttttgagatggagattccttctttgagaattatggtagaattagggttggaagaagcggaatgggcccaagcatgtttcgaccaattaaatcttattaagagaaagagattggctgccatgagtcatgggcggctatattag

SEQ ID NO: 97319 - DNA, 363 bp, Glycine max
  Peptide Sequence Number=SeqID_214097
atgacgacaaagatactagaggatgaatccaatatgtctcaccttttacgttctttctctcgcatttcttttagatcaaactcatcttcatcctcttcttcaatgaattcaaccaataagttactcaatgaacaagataaccagatccacgaggtcgtaccaaaatacaatctcttcgatgaggaagtccgattcgaagacataaatcaaaatatggatgattggaacattccagaaatccctcaggataagttgtacattcctgaaacaattgaagacaaacataattttgactatataatcaaaatactagaaaatagtattcctctaggacaagatataggggaagaatttcatctatga

SEQ ID NO: 97320 - DNA, 201 bp, Glycine max
  Peptide Sequence Number=SeqID_214098
atgcccctacggacactattcctacttccccatcaggcattgataccagagatcagcggagatggacctaacggacaaatacgaagtatcaagggcacaccggagaccggcttaaaaatcccaggttttcataaacaaagaaaccgaagcggcggcagagccgcacaggatcggtacaagagggagaggggagacgtttga

SEQ ID NO: 97321 - DNA, 471 bp, Glycine max
  Peptide Sequence Number=SeqID_214099
cctagttgttctgccaaagaaggttgcaaacgtagaaacaatcagagcctagttgttctgccaaagaaggtggactattcatgcactcctgaggaagtgcaacagcattttcagtcttgtggaacagtaaacagaatcaccattcgaactgataagtttggccaacccaagggttatgcgtatgttgagttccttgaggtggaggctgttcaggaggcccttttgctgaatgaatctgaacttcatgggcgccaattaaaggtaacggctaaaaggaccaacataccagggatgaaacagtatcgtccccgacggtccaccaatccttacatgggggggttgcgaggcagaaccccatatgcagctccttttatctactctccatatggatatgggttccaaggttcagaatggcaatgcgccacagcccctactattgacagtccaattctggtaggatggactgaatga

SEQ ID NO: 97322 - DNA, 156 bp, Glycine max
  Peptide Sequence Number=SeqID_214100
atgtataattggactccaatctctgttattgattcttatttccaaatagatcctgcaaatgcttctgcgagtcaggccaataaagaggaaatagattctcgatcagtctttgtaggcaatgtcatgcttccatctacaagttttctggttttgtaa

SEQ ID NO: 97323 - DNA, 246 bp, Glycine max
  Peptide Sequence Number=SeqID_214101
atgcagcacacaaacaggcactacaacacccttcttgcaaaatgcaaacaactatgccaatataggttttgcccatgtggttgcatgattcatcctctaaaatgcaagctttgctgcaatcttgagcaactagatgggtactgggatgtgctgccttgcgtgatttggaagccactgtttctgagtgaatggtatatgggctggcttctgcacctgcaactatcctccatttccattctcaactga

SEQ ID NO: 97324 - DNA, 849 bp, Glycine max
  Peptide Sequence Number=SeqID_214102
atgatgctggatggagttaaaccctctcacataacctactttgttggatgcggaccgtggcaggagaaatcatggggttgtggtgaagtatatgttgagggtcgagacgttctgtatgaaacatgtgaatacgtgaccgaagaggatactcggtttgaatgtgtcagacctggattagttctacatttgattgtttatacttttgcaatacctgacagcttggatacccttaagttggttgtggaagtttcactagatgctttcatgaaacttgacagaaacatgatagagcaacaatacatgaagccatggggagcagcagaaaataagtgttgccaaggtttgtggcaaaaaagtgtggctactgatttactttcttgctttattcaggctggtcttgtaacaacactaagcactagaactgtatttggcgccacaaatcccaaaggacagtatgatcctgatcaacgtatcacttacattatgtctgaagtagtttactatgacttcagttcaattactattgcttcagtcctatacttgtcagacttaacccaaggtagcactgtccgtcaatacaacagtctctggtcctttattaagcaggaagaactggatagaaccaccaatgatgaagatctgttaaacagatggccacttcctacactcaagagaggagaatccaggaggtacaacaataaaccaagaggacgtcataatttgacaacgcagaagaagcaggagattaaggaagcctttgagttatttgatactgatggctcaggaactattgatgccaaagagctgaatgttgccatgagggcccttggatttgagatgacagaagag

SEQ ID NO: 97325 - DNA, 906 bp, Glycine max
  Peptide Sequence Number=SeqID_214103
atgaatctgggctttaggttactgagacatacagataaagaaaatattaaatgtctgactgctgctgatctggacaagtatggtgcggatgcatggcttctttctcctccttgccaaccttacacgcgacaaggtgagtttttctttttcttcggcaaaaagttactcaataatcttgtgctaggtctccagaaggacactggtgatgctcgagcattttcttttcttcagattcttgagctcatgccatttttattgcggcctccaagtatgttatttgtggaaaatgttgttggatttgagacatctgatacacatgcaaaactgattgaaatattggaaaaaacaaattttatcacacaggagttcattctgacccctttacagtttggaatcccatattccaggcctcgttatttttgcctggctaagagaaaaccttcatcttttgttaatgaatgtctgaacaacctgctgattcaatcttcaccgccattatttgggcattttgatacagtggctgatgatgacaattcatcaaaagaggacaggcaaaacttgttgcagtcatgtcagcctattgagaaatttattgaattgaagaaccttagcaatgatatagctgttgaatctgaagctttaaggactgatttatctaatgatgctcctagaactttgggggaaaataatggtcatgaatatgaatctttggaccagtattacattcacccaagcttgatagaccggtggggaagtgcaatgggtatccttgccttattgtcaatagcgaccgtagttgctactatagcggcggggcggagcggagcggcacccgtccatgacggacacgtgtggagcggtgcgggttgcggagctgtttttcgcgccgttacttcgaagcactag

SEQ ID NO: 97326 - DNA, 255 bp, Glycine max
  Peptide Sequence Number=SeqID_214104
atggtaaataacccaagtattaggatttcacactggaggtcagagtttcaagaaagtcattatctttcttctttgtctgcatggcttgttggaattctcagtaaagttccttctgtggcagcaaatatgccaaaaagagttttgcttgaacttctttgtagatgccttctaacatcacaactctgcaacaagcagcttgtggattcaacacttcagcttgcagaactgatagatgaaagatacttggtggacaaa

SEQ ID NO: 97327 - DNA, 1098 bp, Glycine max
  Peptide Sequence Number=SeqID_214105
atggccatgggattgatgtcacaactccttcttcttgcctcttcactttcacgatctaaccagttttgtgacgctggaacttcatccaagctgttgatcaagggaggcaccgttgtcaatgctcaccaccaacaggttgccgatgtttatgtcgaagatggtatcattgtttccatcaaatccactattatggttggagatgaggtgactgtcatagatgccactggcaagtttgtcatgccagggggcaccgatcctcacacccacctagagtttgaatttatgggtacagaaactgtagatggcttcttcggtggtcaggctgcagcattagctggtgggacaacaatgcacattgactttgttataccacgtaaaggaagtttaacggctggtattgaagcctatgaaaagaaggcaaggaagtcttgcatggattatggtttccatattgctattaccaaatgggatgaaaccatgtcgagagaaatggagctcatggtcaaggagaaaggtaccaactcttttaagtttttcatggcatataaaggagctcttatgatcaatgatgagtttcttctggaaggatttaaaaagtgcaagtctcttgaacttggaataactggtcctgaggggcaagctctttcatggcctgcagtgttggaaggagaggcaactgctcgtgctattcatttagctgattttgtgaacactcctttatatgtggttcatgtaatgagcattgatgcaatggaagaaattgcaaaggccaggaaatcaggacaaagggtaattggagagccagttgcctctgggttagcccttgatgaatcttggctttggcatcctgactttgagactgctgcaaattttaagaatataagccatctggtaggaactgatcggtgtgcctttaattccacccagaaagctcttggaattgatgacttccagaaaattcctaatggtgtcaatggtattgaagaaaggatgcatttggtatgggatatcatggtgattgggatgaactcgaggttgcacttcagggaacccccaaagaggccgcaactaaggtgggcaaggggtgtccgcaattaa

SEQ ID NO: 97328 - DNA, 1588 bp, Glycine max
  Peptide Sequence Number=SeqID_214106
atcccaattcaaccaatctcaatctctctctctccgatcacccatcacaatctcccaacgtttctccttcccctcctccaccttcaaattcaaccctttctcaaaaccccattaccctattcaagcttctccttcatcaccaccaccaccaccaccaccaacacctatacagggtgcaaagcccattccttttatcatctccatatccatcggcctcattgttcgctttttggttcccaaacccgtccaagtcacccccgaggcctggcagctcctctccatattcctctccaccatcgcgggccttgtgctgagcccgttgccggtcggggcgtgggcctttctgggcctcacggcctccgttgtgaccaaaactctcacctttacagaggccttcggcgccttcacgaacgaggtgatttggctgattgtgatttcgttcttctttgctcgcggattcgtgaagaccgggctcggggatagaatcgctactttcttcgtgaagtggatgggaaagagcactctgggtctgtcttatgggctcacgttcagtgaagtgctgattgcgccggcaatgcctagcaccaccgcgagggctggtggtgtgttcttgccgattattaagtcactctcactctctgctggcagtgaacccgccagtcccacttctaagaaactcggggcttacctcattcagaaccaatttcagtctgctggtaactctagtgctcttttcctaactgctgcagctcaaaatctgctgtgtctcaaattagcagaggagcttggggtgatagttccaaacccatgggttacttggtttaaagcagctagtttacctgccattgtttgtcttcttcttacgccattgattttgtacaagctctatccccctgtaatcaaagacacaccagaggctcctgccctggctgccaagaaactggaaagtatgggccctgtcactaaaaatgaatggattatggtcggcacaatgcttcttgcagtgtctttgtggatctttggagacactattggcatagcaagtgctgtagctgcaatgattggtttatcaatactactcctattaggagtccttgactggaatgactgtttgaatgaaaaatcagcatgggataccttagcttggtttgccattctggtaggcatggcaagccagttgacaaaccttggaattgtgagctggatgtctgattgtgtggccgacaaccttcggtcattctctttgagctggccggcctcattggctgttcttcaggcagcttatttcttcatccactacctttttgcaagtcagactggacacgtgggggctttatactctgcatttcttgccatgcatagggcagctggtgttcctggtattctggcagcccttgctttaggttataatacaaatctttttggtgcaataacacactatagtagcggccaggctgctgtatactatggagctggttatgtagaccttccggatatcttcaaaatgggcttcatcatggcttttattaatgctatcatctggggaggtgttggttctgtctggtggaaatttttgggattgtattga

SEQ ID NO: 97329 - DNA, 432 bp, Glycine max
  Peptide Sequence Number=SeqID_214107
atgaaggtcatgttggtcgtgatcgcaccttatgccttgtttctgactctttctactggcccactttgcgcaaagttgtcagcagaatcatcgactgttgtcatgtttgccaagtgtccaagggtacaaccaccaatgctggactatacttacccttgcctataccccactcagccttgggaaaatattagttggaccgagacccagtcatgtgaccaccagtctgagtgggtcttcagatcggatgtgcatatgacccaactcaacttgtcagaatgcacatctctgactggaaatcatggacgcagctctgatgaggtcaattttgactcctgcaagctcctatggatgttcgattgtggtgagcatcgactcaaaggcattcaaaaaggcacggtggaagaagagaggttgattgcttctcaaaaataa

SEQ ID NO: 97330 - DNA, 525 bp, Glycine max
  Peptide Sequence Number=SeqID_214108
atggcttctacttgttcttcctctttttccgttaccaaaaaatatgatgttttcatcagctttagaggagaggatactcgcgctgacttcactagccatcttcatgctgctctgcgcagaaacaacatcgatacatacatagactacaggatccacaaaggagacgagatctgggtagaaatcatgaaagcaatcaaagagtccactctcttcttggttattttctcagagaactatgcgtcttctagttggtgcttgaatgaactcatccaactaatggaatacaagaaacatgaagatgttgatgttattccggtgttctacaaaatagatccatctgaggtacgcaaacaaagtgggagttatcacatggcattcgcaaaacacgagaaggatagaaaggtgacggaggacaagatgcaaaagtggaagaacgctctctatgaagcagccaatttatcaggcttcctttctgatgcgtacagggaaaaggaaatgaggattcaacgtctcgctgatttctaa

SEQ ID NO: 97331 - DNA, 3006 bp, Glycine max
  Peptide Sequence Number=SeqID_214109
atgattgaagacattatcaaagttattttgcaaaaactaaatcataagtacccaaatgactttagaggccagttcgtatctgatgaaaactatgcaagcattgaatcattactgaaaattgattcagaggaagttcgagtcattggaatttggggcatgggaggtattggtaaaacaactattgctgaggttatttttcataagatttcatctcggtatgaaggcagtagcttcttaaaaaatgtggcagaggaatcaaaaaggcatggcctaaattacatatgcaaagaacttctttctaagttactaagggaagatcttcatattgacactcctaaggtgataccctctatcattacaagaagactcaagcgtaagaaagttcttatcgtactggatgatgtgaatacctcggaacttcttgaaaatttggttggagtgggccgtgactggcttggagctggtagcagagtcattgtgacaaccagagataagcatgtaattatgggtgaagttgttgacaaaattcatgaagtcaagaaaatgaactttcaaaactccctggaacttttcagcttaaatgcctttggcaaaacctatcctcaaaaggggtacgaggaattatcaaaaagagcaatgggttatgccaaaggaatccctttagctttgaaagttttgggatcattgctccgttctagaagtgaaaatgaatgggatagtgcactaagtaaattaaagaaaattcccaatccagaaattcaggcagtgttcagattgagttatgaaggattagatgatgatgagaaaaacatttttcttgacataacttgtttttttaaagggcaaagaagagaccgtgtaacaaaaatattaaatgactgcaatttttctgcagacatagggataagaagtcttttagacaaagctcttatcactattacatcagatagtaattgcatagatatgcatgatctgatacgagaaatgggtagagaagttgttcgtgaagaatccatgaaaaaccctgggcaacgcagtagattgtgggatcctgaggaagtcattgatatattgacaaataatggaggaactgatacagttgaaggaatatggttagatatgactcaaatttcatatataaatttaagctccaaagcattcagaaagatgccaaacatgagattacttgctttccaatcccccaaaggagaatttgagagaattaattcagtgtaccttccaaagggtcttgaattcttacctaaaaatttaagatatttggggtggaatggatatccattagaatctctaccatcaagtttttgccctgagaagcttgttgagctttctatgccatatagcaatctggaaaaactttggcatggagtacagaatttgccaaatttagagagaattgaccttcatggctccaagcaccttatggagtgtccaaagttgtctcatgcaccaaatcttaaatatgtaagtatgcgtggttgtgaaagcttgccttatgttgatgaatcaatttgctctctcccgaagcttgaaattttaaatgtgagcgggtgctcatcgcttaagagccttagcagcaacacttggccacaatctcttcgagcgttgtttttagtacaatcaggtttgaatgaactgcccccatcaattttgcatatcaagaatctcaatatgttttcttttttaattaataatggtcttgcggatcttcctgaaaactttacggatcaaatctcgctttctgagtcaagggaacacaaatgcgatgctttcttcaccttacataagttaatgactaactctggcttccagtcagtaaaacgtctagtattttatcgaagcttgtgtgaaatcccagacaacatctccttgttatcatcattgaaaaacttatgcttatgttattgtgccatcataaggttacccgaaagcattaaggatcttccaaaactaaaagttcttgaagttggtgaatgcaaaaaacttcaacatatacctgcactaccacgatcccttcagttcttccttgtttggaactgccaatctcttcagacagtgttaagttcaacaattgaatcatccaaaagacccaactgtgttttcctgctccctaactgtataaaattggatgcacattcatttgatgcaattttgaaagatgccattgttaggattgaacttggatcaaaaccattgccagcaacagaattagaaaatgaggatgcatccttggagaatgaggatggtgatttttattattttcaattagcaagaaatggtaagatttgctactgtttaccagctagaagtggcaaagttcgagattggttccattgccactttacacaagctttggtcactgttgaacttccccctaatttgctgggttttattttctactttgttgtttctcaagtccaatcatgcaacattggttgctatggaagtattggatgtgaatgctacttggagactagccgggatgaaaggaagaatatatcaagtttctttgtacaagaaaatatcttgtcatgtctcgatcctccgtttggatttacggaagatcacgtatttatatggtatgatgaacaattttgcaagcaggtaattgaaataattaaagagaggaaagccattaatgataagagcaccactcatcatccaaagcttacatttaaattctttgttcaaaccgaaaataacaacgatgaagtggttataaaagagtgtgggtttcgttggatgtattcctttgaagaaggaggatgcaaatacaaggaaagcagggaaattcatgaagtagaacccagtgttgtccaaaataaagtcaaggaatctgagtctaatgagcaagaaacatttcctccaacaaaagaatttaagcaatgtgtcttcagaacttcaaactttgaagcagaagaaacagaagacctgagttgtcttcttgaagaactcttgcatattggatttggtggagacctcatgtaa

SEQ ID NO: 97332 - DNA, 627 bp, Glycine max
  Peptide Sequence Number=SeqID_214110
atgggtaacaatgctccttgcaagtcaattggtataggttctatacaaatcaaaatgcatgatgggattgttagaaccttaaccaaggttcatcatgttctagagcttaagaaaaatctagtctttgtgggagtcatggattcaaaaggttttttttgttggattgaaggtggagttatgcaaataagaaggaaagggaagtttatggtaatacaggggaccaagcaaggaaatttgcacatccttcaaggatctactatggcaagctctgtctcaactatttcacaagctgagaggcatgcgtctaatggctcgtccaatgataattctcaatggcatatatgtctaggccacatgagtgaaaaaggattagaaattctaagcaagcaaggcttacttggaaatcacaaggttgaacctcttcatttttgtaagcactatttctacaggaagcaacatcagacgaaactcccaaaggtgcatttgagagttccatcatggggagaggcaagatacttcctctccatcatcgatgattactcaaggatgacatggttattcatgatgaagcagaaatttgaagctttcaaatgtttcaagcatttgacaattcttaagaagaattaa

SEQ ID NO: 97333 - DNA, 261 bp, Glycine max
  Peptide Sequence Number=SeqID_214111
atggaagacaatgccttggtgttgttgctctatgttggtcgtcacaagtggaagcttctcatgtctcctttgttgctcatgcttttgcgtatctcaccactggcttcctccttcagtgaagaagagaaggtagaagaagacactaaagctacgatttttatctcattttcatctcaaacagagaaactagaagaagacactaaagctgcgatttttatctccaaattatctcattttcatctcaaacagttctcgcagtga

SEQ ID NO: 97334 - DNA, 291 bp, Glycine max
  Peptide Sequence Number=SeqID_214112
atggtggtgagcttcttcttgactcatcttctctttgaagtggagtatcctctcaactcttcttcttctcctttccatgtcattaaaattcaagaagcaaaggactccattgatgaagaagatccaaggcctacaagctccaatggagctacatcattatgtgtagagaagcatccaagaaaggcaaagactgtgaaagtttgccgaagaactttatgtgtttccagaaatggtatgaatattgtgttgggttacaagtgtgaggtgaagtcccacatcgagcaaaagtag

SEQ ID NO: 97335 - DNA, 1417 bp, Glycine max
  Peptide Sequence Number=SeqID_214113
ctgggagaagcggtcggtctcgatcgcaaagtcttgctgtcagagaagctggtattgccaggcgtacggtttgccgttgatgcctatgtcaactttgcgcgtcgcgccaactggcaggaagcagcgtgcagctcgctcaccgagctgtttgccccgcagattcatcagtcgcgcctcgacagctggccgcagcactatccgtggatcaaagaggaaggctatttctacttccgcagccgcctgagccaggcgaaccgcgatgtggaacacggcctggcgctggcgctggaagtctttaccagcgctgagcagcagaaccgtatgctggagatcctgcagtttaaactcgacattctctggaccatgctggatgccatgaccatggcattcgcgctgcagcgtccgccgtaccacacggtgaccgatcagtgggaagtcgcgcaggacagccacgtagtgctttacccggaagggatggcgaagctgaatgaaaccgctgccgccattctggagctggtgaccggcaagcaggatgtggcggccattatcgccacgctcaatgcgcgttttccggaggcgggcggcgtcgatgatgacctgacttatcgctgcccgctgcagtgtccttactgctcgaacccgctggatttttcgcagcaggaacaggagttgagcaccgaacagtggattgaggtgttccgccaggcacgcgccatgggcagcgtgcagctgggcttttccggtggtgaaccgctgacgcgcaaagatctgccggagctgattcgcgccgcgcgcgatctgggcttttacaccaacctgatcacctccggcattggcctgacggagaaaaagcttgatgccttcgccgacgccgggctggatcacatccagatcagcttccaggcgagtgatgaaacgctgaacgccgcgctggccggttcgcagaaggcgtttcagcagaagctggcgatggcaaaagcggtgaaaaagcacggctacccgatggtgctgaacttcgtgctgcatcgtcataacatcgaccagatcgataaaatcatcgatctgtgtattgagctggaggcggatgatgtcgaactggccacctgtcagttctacggctgggcgcatcttaaccgtcagggattactgccaacgcgcgagcagattgcccgcgccgaagcggtggttgcccgctaccgtgagcgcatgggcagcagcggtaatctcaccaatctgctgttcgtcacgccggattactacgaagagcggcccaaaccctgtatgggcggctggggatcgatatttctcagcgtgacgccggaagttcccttcagtgctggagcagagcctggaggatatctggtacaactcgttctggcttcaatcgctatcgcggcttcgactggatgccggaacc

SEQ ID NO: 97336 - DNA, 3405 bp, Glycine max
  Peptide Sequence Number=SeqID_214114
atgaacgccgacgatgtggtctttagctttgcccgcatgtttgatcgccagcatccgtggcataacgtcaacggcggcagctatccctacttcgacagcctgcagtttgccgactcggtgcagagcgtgaagaagctggataacgacacggtagagatccgcctcaacagcccggacgcctcgttcctgtggcatatcgccacccactacgcgccggtgctgtcgcaggagtacgccagtcagctgagcgcggcaggccagcaggaacagctggatcgccagccggtgggcaccggcccgttccagctgagcgagtaccgcaccgggcaatatctgcgtctggcgcgcaatccgcactactggaaaggcgtaccgcgtctgcaacaggtggtgatcgacctcggcgtgggtggcactggccgcctgtcgaaattgctgaccggcgagtgtgacgtactggcctacccggccgccagccagctgtcgatcctgcgcgacgatccgcgcctgcgcatgacgctgcgccctggcatgaacatcgcctatctggcgtttaacacccgcaaaccgccgctcgaccgtccggaagtgcgccacgcgctggcgctggcgatcaacaacgagcggttgatggagtcgatttattacggcacggcggaaaccgcagcctcgattctgccgcgcgcctcgtgggcttacgataatgatgcgcgcgtgacggaatacaatccggcaaaagcgcgtgaggcactaaaagcgctgggcattgaggatttgcatctgcgcctggtggtgccgaccacctcgatgtcgtggaaccccagcccgcttaaagccgccgagctgttgcaggcggatctggcgcaggtgggcgtgcgcgtcaccatcgcgccggtcgagggacgttttcaggaagcacagctgatggccatgaaccacgatttaaccctgaccggctgggccaccgacagtaacgatccggacagtttcttccgcccgttgctgagctgcgcggcgattcgttcgcagaccaactacgcgcactggtgttcgcccgcgtttgatgaggcgctgcagcgcgcgctgctgtcgcagcagctgtcggcacgtatcgacagctacgatcgcgcccagcagatgctggcgcaggcgctgccggtgctgccgctggcgtcatcgctgcgcctgcaggcttaccggcacgatattaaaggcctggtgttgagtcccttcggtaacgcctcgttcgccggggtttaccgcgatgagcacggcgaggacctgagctatttcacgcccaacgcgccgctggaaggcgcctcgctgttcgatgcctggtggttctggtttaaagggctgctgcagtttgatttcggtgtctccagcaccaacggtcaggcaattgatatacagctgcgcgaggtgtttcccgccacgctggaactgtgcgtgctggcgtttatgctggcgctgctggtcggtattccgctcggcatctgcgccggcgtgatgcgcaataaatggcaggataaagccatcagcgcgctggcgctgctcggcttctcaatgccggtgttctggctggcgctgctgtttaccctgctgttttcgctgacgctgggctggctgccggtttccggtcgtttcgacctgctctatccggtgcagaacattactggttttgccctgattgacgcctggcttagcccttcaccgtggcggcatgagatgctggtcagcgcgctgacgcacctgattctgccggtgatcgtgctggctgtggcaccgactaccgaagtgattcgcctgctgcgcaacagcaccagcgacgtgatggataaaaattacgtcaaggcagcggcaacgcgcggcttgtcgcgcttcaccgtgattcgccgtcacgtgttgcacaacgcactgccgccggtgatcccgcgtcttggcctgcaattctccaccatgctgacgctggcgatgatcaccgaagtggtgttcaactggcctggactggggcgctggctgattaacgccatccgtcagcaggattacgcggcgatctccgcaggcgtgatggtggttggcgggctggtgattctggtcagcgtactgtcggatattatcggtgcggcgctcaatccgctgaaacacaaggagtggtcgcaggctggagtagaactttcaaatcataggcttcagattatggatgaagcggatttgcgagatttcgaatgttatgtttcagtgcgtggtgaccacacaaagcagttggagaatggaatcatggcacgtaacatcgcccccggatattgtgtagtagaacgcgccggatctctggattatcaggcaagggagatcttcagggacattcgcagcccagccgtaaacatgtttatgcaactaaatgccgatacgccctggttaaggccgggacaaatactgattgtagctgacccggatacacccgctcctctaactatgcaggcactcacaacattaaaacaggcaaaatcacgcactaataacgcattaatcggcgttaatgtcgaagaagccggttttatgcaaaagcactacggcatgattgcggcgctaaccagtgccgtagataaaattttcggaaccgccggagatgccggtgaaaaatatttcaatgccattgagcagacgctaaagaaaattgaggcaagttatcagaatcagtttcgcacccagggaacgctgattgggcagcagttttttgtcgagcgaaatcagttgctgaatcagttaaaggaattagtaaataagcccttactcaaaaatctggcccgatactccataaaattccagcagtacgagagtatgaaacgtgcgctgaacttgtccagtcgttcgatagttcacgagtggtcgacggtgggtataggcgctataccaggatattcttattatgtaggcaatgcagctaaagccgccagattcatgaaaatgggaggttttattggcattggattttcttttgctgggaccacgaatgatgtggtggatgcttgcagtaaaggccgggaaggtgaatgtgggaaaattgcggttaaagactattcaaaatttgcgtttacaacaggtgggggcatgctgggtggcgtatggggtagttctgccgcattagctggttgtgctgctataggaattgtaacagcgggtgctggaggggttgcatgcgcagttgttggttcagtcgccggtggggaatgtgggaaaattgctgtaagggactactcaaaatttatagttggcagtgccggaggagtagttggaggggcatatggcggtgctgcaatggccggtgtttgtgctgctgtaggtggttaccttggcagcactggtgcagaagcgatcgtcaataaagtaacagagctactatga

SEQ ID NO: 97337 - DNA, 249 bp, Glycine max
  Peptide Sequence Number=SeqID_214115
atgtcaagtgttgaagcctattatgagaacgggaaacaattgaaggatggaaaaggaaagaggaaaatatgcaatttgagtgggcataacagagataaattccaggagagattggatttcaaattctatgatttccaagctctggagatagaaaaagggtggaacaatctttttgtttccattattagtatagaaacaggggaaaccatagctaagtctggcaaagcagcagttaactttgttgcttga

SEQ ID NO: 97338 - DNA, 334 bp, Glycine max
  Peptide Sequence Number=SeqID_214116
ggagaaagattctcttcaacaagagaatgaagagtacaagaacaaggttaaagatcttgaaaaaaagctgaaacaaaagaaagatgtaaagcaagatcaatatgatgggaaagattgtagtacttctaccactgcactgcatgatttgaagttcttacagtcaaattggcgcacaaaagataacggggtacataactttggcttctactgcagaaagaggataattgaagaagcagcaccaaatccagtgaaaggacattgttgccgcatctcttccaatgttacacataacaagaacgacatcccaagctggttcaatcacttttcactctaa

SEQ ID NO: 97339 - DNA, 1149 bp, Glycine max
  Peptide Sequence Number=SeqID_214117
gatgctaaacatggtacaaccactggggtgtcagctcacgatagggcaacaacagtcttggcccttgcgtctagagattctactccaggcgatttcaatcgcccgggccatattttcccactaaaatacagggaaggtggtgtcttgaagagagccggacatacagaagcttctgttgatcttgctgtacttgctggtttggatccagtggcagttctgtgtgagattgtagatgatgatggttccatggctagactgccaaagcttcgccagtttgcagagcatgaaaatttgaaaattgtatctattgctgacttaataagcaaggagattaacacttactgttattgcagatatagaagaaaaagggataagttagtggatcgctcttctgctgcacagatacctacaatgtggggaccattcacagcttactgttacagatcacttttagacgggattgagcatattgcaatggttaagacaaatcttggcttcatgaaagtgccactgtcagaccaaagcacgactaacatttatgcttctgcttttaaagaacagcatagaaaactcatagcagatggtgaaattggagatggacaagatgttcttgtgagagtacactcagagtgtctgacaggagacatatttggatctgccagatgtgactgcggaaatcagcttgcacttgcaatgcaacagattgaggctgctggtaggggtgtgctggtatatctccgtggacacgaaggaaggggtattggattgggccacaagcttcgtgcttataacctacaggatgatggacgagatactgttgaagccaatgaggaattgggattgccagttgactccagggagtatggcattggtgcacagatgttgagggacttgggtgtacgatctatgaagctgatgacaaacaatccggcaaaatatattgggctcaaaggttatggtttgacagtttcgggtaggatcccattgttaactcttatcacttcggagaacaagagatatttagagaccaaacgtgtgaaaatgggtcacatatatggcacggaatttaacggccgattgagcactcatgacagtggtaatggtaatgccaccaggattgaggactctaatgctgttactggcttataa

SEQ ID NO: 97340 - DNA, 933 bp, Glycine max
  Peptide Sequence Number=SeqID_214118
atgacagattttcagccgttacagcagaagcctgagcctgctgatgcccatgccgagtttgagcttggactggaggagtttatgcgtgggcacttggatgattgtatgtcgtttgcttcgtgtagctcgtcccgtgcaccggatgatgaggatgacgagggtgatcagctggttcggaggagaaggaggtctgaccttgaaggggatgatttggctgagtcgtcggctgcacgccggcggcattcgaggattttgagcaggtgggctgcacggcaggcacaggagatgataactaccatcgagaggaggaatcgagagtctgagttgatggcgctcgcggggttgcatactgtgtcaatgttggattcttcttttctgaggggctcgcagtctccaacttctgggcaggagggggctgtggagaggccgagcactcaggcatctgctattctgcagatgtggcgtgagttggaagatgagcatttgttgaaccgggcgcgtgaaaggatgagggtaaggttgcggcaccagaggaattctgactctcataccaatgtgtccagtaccatgtctgatagtcgaggcagtgagaatcaaggaagtttgggggatgcaagtgaaagtgaaaatgattatggtacttggtcacatgatcaaactggatcaaggaatgcacatggggatcataatgggtctagcagggagcaatctcttgatcttggcgaagttgagagggagagagttagacagattgttcagggatggatggaaagcggtattagtgatcattcgtctaatgtgagtcagataaacaatagccggagagcagaatggcttggagaaacagagcgcgagagggtaagaaatatcagggaatgggtgcaaatgattagccagcagagaggttcacgtgggagccggagggatgctcaa

SEQ ID NO: 97341 - DNA, 374 bp, Glycine max
  Peptide Sequence Number=SeqID_214119
atgggtacagctgatattggacttgtctaccatggagacacgtcttgtgctcttgctggttatttagattttgactatgctgtagatttggatgcaaggagaactatgacaaggataagaggtgagatgaggcgccatctactagaggataagccatggaaggagaagcttcaccaccaaaagagtgccttggataagaagcttacagaggaagcttcaatgaaggaagagaatgagagagatagagtgatgcaatcctaccccctaagggcattggatagaagactccaagaagattgggccagagatgcaagagaaggccctacggttctcatgagccttaaggtcgatttcaggcccatgacatgggctaa

SEQ ID NO: 97342 - DNA, 1278 bp, Glycine max
  Peptide Sequence Number=SeqID_214120
atggaatccggtatgaccactcgcccgcccgccgagccgctgctgctgaaccgtgaattgtcgctgctcaaattcaacgagcgcgtgctggcgatggcggaaaatcccggcacgcccctgctcgaacggctgcgctacgtgtgtatcgtcagttccaacctggacgagttcttcgagatccggatctccagcctgaaagagcagcagcgccaatcgcccaacctggtggggccggacggcatgacgcccgaccaggcgttcgagaacgtccagcaggcggtgcacgagctggtggggcgccagtatgcgttgctcaacgacgccatcctgccggcgctgcaggccgagggcatcgcgctgcatcatgcgtcggaatggaatgccgagcagcaggaatgggcgcgcgaggtcttcaaccgcgacgtcatgccgctgctgaccccgatcgggctggacccggcgcacccgtttccgcgggtctacaacaagagcctgaacttcatcgtttccctgtccggcgccgacgccttcggccgccaggcctctatcgccgtggtgcaggcgccgcgcgcgctgccgcgcctgatcaagatgccgcaggagctgtccggccatccggaaggctacatcctgctgacctcgttgctgcgcgccttcgtcggcgagctggtcccgggcctggaaatgctgggctgcttccagtggcgggtgacgcgcaacagcgacctgttcgtggaccaggaagaagtctccaatctgcgccacgccttgcaaggtgagctgtcacagcgcaacttcggcgcggcggtgcggctggagatcgacaagctgaccccggtcgagctggaatccttcctgcatcgcgaattctcgctcaatcccgaggacacctaccgcgtgccggggccggtgaacctgtcgcggctgatgctgctgtgctattcgcccaaccggcccgacctgctgttccccgactaccgcgcgccggtgccggcgccgttcgaccgcgtcggtgacaagccggccgagctgttcgaggccgtggccaagcatgaccgtctgctgctccacccctatcattcgttccatcccgtcatctacttcctgaccgccgccgcgctggatccggacgtgatggccatcaagcagaccatctaccgcaccggcgaggattccgagctgatgaagatcctgctggccgccgcgcgcgccggcaaggaagtgacagtggtggtagagctgatggcgcgtttcgacgaacagaccactatcaactga

SEQ ID NO: 97343 - DNA, 384 bp, Glycine max
  Peptide Sequence Number=SeqID_214121
atggcttctccacctagctcgcctcctcctcctcctccttctccttcagacacatcagtttcaccgtctgccgtgaagcggacacaaattaagaacatatttggggggattgtggcgcgtgataaggtggacgtcacgtacgagaactggaaggaggtccctactgctcagaaggacttgatttgggaggatattcaggtggaatttgaaatcccagaggcttctgatgataggacaaaaaagaagttacttcacactatcggcgagagatggaggcagtttaaatcagacctcataaggaaatgggcccttgcagccgatcaggacggtgtagacgacactgtctgtgagaaatacggcataagcaaggaaaaatggtcctag

SEQ ID NO: 97344 - DNA, 747 bp, Glycine max
  Peptide Sequence Number=SeqID_214122
atgaataacttgaaagtatcaattatcaccgtctgctacaacagcgcaaaaacaattgaagacactattgtttctgtcgcctcccagcaatacagaaacaaagaacacattattgtagatggtgcatccacagataacactatggatattgttaaaaatgctgcaagcgtatccagctatatttctgagcctgacagaggcatttacgatgcaatgaacaaaggtcttaagcttgcaaaaggcgatgtcatcggcttgctaaatgctgatgacttttatgctgatgatgatgtactcgccaatattgccgaaatatttaaggatcatgatgtgcaagcctgttttgcagacttggtatatgtagatcaaagagaaagctcgcgagtggttagatattggaagtctgagccctatcaaaagggattattcaaaagtggctggatgccagcacatcctactttttttgtaagaagagaggtctatgagaaatatggcctctttaatctagattataaaatagcagcagactttgaactcctcttcaggtttattgaacagtatcaaattaaaacagtttatcttgataaggtactcgtcaaaatgcgaacaggtggtacaacaaacaaaagtttaaaaaacatatgggcgcaaaataaagagatcattcagacactgaggttaacataccctgatttctcagcaagtatctacaagataaagggcatgacactacgattatccaacgaa

SEQ ID NO: 97345 - DNA, 276 bp, Glycine max
  Peptide Sequence Number=SeqID_214123
atggcaaaggggggtgtatttagtaaaaagaggtgtgcaaatagcaaccaggcccacttggaccttctagggtgttccaacagaaggtggtgccttcaggcgagctgggcggcaaccacctccctcttttcccctataattaggggaaagagggcagagcaaattcgttcagctcttctgatatttaggattcacttgaaattagtgaaaaaattgtttccgcgaagaaaatccaagccaaggcgcttccgtaacgcttccgagacgtttccctga

SEQ ID NO: 97346 - DNA, 513 bp, Glycine max
  Peptide Sequence Number=SeqID_214124
atgaaagattgcattagtctcttcatcaaagtcggagacctgccccctcctcaggttatgctcgcacagttggccaccctccaagatcaaggggtggcccaggaactgataaaaggaaactacgggcccttcacctgggagcacaagcctcgattaagcattaaggaagaagaccttgagttctctgaaggcgtggatgtggagtcctctaaaggcaaggacgtgcagccctctaaagacgagggtgtgcaaccctctgaaggtgagggcgtgcagccctctgaaggcgagggtgtgcagccctctgaaggcgagggcgtgcaaccctttgaaggcgaaggcgtgcagccatctgaaggtgaaggggtgcagccctctgatggtgaggacgttcagaccactgaaggcgagggcgtgcaaccctctgaaggtgagggcgtgcatccctctgtaggcgaggatgcacaacctgttggatcaagtggcctcggaataattaagaagaggggctga

SEQ ID NO: 97347 - DNA, 330 bp, Glycine max
  Peptide Sequence Number=SeqID_214125
atgcacctttgccttatccctaccttgttactttttcttcaccatttcaatgttcctttggatgatgaaccatatgtcaagtgggttcgcaaacaagacttgcctccgcctattcctaatgaacgtaccccatttcctccaccacaaagggatgcttcctcttctctgctgactgaagtcctcacagagctctgcgatcttcgagcatttatgggtgagcattttgatgcgatggatactcactttgatggaattggtactcgtatcactaggcttgaagatgatataagcttcatcaggcgttgcttcgatcccccgactgacttttag

SEQ ID NO: 97348 - DNA, 198 bp, Glycine max
  Peptide Sequence Number=SeqID_214126
atgtggaagatcgaggagatgaaagagatggaggaactggtgtgggtgggtctccaaaggttccttggtggcagtggccagcagcggtggtggtggaggaagatccctttcacttctttgatgattctgccatttgaaggtgtttcaactggttttgatcaatgggagtaccctgtaactattggagcctactggtaa

SEQ ID NO: 97349 - DNA, 219 bp, Glycine max
  Peptide Sequence Number=SeqID_214127
atggaaaatccatatatcttcaagtgggagcaagggggacctaaattcttagattcatcgacatatgaaacacctaatgttcatggtgaggataatgcaacacatggagaaactcaatttaattatgaagctgataatgaagaactaccaaatgcaatgcaaactgcctcaaacgtgaatgcaaagaggaaaagaggggaaaaagggaaaaaaatctag

SEQ ID NO: 97350 - DNA, 1194 bp, Glycine max
  Peptide Sequence Number=SeqID_214128
atggcttcttcttcttctcttctcccaaggccacacattcccacccccctcatctccaaactcacctcctccccaagaacatggagcctcttcatcctcaaatacccttcgcaccccaaaaccaacagcaacaacaacaaaagactaatcctttcccccaccaatgcagtgtacacccaaagcccccacaccccttccacaccctccaagaccgaactccacaacgacgccatcaccgtcctcaacgagaggattcgacgcgacttcagcaagaaggaggcattcagaacggtgatggactcggaggaggcggggaagtacatgcagatggtgaaggtgcagcagcagagagggctgcagaagctgaagggcgacagggggaccaaagatggcgtctttagctacaaagtggacccttacacgctccgttccggggactacgttgtgcacaggaaagtcggggttgggaggttcgttgggatgaggtttgatgttgccaagaattcttcgcagcacactgagtatgtcttcattgagtatgctgatggcatggcgaagctacctgtccaccaggctgctaaaatgctctatagatatagcctttccttcaccaatgccgtaagggcattggttagcaagatcctagaagtaaataagaagggcaagtactcgggatttacaacaaccctgctcaaccaaccgaacttgaccccttggccaaatgaaaccaaaaagccgaaggcattgagcaagttgagtgataccagtgcgtgggagagaagaaaggttaaagggaaggtcgcaatacagaagatggttgtggacttgatggaactctatctacataggctcaaacaaagaaggcctccctatccgaagagtcctgccatggccaaattcgcagctcagtttcgttatgaacccacgccggatcagaaacgggcatttattgatgttgagagggatttgacagagagagaaactccaatggacagattaatttgtggagatgttggttttggtaaaactgaggttgcactacgtgctatctcctgtgttgtctcagctaaaaagcaagcaatggttctggcaccaacaatagttctagcaaaacaacattttgatgttatttcagagcgcttttctgtatatccggatattaaggttggactactaagcaggtttcagtcatag

SEQ ID NO: 97351 - DNA, 2319 bp, Glycine max
  Peptide Sequence Number=SeqID_214129
atggaaccggaatccggaacttccacttctcggaatccttcgcagttgtcatgggtgaatctgtctagaaatctgttattagcgtatcaaagctttggtgtggtgtatggagatctgagcacttcacctctctatgtcttcacaagcaccttcagggggaagttgcagaatcatcatgatgaagaaactatattcggcacgttttcgttgattttttggacccttaccttgattccattgcttaaatatgtattcatcctattgggtgctgatgacaacggggaaggtggaacatttgctctttattcgctgctgtgtaggcatgccaagtttaatttactccccaatcaacaagcagctgatgaggagttgtcatcctataaatatggtccctcttcacaggctgtagcctcttctccattgaagaggtttctagagaagcataaaaggttaagaacagccctgcttattgtggtattgtttggtgcttgcatggttgttggtgatggtgtgctcactccagcaatttcagatgaacttgtcttgcttgcctgcgtcatattggttggactgtttgctctccaacattgtggcacacacaaagttgcatttatgtttgcacctattgtaatcatctggcttgtatcaatattttctattgggttgtataatacaatttattggaatccaaaaatagtccgtgctatatctccatattatatcattaagttttttagcaagactggtaaagaaggttgggtttctcttggagggatacttctttgtatcactggaaagaataattacttactgtacatttactatgctggcgattattatgcattgtttggagtacaacttgcgtttgcgtttgttatatacccgtgtttggtggtacagtacatgggtcaagctgctttcttgtctaaaaacctcggctctgttgctaacagtttttatgactcaatacctgaccctgtgttttggcctgtttttgtcattgccacccttgctgcaattgttgggagtcaagctgttataactgcaactttctccatcatcaaacagtgtcatgcgcttggttgctttccacgagtcaaagttgttcacacctcgaaacatatatatgggcagatctatatcccagaaatcaattggatacttatgatcctaactcttgctataaccattggatttcaggacaccaccataattggaaatgcttatgggctcgcttgtatgacagttatgttcataactacatttctgatgacactagtcgcaatctttgtctggcagaaaagtgtcttgattgctgtagtatttcttttattcttttgggtgatagagggtgtatatctatcagcagcattcatcaaagtgcctcagggtggatgggttcctctagtcttatcattcatcttcatgattgttatgtacgtgtggcattatggaactcgtaggaagtacagctatgatctgcacaacaaagtttcattgaaatggttactgggcttgggcccaagccttggcattgttcgtgtcccggggattggtctcatctacactgaactagcaacaggaatacctgcaatattttcccattttgtaacaaatcttcctgcatttcacaaggtgttggtttttgtttgtgtaaaatcagttcctgttccgtatgtttcacctaaagagcgtttccttattggccgagtttgtcccagaccatatcgaatgtataggtgcattgtcagatatggttacaaggacattcaaagggatgatggagattttgagaaccatcttatacagagtatagcagaatttatccaaatggaagcagtgcaaccccagttctcaagttctgaagcttcatcttcccttgatgggaggatggctgttataagttctagaaactatgattatgcttcaagtttagtagtttctgagcacgaggatattggcgttgacatgtccgttcctagcagcagatctgcaaccctgcaaagtttgcaatcggtttacaatgatgatactccacaagttagaaggcgacgagtaagatttcagctaccagaaaatcctggtatggatcccgatgttagggaagagcttttggatttaattcaagccaaggaagctggggttgcatatataatggggcactcgtatgtgaaagcaagaaaatcatcctcattcttgaaaaagcttgtgattgatattggctactcatttctgcgcaagaattgcaggggtccagctgtagctcttaacattcctcacattagtcttattgaagttgggatgatatattatgtgtag

SEQ ID NO: 97352 - DNA, 291 bp, Glycine max
  Peptide Sequence Number=SeqID_214130
atggtgttgtgtttagttgtgctttgtcaagccatggttataatgctggaagaaagtgttggtcattatatgccattctgttttaactttgaggctgggtgcattgttcgtggtggttcgtttgcggtttgtggttgtcatcatggtgggtgttacaatgcaacagcggaggaggagatgagacttgcagaggaggagaagagactcgtgaaggaagcacgaatgaggagaagaggcgtgaagagaagaagcgacaatgttgggtgcacagtagcagctgctgtgatgtag

SEQ ID NO: 97353 - DNA, 1038 bp, Glycine max
  Peptide Sequence Number=SeqID_214131
atgacttcatctactgctagttacacgccaactgatattgaggctgctatgcatgctctatctttctctcaacctgatggaaactactacatggatatcggcgccacatctcacatgacggcggatgcaggtattctctcgtcttatttcaattcaagctctaaaaatcataacattgttgttggcagtggtcatttaattccagttgtcggtcatggtagcactaatttacccccacctcatcctccctttgttcttcaaagtgtgttacatgctcccaaactcattaaaaatctgatctctgttcgtaaatttaccactgacaacatggtttctatttcttttgatccttttggttttttggtcaatgatttacagacggggaccagactaatgagatgtgacagcgttggggacttatatccactcttctcaaattctcaagccacatcacccaaaaattcagcttttactactatgtctcatgatatttggcataatcgcttaggtcatccaggcaatactattatcaattctcttcgtcgtaataaatttattgattgtaataaggcttgtaagactttttgctcatcttttcctcttggaaaacatgctaaacttcctttttatgattctttatcatacacttttctaccgcttgatattattcatagtgatctttggacttctccaattgccagctcttccgggcaccgttattatgttctttttcttgatgactatagcaaatttctttggacttttcctattgcaaagaaatcacagcctgacccaacttctcatgctgctcagtctcggcctactcctcatgtagcaccgacgttgcagcagccccctccaacttcttctcctatcttggcctcacccacctcacgtgtcccagtcccagcctcaacacctaaccccatgctgcaccgcttgacaactcgttctatgagtggcattcataagccaaatcctaagtactctaccaattgtcacacgaccaccactaaggaaatttctcctattccataa

SEQ ID NO: 97354 - DNA, 225 bp, Glycine max
  Peptide Sequence Number=SeqID_214132
atggccaaggtgatttgtaaggaaataactgctagtcctatgtcttcactcactcctagaaggaaagagatggctatttgttggacccctcttcctaccccatctgtaaaaattaatgttgatggttcatataaagcttcttctataaagtttgttgtggagcagagctttggggtcttagactgggtactcaagttgctagagatcctaatctacatgatgtga

SEQ ID NO: 97355 - DNA, 123 bp, Glycine max
  Peptide Sequence Number=SeqID_214133
atgactagagtcctttcttcgagtgagactcgtcgctttctgcggcaaaatcccttgaatggtagcgcaagtgtgagccgtgaaggtatggggtttgtccaggagctatacgtacacggttag

SEQ ID NO: 97356 - DNA, 303 bp, Glycine max
  Peptide Sequence Number=SeqID_214134
gatagactatcaagaatatggagactagcagattttgatatcttggacattggaaataatttctatatgatcaaatttgatatggaggctgacagaacaaagattatggaaggtgatccatggatgattttttatcactacctaacagttcaaacatggtccttggaattcatatcttcaaccgcaaaaattgataaaacccttgtttgggttaagtttccaagtttgaaccttgtttattatgatgagagcatccttctagctcttgctacagccataggcaagcctattagggtggactaa

SEQ ID NO: 97357 - DNA, 1014 bp, Glycine max
  Peptide Sequence Number=SeqID_214135
atgaatattgtttggtattacactgcaatttatgcttcacctataccttccaaccgtcatcatttatgggatcacttaagagatataaggaatcaaattagagggtcatggctgttgattgggaattttaatgatattattttcgcttcagaagtttcaagagggcaattcaactcttctcgtgcttgtctcatgccagatataatgaatgcttgtggtgttatggatttggaaatggtagggggctcgtttacttggaggaaaattattcaggccggtggtcatgcagcttggatgtctcatccagattatgcagctcttgttcaacacacatgggtttctactattggtaatgttcatagaaaacttgactatattcaaaagaaatctactaagtttaatgagagagtccttggcgacattttcaaaaggaattgtcagattgaggctaggattaaaggggttcataagcaacttgatactttcccttattctcattttattatttggagaaacaacttcaggcctaatataatcaggtattccatcaggagtgaattttgtggtataaaaaatcaagggaacaatggattaagtttaataacaagaataccacatttttccatacacaaacagtcatccgaagaagaagaaataggatattacaccttgatattggagaatctctttcaatctagagaccagtgttatccacaaagccttcaatttttccacgttccttatgtagatcaagagttatttgatgatcacattaaaccagtttccatgaaagatgttaggcatgttatcttttctataagttcatacaaagctcttggattatatggcttccaaccaatcttcttcaaatcttatcaggatgttgttgctaatgatgttttgagtatggtagctactgcctttgctacagggacttttgacactatcctggcagaaactctaattgttcctatccctaaagtagatgcccctatgacttttaaagatttctaa

SEQ ID NO: 97358 - DNA, 150 bp, Glycine max
  Peptide Sequence Number=SeqID_214136
atggaaatggcgacaatgatcaaggtgcttgagtgggttgcctgctgcgtctccaatggtgcgttgctgcacaatggactggccaacgacggcgaagcaacaaacatggcaagaatgatgattcaacaacttggcatcgagggcaactaa

SEQ ID NO: 97359 - DNA, 324 bp, Glycine max
  Peptide Sequence Number=SeqID_214137
atgcaagcgcacacagcaagaatgctaagaacagaggtggtaaagaaagagcaaaacaacaagaatattatcgtggttcagggaaggggtccaagggaaacaacaacaataaagggtcatgatgacaacaatgaaggagttcctaagtacacaatagataacaatgaagaacttagacttgcagcaaaaaggatagaattgccatctttccatggtgaagacccatggtgggtgtccatagctaagacctattttgttttccaggcaactccccgtgaaatgcggattcaacttgctcaaatatcaatggaaggtcctatttga

SEQ ID NO: 97360 - DNA, 282 bp, Glycine max
  Peptide Sequence Number=SeqID_214138
atgactaaagcacgtcaaaagggggtacggaaattcgatttcgggaacttaccgattgaagaccgaagaacgaacgaagaacgtcgaagaacggttgaaaatcttcgtgaaatcacccacggaaacgttacggaagcgcctcggcttggattttcggttgaagaccgaagaacgacaaagaacgttgaagaacggttgaaaatcttcgcgaaatcaccaatggaaatgttacggaagcgcctcggcttggattttcttcatggaaacaatttttctcactaa

SEQ ID NO: 97361 - DNA, 1143 bp, Glycine max
  Peptide Sequence Number=SeqID_214139
atggatgcaacttttgcaaccctgaatgtcactgctaatctagtcactaagggaattggatctagaaacagaacttcttctggattctggggtgagaacacaaggggaagttttaacatgagattttgtactgttcaatcacacaagagtttaaagattagttctactcaagaattttttgaagatggtgttgtgaagcgtgaggacttgtggatcacctccaaacttcggttttattgtcttctaactcttctgaaaattgtgatgtttcttaatgttgaaaatggagcagttggagtaaaaccagaaaatgttatacaacatgacataccaagcacatggagagcaatggaggaactctatgactcaggcaaggcaaaagccattggagtgaccaatttctcttcaaagaagcctcaagatttgtgggatatagcaggagtgcctcctactgttaaccaagtggaatgccacccacaatggcaacaactaaagttgcatgaattctgtgcatctaaagaaattcacctatctggattttctccattaggatcaaaggatttctcaacaatgatatgcttaagaatcttgttatcaatttcgttgctgagaaactggggaagacacctgcacaagtatccctttagtggggcatacaaatgggacaatgttctgccaaagacctctgatgaagctaggatcaaggaaaattttgatgtcttcaactggtctattcctgaagaactgattgctaagttcactgaaattaaacaggcaatattccatggacccatttgtcagaatccaaaagcaaacccaaaaaatgtagctattatcatattgggtgaaggggctggaactcgactctttcctcttactagcacaagagctaagcaagtggttccaattgcagggtgttatagaatcatagatattcctatgagcaattgcatcaagaatggcatcagaaaagtgtatgttttaacacagttcaactctttctacctcaatggccacttgtgtcgctcttacaattttggaaatagggtgaactttggaggtggttttgtggaggatgccaagaacaaggatattgagaacatattgacaatatttaagttgccaccaacaacaaattactaa

SEQ ID NO: 97362 - DNA, 474 bp, Glycine max
  Peptide Sequence Number=SeqID_214140
atgacatgtaagagatattggacaaaaggtagggctttgcacaatgtccctattggcggtggatgcagaaagaataaaaaggtgaagtcatcaaggctctcatgtgattccaaagactctggctcctctttttcagaacttggtggcctcaaattccttcattctctttctctttccatgaactttcaccttggagggttacccttccctaggcttcaccatcatcatcctccaaccacttacaaccatttcttctcttttggagacacttctaatgcttcttcatgtttcaaccttgacccttctcctggaactaccctatcacattcttttgttgttgtcaataataacccttttcttacaatggtgcaatccaaggtggaacatttgcccccaaatcatttcaattggtttggtataagggccagagatatgtttatgcacacgattctaagcaagatccacccaaactag

SEQ ID NO: 97363 - DNA, 859 bp, Glycine max
  Peptide Sequence Number=SeqID_214141
gatttcttctagatgccttttgaagattgatttgcataaggcgtatgattcaatttcttgggagttcttggattggatgctcaagtatgtggggttcccagcacagttttgctcatggattatggagtgtatctctaccacctccttcagtgtggcaatcaatggatctatttatggtcacttcaaagggcagcgtgctccagcaagtcatccatctactcaacaggaattggccaagatgtgctttctgatatccagcagctcactggatttagcgtgggcagctttccctttagatacttgggtgttccatttttatcttccagggaaagtggagctaattagagctgtcattcaaggaattgctaacttctggatggttgaggtgggtaaaaacaaacctttagtggcttggtctgatgtttgttcctccaagaaagagggagggaccaagactgttttcaattggagttatgttatttggaatcctaccattcctcctaagatgtcctttattctatggcttgctaccaagaatcgcctgctcactcttgacagagctgctttcttgaacaagggtcttctctgtcctttgtgcacaaatgagacagagtctcattcacctttgttcttttcttgcagaatcactcgcagagtttgggcaaacattcgtgattggatacctctccacaggcaaattatttcattacagtgcactatcaattcattcattcgtggtagagccacctctggcacgttgggcaaatttcgatgcttggctttggcaacttcagtatactgcatctggatgtctaggaatctattgctctttgagaattctcctttatctgtaattgat

SEQ ID NO: 97364 - DNA, 1638 bp, Glycine max
  Peptide Sequence Number=SeqID_214142
tcactttccctccttgggcgtttcccagtggctttgccaccgtcggagagctgctccagacttctgttgacgttggtggggctagtgaagctcaggtctctcccactactggtttggcaagaggcattgttgtagaccaagatgctcgaactgcttgcccagctccacagggaaattctgcaaccctggtgctcgacaaaaagccagggtcaagttctgcagtaaccaaagttgtagcacaccaggtgtttgataaattgtctgactgtaccgcagggactgaaacttccccggatgattcctacactctaggagaagatgattcatccacgaatgaagactcctctccctctagtggctctaattcagcgcctcaagttagcaacggagaggcttccacgccttggattaatctgttcaaggacaacagaaaaccatccaagggctttggcctgaagttctcccctccatcctctgaaggcgtggggacacagccttataggctatgtgactggccgtttcccaggaaagaaagctttgctagaatgctatcaaaaatgaggcgtacctatttcatattccaaaggccccttttgctaaaagtcatgcatgctttctttgattttggtaatgaggagctcgaccaccttactacatcaaagggatctatctcatttgctcgagctctggtggaagttgatgcttccttggagcttattgaagaggtttgctttagacttcattctgccaagcacgaccacaaaataaccaccacaaaaggtcccttcactgctcaatctcaagtaactgaggcaacaaataatgttcatgttcttcaaactcctgctgataatgcaggagcagtgaattttgaaagtgtaaatcctgatgatgggtttgttcagactgttattctgaccttgggttggggagccttaacagtcatggaccacactcctttagttgtgaccacggaggtggtggtgcccagaggtaattccccctttaagtttaataatgctattgtggatcatccaaactttctaagcattgtttcagatgactggagtcaccaagttaatggttgtagcatgttcaaacaagctgaagccgagtataatagtctgcttaattccctccggaagaatcctctagatacatcccttctcactcaggttaaccgtacaagaggccatatcatcttgcttaggaaagcagagtcaaggaatgtagctcagctcatcaagaacaggtatctcttgcaagctgacagatgctccaagtttttccacgctttaattaagcgtaacaggcacaaccgttttattgctgcaataaggctagataatggccaaagcacatcctcccaatctaaaattggtcatgcctttgtcaatcacttcaaggatctgtttagtgctaaggagctgcaacatgctgcatccctggcaatctgcaactcaaggcctaaagttcccactgattgctttgctgccttgcttagtcccatcaccacacaagatgtctggaatgttatttcaggaatggacaacaataaagctcctggtcctgatggcttcaatgccttattctttaagaaggcttggaacatcataggggatgatattttttgcagcg

SEQ ID NO: 97365 - DNA, 1206 bp, Glycine max
  Peptide Sequence Number=SeqID_214143
atgtttatcttcttggaaacttgtgttaaattcagagaagtcctggctacatttgctgatgtagagtgtgtttggttccctgttgaaattcccactttccaagatgagaaagtagaagcaagtattaagattgatgacgaggaactcgctcgttttgttgagcgtgttgataaggataataatggtgttataacatttcaagaatggagggattttctgctgctttaccctcatgaagcaaccatagagaacatttaccattatttggagcggatgtgtatggttgatatcggggagcagactgttattccagcaggcattgggggagtagcaggtgcagcatcacgcacagcaactgcaccccttgaccgtctaaaggttgtattgcaagtccaaacaacgcgagctcaaataatgcctgcaataaaagatatatggaaggagggtggtttgttaggattttttcgaggcaatggcttaaatgttcttaaggtggcccctgagagtgccattagattttatagctatgagatgctgaagaccttcattgtgcgtgccaaaggggaagaggcaaaggctgctgatattggagctatggggcggctactagctggtggtattgctggtgctgtagctcaaactgcaatatatcccatggatcttgttaaaacacgactacaaacctatgcttgtaaaagtggaagaattcctagccttggaaccctttcaaaagatatatgggttcaggaaggaccccgggcattttataggggattgattccttctcttcttgggattatcccttatgctggcatagatcttgctgcgtatgaaaccttgaaggatatgtccaagcaatatattcttcatgatggagaacctggccctctagtacaattaggatgtgggactgtatctggagctcttggagcaacatgtgtttacccactgcaggtggttagaacaagtaacttcaaccgtttcggctttctatggaaattagaaaatgaaagacatgttgatttcagaatgcaggctcaacgctcatacaagggaatggctgatgtattcaggaaaacccttgaacatgaaggcttgaggggattctacaaaggaatatttcctaacttgctcaaagttgtaccgtcagcaagcatcacctacatggtttatgagtctatgaaaaaaaatttggatttggagtga

SEQ ID NO: 97366 - DNA, 406 bp, Glycine max
  Peptide Sequence Number=SeqID_214144
atggcctctggtaatcaattaccaagggggtgtaatcgattaccaggcttagaaatgaaatgggatgttgaggtggcctctggtttccatgttctgaagttgtgtaactcgagtttggcctctgggagtttgggagaccctcgaaggcaatgcgaggtgccgattccgtggcacgattcgactcacggctacttcattggtacatctagaggaacccgcacgcacgcttcaacgaattgtggagtggatattacctacacctactccatatcgactagtggagcccgtccaagtgatagagagggtgatgaggacccatttcccgatgtggattctccaaaggacgtcatgtcaacatctgaggcagactctacggaggagagcggccctggagggataacgacca

SEQ ID NO: 97367 - DNA, 471 bp, Glycine max
  Peptide Sequence Number=SeqID_214145
atgtgtctcccccatgggttgagcgacatgtgcatgatcagattgtggttgttggctctcaatgggtatgggtgcggagttatcgatgttctcatcgggagcatgtgcaacattgggtggcgtatagttgggaggcaagccatatggtgggaaggaatgcttgttctaaacctgcacaaaatgggggctgcccgcacttcccaaagctttgcctccctggcctaccatatccgaggctctatgatttacttgattgctggatgggtgagttgggtccaccttagtggcagtacttgtggcaatgattgtagccgtgttgacctccatcatttttcttacactcatcatgacttccatcattgtggtcattttctctttcatggcctccatgtcagccttcgtcttctcttgcacctcctctatttcactcattactctagctctgacatgcgttcggtaagggcactgtaa

SEQ ID NO: 97368 - DNA, 207 bp, Glycine max
  Peptide Sequence Number=SeqID_214146
atgaccatgcaggggacagacgggtctactttcatgatgaaaaatgtgagagaccagccatacatagagagcgggtgtgcaacagacaattctcgcactgctcttctctcatcaccggtcaaacgtgtcataggcattggccaaaacaacaacgatcaggctttccttgctgtgctgataagcaagaaaagcgtcaatcaccgttaa

SEQ ID NO: 97369 - DNA, 861 bp, Glycine max
  Peptide Sequence Number=SeqID_214147
atgcttctgatccattgcccctattgcggggaagaccgttccgaactggaattccgctgggcgggcgaagcccatatcgcccggccggaaaacatcgccgatatttccgacgaggcctttgcggaatatttcttcatccgcgacaacgacaagggcctcgttttcgagcgctggcgtcacattcacggctgcggccgctttttcaacgccgcccgcgattcggtgagcgacagattcctgacgacctacaaggcggggagccgggcaatgagcggcgattatcgtatcaagggcgcaggccgtctcacgccggcgagaaccgcgcgctttacctttgacggcaagatctatccggcgctggagggcgacaccgtcgcgtcagcccttctggccaatggcgtgcatctgatcggccgctcgttcaaataccaccgtccgcgtggtttcctgtccgccgggccggaggagccgaatgcgctgatagacgtgtcgcgcgacagcctgcgcaagcagcccaacgtgcgcgccacggtgcaggaagtcttcgacggcgcgattatcgcctcgcagaaccgtttcccgtcactgtccttcgatctgagcgccatcaacgatcttctgtcgccgatgttcgcggccggtttctactacaagacgttcatgtggccgaaggccgcctggcacaagatttacgaaccgctgatccgccgcgccgccggcctcggcaaggcgccgagcgagccggatgcggatcattattccggacgttatgcccattgcgacgtgctggtggccggcgctggtgtcgccggtctcacagctgcgctttctgccgcgaaaactggcgccagcgtcattctg

SEQ ID NO: 97370 - DNA, 216 bp, Glycine max
  Peptide Sequence Number=SeqID_214148
atgaagaacaatgtagaagtcaattacgatcacaattcggtggagcctcggcctcgttttctcttctttcttcttcttcttacttctttctctcaaaatctctcaatgctaaaccttggaaccctttactcagcctccctcacgtctatttacaacaataaagggcacttggtggacttgcagctcgcccaggctagctggttccttcacctctaa

SEQ ID NO: 97371 - DNA, 171 bp, Glycine max
  Peptide Sequence Number=SeqID_214149
atggaatctcaacctccacagggagtactgcttccataccatacaccaaagagaacggggttgcccctgttgaagtacgcactgaagtgcgatacccatgcaaagcatacgcctcaactgcgccattcatctgaggtctgtaaggagaagaattgtgatgctcaatcttga

SEQ ID NO: 97372 - DNA, 660 bp, Glycine max
  Peptide Sequence Number=SeqID_214150
atggcagatgcgttagcaactttatcctccatgtacgaagtgagtcaccggaacaatttgccaacaatcagaattcagcgcctcgagaggcccgctcacgcgtttgcagtcgaagaggttgttgatgataagccctggttccatgatatcaagtgtttcctccaaagtcaggaatatccacctggagcatccaacaaagacaggagaactttgagaagattgtctgataagcaagaagcagaacttttgatgcatgaggtacatgaaggctcctttggaactcactccaatggacatgcaatgactaggaagttgttgagagcaggttactactggatgtcgatggaaaccgattgttgcaagcatgccaggaagtgccacaaatgccagatttatgctgacagaattcatgtaccaccaactacacttaatgttctttcttctccgtggcccttctctatgtggggcatcgatatgattggtagaatcgaaccgaaagcttcaaacgggcatcgtttcattctagtggctattgattacttcaccaagtgggttgaagcagcatcttatgcaaatgtgactaagcaagttgtggtccgctttatcaagaatcagatcatctgccggttatggtgtgcccaacagaatcattacagataa

SEQ ID NO: 97373 - DNA, 105 bp, Glycine max
  Peptide Sequence Number=SeqID_214151
atggaggagtctcgtggattgccttctgagcaaggggttaagtttgcacattgggccttaaagagactactaccgaatagccttggagacctatgtagtgtttga

SEQ ID NO: 97374 - DNA, 839 bp, Glycine max
  Peptide Sequence Number=SeqID_214152
atgagcagtatcttcaccgatctcacgctgcagaacgatttctataccgtatcggccagtctgcgttatgagagttataggctcaagggaaagacccagttgcccggagggacaaagagtgtctatgagtcgaggcttgctcgtttcgagcaaaccgtctgcggccaaggtggggtgaatgccggcttccccgacaaagcagcagtctacgagaaggcctgccggttggcggtggcgggtgatgaggctggacttgctgcttggtgggaatccaaccctgtctaccattcgcggcggggggcgccggtgcgggtaaacagtctccagaccaagtatgcggaagatgcgaggcacgcgccgcgatgggtggagcgaccggccgactacgactacgaagtcgatcgcagtgccggcatgctattgccttccatgtccgcagcggttcgtccgacaggctggttggaactttacggcagttggggcaagtcatggcgtccgcccgcgatcaatgaatcgttaatgcggggaggacatccaggagacggctttgccaccatctatccgaatccgaatgcagaacccgagacatctcggacctgggaagtcggcgcaaatacgatattccacgacgtggcgctggatggggaccgtctttcgctcaagctcgactatttcgatacccgtgccgacaactatctagtttcctcactgagcaacaatcttccaggcttgaatatggacgtgccgatggggctcggtatcaccgcgttcgtgaacaaccgcacgcttacgcgatttcgcgggctcgagttggagggacgctacgaggccggttggct

SEQ ID NO: 97375 - DNA, 487 bp, Glycine max
  Peptide Sequence Number=SeqID_214153
gcccgggaactgagaaacttagggaactattactctggcatcttgaagaacaaaggaagcagcgagccattgaggcatgcagtgaaaccaaagctaaaatggatgagcttgagaaggaactatcaaatattgtcggtcttaaatgatctaaaagacaactacgcaagtgggcaaagggcatgcttttggatgagaaacgtagatcttcttggtctgcatgttggcaggagaagaccacctcatatggcctttctaggcaaccctggaacagtacagcggactgatttagttggtgaatttgttgggcacactggtccaaaaaacaaggaggaagcctatagattgataccaatgcaaaagtccgacgataaggactatgggttggaagctttagaggagattatgtctgtcatggacagtggcaagattgtagtaatatttgctggctactgtgagccaatgaagcgagtcattgcttctaacgaag

SEQ ID NO: 97376 - DNA, 303 bp, Glycine max
  Peptide Sequence Number=SeqID_214154
atggggaaagatgatcttatgaggcagtttgaagtagctgcccaagatggacacgatgttgcgacattgcatatctctaaggtcttatacgatctgatgctggaagaggatgcaagcttggtgcaagacgaagttaatagtttgctggaagtgtcataccctaatttcgtttggggattatcacttgatgacatgcaacctttggttagccgctttgacctacttggcgtcctttgttgcacaataaatgaagtctcgagacgtgtcaaaaatcaaaaggaagcaggcttgcgcgatccgtga

SEQ ID NO: 97377 - DNA, 246 bp, Glycine max
  Peptide Sequence Number=SeqID_214155
atgtcttcaactcccgacatgtcgcggaactatcacggattgcctaacgatgggcgtcaagtgcagaatgaccataatttgtctctacgtgccatcggacatgatcgggcctggatggaaaggcgtagaatgaccataatttgtctctacgtgccattggacacgatcgcctctggatggcgaaaaggtgtgtggaatgaccataatttgtctccgcccaccactcgactcactgcccctgaatga

SEQ ID NO: 97378 - DNA, 213 bp, Glycine max
  Peptide Sequence Number=SeqID_214156
atgggtgccaggcacctcgaagcggtcaagcaaaggttgcatgccatcaaacaatggtctcggacgaaattagggtatggcaatggggtaaatgggctaatgccagggatttatgctaaattgcatccaatggctttcttgtgcttcttgagcactagcaacaacttctcctcttgcgcaacaggcttcaactctggtgtgggtggtggctga

SEQ ID NO: 97379 - DNA, 210 bp, Glycine max
  Peptide Sequence Number=SeqID_214157
atgaggttagttctacccttcgtctctaacagatttccatcagcaatttcagcatataaacatcacaaacatcatcccaaaaaccctaaaacagaatggaaatgggcaccaaaggttgaagctttgtgtggagcttcaatggagaatgaagaagaagagaatggcaatgtgagggagagagagggctgtctgaaatttctgttttgctga

SEQ ID NO: 97380 - DNA, 354 bp, Glycine max
  Peptide Sequence Number=SeqID_214158
atggatgctgttgataaaggtactaaagcatctaaaactagagcttatccctttggtacagcattagttgaatttttagtgagtcgtggtctattgcgcttagtaacatataatgttgatttattaaatttctctgatgatagtggtccaaagactgttgtcaaaaatgttgtcaaaaagggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 97381 - DNA, 222 bp, Glycine max
  Peptide Sequence Number=SeqID_214159
atgtctcaaggaaatttcaatggggaggttttaccgaaaagcgcactggatcgtcaacctaaactactaaaccttcgatccctcatcaggctgaatatccaagcttcatccacagatccctcatgtaagactacactcgatttagacatccctcttaggtttagactaacttcaactgagtttcatccgcagatcccttatgtaagactagactctgtttaa

SEQ ID NO: 97382 - DNA, 612 bp, Glycine max
  Peptide Sequence Number=SeqID_214160
atgagtcatcattcatctagtgttaatggcgagggtactagtcataaggatcctctatctagaatcttagatcaattgagttccctcaagttatggaaagaaaaactagaaagaaaagaaaaaggaaatgagaagctcactcccataggagagaaaaggagagaaaaggaaagaaagtctcaaaaggctaacattaacctcccatacttccatgggaaggacaatgtagaggcttacttagattgggaaataagtgtagagcaacaacttaaaaggaagtctacttcaaaatcttatggctctcacttttatccaaagaaagaccaaggtcaaggcatcttagggttgacaccttctaagcccaaagatgataaggggaagacaatagaaaagcaatcccttaaggctagtatgcaagagaagactagctctataacgtgctttaaatgtcttggaagaggacacattacttctcaattccccaccaaaaaaaccatgattatgaggggccaagacatttatagtagccaagatgaggctactacttcaccttcctctagtcaaagtgaagaagcaaaaggggaagaatctagtgaagaaatctatccctaa

SEQ ID NO: 97383 - DNA, 416 bp, Glycine max
  Peptide Sequence Number=SeqID_214161
atgaaaaaagtactgattgtgtgtggaaacggtttaggcagcagcttcattgtggaaatgaacgtgaagaaaattattaaggagctgggtaaagaggctgaagtgggtcataccgatttaacctctgccaaatccgagcaggccgatattatcatcagcgctaaagatatcgctgaccagctgtcgagccacagcgcacagaaaccggtatccgatgtcatttccggtacgctaaaaaccatcatgggttttgttattcttatcgccggggccaacttaattgcggccaccctgaccatcttcagccagctattcgagcactcgttcaatattcagggcgtagtgccgaatactgatgcaatggccgcgctggcacagaaaaactacggtaccgaaaccgcgagatcatggtttcg

SEQ ID NO: 97384 - DNA, 1062 bp, Glycine max
  Peptide Sequence Number=SeqID_214162
atggagaggaagaacatgagttattcactgccatccctgccgtacgcctacgacgcactggaaccgcacttcgacaagcagacgatggaaatccatcacactaaacatcaccagacctacgttaacaacgccaacgcggcgctggaaggtaccgaattcgcaaacctgccggttgatgaactgatcaccaaactggatcagctgccagcagacaaaaaaggcccactgcgtaacaacgctggtggccacgctaaccacagcctgttctggaaaggcctgaaaaccggcaccacgctgcagggcgacctgaaagcagcaatcgaaaaagatttcggtagcgttgagaaattccaggaagagttcgagaaagcggccgcgacccgttttggctctggctgggcgtggctggtgaaaaaaggcgacaagctggcggtcgtttcaaccgctaaccaggacaacccgctgatgggcgaagccatcgctggcgtgtctggtttcccaatcatcggtctggatgtgtgggagcacgcttactatctgaagtatcagaacaagcgccctgactacatcaaagcgttctggaacgtggtgaactgggacgaagcagcggcactcagtggaaagctgaggccaaataagctgtggaatagccagcaatttcgcctgaaatttgccttaagccagggcttactgccggctaagccgcatcgtccctatttgcgcgccggtttcagcgtggcgcagcgtgcgcaggcgattctcgatcattatcaattgatggacaagctggcgaataatcagctgcgccagttgctgctgagcccgagcggtaatcttcttgcccgtttcaccggcaaaaacgaggagcagggccgcggaaacatatttccagtgacgttattcgcgatgccaccaaaagccgcgcacggcgtatttcccaagcgtctgctgatggaaagcggtatttattctggcggcacagtgcggcgtacaggccattaccgcggttggcgataccacccatgttttccgcagtctgcgctaccgtcacagcaaaggtga

SEQ ID NO: 97385 - DNA, 1123 bp, Glycine max
  Peptide Sequence Number=SeqID_214163
agatgacagccagctgcagtcgatgttccagaacctcggcggccagaagcagaaaccgcgtaagctgaaaatcaaagacgcgatgaagttgctgattgaagaagaagcggccaagctggtgaacccggaagagctgaagcaggacgccatcgacgcggttgaacagcacggtatcgtgttcatcgatgaaatcgacaaaatctgtaagcgcggcggccagtcgtcgggaccggatgtgtcacgtgaaggcgtacagcgcgatctgctgccgctggtggaaggctgcaccgtgtccactaaacacggcatggttaaaaccgaccatatcctgtttatcgcctccggtgcgttccaggtggccagcccgtcggatctgattccggagctgcagggtcgtctgccgattcgcgttgagctgcaggcgctgacggtcaatgatttcgaacgcatcctgaccgagccgaacgcgtccgtgaccgtacagtacaaagcgctgatgggcaccgaaggcgttaacgttgaattcactgaagacggcatccgtcgcatcgccgaagcggcgtggcaggtgaacgaaaccaccgagaacatcggtgcacgtcgtctgcacaccgtgctggagcgtctgatggaagatatctcctacgacgccagcgatcgccacggcgaatcgatcaccatcgatgccgaatacgttggtcagcatctggatgaactgcgaccagctggacgcgctgaatcgcaaagaaccgcagctgctggaagcgggcgatgccgaaaagcttggcgcgctgctgaaagagaaagagacgctggtgcaggagatagagcgtctgcgcaacgcgaacatgggcgcgctgaagaaaagcgtgcgcggcctggtggtggtacacccgatgaccgcgctgggacgcgagatggggctgaaggtgatgaccggctacgcgaagcagccgttctgattgccgttacgcggcgtgggccacgtcgcgttctgccccggcagcctgcagcacctgctgcgccagcgtatccagcaaggcatagcggcggcgatactccgcgcgcttcttgctggcaatctcttccagatctttacgtgccatgctcagcggcagcgtaa

SEQ ID NO: 97386 - DNA, 477 bp, Glycine max
  Peptide Sequence Number=SeqID_214164
atgggcattgaagctagtttggaaacaactaatgcagagcaaacatttcttgatcaatcgacatcaagtagtgggcaagttgccattgatgatgggaatgatgatattgatgctctcattcagccatttgaatcattagctgcaggaatggacctctggaaattcttcctttccagcaatggccaacaaaggtccaaacatgaactggaaggttcatctagtaacactatggctgctcgaggaaacgaagctcgctcgctccgtgagtggttggagagtaagaagggtgttcgttggggaatcgaagctttgccaaatgatggtggtattggtggatttgaaagcaaggagaacgaggattgcggttgcccagatcatggtaccgcttgcgtcggtcaaaacgagatgacaatgtttttggtttttgattgtgtcttcgcggtttttgacaatgtcaatgtcttcgcgctttttgag

SEQ ID NO: 97387 - DNA, 333 bp, Glycine max
  Peptide Sequence Number=SeqID_214165
atggagcaaatttggttggtggatttggtttgggtggtgggtgcaaatctgggttcctgggggtgcggtggtggttggtggtgtgcgcagacaatggagcgcgattgtgtggttggaggtatatgcgtggagtttggatctttgcggaggttgatggtgcttgtttgggctgagtgtggatttgggtccacagaggttgtggtggtttctggtggtgcgcggtggtgcttgtttgggctttgcggaggttggcggtgtcgtggttgcggtatgatgctggcaatgtcatgggtggcggtactagtcatggttgtgggtggttttttagggtag

SEQ ID NO: 97388 - DNA, 1413 bp, Glycine max
  Peptide Sequence Number=SeqID_214166
atgaacgacgccaatgaatgttgttgcaatgatgaatatggggaaatcgttgttggggtacccctggttatcaatttctttgataagaacaacaacaatgatgagaagagtctcaaggtccaagagaagaagaaccaagaagatcatgattgtgatcaagaagatgatgacgatgatcttgatgccacagctttgggagacgcgggggcgcctagtcctgctgagattaaactcaagatgaagaagtcattgctcgagtttcgttgcaaggttgaggatgccattcttgggaactatttgttaggagaacaagatcatgagaaacttgcaccacaagaaatagcagtggcaagggaacagattagagagattactctctggggtgtccctttgttgctaagcaaggctcatgagggcactgatgttgttttgaggaaattcttgaaggccaaggatttcaaggtgaatgaggcctttgacatgctgcaaaagacacttgtgtggcgccgcgagaacaacgttgatgggatcaccgatgaggatttgggttctgagttcggaaataatgcaggattcttgtgcggtaaggatagggaaggtcgtcctgtgtgttaccatgcttgtgagattttcaaagacaggcgtgtttacaagaagacatttggatcagataacacatgtgacaagtatttgaggtggaggattcaaatgattgaaaaggctgtgaagaagctttgttttagagaaggaggggtggaatccatacttcaggtttttgatttgaggaacactccaatgcaaggaaccaaggagctcaactcagtcagcaaaaaggctctaatattgtttcagaactactaccctgagatcattcacaaaaatattatagtatatgctccattttggttctacacttctcaagtgctattatcagggttcatgaaccagagaaataaaaagaagttcatcttagctaggtcacagaaggtcacacagacacttctcaagtttatagccccagagcaccttccaactgaatatggtggtctaaggaggaacaatgatgaagacttctcgccttctgataaggtttcagagcttaaaatcaaaggaagtacggtttctaaagttgaatttccgatccaacagcttggagtgacaataatgtgggatgtaactgtggtgggatgggatgtgtcctacaaggaagagttcattccagatgatgaaggctcatacactgtactactgcaaaaccaaagtgtagatggtagcagcactagaaactccttttacatcagtgaacctgggaagatagtgataacagttgaaaatagaacctacaagaagaagaaaatgttctatagatctacagctagaaccactgttcccatgttcttcttgttacagtag

SEQ ID NO: 97389 - DNA, 336 bp, Glycine max
  Peptide Sequence Number=SeqID_214167
atggcagaagatcttgcagctggacgagatgatggtagaccagattatggtcctggtcgttcaaaaggtggaggaatttatgctaatggacagttagtttacagaaactgttccataaatctttgcgcttatgtaaagaatgcatgcccgtatgagctaaaatatctgcatgtataccataggggtaaaccaaagaaaggtagaggtggggcaagagatgccaagagagcaagggcttcaactattgtagctgccatagtggtccctgcaataatatctatttgccatgctaccggtagccaaggtggagatcgaatgtatgaagatgaatgttag

SEQ ID NO: 97390 - DNA, 450 bp, Glycine max
  Peptide Sequence Number=SeqID_214168
atgcggcgaagaccactagagtttgaaacggatgatcatgtgtttgtgagggttacacctacaatgggtgtagaaaaggaaatcaagtccaataagcttactctgaagttccttggaccttatccgattctcagacatgtaggtcctatggcttatgagatggttttgctacctttcttagccaacctacacaatatatttcatgtttcacaattgaggaagtatattccagatcctacacatgttttagaagtggacatagtgcaaatgtgtgaagatttgacctacaagactcaacttgcaagaacagaggatcaaaggatcaaacaacttagaggcaagaccatcagtttggtcaaggtaatatggagcgacaatacgggaggtatgacatggaagcttgaggacaagatgtgtgagcagtatccgagactattccctaatcagtga

SEQ ID NO: 97391 - DNA, 804 bp, Glycine max
  Peptide Sequence Number=SeqID_214169
atggattttgattcatctttcttccaataccaaaactttaactcttcctttgtaaattcctctgtttgtgcagaaccattttcttgggagaactttcttttcttcaatgaagaaaacaccaccaccaccacccttaattccttcaccatcactgaccactcctcacaatcacgaatcaaggaatcatcatcctcagattattccaactcttcgggctccttggtcagcactgagtcacaactagaagtctcatccaatttaactcatgcaagccatcaactcgaaacacatgcatcaccacaaccaccaaaagaaggtaacaaagacaagagacccttcagaggagtgaggagaaggccatggggaaaatttgctgctgaaataagagactccacaagaaatggggtcagagtttggattggcacatttgacacagctgaagcagcagcactggcttatgaccaagctgctttgtccacaagagggtccatggcagtgctgaatttcccagaagaagtggtgagggaatcactcaaagacatgcagaacaataataagccatcattggaagatggttcctctccagtgttggcactcaagagaaaacacaccatgaggagaaaatccaaagccactaacaaaaaaaccaaaaggggtcatggaatggagttagaaaatattgtgctttcacaaaatgtgctggtcttggaggacttgggttctgagtacttggagcaacttctcagcttgacttcttctgatgatgatttcctttgctatctttataaagttaacaaattttga

SEQ ID NO: 97392 - DNA, 477 bp, Glycine max
  Peptide Sequence Number=SeqID_214170
atgggaaaggagcaagttgaggtgctaaatgccctggacgcagcaaaaacacaatggtatcatttcacagcaatcatcattgctggaatgggcttcttcactgatgcctatgatctcttctgtatatcacttgtcacaaagctacttggccgcatttactaccacgttgatggggctgcaaagcctggtccattgcctcccaatgtgtcagctgcagttaatggtgtagcttttgttggaacactttccgggcaacttttctttggctggctcggcgacaaaatgggccgaaaaaaggtctatggcatgaccctcgtgcttatgattaccataatgtctgagtattctaataagaagacttgcggtgcctttatagctgcagtgtttgctatgcaaggatttggaattttggcaggaggtgtgtttcctattatcatagcatctttgttcaaggccaagtttgatgctccaccgtga

SEQ ID NO: 97393 - DNA, 162 bp, Glycine max
  Peptide Sequence Number=SeqID_214171
atggcgagttcattttggctaatacaggttcgcaaactccttgtcttagtgtttggaagcagtctagcagttcaaattaaattggcacgtagccaatggaagaaaagagtgaagcttacaaggcttaccttttcttttgaagtagagactggctatggctag

SEQ ID NO: 97394 - DNA, 909 bp, Glycine max
  Peptide Sequence Number=SeqID_214172
atgctgtcttggaagatgctccctgaagagatagtgcttgcatttgtcacacctggaaaacttgttcgcaactgggacgcggttgacatcccttcagtggttcatgcatcaaagacgaaagcgcaattatgtagggctgttttgtttcaagcactactcttattaatggaaaatgtggtttatcccgatatctatgcttattgctctttctggaaaatgtccgcattgttcactcattttctaaatcaatcatcaatcatatgcagactaggcatttatgagcccgttgaacataataaccctgcactctctcccaactacgaatctcctgtctacgaggctgaagaggaggaggatgatgaaatcccggaggaacttgctcggttattggaatatgaaaagaaaaccattcagcctcatgaggagttagtagaggtgattaacttgggaaccgaggaagataagaaggaagtcaagattggggcatcgcttgaggcagctgtcaaacgaaaggtgattgaattactcaaagaatatgccgatgtgttcgcatggtcgtaccaggatatgcccggcttggatccccgtattgtggagcaccgtttgcctttgaagcccgaatgcccaccggtcaagcagaaattgagaagaactcgccctgacatggctctcaagatcaaagaggaagtacagaagcagatcgatgcaggttttcttgtcacatcagagtatcctcaatggttagccaacatagtgcctgttccaaagagggacggcaaggtcaggatgtgcgttgactaccgagatttgaacaaggctagtccgaaagatgactttcctctacctcacatcgatgtattggttgacagcgctgcaaagtccaaggtgccacttaccaaagaggcatga

SEQ ID NO: 97395 - DNA, 282 bp, Glycine max
  Peptide Sequence Number=SeqID_214173
atgtcgttagaatgctacgagctccgttttcaatacgagcatctcgttatattacacgactcaatcggacatccgagaaaaaggttatcgtcgctagaatttgctcagagcttacgttttcaaagacgagtatctcaatacattacgggattcattcggacatccgagaaaaagttctgtcgtgggattgtgctcagagcctctgtctcaattaagagcgtctcggtatattacgggatcaatcgacatccgattaaagttattgtcattgaatttgcttag

SEQ ID NO: 97396 - DNA, 609 bp, Glycine max
  Peptide Sequence Number=SeqID_214174
atggtcattcccaagttcaaggtgccgaactttgacaagtacaaggggactacttgccccgagaaccatctaaagatgtattgtcggaagatgagggcatacgcaaaagatgggaaactgctgatacatttcttccaagaaagtcttactggggcagttatcacttggtatactaacttggaaccttctcgagtccattcttggaaggacctaatggttgccatcgttaggcagtatcagtacaattctgatattgctccggataggatgcaactacagagcatatgtaagagggggcacgaatctttcaaagaatacacccaaaggtggagggatctggcagcccaagtggttccctcaatgacggagaaagaaatgataacaatgatagtagacacattacaagtgttctattatgaaaaatgggcaaatgaagagggcgagaatgagggagaaacccatgttgtgactgccattcctatacggccaagtttcccaccaacacaacaatgtcattactcagtcaataacaacccttctccttacccaccacacagttatcgacaaaggctatccctaaatcaaccacaaaacccacctaccacataa

SEQ ID NO: 97397 - DNA, 193 bp, Glycine max
  Peptide Sequence Number=SeqID_214175
atggcgttcatattgcagtatgctggagtatatcaattttgcattcattctttacacagtagaatggataacaagtattgccttggtgatctctactccctggattctgatttctcaacagccttggtgatctctactccctggattctgatttctcagattttgcctatagtttctacttttcattggccta

SEQ ID NO: 97398 - DNA, 249 bp, Glycine max
  Peptide Sequence Number=SeqID_214176
atgtcattgcctaccgttgttcatgtgtcctccatcttcgagtttggagctatgcttcatgattgcctaagtgtggacactcaagtgcaatcctccattcaccacttttttcggagccccatgaaaaaaaattgcctagcgctgttcatgtgtcctccaccttcgagtttggagctatgcttcatgattgcctatgtgtggaccctcaagtgcaatcctccattctccacttttttcggagccccatga

SEQ ID NO: 97399 - DNA, 278 bp, Glycine max
  Peptide Sequence Number=SeqID_214177
ctgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 97400 - DNA, 400 bp, Glycine max
  Peptide Sequence Number=SeqID_214178
agggtacatctacttggttgttcaaagagaacaagggagggtacatcccttgtggatctttgcttgtaaaggattttacaaggttattggaaatctcaagaaccgtgggttgcttggggactggacgccacttgatccaacaaaactaagttcatttctcttgaaaaatggctttgagcaaggaaagactgaattcaaaatgagcatgatgcgaaagctgaaattctttcttggattgcaaataaggcaaacatcccaaggatacattcatcagaccaagtacgtgaaagaattactaaagaaattcaacttgagtggcacaaaagagatgcagactcctatgcacttcataccttgggttggacgaggaattaatgaaggtggacaggactcaatatag

SEQ ID NO: 97401 - DNA, 213 bp, Glycine max
  Peptide Sequence Number=SeqID_214179
atgaatagcacaagttttcaaggtttagaaaaccagaaaacttcagaaagcttttggtacaaagaagaagaagaagttcaaagagattcaaggcttgtaaaagattgggatggccttaggcttagggtgcatcctgaagcaatggggcatgccacattgcccccactctcttgctattcatgcctaaacatgcgcccaccaagtgctcggtga

SEQ ID NO: 97402 - DNA, 324 bp, Glycine max
  Peptide Sequence Number=SeqID_214180
atgcttttttgtaccattaattacttcccagcatacgggaatttgagtggatacagtgttaagggtggtgcatgccccatctgtgaagaagacacaagctacgcacaactaaaacatggtagaaaaacaatatacactaggcatcgatgttttctgacaccttatcacccttaccagcgattagaaaaagcttttaatggaagtaaagagcatgaaagtgcacatatactgttaactagtcagcatgtttttcagcgggttgaacacttgaatactatttttggaaagactcaaaagaaggataaaaagaaaaatgctccttaa

SEQ ID NO: 97403 - DNA, 750 bp, Glycine max
  Peptide Sequence Number=SeqID_214181
atgacccttgctcaggtctggagtgttctatcctactccaacctggctcggacctcccacacattgaatctgactgtggatcgagctaggttaatctttggcctagttactcagttggacatgaatgtcggagccctcatttcttggcagattacttctatggcccagtctaactccttaagactcgggtttcctgcccttatcacaactttatgctggaccagagaagttgcctctaacagtcttgtctttgaacgtctgagcccggtcattaatttggcctacataaggaagaattcttggaaccctgatgatccaacaattattattaggggggccagaagaccaagggcaaggccagctaaggctccttctacagcaatagctcctcatctagcttctacatcaacagctcctcctccagctcgtattgcagcatctcattctaccccatctcctgaagattttcagtgttttgaagccatgcttcgaagcatacatcaggggcagattattttgctgcaaacctggccagggactcagcctcctcctcacagggacgacaagaatcctgccactcaggtaccacatcaaccagcggatgagtcatcagagtcttccactcctaagcccttgatcaggaagaggagggtagttgtaactcaagaagccacaaccactcctgaaaagtctcctaaggccactccagagcctccggcaccaatggcagataccacttctccacagtag

SEQ ID NO: 97404 - DNA, 599 bp, Glycine max
  Peptide Sequence Number=SeqID_214182
gctaccctcaccaaggcaacaagaatccatgtgaaggtgacattctacctagaaggagacatgccataggacaagggaaatctcctagtgaaagaaaggtagccaagccaaaagctcagtcgatgaagaataagcctccaactagaagagaaaaacaacatcaacaaaggaagagagtcatgcagaagctaagagggatgtttcagatgttggaggaaaaccacaagatggacagaacaaatgtggcatcaccacctcggctaaatctttttattgaaatgttaggcgacaagaaagagctagagttgtctgatgatgatactctcattcctatcacagttgttggcatccttactatggagtttgctaatcaagatcggctaacggataccttagaaggtgatgtattagatgatgaagtagagtgggcaagtttggcaaaagatctcaatgttgaaaagggagtttccaaactatacaaggcacaagaagatgacaaggcggttgcttctggaggaagcaaccctgctcgcctgggcgagctgagctcgcctgggcgagctgggcggcaaccacctcccctatcttgctataaatag

SEQ ID NO: 97405 - DNA, 209 bp, Glycine max
  Peptide Sequence Number=SeqID_214183
gccccgacgggtgcagagaaacacgaggaactggaaccagagaggcggcacgcaaaccgaggcgaaagggcgacctacccttcggcgaaagggcgacgcggggcttacgggtgcgtcttccatgggaggaaaatgcgtggagtcgccaccaacgtttattcgaggaaaacgtcagaaaaactggaaaaggtgtggtctacgaactttaa

SEQ ID NO: 97406 - DNA, 399 bp, Glycine max
  Peptide Sequence Number=SeqID_214184
atgaaggtcaggggtaagagatctgaggccccttccacttcagcatcagaggcaccagcaccttcttcttctacagtacctccctcttcatccactcagattccagttattccttcagcacctctacatataccacttctagctcctctatctgcaggactagaagattttatttttacaccgcagatgcttcattccatgctccaaagcatccacagggggcagtccatcatcatgcagagccttcagggcttgagcttgccctccattatgagcatggaggagtttgagactcaggtggtctggccaggagaccagccctcttcttttggaaggggtggggcctctgcagcccaggagcttgatattgaggagccaccagcaccagcagaggactag

SEQ ID NO: 97407 - DNA, 198 bp, Glycine max
  Peptide Sequence Number=SeqID_214185
gggaagctggatgtttgagtgagatagaggaggagtgcttcttgaagcagttggatgagaacaaaaaaggattctctatttcacctgcgccaccactccttgcttctagttatgttcagtttagggctgaatttgacctggttatgtatgttcttgtactagaccattctaaccatgacaaattggaatgggctaaag

SEQ ID NO: 97408 - DNA, 332 bp, Glycine max
  Peptide Sequence Number=SeqID_214186
atgaattgcgttttcgttcatggatcctccacccacgactttggagccatgcatagtgattgcttagtgcaattctccattatcaaccctttttcggagcccatgaattgcgttttcattcatgcatcctccaccttcgagtttggagccatgcgtagtgattgcttagtgcaattctccattctcaaccctttttcggagccaatgaattgtgttttcgttcatgcgtcttccaccttcaagtttggagcaatgcgtagtgattgcttagtgcaattctccattctcaacccttttttggagacccacaagaattgcgttttcgttcatgt

SEQ ID NO: 97409 - DNA, 267 bp, Glycine max
  Peptide Sequence Number=SeqID_214187
atgaaagtcaaacacatgcgttatacaacaaatactctagactcaagcctacatggaatgtggtaccatttttcaatgaaaaatctcgtcgggcacctaggagtacatgacaggacatgcctcacaatggggagactagtcagggtcacgttgttttgcgagaatgctccaaccatgtgggatcggcacaagctcacaggagcactcaaaccggatgacccccaaggcctacactccgaagagtccatctgggcatctccctcctga

SEQ ID NO: 97410 - DNA, 261 bp, Glycine max
  Peptide Sequence Number=SeqID_214188
atgagtaccttcttcatgtggagtttgcttataacaggggggttcatagaactatcaggtgtagctgattcagatgatgaggggtctacagatttgaggacaaatcatcttcaagagagaggggatgatgcaatcctcccaaggaggggacccatcactagagctatggctagaagactccaagaatattggggtagagatgcaagagaagaccctagggttctcatgcgtcttagggtagattttgggctcataggctaa

SEQ ID NO: 97411 - DNA, 597 bp, Glycine max
  Peptide Sequence Number=SeqID_214189
atggttatcagccaggcgggcgatgaacctgaagtgaaggggctggtgtacatcgcagcgcgcgcgccggaggccggtgaagattatccggcgctcaccaaaaagttccctgcagcaccggttgccgctggcctgaagtggcgtgacgacggttttggggcgctcagtgaacaggcgtttatccacgactttgccggcgatctgccggaaagcgaagcgcgggcttattacgccgttcagcagccgatgggtaaagccattacccaggcgaaaaccagcgtggcggcctggcatagcaaaccgagctggtatgcggtgtcgacagaggatcacactatcaatccggatctgcagcgctttatggcgaaacgcatgcatgcgcagaccatcgaactcaaggccagccatgtgtcgctgatttcccagccgcaggcggtggcaaatctgattatgaaagccgcgcacgtaccaggggctggtcgtaatgctgctcgataccgcgatagcgcatacccagccgctgcatcacccggtgggaagcaagattttccggatgtgccaccgccaccagataatccacgccaatctgcccggtag

SEQ ID NO: 97412 - DNA, 929 bp, Glycine max
  Peptide Sequence Number=SeqID_214190
gaccaggagatgctcggagatagattttcttcctcccgcccccagcaccagcggatctatcaacagggcagcaacataacagttgctacagtatcgttccagcgcatcgagtgtttcctgttctcggcccgatggaaacgtgatggtatcgacctggaacaggaggggctcataagccgcgttgaacaccccgcgcgcgccggtggacatggtgccgatcgtatcgccgtgatagctatactccatcaccacgatgcgcgagcgcggctcgtttctgttataataattgccaagcgccatcttgatcgccacctcgaccgcagtggaaccactgtcggaatagaacacatgcgcaaggttaggcggtgcgagcttgaccagttctttcgccagcctttctgccggttcatgggtgaactcggcaaagatgatctggtcgaactgttccgatgcatgccggatcgccgccatgattttcggatgtcggtgcccataggcgccgtcggttttgatgatcttgcggaaagccggttctgtggcgtgttgcgtaaatggatgccagacggggaacggatgcccggtgtggcaagcggccagtctgcgcgtgccgctaagctcaaggataatttcttcggtgtcgggttgtcggtcaccgataaaggcgatgccaagcacgggtatattgcgccggtccaaggcctcgagcgaaagcaatgtatgattgatggtgccgaggccggttctcgaacagaggatgaccggcttctgccagcgcgcaaaaacatcgataaatgttgtgcggcgcgtcaggggcacatgcaatcctccagcaccttcgatcaccagtggagcatcgactgtcggtacttccagcgtttccgtattgatatcaatcccgtcgatccgtgccgcaagatgtggcgaagccg

SEQ ID NO: 97413 - DNA, 160 bp, Glycine max
  misc_feature (144)..(144): n is a, c, g, or t
  Peptide Sequence Number=SeqID_214191
atgactaatgcaaactgtccgcaagagtcaatgcattcagtctcaaacgggaatctaaggtttgacactgcacaaactcttgtatcaaggttccttcaggtttcttcttttttcgaggacgagggtgagagccccgtcgagtcnttaatgaaaaacaaaa

SEQ ID NO: 97414 - DNA, 543 bp, Glycine max
  Peptide Sequence Number=SeqID_214192
atgaaagggctgcacgtcctgaccttcagaggaatacacgtcctagccatcagagggctgcacgcctacacctttagaggactacacgtcctcgccatcagagggttgcacgccctcaccttcagaggtctacacttccttgccattagagggctacacgccctaacctttaaaggactacacttcctacccatcaaagggctgcaggccctcaccttcagaggactacatgtccttgccatcagaaggttgcacgccctcacctttagaagacaacacttcctcgcaatcagagggatgcacgccctcacctttagaggactacacgtcctagccatcagaggactgcacgacctaaccatcagaggactacacgtcctcgccattagagggtcgcatgccctcaccttcagaggactacacgtcctcaccatcagagagctacacgtcttcaccatcagatggctgcacgtccacgccaccagagggctgcacaccctcaacttcagaggattagaaatcctcgcctttagagaaccacac

SEQ ID NO: 97415 - DNA, 303 bp, Glycine max
  Peptide Sequence Number=SeqID_214193
atggcttcctatggtgaagatccaaggcctacaagctccacatggagctacatcactcatcttctccttgaagtggcatctccaatcatatttctccttctccattccgctgccatcaaacttctagaagcaaaggactccattgatgaagaagatccaaggcctacaagctccacatggagctacatcaacacccagcgaccaacatggtcatctgcatcctttgtcgaagacgtgacttctattgatgaagactactttagtctcttcttttcatcatccagagacaatcaagtccgatga

SEQ ID NO: 97416 - DNA, 186 bp, Glycine max
  Peptide Sequence Number=SeqID_214194
atgtgggtgcaagccattggtctgtttgctcaagcgacctgtgctcctgagtttggacttccaagaccgttcaatcaaagattactcgtcttgcacgttggtggggctgccgtaaaacaacaagtttgtcttttagagagaagtgagttatcaagaataggatgttggacaaatggcctcagttaa

SEQ ID NO: 97417 - DNA, 150 bp, Glycine max
  Peptide Sequence Number=SeqID_214195
atggctaaggaatttaacatcctttcggtaaccaaagaagatgggcctagtcgatctgacgaccagtttgaagggcccacaacacaatcaaatcctcctcagaggcttaggcaaggtttgaagaccgaggaagcaaaatatgaacaataa

SEQ ID NO: 97418 - DNA, 222 bp, Glycine max
  Peptide Sequence Number=SeqID_214196
atggacgtatacgcaagcatacgtttcatgcttgtttgggtaatagcaatgagattccccaatatcatgctaatggctgaagctgaagcagctactttcgaagtaacagaaagaaaagcaacgactggagtgggagagtcagagtcgaaaagaggattcctcacttctttctctcattcaaaaccgtgcatgagactttcatctcgcacggctcctaagtga

SEQ ID NO: 97419 - DNA, 291 bp, Glycine max
  Peptide Sequence Number=SeqID_214197
atggggctccgcaaaacggtgagaaaggggaattgcactaagcaatcactatgcatggctccaaactcgaagattgagaatggagaattgcactatgcaatcactacgcatggctccaaactcgaaggtggaggacacatgaacgaaaacacaattcatggggcttcgaaaaagggtggaggacacatgaacgaaaacgcaattcgtggggctccgaaaagaatgagaatggagaattgcactaagcaatcactacgcatagctccaaactcgaaggtggaggacacatga

SEQ ID NO: 97420 - DNA, 636 bp, Glycine max
  Peptide Sequence Number=SeqID_214198
cggcgccggcaagagcagcctgttgcgcctggccgccggcttggcgcggcccagcggcggctccttgcgcaacgattttcgccacgccgcgctgatgttccaggagccgcggctgctgccctggcgtcacgcgttggacaacgtggcgttgccactgcgtgctgccggccatgcgcccgccagggcgcgggcgctggcggcgcaatggctggcccgggtggggctggacgcggcgatgcagtcgtggccgggcgagttgtcgggcggcatggcgcagcgtgtcgccctggcccgcgcgttggcgctgggacccgacctgctgatgctggacgaacccttcagcgcgctcgatccggcgctgcgccgccagctggccgccaattgccgcgaggaattggtccgcagcggcgcggccttgctgtgcatcagccacgaccccgaggaattgctgggcctggtcgaccgctgcgtgctggtgcggcaagggagcgtcattgccatcgagccggacgccactggcgccttgtcggccgtgcgcctgcgcgccctgttgctggaggccggcgccgggccgtgacgcggccattgccaggatttccgccgttccgatttccccgttcgccggctccgccatga

SEQ ID NO: 97421 - DNA, 174 bp, Glycine max
  Peptide Sequence Number=SeqID_214199
atggaagacgcacctgtgagcctcgcctcgctcgcccgcaaaaggaaaaagccatttactacaggggaaacttgcccaggcgagttggagctcgcccaagcgagttgcttgcttaaggctgaaggtatcagctcgcccaagcaagtggctttcttagggctaaaggcaagctag

SEQ ID NO: 97422 - DNA, 384 bp, Glycine max
  Peptide Sequence Number=SeqID_214200
atggaaaaatctcttttgattgtagaagaagcaaacttatcatccagatctttttctggaagagttagtgatgataaagctaacagaagtggaaggaagggtatggttcttccttttcaacctctatctctcacatttgatgagatcaaatattctttagacatgccacatgaaatgaaaaagcaaggagtttttgaggaacgtcgagaacttttgaagggtgttagtggtgtctttaggccaagagtactaacagctctgatgggtgctattcaaggagttcctaagatcaaagaaggttataatcctgcaacctgcatgttggaagttacatcagcaggcatagaagcatctcttaagatatttcaaaccaaaggctattga

SEQ ID NO: 97423 - DNA, 162 bp, Glycine max
  Peptide Sequence Number=SeqID_214201
atggcatatgccttctctcatcagatgaaccttgtgatctcaaatctcaaagaactcccaacagttcatcccaagataagattgtcatgtcccttacttcttgaatggctagtgtctttggttcccacaccttgggaaagatatctaggacctttagattga

SEQ ID NO: 97424 - DNA, 616 bp, Glycine max
  Peptide Sequence Number=SeqID_214202
atgcgtagtgattgcctagtgcaattctccattctcaacttttattcggagccccaggaattgattgtccttcatgcatcctccaccaatgagtctggagcaatgcgtaagtattgcctagtgaaattctctgttctccacttttattcggagccccatgaattgattgtcgttcatggatcctccaccaatgagtcgggaaccacgcgtagtgattgcctagtgcaattctccatgctccacttttattcggagccccatgatgtgattgtcgttcatgcatcctccaccaatgagtctggagccatgcgtagtgattgcctagtgcaattctccattctcaacttttattcggagccccatgaattgattgtcgttcatggatcctccaccaatgagtctggagccacgcgtagtgattgtctagtgcaattctccattctccacttttattcggagcccaatgaattgattgtcgttcatgcatcctccaccaatgaatctggatccatgcgtagtgattgcctagtgaaattctccatgctccacttttattcggagccccatgaattgattgtcgttcatgcatcctccaccaatgagtctggggccacgc

SEQ ID NO: 97425 - DNA, 945 bp, Glycine max
  Peptide Sequence Number=SeqID_214203
atggaattgtatgacaactcttctaattcgaacgatcatttgtcaatgttatcctacaaaggagcttatgcttcgatagtttgccttcgcaaccagcaaggaggggctaaagacagaggtcaatctaagagagggttgttggctagagacagtgtgaaggaaggatcttttttcttcatatccatcttgaaaatgccgcctaacactttggaagaattttttaaaaaggcagagaagtacattaactatgaaaatgtattggaagccagaaaaatgaaaatggttggacagataactacaaaccttagtatgatagaccaacttgcaataaacaataggaaaggtcaagaagtcttgactgataccaaagaaagggatgttctaggagtgttctccgaggtgatctatgtcatagcaagaggatccactagcagaggtcccttaaacattgctcagaagagacacgcgagagaggtcttaacaaacacccttggtagaaggaattatgagtcggccaaaagaagacctcctccattgacatttaatgacaaggacatggatatgtcaattttcccgaaccatgattatcccttattggtaaaagctttcataaacaataaacaagtacattggttgttggtcgacattggtagcactgcagatatcatgttttatgatttctttaagaacctcagaatcctacaatcagagttgcttccttacaaagaagacctcataggtttctctagtcatcatataacaccattgggaaaagtaaagtttcacataacctttgggaaggcacgagaccagaaccatcatcatcaagttcattgtggtaatgctacaatcatcctacaacaccatactggccagaccaaccttgaatgccctgagagttgtgatttcgatagttcacttggccatgaagttcctcatcaatga

SEQ ID NO: 97426 - DNA, 210 bp, Glycine max
  Peptide Sequence Number=SeqID_214204
atgacggtggcgagcgtagccaggatagggcggtcgtcgagcacgcgaggaaggaggttgggtgaggtcgacgaagctccacttagtgtcgctctgcagcagatccgggtggcccgacagcgagtcaggtgtgtctggtggtggaagagtgcgggattagggattgggacgtttggctgtcttgggatgttaagggatggcaaatcttaa

SEQ ID NO: 97427 - DNA, 102 bp, Glycine max
  Peptide Sequence Number=SeqID_214205
atggtgggagcaggttcgatgatttacttcacgggcaaggtctctggttcaagaccaggatggcccagctgcgtcaaggaaaagaatagaaaactgacttga

SEQ ID NO: 97428 - DNA, 1167 bp, Glycine max
  Peptide Sequence Number=SeqID_214206
atgacgtacttaatataccagaaaaggaaacttgccaaactaaaagaaaagttctttcagcagaatggcggtttgattttgctaagaaaactttctagaagagaagacacttcccaaactactcaagttttcaaagaagaacagctaaagaaggccaccaacaactttgatgagagctcaatcattgggaaaggaggttatggtacagttttcaaaggatttctagcagatagaaacagaactgtagctatcaagaagtccagaataattgatgagagccaaaaggaacaattcattaatgaggtgattgttctatcccaaatcaatcataggaatgtggtcaaactcttgggatgctgtttagagacagaaattcctttactggtttatgaatttgttcaaaatggtaccctatacgaatttatacacactgaaagaatggtaaataatggaacttggaaaactcgtctaaggatagcagctgaggcagccggagctctatggtatttgcactctgcagcctcaatagccattatccacagagatgtgaagactgctaacattctcttggatgacacttacaccgccaaagtgtctgattttggagcttcaagattggttccacttgatcaaactgaattagccacaatggtgcaaggaacttttggctatctggatccggagtacatgcttacaagccaactaactgagaaaagtgatgtctacagctttggggtagtgcttgtagagctactgacaggggagaaacctctttcttttagcaggccagaagaggaaagaagtctcgctaaccactttctatcatgcttgaaagaggatcgcctgattgatgttcttcaatttggccttctgaatgaagaaaataaaaaggagatcatggaagtcactgttcttgctgcaaactgcttaagactcaatggggaggaaagacccagcatgaaggaagtggcaatggagttggaggcaataaggcaaatggagaaacacccatggatcaatagagagaaaaatctggaggagactcaatacttgcttcatgatgcaccatccaagatttatgaacatcgtgatagcagcagccttcaatataatggctatgacagcatcagggatcatgtactaattgccttggataatggaagatga

SEQ ID NO: 97429 - DNA, 2721 bp, Glycine max
  Peptide Sequence Number=SeqID_214207
atggagagttatctctacctccatccgagcaagaacccggccactgccctcatttccccaatcctagattcgaccaactaccactcatggagcaggtccatggtcactgcattaagtgccaagaacaaagtagagttcatagatggcagcgcacctggacctctgaaaatagatagaatgcatggagcgtggcgtcgatgtaacaatatggttgtctcgtggatagttcactcggtggccacctccatacgtcaacctatactttggatggacaaagccgaagaaatctggcgcaatctgaaatcaagatattcacagggtgatcttctgcgcatattcgaccttcagcaagaagcttcaacgatgaaacaaggctcactcacagtgactgagtatttcactcgtctacgcgtgatttgggatgagattgagaactttagacccgatcccatctgttcctgtaatatcaggtgttcctgcaacgcattcaccattatcgcacaacggaagctcgaggatagagccatgcagttcctacgaggcttgaacgaacaatatgctaatattcgttctcatgttctcctcatggatcccatacccgctatctccaaaatattctcctatgtagctcaacaggaaaggcaactactgggtaacaccggaccaggtattaacttcgaacccaaagatatctctattaacgctgctaagaccgtttgtgatttctgtggacgcattggtcatgtggaaagtgcgtgctataagaagcatggagtaccctctaatcatgatgcaagaaataagagtaatggaagaaaagcatgtactcactgcggcaagataggacatactgtagatgtctgttatcggaaacacgggtacccgccgggatacaagccttacagtggaaggaccaccgtgaacaacgtagtggcagttgaaagcaaagccactgatgatcaagctcagcatcacgagtctcatgagtttgttcgcttctcccctgagcagtacaaggcacttcttgccttaatccaggagccatccgcagggaacacgacactcactcaacccagacaggtggcttcaatctcatcatgcatcgacaatactccaacaaacccaggatatcttgtatatgatttgcattctaatgatgttaccgtatctagaaatgtcacgttttatgaggatcattttccttactattctgaaacccagcatataaactcagaacattcagctccctctccgggaccctttttcggcaagagccttgacccacaaatagaaaatcgctcatcacaacctacgatatcagtaccgtcatccaatgaaccttcaaatgagcaacctcttccacatcttaggcgatccacaaaagccaaaaacaccccaacatatctccaagactatcatagagaccttgcttcatctacaccaaatacttcagcggtcgttcgttacccacttagttccgtgctttcatattcaccttctcgccatgactgctggattaaggcaatgaaggtcgagttacaggctctccagacgaacaacacatggagactcacacctcttcctcctcacaagacaactattgggtgtaggtggatatacaaaatcaagtatcgggcagatggatccatagagaggcacaaggcgcgattagttgcaaaggggtacacccaaatggaggggttggattaccttgacacgttctctccggtagcaaagctcaccacggtgcgccttcttcttgcgatagttgcactcaaccagtggcatttacggcagctggacgtcaacaatgcgttcttccatggagaacttgacgaagaggtgtatatgcaaatacctccaggactttcggttgacaatccacagcttgtgtgtcgtcttcaacggtccctttacggactcaaacaagccagcagacaatggttcatgaagttatcgagcttcttaagctctcatgggtttcaacagtcgaatgcagatcactccctcttcttgcgcttcatcggagacatcactaccatactcctagtatacgtggatgatatcatcctcacgggaaacaacatagctgaaatacaaactatgatcaccctcctggatcgcgagttcagaatcaaggatcttgaggatttaaagttctttcttgggctcgaaatcgcacgcacctctaaaggaatccatctatgtcaacgtaagtatacattggatattttgagtgattcaggaatgctaggttgcaagcccaattcaacaccaatggattactccacaaagctacaagcagattcaggaagtcttctttcagccgagtcttcttcttcctatagaagattgataggcaaactcatataccttaccaacacacgacccgatataacatacgtagtccagcaactcagccagtacatggccactcccaccaatgctcatcttcaagccgcttttcgcatcctccgatacctcaagggtacaccaggttcaggactcttcttcgttgccgcaggcactccacaactccgagcattcagtgactcggattgggcaggatgcaaagactcaaggaagtccactacgggttacttagtttactttggttcttctgttgtctcttggcaatcaaagaagcaatcaactgtatcacgcagctcctccaaagctgaatatcgcgctctcgcttccactacttgcgagctacaatga

SEQ ID NO: 97430 - DNA, 264 bp, Glycine max
  Peptide Sequence Number=SeqID_214208
atgaaaagaaagggttgccctgctcttaagggattacctctaatagtagggagtagaatgcggcgaagtttcctttgtactggatcgaagaccattatcgagacgaggccaatgcctaatatgtcgttgataatgatttgtcaaaggaagaaacgagatgctaggacaagattcttgcatttcggaagagatggcgtcgggctattccaagagggtttagtgactttttcagtgtatatgggatggattgttgttgatggttaa

SEQ ID NO: 97431 - DNA, 213 bp, Glycine max
  Peptide Sequence Number=SeqID_214209
atggtgaaacttgaatctttgagaccaaccatgagtaagatgtgggtacgaaggcgtgcaaaaagccctcaacctagggttggaggttgtcgctggtggctaacagtgaaaaggcctataggatggatgagtgggcgaactcctagagaggttaaggtctttgcaagtctaatcgagatcatagagtccaacaatgttgagggatgtgcttag

SEQ ID NO: 97432 - DNA, 1758 bp, Glycine max
  Peptide Sequence Number=SeqID_214210
atggggtgcttgacaagatgtgacagcagagagagcgtgcgaaacatgcagagagatggaaaatgtaccggaattggatgttgccagatcgatataccacctggaatgaagaacattagtttacaaacattcacctataacaatttcaattcctcttccgacttcaacaaatgcagctattcctttgtggtgaaaaatggcaactatactttctcgatggatcatttaaaaggactcccgttcaataaagcaccctttgtcgtagattggactgttggaaaccagacatgtggcatttccaagggtaaactcgactatgcgtgcagaaataatagcgattgtgtggactcgggatatggttaccgatgcaaatgtaaagaaggctttgaaggaaacccataccatcccgatggttgcaaagacgttgacgaatgtaagataggcaatcatgcatgcataagtgaaaaaaattgtctgaacaccaatggatcctacatatgtttctgtccgaaggggcaatccggaaatggaacaaagggagaagggtgccaccaacaagatgttgttaccaaggtagtcataggagtagcagcaggaattgttattctatttgtggggactacttcattgtacttgacataccagaaaaggaaactcatcaaacttagagagaaatactttcagcagaatggtggttccattttactacagaaactctctacaagagaaaactcccaaattcaaattttcacaaaacaagaactaaagaaggccaccaacaactttgacgagagcttaatcattggcaaaggaggttttggtacagttttcaaaggacatctagcagataacagaattgttgctatcaagaagtccaaaatagttgataagagccaaaatgaacaatttgttaacgaggtgattgttctatcacaaatcaatcatagaaatgtggtcaaactactgggatgttgtttagagacagaagttcctttactggtttatgaatttgttaacaatggtaccctttttgattttatacacaccgaaagaaaggtaaatgatgcaacttggaaaacccgtgtaaggatagcagcagaggcagctggagctctagcatatctgcattcagaagcctcaatacccattatccaccgagatgtgaagactgctaacgtactgttggatgacacttacactgccaaagtatctgattttggagcttcaaaattggttccacttgatcaaactgaattagccacaatagtgcaaggaacgattggttacttggacccagagtacatgcaaaccagccaactaacggagaaaagtgatgtctatagctttggggcagtgcttgtagagctgttaacaggggagaaaccttattcttttggcaggcctgaagagaaaagaagtcttgctaaccactttctatcttgcttgaaagaggattgcctgtttgatgttcttcaagatggcattttgaatgaagaaaatgaaaaggagattaagaaggttgcttttcttgctgcaaagtgcttgagagttaaaggggaggaaagacctagcatgaaggaagtggcaatggagttggagatgcatcagtggattaatacagacgcaaatctaaaggagtctgattacttggttcacaaggtatcatctatcgtttccgagcctggtgatagcagcagccatcaagagtatgacagcattagggatcaagtactaccttctttgggtgatggaagatga

SEQ ID NO: 97433 - DNA, 1173 bp, Glycine max
  Peptide Sequence Number=SeqID_214211
atgcctaagggccatggaaattgcggttacaaggtatgggaggatgagctgctacatataagaactaatgatcaagatgaccatgacttcgatgagggtgttaatttggcagtaaatcattccaaaaagatgagaatcatggacagttccgaggaggatccaacaccaatggctgtatccgaggctgagctttcacagagtgaagatgaagcactcgagaaagcatcgcagctatcttgcctatcagaatcaacaccttcaaggatcggtggggatcgacagcatgtgtttccaaggcacatttttgctggtgctggtgctggcgctggcgctgatccatcatttgctccattaggtcggttaggtcgccttctcttcagtccaccacaaagcttgaaatccccctcatctcagacacctcagtcaattttctgctgtgttttcccatcctttaatcccatagatgtcccaaaacaaccaagtattactaatgttccttgtgctgaacataaccagcttgatgttattcgtctcagccaacaaagccaactttcaagcagtgaaagaaaactaatgtcaagggcacaaaggcaaagacaattggcctttgctgcacaaaagcagctcctcaatgatctagaaacctcgaagcctcacgagcatgagtccatgaaagaggcagcacaagacacttttgctatattagacaacttgggtgcaaatgacacacaattctttgagcatgttttgtatttcataaaactcacatcatcggttgtacaaatgactaaatccatcgaatgtcttgaggaggacaacaagcgtcttgaggacgagaatgccaaactcgcccacattcgtgacctctacgccaagaccgaagatcagttccaagcctctgatcaacgaaggcaattactttccaaagagatctctgactttgaggccatgcttgttgagaaacgaaaccaattgaagtcgtgtgaattggaaacttcaaacatgcgaatcgaacttggtggtttgagaagaactatgttggaagctgatacagccttgaaggctagaatgaagcaagcagagattgcaggtaaacttaggaaagagagagaagccaaacaaattgcagccaaaacagcactcgagaaggccaggcttaaatcagagtattaa

SEQ ID NO: 97434 - DNA, 336 bp, Glycine max
  Peptide Sequence Number=SeqID_214212
atgaggagtacttgtgatgaatggaaacctttcttagtaatgatagcaattgatttttcttttgcggcagtgaatatccttctcaagaaagtcctggaagagggaatgaaccatttggtttttatcacataccggctgtcaattgctaccattttcatagccccaatcggctactttagggacaggtctggagattcaacagctcgaatttggaaaattgttgatggagcttgtgactctagtgtgcaaaatgaaccagtaaatgttgtacatgttgtggtgctgcagcacttcaaagaaagcaccaatgagaaaagcaaggaacccatttactag

SEQ ID NO: 97435 - DNA, 612 bp, Glycine max
  Peptide Sequence Number=SeqID_214213
atgggaagcgcgttggaaacgctatgtggacaagcttacggagcggggcaagtgcacatgttgggagtgtacatgcagcgctcgtgggtgattgtgaacgccaccgcgatcctgctgtcgctcctctacatcttcgcggggcctatgcttagagctataaggcagacagaggcgatttcggcagcggggggggagttcgcggtgtggatgatcccgcagctgttcgcgtacgcggtgaactacccggcgcagaagttcctgcaggcgcagagcaggatcatggtgatggcgtggatcgcggcggcggcactggtgctacacactttgttcagctggttgctcattctggagttctggtggggtctcaagacgacacaagttcgccatcagagcttgaagatgagagggcaaagagtgtttcttctctctcccgcgctcactatgacggcaatgaagagtcaggatagaagaaaaactggatttgacatgcttgagatagccttagttgcacttcaagacatcacaccctggaaaagattttttatgacaatggaaagaaaactcggctcaaagttcccgcagataatgccagttaggaatttacaaaaatga

SEQ ID NO: 97436 - DNA, 189 bp, Glycine max
  Peptide Sequence Number=SeqID_214214
atggttagggcgaaggaagagacgagagagaaggttgaggagaaagagagagagattgaagagatgagacagagaattgaagatgtagagaaagttagagttgtggaaatgaaagagaaaggagagagtggatggttccatttatcttcaaagggacttcagtgtccaattgatgttcttcctatgtaa

SEQ ID NO: 97437 - DNA, 645 bp, Glycine max
  Peptide Sequence Number=SeqID_214215
atggcaaagggcacaaaacccttgtgggtgttgagtaactttctaatttgtgatctcccccttccaatggagttagtgatgaaacacttgcaactgcggcgggtgctaatggtcgcattagccctggtagtagtagctgttgcacctcatcaaacactttctgccactacaccaaaacaagccctacctggctgcaaatccacttgtggagatatcgaaattccatatccattcggtataggcaactcgtctacgccggatcaccgatcctgtttcttggagcccaagtttaaacttacttgcaacaactccagattgatagcgggtaacatcacagtttcaaacataagcatcctagctcaccaaatggacgtatggtttttcgtcgcaaaggtttgcaacggaacaaacagcacgatcccctggctgggaacaggctatttcagcatctctagcaaggacaacaaattactaactgttggtacccatagttatggatacgtcaacagttatttcaacggggagtcatattcaacagggtgcttaacgagcactcacggcaacacaaggaagatccaaaacggtacgtgctcgggtatagggtgttgccaggtggatattcctacagggatgagaaacatcact

SEQ ID NO: 97438 - DNA, 1461 bp, Glycine max
  Peptide Sequence Number=SeqID_214216
atggcagggactactatgcctgccccatcaaaagggtatgcttctaacacttccaattttttaatttttcttttcgtgcctccaccttttaagtatcctcattgtgcatgttctgccggagtgtgtaaaagggttaagggtacatactctaagtactattttatttgccctattaaacagggtcagggatcttgtggatacattgtgtcagaagatgacgttaaattgcttagtagaaaaagcactgttcctgtccagcaaagtaggcaaagaactcatgatgatttttgggagggatgcctaaatgatgagatgggtgatgaattgggtaagggagatggtttgcatgtacagatcaaaaggatgagaatcgcagacagtcccgcgagtccatttccggtgaatttatccgagactctgggaaaaaaagatgcaggtgcagcactaaatgcagccaattcaaaacgtgatggttttccggatttggtgtttgatgatgatgatgatctagaatttgcaaactcagtatcatgggagactgttgaggcagaagcatttctgttattatcctgtctatcaacaccttcaaggatctgttggcgacagattatgtttcagaggcgcattttctctaatgttgattctgtctctctcatcattacaggcgttttcccatcctataatccaataattgttcctaaaaagacaagtattcctgattgtcctgttgaatgtaaccagcttgctatcagcagagtcagtcaacacacccaactttcaactgttaaaactgaggtttctggagatgtagttagtcccagtaaatcaccagatggtaaaagaaagtcaatattgtcaaaggcacaaaggcatagagaagtggtcttgtttacacagcaacgacttctcattgatctagagactttggctcctcatgagcacgagtccatgagagaggcagcaaagaacacttttgaattattaaatgttataggggttgattataaacaattttctgataacgtcttggactatatcaactttgtatcatcaattgcagaaatagataggtccatggaaaattcccttactatggaggagcgtattaaactctttgaggaggagaaaatgagatttgttcaactccaagatgactatgtcaagaccaaagctttgcttgaagcatcatatcggcatagacaattgctctgtgaacaggtctctaatctcaaggccatgctcaatgaaaaacaaaaacaattaaaacatcgtgagttggagaccttgaagatagagactcatcttcgtgatttgaaaaggaatatattggagactgatgcaacgttgaaggaaagagctgagcaaacagaagtggcaaggaagcatagtgaagagagacaagcaaagcaaattgcagctaaggaagcgcttgccaaggcaaaacttgaattggaaaactaa

SEQ ID NO: 97439 - DNA, 192 bp, Glycine max
  Peptide Sequence Number=SeqID_214217
atggcactcaccaagcagtatggctctcaattcagattccaaaggaataaaaaggtgggtgcaatacaacaacagcccatcctggcaacttttgatccactaaatgatttaggtaaaactggtggagttgagccgaaaactcaagttgtctcgtggaagttgtcgtgtagagaaactcaagggagacattag

SEQ ID NO: 97440 - DNA, 753 bp, Glycine max
  Peptide Sequence Number=SeqID_214218
atggagccctgggcatcgctttcagaagaagcaatttctcttgttgcagaggatataccagatccgggacaatcatcaaaggaggaatctgtcagggaggaagaagctaaacatgcagagcattttcatttatcttcagctgcctttcatggacaaccatcaccatgcaccttatatgttgcaggcaaggtcaaggagttgaatgtgaatatcctcattgactcgagcagttcacacaatattttgcaaccacaggttgtagagtttctgggattaccattggtcgctatcaaatccttctccatcatagtgggccatggcaacactatccaatgctttaggtgctgcccagatgttccagttataatggcgggtcagtttgcccctatctttgctatgcctcacggtttgcctcttgatcgaacccaaaatcataacattgaccttttgcctcattcccaacttgtcaacattaagctatatcgatgtccacaatatcaacacaccataatgacacgacttattgcagaaatgttacaagatgtgaaggatagattctccatacctatggataaacttttagatgagttgcatggttttatgatttactccaagttgaacttgcgttctggttattatcaagtgttgttgaaccctgatgactctcttaagacggcctttcacataattgactgccattttgagtttctggtaatgccttttgggttgaccaacgacccttctactttctag

SEQ ID NO: 97441 - DNA, 471 bp, Glycine max
  Peptide Sequence Number=SeqID_214219
atggggttctcagttgaaggaaaggaacatatggaaaatactgttgatcggtatatgtatctgaaggtcagtgggagtaaggttatttttccaattctgtatgttgattatatcttacttgcaactaatgatcttggtcttcttcatgagactaagaagtttctctctagcaactttgaaatgaaagatatggtcatgtcatatgtcacgaacttgcagcctaccacgtggagtctatgcagacacgtgggactaatggctgatgtggctcttgtggatgaaatggagttggctacgtttagggaacaagttcaactcgtgactatgaattcggtttttgcttcacgcaacattccagttcgggcaacaaaggcgatgctggctccgtttgatggatctaatccattagaatggatcttccaagcggaaagttactttgagttaaaccaagtcgccattcctcagcattag

SEQ ID NO: 97442 - DNA, 4665 bp, Glycine max
  Peptide Sequence Number=SeqID_214220
atgagtggagaaagaaacagtaagaacggacatcaacacagctacacgagagcaaactggagagaccaaaaggatgtaacatctttctacttcacccggttccctgaagatgcaacaaagaaagatttgtggcaccatttcaaacaagcgggcgacgtgagggagattttcatctccagaaaaagaaacaaaaatggtaggaagtatggattcgtaagattcaaaggggtggaggaagtgcacaaattagaaaggaagttagacaatatcatcttcggtgggctaaagatgtatgtcaacatcccaaaatttgggagagctaagtctggaaagtcacaaacaacaactaggggacgagaatatgtcgagcaaaatgaagaggagattagaggtgcgtacccgagaatgaagccaggagtgtctgcggaagatgacatcttgtggaatatcggagctaacatatcgaaatacataggtgacgacatggttttgcttcttggcctcatagatgacaaaacatggcaaatgatggatgaagaagataaaggaggggtttcgctgttccactccttggagacgaggaacctgaggatgcgctccggttataggctgacatgggtccattgttggggaatacctttaatagcttgggacacgcaacaaattaagaagataatggccaatatcagcgacatggtggacgttgatgacgacgtggaggaacttaggaagctggatatggcacagatcctaatcaaaacgccatggaagccattactacaacataccgaaagtggaagtccctttaacacttgccagtgccggcgacggaccgagttcaactcatcggaggaaatccaatcagaggacagcgatgccggcacaccgcggagggtaagttcgctgacgaggcagaacgaacatggagtgcaagacatggcggcgtcaatcggcaaccccacctcatcgtcaggaacgacagacaacaaccgcgcgccgggaatggaagacaacgattgtgtgacgttaaccactggacgcaacaacaaggctaccctagcggaagcactgatgagttgttgtggggtcacggatgcccaagaaggtaccatgcatgaaaacgcgggagcgcagaacaaagggaatcgaacccctatagggaggagagagaacttgcatgaaaggggaaacatagaggtggaaggggatgttggagctttggggaagaaaacttttgacttaaagaagtcacatgaccagggggatgaggatataatggggttgggctttgctaattacaccctcagcaaaacatcatttcagcacattgatagcccaccgaaacccgaagtagccccaaataactcgtacgcagccactgttcaagacgaagccacaccacatccacacttgcaggagatcgtacgcaagacgactaatgaccaagaaaaaatcataatctgccatgaccacacatcaacacaagcagtgcttgaggaagcaaagccaacaaataatcatattcaagaggcaaaaaatttatggaagggaggtcaaatggccagcaatcagaaggatggtcaacaaacaacacataaacatgttgtgtatccaggaaacaaaaaaggaggcggaattctatgtatatggagtgagaaaacttttaaggtagaaagaaaggtcattgggataggtttcataatgctggtagggaagtggcttcaagaggcacaaccagttcatatcatcaacatctattcgccttgtgatattcaaagtaaaagagtgttatgggatagggttaaacaattgaaaaatgtaaaccctgggggattatggtgcatattaggtgatttcaataacatcaggactcatgcagagagattgggtgcatgtcagaaggggttggtggatggtagcattatggagttcaatgaatggattgtggagctggaggtagaggaagcgccatggatgggtagaaaattttcatggtttagaccaaatggagcagctaggagcaagctggatagcttcctgtgtgttgattggggtcccaaaccttttaggatccttgatttttggctctccgacaactcattcaagaacactgttcatgaatgttggacctcttatcagcataatggttggggagcagaacaattcggggatactttcaagaaatataaaaagattgaggaagatttaaacaagctggaagaggacacaattgacagacacctagttcctcatgaattggtgtctaggaagcagcttcaggaagatttatggaggttccaagaatatgattatgatagacctcgattggatggtatatgtttccagaccattggtagccaacaaaacgatatgcttgtggagcggtttcaggaggatgaggtaagaagggttgtttggaactgcaagagtgacgaaagtctaggcccagatggacttaatttcaaattcatcaaacaattctggcacattattaaacctaatctccttcggttcttggatgaattctatgttaatggaatttttccaaggggctccaatgcatctttcatagccttaattcctaaggtagtggatccacaactgctgaacgattacagacccatttcattgataggttgtatatacaagataatggctaaggttctggctaatagattgaagaaggtcatgcctcttatcatacataaaaggcaatcagcattcatagagggaagacatatgctacacagcgtgctgattggaaatgaggtagttgaagaagctaaaagatgccaaaagccatgcattgtattcaaggttgattatcagaaggcggtgcctaaaatcaacacggttttggtaaatagcagtccctcatctgaattcttacctcaaaaaagacttagacaatgggatccattatcatctctattcttcaacattgcggctgaagccctaaatgggctcatgtcacaagctatgggaaaaaggctatttaggggtttcttagttggcataaacatggtggaaattagcatcctccaatatgtgaatgacacaatttccttcggtgaggcatctatggagaatgttaaagcaatcaaagcaattttgaggacctttgaacttgtatcaggcctcaaaattaattttgctaaaagtagttttagtgcatttggtgtgtcagatcagtggaaacttgatgcagcaaattatctcaattgtagcttgatgttctttccttttgtttatctcggagttcctattggagcaaatccaagaagatatcagacatgggaccctatcattagcaagtgtgagagaaaattagcaaaatggaagcaaagacatctgtctttcgagggaagagtgactctcacacagtcagtcctaacatccattcctatctatttcttttcatttttcagagttcctaaaaaggtggtggacaagttggtcaacttacaaaggagtttcctatgggatgggggatatgagcagaacaagatagcttggatcaaatgggacacagtgtgcctcccaaaagaaaatgggggtttgggaatcaaagatatcaacacttttaatctagcattgatgggtaaatggaagtggaacttatttcagcaccagggggaattgtgggccagggtactcgaatccaagtatggtggttggaggagtctaaatgaagcacctcgagacaatagtgaatccatatggtggagggacctaaagttgatgactcaacatccgcaacatagtgagacaatgcaaaattcaacactatggaaggtcggctctgatgacaaatttaagttttgggaggacaattggataggtggaaagggttcgctattagctaaataccctaggttgtatagcatttcttctcagcaaaaccaacttatccagcaaatgggagcttacaaagacacaggatgggagtgggattttaggtggaagagatcattgttcgatagtgagatagacatggaggtgtcattcctaaaagatgtcgagggcattagaattcagcctcaggctagtgatgaatgggtgtgggcggtagatccatgcggtcaatactcggctaaaagtgcttataatgtgcttagggaggagacatcaaaggagatccacaaagaagctttagaggatctgtggaaactcaaggttctaactaaaatttctgcttttgcatggaggctactcaaagatagactaccgacaaaagtaaatttacgaaggcgacacattgacttagatgataccacttgtcctttctgcagaagcatagaggagagcgcaagtcacttgttttttcattgcagcaaaattcttcccgtatggtgggaatcgttgtcttgggtgaaattggtgggtgttttcccacataacccaaaacaacatttcctccgtcacatatatggagtgaccgagggtataagggcgaataggtggaagtggtggtggctagcattaacatggaccatttggaagcaaagaaattacattatcttttccaatgatacctttaatgccaataaaatgctagatgatgcacttttcttactctggacatggctcagaaatttggaaaaggattttggcacgcactacaatcattggtctagtaatcttagtgcaggatttcttaagtag

SEQ ID NO: 97443 - DNA, 414 bp, Glycine max
  Peptide Sequence Number=SeqID_214221
atgtgtcctccaagatcagatactagatgctggatagacaagtatggattatttctcattaataataatcataaactactcacgactaatgagtcatatgtcttggtcattcaagctcaacaagtatattatgttaaagatatcaaagatcctgattggttagttgttgaaaaaacaaagcctcgagacttgtatgatgtgcttgagaaagctacacttgaggcttataatgatcgaggattgtatttggataggaatgatttagtccgacctataattgatggaaaactgatgatatattcaggagttgttgaccgtgaagaagaagaaagtgatgacgaaattattgatttaacaaaagatgaagaaagtaattatattgataaagctaataataatgatgatgattattag

SEQ ID NO: 97444 - DNA, 489 bp, Glycine max
  Peptide Sequence Number=SeqID_214222
atggtgtatgggacggggtcggggatacccgatatccgacggatacgaggatgggacaataaacttaaacccgtcaagtatcggctcatcggccttgatgctttcgtgaatgaggagggtagcgtcaccaccgtcatcgacgatgagggcacactcggtgcaccaccagtactcttggagggtctccctcttccaggcaaagacgacaacactgtcacaagcagtagcggcgacgtcgtggtcctaggtggagaagatgttgcaggagcaccgacggacttcggcctaggaaaggtcattgaccttgtactcgagaccacttgtgtggttttctccaccaacaaagccatggtttacgcgctgagaaagaaagaaagaaagaaagaaagaaaaaaagagagtggagtggtgaggaaaggctctggagtcgtggaagacgaagacgaaacgaaaacgacagaatgtgatattttgagtgaggctagctag

SEQ ID NO: 97445 - DNA, 705 bp, Glycine max
  Peptide Sequence Number=SeqID_214223
atggagattcttccactatacaaaaagatagtagggttacaaggatgtgtttacaaaattgactcactctatggtggctcactcaagcttgaggatagagatttcccaagctatttatcttctctctcagagaggctctctacttggattgactcattctacagtggctcactcaagcttgaggatagagacttcccaagcaatttatcttctctctcagagaggctctctacttggattgagtcaccctatggtggctcactcaagcttgaggatagagacttctcaagctatttatcttctctctcagagaggcttactcaaagagactctatacttggattgactcactctacggtggctcactcaagcttgaggatagagacttctcaagctatttatcttctctctcagaaaggctctctacttggattgagtcaccctatggtggctcactcaagcttgaggatagagacttctcaagctatttatcttctctctcagagaggcttactcaagcttgaggatagaaacttctcaagctatttatcttctctctcagagaggctctctacttggattgactcactctacggtggctcactcaagcttgaggataaagacttcccaagctatttatcttctctctcagagaggctttttctcactctaagaaatggattcactcttgtcttggatggatag

SEQ ID NO: 97446 - DNA, 372 bp, Glycine max
  Peptide Sequence Number=SeqID_214224
atgaacctgactcttgataccactgttgggaaaaactcgatgggaggaaataccggagagattcctaatgtgggacttcacctcacacttgtaatccaacacatctccccctcaagtgtgagtctcttccacatggtagcctcccccttcgagcgaaagtcatcatccacgactacatgcggtacttgcaccgccgctccatctgcgggacacgctgcctggactcaccaccaggaagactttcgatacaagggatctccaaggctgagatccatcaccgccatcttactcgtcagagccggtcaccaagtcgaaccatctggctctgataccactgttgggaaaaactcgatgggaggaaatatcgggtag

SEQ ID NO: 97447 - DNA, 651 bp, Glycine max
  Peptide Sequence Number=SeqID_214225
tatttagccttagacggaatttaccgcccgattggggctgcattcccaaacaacccgactcgccgacagcgcctcgtggtgagacagggtccgggcaagacggggctctcaccctttctggcgcccccttccaggggacttgggcccggtcagccactgaggacgcttctccagaatacaattcggatgccgagggcgaccgattttcatggtgggcttttcccgcgggtagccccgcgtgacctgaggtctctttgggagcgtgcgtgcacgcaaagggtcgtcgatgggtccagaactgaccggctctcacgtgattggtctcgagcgtggctcatccaccattttatcacggcgaagtcgcccatgaacccagatttcaaccaaccacgaggcgggtgctcgcgggaggtcagcatacaccccgcgcagcaacattgttacatgtttgctttggggaaacgatgtgtgacacccaggcaggcgtgccctcggcctaatggcttcgggcgcaacttgcgttcaaagactcgatggttcacggagattctgcaattcacaccaagtatcgcatttcgctacgttcttcatcgatgcaagagccgagatatccgttgccgagagtcattgtatgtaaatgttgtgtcgtga

SEQ ID NO: 97448 - DNA, 669 bp, Glycine max
  Peptide Sequence Number=SeqID_214226
atgaagaaactgcatgttgtttatcttgatggaaaaccattacttttgcgaaagctattgctatttctagtatcaccatcaaccaaccttgagtgcactccactctcacgtacggtgttattgagctcacgcatggcttctacatttcctcaccaacttcaggtgaagccaattcactttttcaagatcataaccgctcaaaatcttcaggatggaaagctaatgatcccaaacaagtatgtggataaatatggagaaggcttgccaaattccctatttctcaagactccaaatggtactgagtggaacttcaatttgaaaaagcgtgatggtaaaatatggtttcaaaagggttggaaagaatttgcggagtatcactctctagctcatggtcatcttttggtttttagacgccatagaacttcccattttcaggtacacatctttgatttgagtgccttagagatacactacccttctaaaggtagagaagaaaaatcaaaggtggttgttgctaaccaaattatagctcttgacctaaaaagttctttgaaaccttgtaatccgttcttcttagttgtcatgcatccatcatacatccattctaatggcagtcctcagataagccgcaaagaaagatttggcttgttgtttgtagaacttacatga

SEQ ID NO: 97449 - DNA, 687 bp, Glycine max
  Peptide Sequence Number=SeqID_214227
atggacacccccttgaagcaacaacctagtttgggggaaaacctagaaaattttctagctcctgcaggtgtgatcaatgtaggagatcatcaagatcacaatgttaatgttgttattggtggtgatactcatcatcagaacctgatgggaatggatccaatagtaatgccttcacaacaagaacattggttgcaaatgcaaattcctgcagctattaacatacaccaacacggaggggtccttgtccctaagacttatgaacagatggggctgtggtggccacaactaggtagttttggtgtagtggtgcttgagagtgtaagtggacttaaggatgtggattttaggcaacctgaggtgctattggtaaagaaggttcatcaatttgaggtgacaaaaagcccacttgaggcattagcagatatgggactaaatggagagtacaatttgaaggagttaatgacattggtaagcttaggagctgaacatgggagagaacatggagagcacggaagattggagagaaacaaatacttgccgtatgaattcacagtgggagctccaccgggaaaggaaaggaagcttcaatttgttgacaacccaaatggtttattctctgctcaagcaacaccaaaacctccagctactgtgtatacaataccggaaggaatgcatggttcaaattag

SEQ ID NO: 97450 - DNA, 255 bp, Glycine max
  Peptide Sequence Number=SeqID_214228
atggtgaccgtggaggaaatccgcaacgctcagcgttcccatggacccgccaccatcttggccttcggcaccgccacgccgtccaactgcgtctcccaagccgattaccctgactactacttccgcattaccaacagcgaacacatgactgatctcaaagaaaagttcaagcgcatgttacaccaaactgaccagagttctccggaaactttagttctttgttacttatgtgcagtaaaaatattaacggcatag

SEQ ID NO: 97451 - DNA, 2286 bp, Glycine max
  Peptide Sequence Number=SeqID_214229
atggctggaagtctatcaaaaatcattccggatatgtcgaaaatagaacctctaaacggctcaaattataggagatggtctcaaaaactgttgattttgtttgaagccttagaggttgattatgtgctatttgaagatcctcccgctgatgtcaacgcttctgaatcatctactcctgaaactcctgccacccctgacgtcacaccgcttcctgcagaaaccaagaaaactgacgaagaagcaaagaagaaatatgaaaaggacaacaaaactgctagaggtcatctgctaactcatatggcagataatctgtttgatcttttcattaatcaaaagtctgcgaaaacaatatgggacactttgctgaaacgttacgacgatgacgatgctggaagaaagaaatatgtggtaggaaattggctgcgtttccaaatgatggatgacaaaccaatcatggagcagattcatgagtatgagaatctagttggtgatatactaaatgaaggaatgaagatgtgtcataaagcttatgagtgcaaactgaggaagggacaacaatctaacaactcgaaacctgctgcaccacatgctcctcaagcacatctagcagaaaatgaagaagtgatagctgctgtggtagtggaggcaaacatggtcaacaacaaggtggactggattctagataccggtgcttctaaacacttatgcgccaacaaagagctttttcaccagattgaggatgctgatgacggagaatgtgttttcatgggaaattcagctacagctggagtgcttggtaaaggaaagattctccttaaacttacttctggaaaaacattatctttgagtgatgttttgtatgttccctctctgcgtaggaacctaatttctgtatggggatgtcttgctaaggtagctctaccagatttcaagaggactaatgtagtgcctttacatttgcatacttcttcctctgtaacaaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaacttataatgaggctgtaacttccattgatgccaatttttggaaagaggcaattaatagtgaattagattctatcatgtataatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttagctgctattcatggacttatagtgcatcaaatggatgtaaagacagcttttcttaatggtgacttgagagaggaaatttatgtggaacaacctgagggctatgtgattcaaagtcaagagaacaaagtgttggaaaagaccaaattattcttatcttctcattttgatatgaaagatctaggagaagctgatgtgattcttggagttaaaatgagaaaaagtgataatggtttttccttgtgtcagtcacattatattgaaaagatacttaaaaaatttaactgttatgatgaattacctgtgagaactccctatgatcctagcatacatcttaagaaaaacaatggttctagtgtttcacaaactgaatatgctaaaatcatagggagtgttatgtttctcatgaattgtactagacctaacatagcatatgttgtgagtagactaagcagatatactcacaatccaggtggaggtgccatatcctggaagtcttccaagcaaacttgtatagcacgttcaactatggaatcagaatttattgctcttgatttagcaggtcaagaagctgaatggttgagaaacttattggcagatgtgccattgtgggggaaacggtctataccagtttctctttattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttgtacttgaatcgtcgagggggatgaggcttaagcctttgtgttga

SEQ ID NO: 97452 - DNA, 879 bp, Glycine max
  Peptide Sequence Number=SeqID_214230
atggaaaattactatgattctggctggcacatgggcaccagcaactgggctcaatgcagtgatcattcttcttcttcttcctttgcagtgcctacacaacaaatactccctcatcatgtcactgacgctgcctctcttcaatttggtgagtttcactcatggtcacttcccattgaaggggctgcagaagagagagcaataagtgcttccaagagtcacaggcaagctgagaaaaggcgcagagacaggatcaatgcacagcttgcaactcttagaaaacttattcccaagtctgataagatggacaaggcagctttactagggagtgtgatagaccaagtgaaagatctaaagcgaaaagccatggatgttagcagagccttcacagttccaactgaaatcgatgaagtatcaattcatcatgaccatgttcttcaagatgaaagctgcactgaaaaagtgaacaaattgaaggacaatattgtgatcaaggcttctgtttgctgcgatgatcgaccagaacttttccctgaactcatccaagtcctcaaaggcttgagactcacagcagttaaagctgacatagccagtgttggtggcagaatcaaaagcatattggtgctttgttctaaggatagtgaaagtgtttgccttgccactctcaaacagtccctcaaatctgctatcaccaaaattgcttcatcatcatccatggcttctagttgtccctctagaaaaaagttgcaaagtgattttttacccatgatccaatcgaaggttcactgggagagtaaaaaagtgaagaacgtagcaggagaaaaagaaacgaagagagcagtggaaaagcaattgatcattgcgttgctcgttaattattag

SEQ ID NO: 97453 - DNA, 335 bp, Glycine max
  Peptide Sequence Number=SeqID_214231
atgactaatgcaaactgtctgcaagagtcattgcattcagtctcaaacgggaatctaaggtttgacactgcacaaactcttgtgtcaaggttccttcaggtttcttcttttttcgaggacgagggtgagagtctcgtcgagtctgatgaaacaaaagtccaaacttggagcagccaacactacaggaacgaacctgtggttgttgttgctactccacggttgcaaaagtattcaagttttgatgaccagagtggggagaagcctctgcttttgcccattcgaagcttgaaatctcgcttatctgaagaagatattgatgttcaatctctgaacat

SEQ ID NO: 97454 - DNA, 156 bp, Glycine max
  Peptide Sequence Number=SeqID_214232
atgggtgctcttaagttacggagctgcttgctcgtggccttagataaaccagcaacatgcggaaacttgaatcatatacggaccgatggtgggaataggtcaggccagcttacagggatctacgatctgacctacataaagtctggtttgtattga

SEQ ID NO: 97455 - DNA, 168 bp, Glycine max
  Peptide Sequence Number=SeqID_214233
atggagcagtgtagcgggttcgccgacacgtcctttttccttggagacatcatggctatattggatacgattatgtgtccagtgtatactagaagggattcctatggaaatccaactctttaccattggttttcatacccaatagtaaagaccttttgcaaatattaa

SEQ ID NO: 97456 - DNA, 561 bp, Glycine max
  Peptide Sequence Number=SeqID_214234
atgaagttagaagacagcactggcccatgcaggtcccaaacctgctgctaccctcttgttactggcacgatgatcaatccagctgagctaattggtgatgacacgtctgatgagtgcaagaagtttgcaaaggtgcacaaggtgtttggagcaagcaatgtgagcaagattctgattgaagtgccggaagagcagagagaggacacagtgaattctcttgcttatgaggctgaggcaaggctgagagacccggtttatggatgcattggtgccatagctctgttgcaaaggaagatggtggagcttcaacatgatctggtcatcgcaaaggatcgtctcgcgcgttgtcacgctgctgctactgctgctgccaccaccaccaccactactagtatcccttctcctgatatcttgcatgccaatgttagccttcccccattccctgacttttacacttcttcaagtgacttcaatgatatcttctgccacagttcttcgtctcaattattgagccgacatgaaacggtggatgatttcaatcaaatcccatatatattttaa

SEQ ID NO: 97457 - DNA, 1752 bp, Glycine max
  Peptide Sequence Number=SeqID_214235
atggcgaacgtggatgaactcttatcttccttaatctcagacatccatacctacaccggcaaggaccctcttcttccctggcttcggtacccttcaatcccctcactctctctcttcctctgttttccacttaacttttctgtatactcactcattattcccaactttacttgcagcgcgatccgaaaggtgaaggacacgcttccacccaaaaccctaaaggaaaaactacccgcgttcttgcagaaatgcgcacataccttcgagctcgatcgacgttacagaaacgacatgcgctatcttcggatttggctccatctgatggatttcgtggatgatccaaaaacgcttttgagaaccatggaggttaatcacattgggacaaaacgttgtgaattctaccaagcgtatgcgctttactacgagaagagcaagaagtacgatgaggcagagaaaatgtaccatctgggagtgaagaaatatgatatatggctaagatgcaaccctaactatgtttcaccatttagcttaaacactttcacctttgactggatcagccttgcagagcctgtagataaattgcagaaatcatatgaacaatttcttcaacggatggagcgaaaaaacaataagagaattcaggtgcatcaggaagcaaaaggtgccaggaggcctctgtctacaaaaagcttcccttctcttgacaacaagactgagggaagcaaaagcaatggagcatgctgtgttgagggtggtgtgcaaaagggaccccgaattgataattatgcagctaaaggtgtagctgatgataaaaacgtaaagaccaagaaggatgagcgcaagagatttcatggagacgatacagttgtagtcaagtttgttgacactgccatggttggaaagtctgaagcagaagacgcatgccatcatggattagtggatcctacaataaatatgaaggaggccatgaatgccattaacagcatgttccgggaaccgttagagactgttccattaggcaggaaatcacataaaaaccatccaaaagaagatcctagtacgaagaacgaatttgaggtttttgttgatgaaaacatggatcatggaatcaaaccatcaggttccttgtcacttcaaaacaggactgaagctagccaacctcacccagaaccgctccagatatacgttgatgatgaagaaaattccgagaccagtgatgtgaatgtgaatctgtttgaaggtagtagtacttcatcggcttcacaaccaaatggttttgtttttctacgccccaaggatattccttctgaaaaatctagtgatatggatgctgacatcggtcgtaattcaaagttcagagaggatacagtcgtttgcagatttgttggttctgccattttggatgaaccagaggtggaaaatgtttgccaccacggtttagtagaccccaccatcaacttgaaggaagctatggatgacataaataacatgtttgggaagccaatagattttgttaggagaagaagaaccaccaccaagcaagagaaagccccccagagcaataggggaaatgactttggtgggttttcaatccttgttgatgatgagcacccggtgcaacaagttccacaaccaccaccaccaaaattgcaagaaaaatccaaggaatctgatttgtttgagccaactatgctcacaaaggaagccatagacgatataaacaagatgtttaacatgcctctggatttttag

SEQ ID NO: 97458 - DNA, 2619 bp, Glycine max
  Peptide Sequence Number=SeqID_214236
atggttcactccacttctcttcttccccataataaccaaaccttcatcctctccttccgctccaaaccttctttttttcattcccattcccactctctctctcttccatcttcttcctcttcttctcaatcgtcatgttgccacgtggctcgaatctccaccgagaccttggaagtctcgccgccgccgccgccgcctccgggtttcaacttccgccgcgaaatcgcgcgcctcgcttcgctccgcgacaggctcgccgcgtgcactactttaaacgagaagctccgagtgatggacgccgactccagagtgaagcgcttcttccgttcccgccacgggctcgctagggttttggcgtcgctgcaattgagctccgaccaacttttcctgctcaagtgtgtggtcgcggcggggcaggagcacgtgctgtgtttgggcgaaacggaatcgttggaatcctccgcctccgccgccgccgccaccatgagtgcggtgaagagcgcgctttacgctctggcggagatgattgagaatatggattcctttaacggcaatggcggagcgggtttggggatggcgttgggggatcacgagattgcggagctgaccatgtttttacagactttggcggaaattgagcgattctatgactgtattggaggaattattggatatcagattacagtactggaacttgcacaaaaatcgtttgagatgcagaatataagctgggcccaccagaggcatgacgtgaaagaatgccaaattttgggaattaatgcacctaatgggcttaacctttctgaagacacagagtatgcatctcaagcagctctatggggtatagagggtttgccagacctaggtgaaatttatcctttgggaggttctgccgacagacttggtttggttgatcctaacacaggtgaatgcctgcctgctgcaatgctaccatattgtggaaggactttgttggaaggccttataagagatcttcaggctagggaattcttgtacttcaagttatatgggaaacaatgcatcacacctgttgcaataatgacaagttctgcaaagaacaaccacaaacatgtcacctctctgtgtgaaagactttcatggtttggaagaggtcgatcgactttccaattttttgagcagcctcttgttccagttgttggtgcagaagaatgccagtggctagtcaccaaaccattcagtcccttgagcaagcctggaggtcatggtgtcatatggaaacttgcttatgacaaaggcatcttcaaatggttttattgtcaaggaagaaaaggtgcaactgtgcgccaagtcagtaacgtggtggcagctacagatttaaccctcctagccttagcagggattggtttacgtcaaggaaagaaactgggatttgcatcttgtaagcggatctcaggtgccacagaaggagttaatgtgctgatggagaagaaaagtcttgatgggaactgggaatatggtgtgtcttgtattgaatacacagagtttgacaagtttggaattactaccggacctcttgctccaaaagggctttctaatttggaatgcataacccaaatatcaactttatttttatactcaagtttgcaggcagagttccctgccaatacgaacatcttatacattgatttgccttctgcggagctagttgggtcaagtaagagtgaaactagtttacctggaatggtgctaaatactagaaagccaatagtttacacagatcagtttggaagacatcatagtgtctctggtggtagacttgagtgcacaatgcaaaatatagctgacaattattccaactcatattcttctagatgttataatgatgtggaagataagctggatacttttattgtatacaatgaaagaagaagggttacctcctctgctaagaaaaaaagaagacatggagacaagtctttacaccagacacctgatggtgctctgttggatatcttacgaaatgctcatgatcttctttcacaatgtgatataagacttcctgagattgaagctaacgagaactatgctgattcaggaccaccatttctcatccttgtgcatccggctcttggtcctctttgggaagtcactaagcaaaaattttatggcggttccatatcagagggctctgagttacaaatagaggttgcagagtttttttggaggaatgttcagctcaatggaagcctgattataatagctgagaatgttatgggctcaatgaagattaatgagaacagtgaatccatactacattatggccaaaggtgtggaagatgtaaattgcaaaatgtcaaggtattgaacaagggaattgattggacttgcgatgaaaacatatactggaaacatgatgtgcagcgatctgaggtgctgcagatcatactgcatggaaatgctgaatttgaggctactgatgttgtcttacagggaaatcatgtgttcgaagttccagatggctacaaactgaaaatcatgccaggaagctcaggtttagcaatccagttggatccaattgatcaagatatgatggagagtggaagctggcactgggattacaagatagaaggtttgtaa

SEQ ID NO: 97459 - DNA, 138 bp, Glycine max
  Peptide Sequence Number=SeqID_214237
atgtatcgtgggccccgtggctcgttcggtgtaaaaggtcgatcgaaagtcggcccgtccgggcaggcagaaggaatatacactaatgcaccggatcccatcaaaactccgcagttaagcgtgcttgggcgagagtag

SEQ ID NO: 97460 - DNA, 417 bp, Glycine max
  Peptide Sequence Number=SeqID_214238
atgtcgtacaatgtaatgattcctggttatgcacaatacaagagaatggacatggcaagggagttgtttgaggcaatgccttttccgaatataggttcgtggaatatcatgataagtggctattgtcagaacggtgatgtagcacaagctaggaacttgtttgatatgatgcctcggcgtgattctgtatcttgggcagctatcattgctggttatgctcagaatggtctctatgaagaagctatgaacaggtttgtggagatgaaacgagatggagaaagtttaaatagatctaccttttgttgtgctttgagcgcatgtgctgatatatctgctttggagttagggaaacaagttcatggacaggtggtgaagacggggtatgagaaaggctgtttagtgggaaatgtattgtaa

SEQ ID NO: 97461 - DNA, 396 bp, Glycine max
  Peptide Sequence Number=SeqID_214239
atgcctgaaaatgatgctgtttcctggaatgccatgttgtctgggtatgtctggagtgggcatgttgacgaggcaagggatgtttttgataggatgcctcacaagtcacaagaattccggccatctcctggaatgggttacttgcagcatatgttcagagtgggagactcaaggaggctcgtcgcttatttgagtccaaatcagactgggaattgtttgatgggtgggtatgtgaagacaaacatgttaggtgatgccaagcagctttttgaccagatgcctgtcagggatgtaatctcctggaacaccatgatttcaggttatgaacaggatcgagatttgtcacaggctaggaggtggtttgaggaatctccagtgagggatgttttcacgtga

SEQ ID NO: 97462 - DNA, 426 bp, Glycine max
  Peptide Sequence Number=SeqID_214240
atgcataaacgacaatcaattcttggggctccgaataaaagcggagaatggagaattgcactaggcaatcacttcgtgttgctcgagactcattggtggaggatacatgaacaacaatcaattcatggggctccgaataaaagtggagaatggagaattgcactaggcaatcacttcgcgtggctccagactcattggtggaggatgcatgaacgacaatcaattcatggggctccgaataaaagtggtgaatggacatttgcactaggcaatcactttgcgtggctccagactcattggtggacgatgcatgaacgacaatcaattcatggggcttcgaataaaagtggagaatggagaatagcactaggcaatcactacgcgtggctccagactcattggtggaggatgcatgaacgacaatga

SEQ ID NO: 97463 - DNA, 225 bp, Glycine max
  Peptide Sequence Number=SeqID_214241
atgtgtctatcgggaaaggagagtatgctgatgaaatttctcatatccataaatgagattctggatgttagcatttcgtttctaaacgaccatttagaggaaacactaggtccaacaaagataggagaaaatcactcaaagtgtatcaatctcacacagtgcgtggcgagaaagtcgctagcgcacaggattttgtcagcaatcaaagggagaggaccactttag

SEQ ID NO: 97464 - DNA, 447 bp, Glycine max
  Peptide Sequence Number=SeqID_214242
cagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 97465 - DNA, 216 bp, Glycine max
  Peptide Sequence Number=SeqID_214243
atgtatgtaggttacgaggaaattatcatgaatccaattatttctgctgcttctgttattgctgctgggttggccgtagggcttgcttctattggacctgggggttggtcaaggcactgctgcagggcaagctgtagaaagggattgcacgacaacccggaggcagagggaaaaatacgagcattagcacttttatttgctaatccttttgtttaa

SEQ ID NO: 97466 - DNA, 261 bp, Glycine max
  Peptide Sequence Number=SeqID_214244
atgagatttcagatgttagcattcgttcctaaacgaccatttagaggaaacactgggcctaacagaatagaagaaaatcactcgaagtgtatcaatctcacacagttttcttctgagggcagggattacggtaagttgggattttggctcaaggtttgtagaacggctggacatgatatatgtcaggatgttggtttggccagcggttcagggaaaaaggagatgtcccacattatttccatgatacacatgcagcactga

SEQ ID NO: 97467 - DNA, 2004 bp, Glycine max
  Peptide Sequence Number=SeqID_214245
atgagcatgcttactgctctggaaagtttgcagctagctgacaatgattttataggccatttacctcaaaacatttgcattggtggaacgttcaaaaaaatttctgctgaaaataacaacttcataggcccaattccagtgagtttgaagaattgctccagccttataagagtcaggcttcagagaaaccagctaactggggatataacagatgcttttggtgtacttccaaatttggactacatcgaattgagtgacaataacttttatggtcaactttcacctaactggggaaagtttcgtagcctcacaagcctcaagatctccaacaataatttatcaggtgtgataccaccagaactagctggggcaaccaaattacaacaacttcacctgtcctcaaaccatcttacaggaaacattccacatgatttatgtaacttgcccttgtttgatctctcactcgacaacaataatcttacaggaaatgttcccaaagaaatagcatcaatgcagaaacttcaaattttgaagcttggatcaaataagttgtctggcttaatcccaaaacaactaggaaatttgctcaatttattgaacatgagtctgagccaaaataattttcagggaaatattccttcagagcttggcaaactgaaatttcttacgagtcttgatcttggtggaaattcattgagaggaacaataccttcaatgtttggagaattaaaaagcttagaaacactgaatctctctcacaataatctttcaggtgatctctctagcttcgatgatatgacgagcttgacatctattgatatatcatacaaccagtttgagggtccacttccaaacattctagccttccacaacgctaaaattgaagcattgagaaataataaaggcttgtgtggcaatgtcactggcttggagcgttgctcaacatcaagtgggaaatctcataatcatatgaggaagaatgtaatgatagtaattttacctcttactttgggcattctaatactggcattatttgctttcggagtctcgtatcatttatgcccaacctcaacgaacaaagaagaccaggctacaagtatacaaactcctaacatatttgcaatatggagttttgatggcaaaatggtattcgagaatattattgaagccacagaagattttgacgacaaacatctcattggtgttggagggcaaggatgtgtttacaaagcagtgcttcctacaggtcaagttgttgccgtgaagaaactccattcagttccaaatggaaagatgctcaatctgaaagctttcacatgtgagatccaagctttgacagaaattcgacatcgtaacattgtaaagttatatgggttttgttcacattcacaattctcatttttggtgtgtgaattcctggagaatggcagtgttgagaagactctgaaggatgatggacaagcaatggcatttgattggtataagagggtgaatgttgttaaagatgtagcaaatgctttgtgctatatgcaccatgaatgctcacctcgaattgttcatcgtgatatatcaagcaagaatgttcttttggattccgaatatgtagctcatgtctcagactttggaacagccaagtttcttaatccagattcatccaattggacctcattcgtaggaacctttggatatgctgctccagaacttgcatacacaatggaggtgaatgagaaatgtgacgtgtatagttttggggtcctagcatgggaaatacttgttgggaagcaccctggtgatgatatatcttctttattgggatcatctccatctacccttgtggcctcaacactcgatcacatggcattgatggataagttggacccacgtctccctcatccaacaaagccaattggtaaggaagtggcatcaattgcaaagatagcaatggcctgcttgactgaaagtccacgatctcgccctaccatggagcaggttgccaatgagctg

SEQ ID NO: 97468 - DNA, 486 bp, Glycine max
  Peptide Sequence Number=SeqID_214246
atgaggggccaagacatttatagtagccaagatgaggttactacttcaccttcttctagtgaaagtgaagaagcaaaaggggaagaatctagtgaagaaatctacccccaagaagaaggacaacctttaatggttaaggaggagtgtaaggagacacttgttagcattgccacacctcttaggcttgagtttattcctcaagtaaaggagttgttggatgagggtttggttcgcaagagcttaaatccttgtgctttgttggtgcccaaaatagggcttcccatggaccctaagagaataaaggtcattcctccaccaacaccactcattgagttggtgaggaactatattctcttatgggaagatgaccgggaaaggggtgttgaggaaagaattaatgagtttcaagaacctctggatttgaggtcaaatccttttcgagggggagggaatgatgcaatcctaccccccaagggcattggatag

SEQ ID NO: 97469 - DNA, 405 bp, Glycine max
  Peptide Sequence Number=SeqID_214247
atgggaatgggaaagggtgaacggagtgagaatggaaatagaatgggaaagggcaggacacgtggactgaaaaaacaattgattaaagaggagggtgagtctgatcccaagtgcattcttgaggcactttatactcttttgaacaaaaagtttgctttcaaagttaagaccatactaggtagcataacattttctgtttttgaagtgtttgaagatgaagacacaattaaagcaatagttgccaaaattccggttgatgaggatttgagcacatctctggtgacatctaagaaagacaagttgatgtcttctatagtgaagctcgatgatatatgtgacaatcaaactctgtctgcaagagtagactatgaccctgaagcactactcacccaaacccactgctaa

SEQ ID NO: 97470 - DNA, 147 bp, Glycine max
  Peptide Sequence Number=SeqID_214248
atggcttcagagttatcgactgacacaaccaagacaagtaccagttttgattcatcatcagcaacaagcaaggttttctttgtctcctactattctgatcttgatctagctatgaaacaaagccttctttcttcctctatgttttga

SEQ ID NO: 97471 - DNA, 441 bp, Glycine max
  Peptide Sequence Number=SeqID_214249
atgtattatgtttgctcctttcatggcctaggggacaaaatacatgctccagtaaaaaaatttgagatagaaaaatggaaagagcaactcaaagatggtatctcttatattctcaagaattttgaagttgaagctaaaagtgaagactatatactaacaactcataattacaagtttgtttttggcaaaggaaccaaagtcaaggttcaaggtctacttgatatctccaaaattgggtatcgtttcacaaagtttgaggatataaacaatgggaaagcttctattgatgtattaataggtaactttgagttgtttgtacacaactcaaagtatggatcaaaacttttgataaatgaaaagattccaaagactaaggacttcataaagagtttgggatcaaatcatacgggtggtgcatcatattctcaaaggatgaattag

SEQ ID NO: 97472 - DNA, 1299 bp, Glycine max
  Peptide Sequence Number=SeqID_214250
atgattcgggccatacgtgcttgcaaaactgcagcagaagaacgtgctgttgtaagaaaagaatgtgctgctattcgtgcttcaatagatgaaaatgatccagactataggcaccggaatctggctaagctaatgttcatccacatgcttggctaccccactcattttggtcaaatggagtgcctcaagttgatagcatctccaggatttccggagaagagaatgggttaccttggccttatgttgcttctcgatgaaagacaagagattccattttacaaatatgctagggagctagcaataatggtgatgggaaatatttcttcagccgaaatggctcgtgatcttgcaccagaggttgagagattgctgcattttcgagatccaaatattcggaagaaggcagcattgtgctctgcaagaatcataaagaaagttccagacttggctgaaaattttgtcaatcctgctactgccttactaagggagaagcatcatggagttttgattactggggttcagctttgtacagagctgtgcaaaattagctcagaagctcttgaacatgttagaaagagggtgaccactggcacaacggtaaaggtgtgccttggtgaccggttggtcataggttcaaatatggaaacagcctctttgcatatgcaaagggctacccacaaaggggttgaccaaaaaggcgaagagaagcattgtagattgcaactgctgaaatgttggttcttaggtgcctatcctagatctgtagatccattgttaggccacttgcattgccatgctccagcttatagccctggctatgaacgggctacttatggaggaggtgataagaaagaaagtgcttataatgcttgggcagtcttcaccttacaagatctagcaaacagtccttattcaccagagtatgatactgctggtttcacagacccttttctccatatcagattgcttagactgctgcgggtattgggtgaagatcatgctgatgctagtgactctatgaatgacatacttgcccagggtggaaataggcctggtggcatatggcttggaggtgaatctttagaattggatccaaatcacgaggaagctgcaaaattctacattgaaggtaattgtacttgcacagttgaaaatcttaacgctgcaaatgatactattgatgaactcgactttcctattgccttgagaaaggaattagatcttgttcagttgaagattcaaagtccaccacaaagtaatgcacaaaagtatgggaaacttggtgacatggagaagtaa

SEQ ID NO: 97473 - DNA, 492 bp, Glycine max
  Peptide Sequence Number=SeqID_214251
gattctgatgcttcaattcggaaaagagctcttgaacttgtttgtattctggtgaatgaaactaatgtgaaggccttaacaaaagagctagtagaatatctggaagtcagtgatccagatttcagggcagaccttactgccaaaatttgctcaatagtttcaaagttttccccagagaagatctggtacattgatcaaatgctgaaggttctgtctgaggctgggaactttgtaaaagatgaagtatggcatgccttaattgttgtgataagcaatgcttctgagcttcatggatatacagtaagagcattatacaaggcatttaagatgtcagctgaacaggaaactcttgttcgcgttgcagtttggtgcatcggagagtatggtgacatcttaatcaataatgctggaatgcttgatgtagaagatccagtaactgtgagtgaatggtttcttcttgaaagtttatgcataatatatactgttgcttaa

SEQ ID NO: 97474 - DNA, 474 bp, Glycine max
  Peptide Sequence Number=SeqID_214252
atgattgtgaggaataatagagacatagaaagtgagtacttaagtgatgctaaaatgtcactattggaggattgtagtgatgttaaagttgttgaacctatacatgaagttgcacttgttacaaggcatgctcttaacatacatcctaaggaaaatggtgatatggaacaacgtgaacatattttttatattaagtgccacataaatgatcatgtatgtagcatgattattgatagtgggagttatatcaatgttactaacactttattgattgagaaattgaacttcaagaaacatcctaatccatataagcttcagtgcctgaatgttaggtggagatatagggtaactaagcaagttttggttttattttccattgacaaatacaaagatgaggttctttgtgatgttgcaccgattagggctagcataatggatggattagtccgaccaattgagccaaacaataaatag

SEQ ID NO: 97475 - DNA, 1155 bp, Glycine max
  Peptide Sequence Number=SeqID_214253
atgaattgggttcactctcaaatctgccatagtactgatgctatcaacaatcccactagtatttgttcttcttcttctgaatcattgccttatagttctgcctacaagaaacaactagcccctcctcctcctctagattcttcatctggcactagaataagccctgcagttgttttcatctttgtaattctagcaattgtgttcttcatctctggcctccttcacttgctagttagattcctcataaggcacagaccctcttcatcatcatcaatttcccagtccaataggtaccctaatgacatgtctgaatctaacgatccttaccagaggcaattacaacagctcttcaatctccatgactccggcctagatcaggccttcatggatgcccttccagttttcctctacaaagacatcataggtttgaaggagccatttgattgtgcagtgtgcctttgccagttctcagaacaagacatgctgaggcttctgccactttgcaaccatgctttccacattgattgcatagacacatggctgctgtcaaattcaacatgtcctctctgtagagggagtctttatgatccaggctttgcctttgaaaacccagtttatgaccttgagggtgtgagggaagaagatggggtttcaggaagtgttgctggtgagggtagttgtgttaataaacatgcagaaaaccacataatgagtgggaaaagggtgttttctgtaaggctagggaagtttagaagctcaaatattgtagaaggggtggaaagatcaggaggtagaggtgagagtagtacaagtaatttggatgttaggagatgctactcaatggggtccttccagtatgtggttgctgattcagatttgcaagtggctttgtgccccaatagaggtgatggtggaggtgttaatggtgacagtatgagacaattgaaagggagattggtcaattatggaaattcctccactgatgatgttgagggaaaaaaaatcaacattgcaaggaaaggtgaaagtttttctgtttccaagatctggcaatggtctaagaaggacaaggtttcaatttcacaagaaaaccatttgggtggttctaatgtcactgcagctttgccatggatgcatagagctcaaggtgcatga

SEQ ID NO: 97476 - DNA, 537 bp, Glycine max
  Peptide Sequence Number=SeqID_214254
atggctaccatcaccgctcacctcataattactacaagccaagatcacacgacccttctttcaccactccacctcaaatccattccctctttcgtgcatgactatgacattatcatccacaacttcacctcaagccaaaacacatttgtgattgcaacaaacctcccattccatttctctttagcgcaatgcacattcccctacccgaaccttcttccttgcaaacactccaaactcaacaaccttcctgaaccttcttccccctcactccaccaacccttcctcctgaagcttctcgaaccttccaccccgcaacaacaccctccttcctcttccaaatcgagactgtcgaacacaccgccaaaccttcagattattcccaacatcaccaatgtcgaaggactagagggaggtgcacacgttggtgaggttgttggaggagagtggaccaaaggtctgagagggaggaatctggccatggaagccggtgttgtagccgtcggagaagggagcgagggagagaggaagcttggatga

SEQ ID NO: 97477 - DNA, 357 bp, Glycine max
  Peptide Sequence Number=SeqID_214255
atggccaccacaccccccgttttgttgaaaaatgggattccggggcttccgggacacccctgggttgcttctggaggaagcaacccagctcgcctgggcgagctaaggtcgcctgggcgagctgggcggcaaccgcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagaaaatccgtgaaggttttcgtccgttcttcatcgttcttcatccgttcttcgttcttcaacgg

SEQ ID NO: 97478 - DNA, 171 bp, Glycine max
  Peptide Sequence Number=SeqID_214256
atgaaagatcgagacactcatgtatttgaacctgtccacggtggttggccgcctgctggcaaaccaaatgctgtaaataacgctctacgcccagtgacccatctggactggcctgccaaggtggtggcagtgcgcctgcggactgatgtgcatcaccctgcgcctgcctag

SEQ ID NO: 97479 - DNA, 375 bp, Glycine max
  Peptide Sequence Number=SeqID_214257
atggaggttggcgacaataacagtaacctgaaaatcgactcgttgatcgacctgattgaggcattagcgatctatgcccttaataagctggatcagcgtagaactttgtggactgatatcgaatgtattcatggcaatcaacatggtccttgggtcttgcttggtgactttaataacgttttgaaagctaaagatagagttggtggtaatttggtcaccgagtcaaaatatgaagacttggcaaaaatgatgcgaaatacgggaacttttgaaaaggatagcacgggtgactactatacttggtcgaataagcaaactgatggtatgatctattctagaatcgatagggtgttggggaatgtggaatggttctaa

SEQ ID NO: 97480 - DNA, 672 bp, Glycine max
  Peptide Sequence Number=SeqID_214258
atgaggaagtttggagatgacaagtcttggattcaattaataaattttagttatttacatcttaatattcgtccttatgaagaaaaatccatgattttaccattgtgcatgtctaacaacggacacttcttcatgctgaaattcactagaaatgctaatgatgaataccaaacaattctgtataaccagggggatggtaagtctcaagttctgtcattccctcagatagtttcagaacgttgttgtggcgcaacctcaagatttttaccaaaagtttggtcataccttattgaaattctacagatagaaataccagaaggataccgtgtttgtttctggaacaaggagacaagggtgatatccagagaattgccaacgctgtctttttccccgggcattggtcgtagaacaatgtttgggtttggctatgatccgtcaagtgacaaatacaaggttgtagcaattgcattgactatgctctcacttgacgtatctgaaaagactgagatgaaagtttatggcgcgggtgacagtagttggagaaaccttaaaggttttcctgttctttggactttacctaaagttggtggagtgtatctgagtggaacccttaattgggttgttattaagggaaaagaaaccattcattctgaaatcgtaattattctgtga

SEQ ID NO: 97481 - DNA, 651 bp, Glycine max
  Peptide Sequence Number=SeqID_214259
atgggaacaaatcacactggaaaaagattctatcaagtcaagattaagggcctagatgtcaccagccttaaggagttggggcggttgatgggacctctccagatgcaagccttccgcaaggcgtacggaaagattttagatttgaccatagcagagatatccacggaagtcgttgatgtcctcttgggggaaggaaaccgtatcttttctccgggttgtggcaaggcaagggaaatggagaatcaagaggagtgggtcccgtttatggatgtattagcattgctaatctttggggttgtcctctttccaaacgtgcatggtttggtggacctagccgcaattgatgctttccttgcatatcaccatagcaaagaaagcccggtggtagctgtcttggcgaacttatttgatacatttgaccgaagagtagattgggaccaactcttggctgggataagaggtagaacaattagctggtttcctcgatggaaggaaggaagggagggagtccttttctcatgtggagagtacccaaacattccgttgatagggacgaggggttgtattaactacaatcccgcacttgctataagacagttagggtaccccacgatgggagcaccgacggaagagagcctctctcctttcctt

SEQ ID NO: 97482 - DNA, 342 bp, Glycine max
  Peptide Sequence Number=SeqID_214260
atgcgtctatcggggaaggagagtctgctgatgaaatctcccataaccataaatgagattttggatgttagcatttcgtttctaaatgaccatttagaggaaacactgggttcaacaaaaatagaagaaatccactcaaagtgtatcaatctcgcacagactctaaccctgggacctcgcattcgcttccgctgcgacaagcacccaccatttgtggttcacgcaccaagcccaataagtgctaggcatgaagggggtgtattgggaaaatacccaagtcccacatcggttgcctcaatccttggagtgcagcttatatacctgttgggcaacttcacttaa

SEQ ID NO: 97483 - DNA, 174 bp, Glycine max
  Peptide Sequence Number=SeqID_214261
atggttttaaggtacgctttaaatgagattgctgctgagtttgagcgtgtacactatgctaacaacaatccttcttcttatggttgtgtgatgaaaaccacgcacgatcgtccttgtgcatgtgagctatctagagaccatggttatcccccaactcgctgggttagaaattaa

SEQ ID NO: 97484 - DNA, 198 bp, Glycine max
  Peptide Sequence Number=SeqID_214262
atggcactgataattactgagcgctgcattaactgcgacatgtgcgagcctgagtgcccgaaccaggcgattagcatgggtgaatcgatctatcagatcgacgctgaccgctgcaccgagtgcgtgggtcattatgatgagccgacctgtcagagcgtctgcccgattgataacactattctttcagacccacagcac

SEQ ID NO: 97485 - DNA, 435 bp, Glycine max
  Peptide Sequence Number=SeqID_214263
atgactacttctgccagtatcgtttgcctcgtcattgcggtgctctcatgcatgctgaatattcagaagggcttttctacgcctcagcagcgcgagtatcagttgttaagcagcgcaatcacagagagcgtgcctgcagaatattctggccagctttattatcgtatcgatagcgacaacttacctgctgtcgcaaaatccaaaaaatacgatgagttcggttcgctttcgctgggtatgccatggacctttgccggtatggccgacgcgattaaaaaagagcacgcgatgaagttttccttgccaaaagcgccccgccgcccttatttcgcttaccacgcaacggctctgcttaccgttgcgtggttttctggctatggcgcgacatcagatcggctggtagcagtcacgtcgccacgttctgctggcggctga

SEQ ID NO: 97486 - DNA, 447 bp, Glycine max
  Peptide Sequence Number=SeqID_214264
atgacaaaacttaattatgtgaaatttacagtatgtgttttcaaatgtaaatgggttgatagcaacaccggtgtgcacaccgatgatataggatttaccctggtagatctaaagaaacttggttaccacaatgaccctttcatcatggcagaacaatctagacaagtattttacgtgcaagacccttgtgatgaaaggtggtgcgtggttctgcagggcaaaacagttggtgttaatgtagaagatgatgattcatacatggacacctatgttagtcctttgaccgctcaaatcactggtaacgttgtcggagaagaagaagctgacgacagacagaggtcaccaaacctagacttcatccagctcatgtttgttggaccttgtggcctcaataatcttaagagggataggcttagaatgcagaagaagcaacaacaatcaatttaa

SEQ ID NO: 97487 - DNA, 717 bp, Glycine max
  Peptide Sequence Number=SeqID_214265
atggtgctcgtttttccaatctatgaggcatggttaagtgatcctactcacattaggcctagtgctcaggtggtttggccaatagtgggccaagaaatattgaatggtgatgtagggggagggttccgaggaatacaaataacctccgccttaatgcttttgctggttggttcattatcacaaagctgctccaaaattggcttggttccaagatgtagaatctatgttgaatcaccatttgacagggctcctgggggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatg

SEQ ID NO: 97488 - DNA, 369 bp, Glycine max
  Peptide Sequence Number=SeqID_214266
atggatcgagttacatctctgcttcgtctactgccaaacacatttaggactgttgatgtttgttacttccagtttcaccttgacaaagatgtcatggaccatgttgaaaatctaaatagattcaaccccatgtcctgcgtaaaatttcgcaatacttcaactgtgcatcattcgcatacatccatgcttttcattgaacacactttacggtgcccttaccaaacccgtgctagagctagagtaatgggtgaagtagaggaggtgaaagagcagatgaagaccgacatggaggccatgaaagagcaaatggccacaatgatggaggccatgatgagcatgaagaagataatggaagccaatgcggttgca

SEQ ID NO: 97489 - DNA, 312 bp, Glycine max
  Peptide Sequence Number=SeqID_214267
agggtacatctacttggggatcgttatactgagaacaagagagggtacatctcttgtggatcagttcaagtggagggtacatccacttggtttttcaaagagaacaagggaaggtacatcccttgtggatctttggcttgtaaaggattttacaaggttgaacagaaatctcaagaaccgcaggttgcttggggactggatgtaggcatgaaccttgcgtttagactgacgaacataaacgagaaaggtctcttagtgacgcaaagagaaactgacgtagagctcatgataggtgaggggagtttattataa

SEQ ID NO: 97490 - DNA, 414 bp, Glycine max
  Peptide Sequence Number=SeqID_214268
atgaaactggccaaatacaggctaaatgcccaagtggagaaggacgaaggcccaagtggagaaggacaaagcccccaagtggagaaggatgaaggcccagaggcagagacactatcaagactattaattgttgctgaaggtaatccttgtggcgtctatcctgacttatcttccttcaccggaagtgatgtctaccttgacttatcttccttcaccggaagtggcgtctacctagacttatcttccttcaccggaagtggtgtcaacccggacttatcttccatcaccggaagtggcgtctaccctgacttatcttccttcactggaagtggcgtcacccaaaacctctgtagcctgtatcaaacgatccactcctactcaggttcacatcatcggccagcgagcgttttttaa

SEQ ID NO: 97491 - DNA, 1233 bp, Glycine max
  Peptide Sequence Number=SeqID_214269
cgctaccggcgactgtgcgatctgccggcgcaggctctcggcgatcacggtcgcctgcgattcgctggcggccaccagtaccagcacgaattcttcgccgccatagcggaacaggtagtcgctgccacgcgtgagctggccgagcaggccggccacatgctgcaacgcgcggtcgccggcatcgtggccatggccgtcgtagattgccttgaaatgatccaggtcgagcagcagcagcgagaacggtgtgcggttgctcgtggccagctcgatttcccggcgcagcacggtgggcaggaagcggcggttgagcagattggtcagggcatcgctgccggtatccagttcgccgatgcgctcgaacagcagtgtcaatcagggtgcggatggcggccaggtcctcgcgtatggccggcagcaccgccagtcgctgtgccgggcatcgccgctggcccgctgcaggtggccgtcaatgcgggccatcaactggcccagctgctgcgtttcgctgctttcgccgaagctggggatgcccttgtgggtgaaccacaggccgaactccgaggtggccaggctggcgttgtcgctggcctgcacatgaccggcgagtgcgtagagcagggcgttctcccagtccagcagcagtgcgcgttgacgctcgcgttccgtaccgacgttctgtaccagcgagaacagccggtaggcggcgtcggcacgggtggagcgctcgcgcgcatgggtgtaggccagggtcatgccttccatggcgatgtccatgatcgcgctgaggcagtcgatggcggcgaacgcggtcgcgctgtcgggcgcgtcgtcgcgcaggcgcacgaacagctcgtgcttgagcacgcgtgcaccgcgggtgaccaggtcgaccgggatgccgacccgcgcgtgtacgtcgccgatcacccgctgcgaggcgacggtggtggcgatgccggaggcgtcggtggtcagcagttgcaccagccagcgctgcatggccggctgcaggcgctgcttgacctggtcgtgggacaggaagcggcgtgcacgcccgtcctgcagcagcacttcgtaaaagcgctgggccagcgcgggtggggcatcggtggcagcggccccgagcagcgcggtggcggcagggccggcctgcagcaggcaatgctgccaggcctcggccagcgactggctggcatcgtccagttggggtggttccacgtcgatctctga

SEQ ID NO: 97492 - DNA, 204 bp, Glycine max
  Peptide Sequence Number=SeqID_214270
atggggaggagactgccgcctagctcgcccaagcgagctgggttgcttcctccagaagcaaccctgcttcgaaaatattctggaacggtgcagattcgaaaatttgaaaattgctatttgcacccccttttgataagttcacccccatctttcgtaattttacggaaaagttacggaagctttacggaagcatataggacttga

SEQ ID NO: 97493 - DNA, 420 bp, Glycine max
  Peptide Sequence Number=SeqID_214271
atggttatttgcccgcatactgttgctattcagggaccccaagttcgtttgacaagaggagaccaaatatggtcatctgcaccctttccagagatgtcaacatcttccagtcgagactttttagtctcacagacaacatctgttaatcctgatccatgggtcaggtggcaggcggacatacccaagtcaggtggcaggaggacatacccaagtgattgtccgtacaacacaacatctgttaatcttgacccacgggtcaggtggaaggcggagatacctcgagtggttatccgtacaaagacaacatttgttagtcctgacccatgcgtcaggtggcatgcggagatgccgcgagtggttatctgtacaaagacaacatttgttaatcctgacccatgcgtcaggtggcaggtggagtga

SEQ ID NO: 97494 - DNA, 564 bp, Glycine max
  Peptide Sequence Number=SeqID_214272
atgggcccagtacctgctcgtacctgtctcggtgtggtggtgcatctgtcgccagttgctggccgtccccaggctgtcgtggtgcctcgtcctacacttgcctggggcgcagtacttcttgatgaaagcccggttaatggggggctgatgatcagagccggaatcctagggccatgttggacttcttcgggtccaagggactcctcaatgttgctaagtagcaacgtcatccacatctgtgtaagagtggttatgttggtgcgcatgatccacactcgtgtctttgcagcggcctgggtgaaatcttgcctcgggcagaggaccttgagctctctgaaggcgcgtatgtggagccctcttaaggcgagggcgtgcagccctcggaaggcgagggcgtgtagcccccgaaaagcgatagggtttgtccctcctgatgtaagctccattggagcttgtaggcctaggatcttcttcatcaatggattcctttgcttcttggaagatgaatggcagcggaatggagaaggaagagagagaggagacgccacttcaaggagaagatga

SEQ ID NO: 97495 - DNA, 366 bp, Glycine max
  Peptide Sequence Number=SeqID_214273
atggtgggtgacacacgttcaaactttgtggatttggtcttcactggcgaaaggatcgaagtgggtctgaaaagaggcaaatttgatcatcttgctttaatgaatgagaaaattgggacaaatggaggggatgaggaggaggaaggaaaccatgttgtggctgtcattcctagatggccatgttttccaccggctcaacaatgccattacccaccacccaatcatccacaagggtcatccctaaatcaaccacaaagcctgcctaccgcacatccaatgccaaacactacttttagaacgagccaaaacatcaaccaaggaaggaattttgcagcgaaaaagcctgtacaattcaccccaattccg

SEQ ID NO: 97496 - DNA, 432 bp, Glycine max
  Peptide Sequence Number=SeqID_214274
atgcataaatacaactcccgaacctttcactataaagttcgtagatcacgtctttttccggtttttccgacgttttcctcaaataaacgttggtggcgactccacgcgtattcctttcttagaacacgcacccgcgagtcacgcgtcgccctcccgccgaaggtattggcgatcgaaattgctattccttgcgttacggggttgaaccaagcacatgctttcaagaaaagtacttcaacaatgcatcattcacatagaggccgtgaaagagaaagcatgtgtgaagtaaaggagttacaagagcagataaaggccgacatagaggccgtgaaagagaaaatggccacaatgatggaggccatgataagcatgaagaagatcatggaagtcaatgcggtagtagttgccgctaccagcgctattcaaagatga

SEQ ID NO: 97497 - DNA, 402 bp, Glycine max
  Peptide Sequence Number=SeqID_214275
atgggtgaagtagaggaggtgcgagagcagaagaaggccgacatggaggccatgaaagagcagatggccacaatgatggaggccatgatgagcatgaagaaagataatgccgacttcgagccttgcctcggatatgccactgaagggcaagcagttggtgatatacccctgcaaaacactttggagggccctcagtatcacccacaaccacaccccttgcattccacaccgggtaaaaaccctcatgctatggctgaaatgggagagttggatcatcgaaaggaaaggcttagggccattgaaggaggtgaagattatgcctttgctaacctagaagagttgttcctagtacccaatatcatcacccctccgaagttcaaggtgccggactactttccctaa

SEQ ID NO: 97498 - DNA, 246 bp, Glycine max
  Peptide Sequence Number=SeqID_214276
atggataaccattcatggtgttatccagcttgccttcagtgtcataggaaaactgacatccaaacaggaccattcacatgcggatgtggcaaggataatgatcagcctgaccgtgaatgtgctgaattgattggtcaaacagctgatgatgtgaatagggtcaagattgaacaagatggtgatcttgatttgaatgcttcccctcaagcacttgacagactgttgggtcatgtgcttgcttttaag

SEQ ID NO: 97499 - DNA, 1113 bp, Glycine max
  Peptide Sequence Number=SeqID_214277
atgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacttagatatgggttacaatttcttctctttttcgcggtcttctatttaattagtactaatattaatatggcttcggtggacacattcgagagtctggtcaggagacttgctttctacctcggcaatcaagccttatctaggctattgcttcagaggggatgctccgtaggtctgaccgtggccattgctgtgctttttggggacacgccatcagtagggaataacatgatggacccctcggggtcttccggttcgtcaggagggggtgggtctgaatcctcgtggacgggtgcccttctatcttcggaaacgctttcaggaacgggatccgttaatcagcccgcggagggaatgcctgttcctcccgcaaatccggtcgtggagcaagccggtccggcaaatccggaagataccactgaaatcataggtggagactctattgactcgataaggaaccgcctcttacagtcatacgggaatccttcggcggagcaaatctctcgcgcctcgtatgacgccgatgatctctttcaggttaaagtggagatcataagggggatgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaagtttttcgaagacctcgacctttagaagatgcaaattctactacttaa

SEQ ID NO: 97500 - DNA, 180 bp, Glycine max
  Peptide Sequence Number=SeqID_214278
atggcggaactggtagacgcactggactcaaaatccagcgccgcaaggcgtgccggttcgattccggctcccggcaccaatgttatgcacatggcgctcactgatacacagctccgcaatgccaaatcagccggaaaagactacagaatcacctacggccaaggttttccatacttataa

SEQ ID NO: 97501 - DNA, 234 bp, Glycine max
  Peptide Sequence Number=SeqID_214279
atggcgtcggatctgaaagtagcattactagatcagtcaaaatctgccctcagctggatgggaccggtaggatgtctcggcaagtccattgctagtagttgcatttcagtagttgaattggcaaggggtccggttcatgtcggcaagagcgctgtcatctggttgccctcatccaagtttcgtcgtaggcttggagaagagatggagacaagagacaacaaggtggtggggtag

SEQ ID NO: 97502 - DNA, 582 bp, Glycine max
  Peptide Sequence Number=SeqID_214280
ggagattctaggattggaagaggaaaacaggagcttgatggaaacaaggattgaaccgttgtctcaatgtttgattcagaacatctcaatggaatccaagttaaacggattcagtggattccgaggtgttctctatgcaatgcggagtgttagttcactgcttctgatgattctgcttagcggacttgcgtatagttggtcctcctcttgctttcaccaagggtacgatgggcacatggtttttggatccactggcttcatggtttcaatggcaatactgcagcagaaagtggcagaggagatagaccagaatattgaaggggggcagccagggattctgctgtttgagtttcaaaaagcaaagaatgccatggaggaactaaaactggagttggagagaatagcaataagttgttatgaagaagggcatgctgatcatgagatccaagaaaaaattcacaacgtcaagagttgctttgggttgttgagatgtggggtcgagactataacggggcaacttgatgatttctttgatgaaatagtagaaggaaggaagaagcttttggacatgtgcagtcatag

SEQ ID NO: 97503 - DNA, 657 bp, Glycine max
  Peptide Sequence Number=SeqID_214281
atggttgttgatgatcaaataaacaccaaccagaaaaatggattcaaccattgtgagaagaaagaggtaggggaaaaaactggtgttccggcgacattgctgtggttttcaacgtataaaccatttcgccggaacccagagaaattaacaatgtcttcccctcataactctgctcctcataattcctcacccgataactccacccctgatgatgccactcccaataactccattcctgataattccacacccgataactccattcccgataattccacacccgataactccacatccaataaatccgctccccataactccacacctgataacgccactcccgataattccacacccaataattccaataaatcacacaaaagttcctcggtgtcccctccttcgatggagggacaaagtactccaacatcaggaaaagattcatcaaacaaatcattatcaaatgagaaatcattgggttcaaacaatgatagtagcaataaagtagcaatgggagctgggattggagtagggttcattcttcttgtgctagtcattgtgtgtttcatttggagttgtaggaagaagaagcgaaaacaaaagtattattatccaaacccttctcacgggaaaggtgacaattgtctaaaacattaa

SEQ ID NO: 97504 - DNA, 1578 bp, Glycine max
  Peptide Sequence Number=SeqID_214282
atggacgagatctgggagagggctgtggaaacggcgttggacggcgagaaagaccacgcggccgcgcggacgctaaccctagacggcgccgttaagtgcgtccaggggcggttacccccgcctagccttctggagcggttccagaacctgcagcacctctcaatagcaaacgtcggcgtttcgtcgctggagcagtttccccggctgaggaacctgcagaagctgaacctctccgacaaccggatcgcctccgggctcgaatttctcgtgcaggccgggctcgattcgcttcgcgacctcgatttgtcgaacaatcggattcagtacattgaggatctcgcgccgctcgcgcagttgaagctggtgtcgctggatctgtacgagtgccccgtgacgcgcgtgaaggactatcgatctagggttttcgggttgatcaagtcgttgaagtacttggacaagatggacgcggaggagaacgagaggcccgagagtgacgacgaggaggaggatgaggaggaggaggaggaagaggatgaccctgggagcggcgagattgacggcggtgaggaggatcggccctttgggattaacaatgggcacagtgagggtgctgatggcgttgtcgatgctgatgatgaggaggagagtgacgcggatgaggaggagacggagtcgtcgaggcggatggttgttaatggagagggccatcgggagaatggtcttggggttgcgccagtggagggggacgatgttgaggaggaagatgatgaggatgattctggtgaggagattgatgaggaggagggggatgatgatgatgtggtggaggttcatgagattgaggatagtgatgatgaggatggagtggaggagtatgatgaggacgatgatgatgaggacgacgatgaggaagaagaggtggataacgacgagggtgattttgtggagcctgagagaaccgggaggttgacgagtactgagggtgagattgatgggcatgagcagggggaagaggatggggatgaggatgataatggggagactggggaggatgagattggggttgaagatgatggagactttgaagatgacgatgaagaagaagactatggtgctgggtatcttgttcagccagttggacagtctgatgctgtcaatgctgcagttgctgatgtagatggtggaaatgatgatggtgaagagaaggatgaagttgatgacgacgatgaggatgatgttcaggtgttgcctcctcctgaatcttcccaccttaagaggaagagggatgatgatgaagaggacgaggacagtgacaatgatgatgatgaagatgtggcttccatgtgttggaagcagggaaacctcctcagtttagatagaagaacgatgttatcagaggtttaccgctcagtcatgtgctcgatgttggtctggtgttggcttgtaaaggaactggtgtctggagggaaaggtttctgcctcacatttataattttgataacaatgtgcaaaacttggtcccgtgtgggagtagtcaactgccgtgtaatggggccctcggttgcaaatagacagtga

SEQ ID NO: 97505 - DNA, 747 bp, Glycine max
  Peptide Sequence Number=SeqID_214283
atgaaggataaggagacattccctattgcgaaaaaggaagcctctgattcaggtttattcggaagaggaagctacaaattctgggcactagctgccatgctgctcttggcattctggtccatgttcaccggcacagtctctctccgctggtccggcaccctcaacactttctcccacgcgtcccttcacgaccacctcgacgtcctcgaaatcgaggagcgggagaagctggtgaggcacatgtgggacgtgtacacgaataaccgtaggatcaggttgccgcggttctgggaaaaggccttcgaggctgcctacgaggatttgaccagcgacgccgccgatgttagagacgttgccgtcgccgagatcgttaacatgtctctgcgctccttggatctccaattgcctcctgggatccttggtgcaacagttggagttacttaccatgtgactaggaaggtcacaggtagtgtgatcataaggactctcaagggtaaaaagaaaaaactctcaagggtgaaagtgtttacagaaaacagacaaggctcttcgctatgcgaagatatgggggagggatattgtacgcagtcttacccttgcatatgcaaagaggctgtttccggattcgaacccatgaccaacaagtcaccaaggcacaactttaccgctgcaccaggagcacggaaacttagtaagaatctcaaggaagttgagaaaggcaaaggagcaacctccgaacgtgcttag

SEQ ID NO: 97506 - DNA, 690 bp, Glycine max
  Peptide Sequence Number=SeqID_214284
atggcagaatgttatgcttatctattggagaaatctgacaaggagcaacagcagtcaggtctttctcgttctgaagaacctagagcacaagaggatcatcatggtgatcgggacagagaaaagtcaagggaaagaggtaaggacagacacagagaaagtgagtggtcatgtgagcgatctagtggtagggccagggatcgtgattatagaggggataggcactacagagattgggataggaatatggacagagacagggaacgagagagagatcgggacgtgatcgtggtcgagagcgtgattaggatagggatcatgaccaggaccgcgaacatgaccgttatcgtgaaagagatagggattatgaaattggggaacatcatggtgaaagagagcatgactatgaacctgaggatggtcgtggttggtacaaccaacctgggtatgggcatagccatgcagatcccaaccatgatcctgatcactaggagcatcattgaggaagggggcaatatgatgagggagatgaccatggtgaccattacaaccaatatcctgatcgtggtaggaaagaagatgactaccatactgaacatgcaaaatcttaatcacgtgacagggagagaaatcgtgatatggaccatgaatatcgtcactcagatttctcattctcaggagtatgattactag

SEQ ID NO: 97507 - DNA, 378 bp, Glycine max
  Peptide Sequence Number=SeqID_214285
atgggagaagacttcaacaataacgatcctctcatccgcaaccaaaacgccgccgttcaggctcgcgccaaggaccagaaccgcgccaacgcccttcagctcaagctggcacaaaaaagagcaagaatacacaagttaagactagagaagggagctgcaaaggctgctgaggagcttgagaaatatgatccacacaatgacccaaatgtatcaggagatccatacaagacattgtttatagccagacttagttatgagagcactgatagcagaatgaaaagggagtttgagtcatatggtgcaatcaaacgggtaggtgttttgaatatcccaaagggattcagtaaggatatcgtatatgctaggctcttgatataa

SEQ ID NO: 97508 - DNA, 1239 bp, Glycine max
  Peptide Sequence Number=SeqID_214286
atgggaatgggaatgggaatgggaggaatgggtcctcatagtggtggatggggtgcaccaccaccacatatgatgaatagtggtgaaatgatgagctcaaattactcattgggaatgagttcttcctcaccaggcctttctcttgcgctcaatgccaatggtggtacattcacttatgaggaactagcagctgccaccaaaggatttgccaatgagaacatcataggacaaggtggctttggttatgtccataaggggattttgcctaatggaaaggaagtggctgttaagagtcttaaagcgggtagtggccaaggagagcgcgagttccaagctgagatcgacatcattagccgtgttcatcatcgacatcttgtgtcacttgttggatattgcatttgtggagggcaaagaatgttggtctatgaatttgttcccaattcgactttggaacatcaccttcatggaaagggcatgcctacgatggattggcctactagaatgaaaattgcacttggatccgctaaaggacttgcctaccttcatgaagattgtagccctcgcattatccaccgtgatattaaagcttctaatgtccttctcgatcaaagcttcgaagcaaaggtctctgattttggattggctaagttgaccaatgatactaatacacatgtctcaactcgtgtcatgggaacattcgggtatctggccccagaatacgcatcaagtggaaaattgacagagaaatctgatgttttctcatttggggtcatgctattagaactcataactggaaaacgacctgtagatttgacaaatgccatggaggacagtttggtggattgggctcgaccactcctgaataaagggttggaggatggaaactttggagagttagtggatccatttttggaaggcaaatacaatccccaagaaatgacaagaatggcagcctgtgctgctggaagcattcgtcattctgccaggaaacgttcaaagatgagtcagattgtaagagcactggaaggagaagcctcattggatgaattgaaagatggaatgaagcttaaggggagtgggaatgggaatagcagtgctcccacttcttcatctgggagctcagaatatgatacaatgcaatataatgctgatatgataaagtttagacaggcaataatgtcaagccaagaatttaacgacagcagtgagctttccagtaaggagatgggttatcattag

SEQ ID NO: 97509 - DNA, 315 bp, Glycine max
  Peptide Sequence Number=SeqID_214287
atgtggcggtgcgtggctcgtgctattcgcgtaccagcttcggagagatccatacctaatcaccaaccacttagatctcacatttcaagatttttctctggtggtggtggtggtgggagctcctcgtacaacgtggtggatcacaagtacgatgcggtcgttgtgggcgctggcggcgcagggttgagagccgccattggactttcggagcatggcttcaacactgcttgcattacaaagctgttcccaactcgttcacacactgttgcagctcaggtaccagatcttcatatgcacgttacttgtttgtcgtaa

SEQ ID NO: 97510 - DNA, 1368 bp, Glycine max
  Peptide Sequence Number=SeqID_214288
atggggtggccccttcttggggaaaccatagggtatttgaacccttaccctgctgttacacttggagaatttatggagaaccacatagcaaggtatggtaaaatttacaagtcaaacttgtttggggggccagccatagtgtcagcagatgcagggctgaataggttcatattgcagaacgatgggaagttgtttgagatcagctatcctaagagcattcgtgatatactcgggaaatggtctatgttggtcttagtaggggacatgcacaaggaaatgaggaacatttcactcaactttctcagcaatgctaagctccgaacacatcttgtcaaagaggtcgagaggcatgcccttctcgttattaactcatggaacaataattctacattctccgctctacaagaagccaaaaagttcaccttcaattttatggcgaaacgtataatgagcttggagcctgggaatcccgaaacaggacaattgaggagagaatatgtgtctttcatgaagggtgttgtatctactgcgcctttgaatttgcccggaacagcatacaggaaagcattaaagtctaggggtgccgtaaagaagattatagaggggaaaatggaagaaaggaacaagaggatccaaaagggtaacgcaagtttggaggaagaccatgatcttctaagttgggttatgacgcacacaaatctttcaaatgagcaaatacttgacttggtattgagcttgctctttgctggccacgaaacctcatcggtagccatagctctagctatttacttcttgccgggttgtcctcgagccatacaacaattaagggaagaacacgtggaaatagtcacttcaaagaagcagacaggggaagttgaattgacttgggatgattacaaaagaatggagtttactcactgtgttgtgaacgaaacacttcgattaggaaatgttgtgaggtttattcacaggaaggctattaaggatgttcactacaaaggttatgatattccatgtgggtggaaagtccttccggtggtttcagctgtgcatctcgatcctgcactttttgaccaacctcaccaatttaatccttggagatggcaggacaagaataagagtggaagttgcgaaaacgcgaatgttaacatgaacttgatggcgtttggaggaggaccaaggatgtgtgcgggatcagagttagggaaacttgaaatggctgtgttcatccaccatctcatcctcaactacaactgggaacttgttggagaggatcaacctattgcatacccttacgttgatttccccaaagctttacccatcaaagtccaaacccactcttccaaacactcctcatttagtagctag

SEQ ID NO: 97511 - DNA, 1494 bp, Glycine max
  Peptide Sequence Number=SeqID_214289
atgactgaagatgattggaggtggcacatgtatgacactgttaagggaagtgattggcttggggaccaagatgccatccaatatatgtgtagggaggcaccaaaagcagtcattgagcttgagaattatggattgccattttcacgaactgaagatggaagaatataccagcgtgcatttggtggtcagagcttgaacttcggaaaaggtggtcaggcatatcgttgtgcatgtgctgctgatcgaactgggcatgctttattgcacactctctatggccaagctatgaggcataatacccagttttttgtggaatattttgcattagatctattaatgaacagtgatggtacttgccaaggagtgattgccttgaatatggaggacggaacattacatcatttccaagcttcttcaacaattttggccacagggggctatggcagagcatacttttctgcaacttcagcacatacatgcactggagatggcaatgccatggttgcacgtgctgggataccacttgaggatttagagtttgtacaatttcacccaactggcatatatggagctggctgccttatcacagaaggttctcgtggtgaaggtggaattcttaggaatagtgaaggtgagagatttatggaacgatacgcacctactgcaaaggatcttgcatcaagagatgtagtttctaggtcaatgactatggaaatccgggaaggccgtggtgtaggacccctgaaagatcacatctatctccacttgaatcacttacccccagatgttcttaaggagaggctacctggtatctctgaaacagctgctatttttgctggtgtggatgttactaaggaacctattcctgttttgccaacagtgcattataacatgggtggtattcccacaaatcatcatggagaggtgattactattaaaggtgatgatcccgatgcagtagttcctggattaatggctgccggggaaacagcctgtgcttcagtccatggtgcaaataggcttggtgcaaattcacttcttgacattgttgtttttggtgataaaaatgcacctgtttctcgttttgcaggagagaaacaaaagcctttagagaaggatgctggtatgaaaacaattgcttggctggacaaattgagaaattcaaacgggtcgttgccaacttcaaaaattcggttaaatatgcaacgaataatgcaaaacaatgctgctgtgttccgtacacaagaaacgttagaagaaggttgtcaattaattgataaagcatgggagagctttcatgatgtcaagttgaaggatcgaagtttgatatggaactctgacttgattgagaccattgagttggaaaatcttctgataaatgcctgcatcaccatgcactctgctgaagcaagaaaagagagtagaggtgctcatgcccgtgaggacttcacaaaaagagatgatgagaaatggatgaaacatactttggggtaa

SEQ ID NO: 97512 - DNA, 291 bp, Glycine max
  Peptide Sequence Number=SeqID_214290
atggagaatagcagctctccaaaaggccagtccaagacgctattctacttgttccctgagcagctgcaagtccagtacgccctcgaagccatcggcatttgcggcaccaacaacgtcgtcctcggcgttgagaagaaatccaccgccaaactcctagactccagcaactccagtattttcgggcaggatgtcctggacattgtatccgacatcgtggatcctgcaacttcaattcttcacttgacactttatcttgccttgtgcattgtgcagcccgatcttattccttga

SEQ ID NO: 97513 - DNA, 1194 bp, Glycine max
  Peptide Sequence Number=SeqID_214291
atgtgtcaagttactatctttctttcctttgtcctttgcttgcttcctctctctatagtcagaaatgacactcgcgtgggagtgtgcgtgaaacgtgatttcaacgctgccaagagaagcgtgaaactacttcgcgttattgctgattccgcagagtgtacggtcagaatagggtgtttgatcccagttctcacgtttagttctgtaaacggatccgtttcagaagagaaaaaaaacaaaattgagattcaaaacgttgacattcttcgtctatgttgggaattagtgcctttggtgatcatcatgttccttcttagaaggcaaacccagaataaccaggagaatgattcctcatatcaagatacaaaggtggctgaactcaagacaggtcttgggcccctctctggtcgtcgattaaagtattgcacagatgcatgtctaaggagatatttagaagcaagaaactggaatgttgataaagctaagaaaatgctggaggaaacactcaagtggagggcaacttataagccagaggaaatccgttgggctgaaatagcacatgagggtgaaacaggcaaagtctccagagctaacttccatgatcgacttgggaggactgtgcttattatgaggccagggatgcagaacacaacatcggctgaagataatatcaggcatttagtctatctgttggaaaatgctatcctaaatctttctgaaggtcaagaacaaatgtcatggttgatagacttcacaggattatcacttagtacaaatatgtctgttaaaacatctcgtgatattattcacattttacaaaaccactatccagaaaggcttgctattgcttttatgtacaatccaccaagaatattccaggctttctggaaggccatcagattcttcctggatcccaagacagtccagaaggtgaagtttgtttatcctaacaataaggacagtgtggagctgataaaatcactcttccccacggaaaaccttccaagtgaatttggggggaaaacaagtctaaactatgaccatgaagagttctcgcgattgatgaccgaggatgatgtgaaaactgccaagttctggggacttgatgagaagcccttcaaccctcctaagaaggggcattcgggagcagaggtggcaccggaaccagtgcctgttgaggcagtagttagttag

SEQ ID NO: 97514 - DNA, 324 bp, Glycine max
  Peptide Sequence Number=SeqID_214292
atggcaagaagaagacatgttttaatggtggaagctattcaggctattagggagatggttgcagttatgttgcaacaaactaatcaaaggaatgaagaagtagccgaatttcaaggtttatctgaattcaaaaggaacaatccttcagaatttgtaggaggatatggtccggagaaagctgatttgtggattcaagaaatggagaaaatattttgtgcaatgacatgcacaaataggcaaaaggaagatatcaatgatgctctaagcgtggaggatgcaaagagggatgtggtggacattgaagaatctagaaccaagtggtga

SEQ ID NO: 97515 - DNA, 183 bp, Glycine max
  Peptide Sequence Number=SeqID_214293
atgaatgtcgaagtatgtcagtgtgtgttgaatgttgaggtcgagtccctccaacatttcaatatcgaaaaagtgttcaatatgaacaatgggttcaccttcagggtagatggtggtggcatttatggtgatgatggacatggcaggaacaatgttttagttggagtttatcaaggctcttaa

SEQ ID NO: 97516 - DNA, 144 bp, Glycine max
  Peptide Sequence Number=SeqID_214294
atgaaaaaagaaaggaccccagaaggtggaatcacgagaataactcggtgggacgttgtgaaaggtggcatgatgatgagaaaagggtcgcgtggtgcaatggtcatggttgttgtggctgaagaggaagaagcgtgttggtga

SEQ ID NO: 97517 - DNA, 1507 bp, Glycine max
  Peptide Sequence Number=SeqID_214295
atggacccgaaaaccccatatgagaattcttccaattttgattctttcatgttcaactcgtcatcacctagaagtgacatgtccattcagtctaggagttctggcagggacaactccacccgtgaagtgagtttcggccacacaggatccaagcctgtgaggcatgggtcaaattctgaaggtctaagcatgtctcagaaggaaatcagtgatgaggatgcaaggttggtttatgttgatgatcctgagaagacaaatgaaaggctcaaattcgcggggaattcgattcgaaccgggaagtactccatcttcacctttcttccaaggaatttgtttgaacagtttcgtagagttgcttatatttacttccttgtaattgccattctcaatcagctccctcagttggctgtctttgggaggggtgtttccattatgccattgacctttgtccttgttgttactgctgtgaaggatgcatttgaggactggaggaagcacaggtcagacaaaattgagaacaacaggttagcattggttttggttaatggtcagtttcaagagaagaagtggaaggatgtcagggttggggaggtcattaaaataagtgcaaatgaaacaattccttgtgatattgtgttgctatcaactagtgaccctactggggttgcttatgtgcagactattaatctggatggagagtctaatttgaagactaggtacacgaaacaagagactcaatctatgtttcctgaaaaggagaggttgaatggattgattgtgtgtgagaaacccaataggaatatatatgggtttcagggttatatggaaattgatggaaagagattgtctcttggatcctccaacattgtcattagaggctgccagctcaagaatactaattgggcacttggcgttgccgtgtattgtggcagagagaccaaagctatgctcaacagctctggagctccatcgaaaaggagccttctcgagactcgcatgaactctgagatcattatgctttctttctttcttatagctttgtgcacagtcacctcagtttgtgttgctgtttggttaaagcgccacaaggatgagttgaatctctccccgtattataggaaaatggatgtttcagagggggaagaggatagctataaatattatggatgggtactggaaattgttttcactttcctcatgtcaattatagtgtttcagattatgatccccatatccttgtacatttccatggagcttgtccgtgttggtcaggcatacttcatgatccgagactcgagaatgtatgataaggcgacagattcaggatttcagtgcagggctttgaatattaatgaagatttgggccaaattaaatatgtcttttctgacaaaactggtacactgactgagaacaagatggagtttcaatgcgcgagcatcttggggtttgattacagttctgcaaaaatgggtcctgagaatgagcaagttgaatactctgttcaag

SEQ ID NO: 97518 - DNA, 159 bp, Glycine max
  Peptide Sequence Number=SeqID_214296
atggttgcaaaagtttgtactggagctaagagtgaacaacagtctaaattggcagcaaggaaggatttcaaaattcagatcattgtcggctcttgtgatgtcaagttccccatatgctggagggtcttgcatattcccatggtgctttctcaagtgtaa

SEQ ID NO: 97519 - DNA, 999 bp, Glycine max
  Peptide Sequence Number=SeqID_214297
atgttttgtactgttcatacaaagagtgtgaatatcatgctatttattccatgtagatatgttgaaggtggaatgggctcaatatccaaggctattggtaatgctgctattgaagctggagcacatgttgtaaccaatgctgaggtgtctcggttgttgattgaaaactctagcactgtctgtggggtggctttggctgatggtactgaagtgcattcttcaattgttttgtctaatgcaactccatataaaactttcatggaattagtgtccaacgatgtccttcctgatgattttgttcgtgccattaagcacactgactacagttctgctactacaaaaataaatgtagcagttgataaattgcccgaatttcattgttgcaagttagaacaccctcatgctggcccacagcatgtcgccacaattcatataggttcagaaagcatggaggagattcactctgcatgtcaagatgcagtaaatggagtaccgtcgagaagaccggttattgagatgtcaattccctccatactggacaaaactatttctccacctggtaagcatgtgatcaacctgtttgtgcagtatacaccctacaaaccattggatggtgactggcaagatcatgactacagagttagtgcttcattatatcttatctatcctcctattcaggaatcgtttgcacaaaaatgtttcacattgattgatgaatatgctcctggcttcagcacatcagtcattggttatgatatgctgactccaccagatcttgaaagggaaatcggtttgacgggagggaatatattccatggtgctatggggttggattcccttttcctcatgcgacctgcaaagggatggtcaaactacaagactccgcttaaagggttatacttatgcggaagtggggcacatcctggtggtggtgttatgggagcacctggacgtaatgctgctcgtttagttcttcaagaggttggagaaagaacttaa

SEQ ID NO: 97520 - DNA, 481 bp, Glycine max
  Peptide Sequence Number=SeqID_214298
aaagaagcaagatgataaaagcagtgctggtgttgaacacgcaggggaagcctcgtctcgccaaattctacgaatttcagatcagtctgtggagaagcagcatgatgctattcgcaatgtgttttcagtcttatgcagtagacctgaacatgtcagcaattttgtggatgccgagtccttctttggcccggactcccgcctggtctacaagcactttgcaactttatattttgtgttcatatttgatagttctgaaaacgagcttgctatgcttgacttgatacaagtgcttgtggaaacattggacaaatgcttcagaaatgtatgtgagcttgatatcgtgttcaactatagtaagatgcatactatactagatgagatcattctcggaggccaggtgttggagacaagttcaaacgagccttcggctaggattataagatgtaaagtgaatgatttccctggatattcaagagactag

SEQ ID NO: 97521 - DNA, 1035 bp, Glycine max
  Peptide Sequence Number=SeqID_214299
tcactaatattcgcagcagttccaaatatattcggatggctagccatttctatagcgaaagacacatcgcttctatttatgggaagattgttggaaggttttggcgtgggaataatctcttatgtggtacctgtttatatagcagaggtatcacctagaaccatgagaggtagtcttggatccgtgaaccagctttcagttaccattggaatcatgttggtttacctgttgggtctttttgtcaactggagagttttagcaatattaggggttattccttgtgcagtactaataccggggctatatttcattccagagtctcctagatggttggccgaaatggggatgctagaaaagtttgaagcttctttacaaactttacgaggacccaacgttgatattactatggaagcacaagaaatccaggtaggtattggactacttgtgctccaacaacttactggtatcaatggtgtttttttctattctagcaagatatttgcaagtgcaggaatttcatccagcgatgctgctacatttggacttggagccatgcaggttgtaatgactgggattgctacttcgttggtagacagaagtggaagaaggatgcttctaatactatcctcctctataatgacacttagcctcctccttgtagccaccacattttatttggagggtgtggcaacagatgattctaacgttcatgaaatactggcaatgctctctgttatggggcttctggctttggtcattggattttctctaggcatcggaccaatcccctggattataatgtctgagatacttccaccaaatattaaaggccttgctggcagtgcagctacctttttgaattggttcactgcatctgtaatcaccatgactgcaaatttgctcttacattggagcagttcaggaacattcacaatttatgccattttttccgccttcaccgttgctttttcgatactttgggttcccgagaccaaggacagaacactggaagaaattcaggcatccttttattag

SEQ ID NO: 97522 - DNA, 441 bp, Glycine max
  Peptide Sequence Number=SeqID_214300
atggcatcttggattggggcggccatgaacaatgacaatgacccatatagaacccgtgaagctggtggcagcacagaggccattgctacattgcctcatgaagatggcagctggggtgaagccctacaccgtgatgagtttctgggtaccctccgacaccataacgaagccgaagaaaaagtacgagaagcccagaatcaccacgagccccaacaagcccgcggtggttctggtgcatggcaatacaaagttggtgccttaacaaaaaaatacgccgtctacgttcctgatcttgtcttcttcggaggtgtttcaagcgcagtgtgtggtacatctatgggggaatggtggcgtttaagatggctgggatgtaccctgaaatggttgaagcgttggttatcacagggaagcagtggtcctccttatatatatcaagtctaa

SEQ ID NO: 97523 - DNA, 312 bp, Glycine max
  Peptide Sequence Number=SeqID_214301
atggcgaaataccagtcagcagctgcagtccacgttgtcgttaactgcgaatggaggtatgcacaaatgaattggagggacccagagccagtagagtgggaaagagaagagaaagagtgcaatgggtttggtcattgggtagtcaaaagtgggcacgtgacagtgggaaacagtattctccgatcacgaggctttattagtgtctcaaacccgatacccataaaaaaaacctctgtctgtatccgtatcactgccatcccccaaggaaaatggaatagtacttccctactctctctcacgctcccttcataa

SEQ ID NO: 97524 - DNA, 759 bp, Glycine max
  Peptide Sequence Number=SeqID_214302
atgatgcatcattgttgtggaagctcacaggggcacgtgatgggcacttgcacatgcggcatgtatcacaatcacaatagcagcgaagccagctcttatgggtcgatgctgttttctatgcccaacaacaacgaatattaccaagaacacgacatctattcttccttcacgccctctcattcctccgtcgactgcacgctctccctcggaaccccctccacgcgtttaacccaagacgaggacgacaacaaacgacaccgtcaccaacgtcgttctggtgtcaccagtttttgctgggatctgctccattccaatcacaacaacaacaacatcacgcaatctcaaagcaagtctagcagcagaggaagcaacaacaacaacgactctctcctcgctcgtcgttgcgctaactgcgacaccacttccactcccctctggaggaacggtcctcgtggcccaaagtcactatgcaacgcttgcgggatcagattcaagaaggaacagagaagagcgagcgccgcgggggccacgtcagcgtcagcggcggttcccggcggcgcaatggaatcggcgcgcgtgtacggccaccaccacaacaattcatggtacgcacactctcagagccagaagatgatgggtaacgagttacgcttcatggatgattccgatgacagagactcggataataatggcattccgttcctctcttggaaactcaacattccagatcgaacgagcctggttgatgaacgatggtga

SEQ ID NO: 97525 - DNA, 615 bp, Glycine max
  Peptide Sequence Number=SeqID_214303
atggctacaaaaaatccacccttcaagataattctgggctcttcttcgaaggctcgtaaagagattcttgctgagatgggatatgagttcgcaataatgactgcagacattgatgagaaaggtattaggagagaaaagccagaagatttggtaatggcattagctgaggcaaaggctgatgctattgtgcaaaggctccctgttgggggtccattggaggaagatgcttctacaacactgttaattactgcagacacggttgtggtgtatcgaggagtaataagggaaaaaccaactagtgaaaaagaagcacatgaattcatcaaaggatattctggtagtcatgcagcagtggtaggatctattgtagtaactaaccttgcaactggaaaacgatgtgggggctgggacagtgcagaggtttacttccttgaaattccagatgaggtcattgatagtctgattgacgaggggattacattcaacgttgctggaggtttgatgctggaacatccattgacattaccctttgtggatgcagtagttggatcgactgatacagtgatgggactttccaaagctcttacagagaaactcttattggaagcactatag

SEQ ID NO: 97526 - DNA, 951 bp, Glycine max
  Peptide Sequence Number=SeqID_214304
atggtgaacctagtggtagcacagagaccattgctacatgggcttatgaagatggcggggatcaggccctacacggtggagatagagcccgggactaccatgagcttctgggtcccttcggagaccataacaaagcctaagaaaaaggacgagaagcccagaatcagggcgaagcccagcaagcccgcggtgattctggtgcacggcttcgcggccgaggggatcgtgacgtggcagttccaagtaggcgcacttacaaaaaagtacgctgtttatgttcctgatcttctgttctttggagggtcgacgaccgataaggccgagcggtcgccgaggctccaagcggagtgtttggtggcggcattgaggaagctcggggtggaggagtgcgtggtggtagggtttagttatggggggatggtggcgtttaagatggccgagatgtaccctgagatggttcaagggttagtcatctccggctccattttggccatgtcggagtccctcagcgcctcctccctgcaggagcttggggtctcttcttcctccgagctcttgttgcctacttctgttaagggtttgaaagcactcttgtccatcgctgctcacaaaaaactatggttccccaatcgtttgcacaaggattatcttgaggtgatgttcacgaataggaaggagcgaagtgaactattggagggcttagtaattaccaacagagatgtcacaatcccaaattttccacagagaatacatcttttatggggagagaatgatcgaattttcaaactggagcttgcccaaagtatgaaagagcaactagggaatggcgcaacgtttgaaggcataaagaaagctggtcacctggttcacctggagcgaccctgtgtctacaatagatgcctcaagcacattattgcttccttcttggactcgaatgaacccaaaaaataa

SEQ ID NO: 97527 - DNA, 699 bp, Glycine max
  Peptide Sequence Number=SeqID_214305
atgagtttcagggaagagagtggcgatgcgagggatcttcagaaaccgttcctccacacggggagttggtacaagatgggttccaggcagtccagcatcatgggatcctccactcatgtcatccgcgacggcgccgtctccgtcctcttctgcgtcctcatcgtcgcattgggtcccatccaattcggcttcacgtgtgggtattcttctccaacccaaggggctatagttcgtgatctaaacctctctatttcggaggttttggtgcttaatatgttgagttcgctgcagttttctttctttggatcattgtctaacgtgggagcgatggtaggagctatagctagtggtcagatagctgaatacatcgggcgcaaagggtcattgatgattgctgcgattcccaatataatagggtggcttgctatttcttttgccaaagattcctcgtttttgtatatggggaggttgttggaaggttttggcgttgggattatctcttatgtggtgcctgtttatatagctgagattgcacctcaacacttgagaggtggccttggatcagtgaaccagctctctattactattggcattatgctggcttatcttttgggcctttttgtcaactggagagtgcttgcaattctaggagtgaatttgattgtggatggaaagcacgaatatgacccggggttttga

SEQ ID NO: 97528 - DNA, 315 bp, Glycine max
  Peptide Sequence Number=SeqID_214306
atgcctttgggggaggactacgaggatgctaggaaccataggaagcctttcatcaacatcaacaacaacaacaacgctggaagtgggaatctctttgttgtgctgtgcgtcctcattgtggctttgggtcctatccaattcggtttcacgtgtggctattcttctccaacacaagctgatatgattcgagatcttaatctctcaatttcaaggttttcactctttggatctttatccaatgttggtgcaatggtaggagcaacagtcagtggtcaactagctgaatactttggacgtaaaggggtattatactag

SEQ ID NO: 97529 - DNA, 726 bp, Glycine max
  Peptide Sequence Number=SeqID_214307
atggggatgacagatgagtttgagacttctttgcaagtgttacgaggatttgacacagatatatctgttgaagtatatgaaattaagagatctgtggcttcaacgggaaaaagagctacaatccgatttgcagatctcaagaggaaaagatattggttccccttaatgggggtggggacgtgggagagtgagaccgaggagggaatttcgtccagcgaagctgctactgttggacttggtgccgttcaggtcatagcaactggaatttccacgtggttggtggacaaaagtggtcggaggctgcttctaatgatatcctcatctgtaatgactgttagccttctcattgtttcaatagcattttatctggagggggttgtatctgaggattcacatctattcagcatgttgggaatagtttctgttgttggacttgtggttatggtcattgggttctctcttggtctgggacccatcccttggcttataatgtctgagatacttccagtgaatataaagggccttgctggcagcatagcgacaatgggaaattggctgatttcgtgggtgatcacgatgaccgctaacttacttttgaattggaacagtggagggacatttacaatctacacagtggtagctgcctttactattgcttttatagcattatgggttcctgagaccaagggaagaacattggaagaaattcagttttccttcagatag

SEQ ID NO: 97530 - DNA, 381 bp, Glycine max
  Peptide Sequence Number=SeqID_214308
atggcctgcggcattccattacgtctctccgctttcccaagcaccacaattagggctacacttccccatttacacgcgccttctatctccagccgcccgagtcctctcagctccaactcaatgagtcaacccgccacaacgaatcacgcggatgttgtagtgcagtacgtggtgctccgccgagaccttatcgacacgtggccgctagggagcgtggtcactcaaggttgccacgcttctgtttccgccgtttggttcaacaaagacgatcctttcaccgtcgattattgcagccccgataaaattgattctatgcacaaatctggttttgggcttttgacccttctaggtggtgcttttggccaggaacaaatgttctag

SEQ ID NO: 97531 - DNA, 1005 bp, Glycine max
  Peptide Sequence Number=SeqID_214309
atggacatgagagagcaagataaggttatagagatgcctagcactttgggttataataactcctcttctggttccaagctatcatcaccaataggtgaaagaagtagtgaccaattacctcctcatcaatctcacacattagttttcactgatccaccccaaacttcttcacatcatcataatctctatcccccttcactcccaccaaaccctcttcaacttccacaacctcatcacagacccagaagagatccagatccaagttctattatttctcctcctatcataagcaccaccccaacaacagcaccaccacaaccacacacaacaacaacattattcagataccgagaatgtctgaagaatcatgctgcaagcatgggaggtcatgtcacagatgggtgtggagagttcatgccaaatggagaagagggcaccccagaatccttaaagtgtgcagcttgtgagtgccaccgcaatttccacagaaaagaacctcatcaaggagtactagtagagtcacaactacaacatgttcttctcaacaaaaacaataggaacataaacactattattcattctccagactctcatcaccaccttcagtttcctacaccacactctcatcttcatggtgggccgcctgttgttcagcccgtgatgttgggctttgggggatcaggcccagctgagtcctcaagcgaagatctcaacatgtttcagaccaatgatcatggaggaggagggaacaacttgttattatcatcagtgcagcagcagccaccactactctcatcatcatcttcaaagaagaggttcaggaccaagttcacacagcaacagaaagataggatgatggagtttgctgagaaacttgggtggaagatccagaaacaagatgaacaggaactgcatcagttttgctcccaggttggtgtaagaagacaggttttcaaggtttggatgcacaacagcaagcaagccttgaagaagaagcaaatgtaa

SEQ ID NO: 97532 - DNA, 210 bp, Glycine max
  Peptide Sequence Number=SeqID_214310
atggcagcaccagcgacgaggcgagggattcatgtttctacttccttcacccacaaagactttcataccagatgggcacaaggcacaacaacgccagacacgacagcaacgagacccacaaacacgttcacacatgaatcaaagctagctgaggtggcagtggccaagctcgcgtttaacagagggccaaacaggagaatagggtgttag

SEQ ID NO: 97533 - DNA, 150 bp, Glycine max
  Peptide Sequence Number=SeqID_214311
atggagaacgaacaatttctgattgaacagacttggagatcaattctagagcgcagtaatggcataaaacccagaaatcctaatgagtcatttgagacatctaacaacaaccttcaaattgccccaagcatcatgcatagtattgcttga

SEQ ID NO: 97534 - DNA, 1338 bp, Glycine max
  Peptide Sequence Number=SeqID_214312
atgtctcgcactcccaactacgagttccaggaatggtggaacaagcagcgcgaaaagaacaccaccaacaccaacaacctcgactccctcgactccctcgacgacaaccttaaaaacctcgaccacgcccactccccctcgtcgccgccgttcacggcgctcgacataagctcttcctccgccgccgacacctccgccgaccacgaccacgaccgctccggccggaaagaacgctctcgaagcgcgcggcagctctcatgggtcttcctgttgaaattccagcagctcgccgccaacctcggctggctctccaacggcctcctcttcctcctccgcaccggccagcgccggatcgcgacggactccgcctccttcggcgacggcggtgacacttcgcgcctctaccgcgcgatccgtttctttctcataacagtcctcctcctcctagtgttcgagctcctcgcgtatttcaaaggctggcatttcagccctcccgatccgagtgacgttttgggcgtcattggagtcgtttactccacgtggctcgacgttcgcgcctcgtatctatcacctccgctgcagagtttggcgaatctgtgcaccgttttgttcattgtgcagtcggtggacagggtcgttttgatcttaggatgcttctggatcaagtttcggaggctcaagcccgtggcgagtgtggattacgatggccccgtgcagagcgtggaggattttccgatggtgcttgttcagattcccatgtgcaatgagagggagcgtgattttgtgggtaaagtgcaaatgctgtggcttgattggtctggtatcgtaagggtttaccagcaatccattggagcagtttgtatcctagattggccaaaggagagaatgcttgtacaggttcttgatgattctgatgaagtagatacccagcagcttatcaaggcagaagtgcataaatggcaacaaaggggtgctcggataatatatagacatcgacttatacgtacaggctacaaggcagggaatcttaaatcagcaatgaactgtgattatgttaaggattatgagtttgtggcaatatttgatgctgatttccagccaacaccggattttttaaagaagacagtgccttatttcaagtctcatttgtgcaaggccagcattttagagctggagcacatgctaatgctacataagcatatgctgctgaataaagagtttggtccccatttaattgagcatatcaagaagagcattgagggagtatgtcagaattcggtgaagcagaagccctttcttggacaaggtggagttacccatctttcatggcagcgctga

SEQ ID NO: 97535 - DNA, 603 bp, Glycine max
  Peptide Sequence Number=SeqID_214313
atgttccttcccgaagcggagctcccagcctgggttgtttgttacattcctggaatcatgtccctcctaagtgttctaccagctccacggtcatttccgtttatagttccttaccttctatttgagaacactatgtcggtaactaaatttaatgccatgatatctggattacttcgctttggaagttcttacgagtgggtggttacaaaaaagttgggaagatcgtctgagactgatttggttgcctttgagaaagaagctgagcctctaatgcgatctaatagtcttcatagatcatcctcagattcaggcattgaggaactaagcaaactagaattgtcaaaaaaaactgggaagacgaagaaaaatcgtctcttcaggaaagaactttatcttgcatttattttgttggctgcctcagttagaagcttattgtctgcccaaggaattcacttctacttcttattatttcaagggataagttttctggttgttggccttgatttgattggagagcaggcagtgaggttttgggcacacctgtcagcaaacatgtgttcatcttttaccattaactttattggttgtatttatcatagttaa

SEQ ID NO: 97536 - DNA, 237 bp, Glycine max
  Peptide Sequence Number=SeqID_214314
atggagggttttaagagagggcgaggaagccacatagagacacaatacagagtatctccagagattctatgcacaagaggcgtgccactggtggcaagaagaaggcctggaggaaaaagagaaaagttgcctaatgttgttgctgaaagtggaagatgtgtttgtgttgggatttttggtcgttttgattggtacgatggttgggatctttacttggttgtggatttgacagtttga

SEQ ID NO: 97537 - DNA, 567 bp, Glycine max
  Peptide Sequence Number=SeqID_214315
atggcgccaatgctagatatcgcaacacctatcccatttgccatgcttcaacaattggagataggatgggggctcgagaggaggaatgataccacgaccaatccgaggcaagaacaagttggggtgcaaatgaagctagttggtaggtcattgtacaagaagccttatcaagagtggattaacaagatagcccctttgtcgagagggtacaagatcctagattttacaactttctcaagcaaggatgggaaatccaccatggaacatgttagttgtttcacaaatggaaaatctaccatggagaactggagagccatcttggggaataggagggctggtcataggagactagaaatactgagacaagacttcgtctggaatgggagcccaccagctaatatgggaacagatcgaagcttaggagattcaagtagagcatctatgtccgttggtttagaccctatagaacttgaaggtggatctattaggagaagacaaagattagcaaggagaagagataagaaatttaaaggagatgtgagaaaccttcttggacaactgaactag

SEQ ID NO: 97538 - DNA, 226 bp, Glycine max
  Peptide Sequence Number=SeqID_214316
ggcactctgggaagattctctgctttttctcttccaacaagggatcctgttcatccactcaagcgcattggatcgttggttagcgtgggtgggcatctcactccctcaaaatgtgatacgatgcatagccctttcatcagtatggggctgattgaagctagtgcacgggctaagggaaaagccaatgccccggatacgaccggaatttacttggactacttccaag

SEQ ID NO: 97539 - DNA, 204 bp, Glycine max
  Peptide Sequence Number=SeqID_214317
atgatggcacatcaaaaccccccatacttagccttttgcactcctgggcaaaatgaaacaaagaacaaaatccaaggatatcagagggagacaaacaaaaacattcacatatttctcagtgaacatcagggaatgaaaggaatggacttagagtccggtagcatgcagagactaacgtcatcatctgcaccttttgtcaactag

SEQ ID NO: 97540 - DNA, 204 bp, Glycine max
  Peptide Sequence Number=SeqID_214318
atgtgggaaaaacttgcttcaccttccatggtacaggtctcttacaaaagtatatcttcaacattcatccttcgtctcgaagctgcacatcctcgttcacttcctctttcatcatcaaaggtttctagtggggttggggttggtttatggtggggatgggttctagtggggggtgttttccaatgtggatggggttgcatttaa

SEQ ID NO: 97541 - DNA, 518 bp, Glycine max
  Peptide Sequence Number=SeqID_214319
ggtccagcggctggaagagcaccgcacgtcgcgtggtgtccggtgcgcccccggcggcccttgaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcggattcccactgtccctgtctactatccagcgaaaccacagccaagggaacgggcttggcggaatcagcgggggaaagaagaccctgttgagcttgactctagtccgactttcggggcactgcccctctttttggacccaaggtcggcttcggccggtcgatccgggccggaagacattgtcag

SEQ ID NO: 97542 - DNA, 114 bp, Glycine max
  Peptide Sequence Number=SeqID_214320
caagcaggggctgttcttgttcttcaacttgccaagactgctcaacttgttactgtgaagggtgcatcaagtgccgctttgaggattgcaattgccaagaatgcagagttgtga

SEQ ID NO: 97543 - DNA, 723 bp, Glycine max
  Peptide Sequence Number=SeqID_214321
atggcgcgccaaaaagaacaggcgcgagctgccggtaaattcaaaatggcgctgaacctggaatacgagggcgctgcaactacattccacggctatgacaaactggaaactcccgccaaagtgctggcattgtataaagatggcagtgccgtacaaacattgaatgaaggtgatttgggtgtggttgtgctcgaccatacgcctttctatgccgaatccgggggccagattggcgatagcggcgaactcaaatctgctaacggtatttttgccgtggaagatacacaaaaaatccaggcggcagtctttggtcatcacggcgtgcttaaaaccggcaccttgtctgtgggtgatgatttaacagccaaggtcaatctgcaagcgcgcgccagcaccatgcgcaaccactcggcgacccatctgatgcacaaggctttgcgtgaagtactgggcgagcatgtacagcaaaaaggtagcttggtcgatacagaaaaaacccgttttgactttgtacataatgcgccgatcaccgatgccgaaattgcaaaagtcgaggcgctggtcaatgctgaaatcctcgctaacgtggcaacgcaggctcgcctgatggatattgagtctgcccaaaaaaccggtgccatgatgctgtttggcgagaaatacggcgatgaagtgcgcgtactcgatattggatcttcacgagagttatgtggtggtacccat

SEQ ID NO: 97544 - DNA, 1356 bp, Glycine max
  Peptide Sequence Number=SeqID_214322
cgcgccgaagatgctgccgaccaccgaacccaggccgccgatgatgatcatgaacagcagctgcagcgagcggtccaggctgaaggccgcaggttcccaggcacccaggtgaacgaagccccacagcgcgccggccacgccgacgatgaagctgctcacggcaaaggcgctgagcttggcgtaggtcgggcggatgccgatcacgctggcggccacgtccatgtcgcgcatggccatccattcgcggccgatggcgccgcgcaccaggttcttggcggccaggcccagcaggcacaggatgcccaggcacagcaggtacttttccatgggcgtgtcgatcttccagcccatgatggacagcgggcccgcgctcaccgagcccgaggaggagttgttcgtcacccaggcggcgcggctggtcagccagtccacgaagaactgggcggccagcgtggccacggccaggtacaggccgcggatgcgcaggctgggcaggccgaagatcacgccgaagaccatggccagcacgccgccaccgatcagggccaccagcagcggcatgccctcgaaacgcacctgcaggttgtaggccgcatacgcgcccaccgccatgaaggcgcccgtgcccagcgagatctggccgcagtagcccaccaggatgttcaggccgacggcggccagcgacaggatcaggaacggaatcaggatggcgcgcagcaggtagtcgctggacagcgccgggatggcgatgaacgccaccgccagcagcagccagatgaagacgcggtcctggcggatcgggaagatctgctggtcggcgcgatagctggtcttgaattggccgttttcgcgatagaacatgtttttatcccagagtgcctgcggtcagacgcggtcgatgatcttctcgccgaacagcccttgcggacggaacagcaggaacaccagcgccagcacataggcgaaccagatttcgatgccgccgcccaccagcgaccccaggtagacctcggacagcttttcgcccacgccgatgatcaggccgccgagaatggcgcccggcaccgaggtcaggccgcccaggatcaccaccggcagcgcccgcagcgccgcggtcgagagcgtgaactgcacgccgaacttggagccccagatgatgccggccaccagcgccaccaggccggcgacgctccagacgatgacccagatgcggttcagcggaatgccgatggactgcgccgcctggtggtcgtccgccaccgcgcgcagggcgcggccggtggaggtgaactggaagaacagcgccagcgccgctaccagcagtgcggcgatgacggcggcggtgaggtcttcgag

SEQ ID NO: 97545 - DNA, 327 bp, Glycine max
  Peptide Sequence Number=SeqID_214323
atgcatgggcatgcaggcaaaccgccattgtcactagtggaactcgccacctctgctggcgattctggtgatgctttcctaaaccgccagtcaaactggcggttttgctttgcaggtggtgcagttagtcgtagcaagcgtaggcacgcaggctttttcagagaaaggggagttgcaactcctcctggcgatttgcttgcaagttgtcactcctcttggcgatttaggactgagaaaatagtcaacccagttggcgatttagggcctataaatacgaaaaagaatttcagtctcacaatcacagctttgagttttctgaagctttga

SEQ ID NO: 97546 - DNA, 210 bp, Glycine max
  Peptide Sequence Number=SeqID_214324
atggtgcagtgtcggtcggaagacgctaacatctccggaaagggtgcaggtggtgacgttattcactgcttgctgtcgtgctttgattcttacggataccaaatgagactttttcgtagtgtcggatcgaaagatgctcacatctccggaaagggtgcaggtgatgacgttagtcactggttgctatcgtgctttgagtcttacggatag

SEQ ID NO: 97547 - DNA, 903 bp, Glycine max
  Peptide Sequence Number=SeqID_214325
atgccgcgggccagcgccaccatgtcggcctgcccttgcgccaggatgtcctcggcctgctgcttttcggtgatcaagcccaccgtgatgttcggcgccaccgggatcttccgcaatggcgaaacgccgccgctggagacgtcgatgaactcacagcccaattccttgagccgcagcgcgaacgcctcggtctgcgccggatcccagccgccctcgacccaatccgtggccgatacccgcacgcccagcgccaccgacgaaggcgtcacctcgcgcatcgcgcggaacactttccagcgggaagcgcatgcggttttccagcgagccgccgtagttgtcgtcgcgctggttggccagcggcgacaggaactggtgcagcagatagccatgggccgcatgcagctcgatggcgtcgaaacccaggcggatggcgcggcgagcgctgtcgacgaaggcgtcgcgcacccgcgccaggccggccgcgtcgagcgcgcgcggcgccggctcggacgccttgtgcggcagcgccgacggcgcccagccctgccagccgccctgctccggcggcaccagttggccgccctcccagggcgcatggctcgacgccttgcggccggcgtggcccagctggataccgagcttgatcggcgaatagcgccgcaccgcctgcaccacgcggcccagcgcggcttcggtctcgtcggaccagaggcccaggtcgcccggggaaatgcggccatcggcctcgaccgcggtcgcctcggtaaacagcagcgccgcgccggacagggccaggtggcccaggtggatcatgtgccagtcggtggcgcggccctcgtcggccgagtattcgcacatgggcgcgatgacgatgcggttggccagttcgagctggccgactga

SEQ ID NO: 97548 - DNA, 280 bp, Glycine max
  Peptide Sequence Number=SeqID_214326
atgattatgaggggccaagacatttatagtagccaagataaggctactactttaccttcctctagtgaaagtgaaaaagcaaaaggggaagaatctagtgtagaaatctacccccaagaagaaggacaaccattagtggttaaagagaagtgtaaagagacacttgctagcattgccacacctcttgggcttgagtttattcctcaagtaaagaagttgttggatgaggatttggttcgcaagagcttaaatccttgtgctttattggtgcccaaaatag

SEQ ID NO: 97549 - DNA, 472 bp, Glycine max
  Peptide Sequence Number=SeqID_214327
gtctagaatagacgccacaggagaaggatccagtgctgcctcagagtttgatagtcatcgtttccggagtgccgagcaccaggagaggcgtgtccagctcagggaggatgagtatacggacttccaggaggagatagctcgcagacattggacaccgctagagactcccatggccaagttcgaccccgagatagccctagaattctatgttaatgcctggcccgcggaggagggagttcgggacatgcactcgtgggtgaggggtcagtggattcccttcgacgccgatgccctcagccagaggagcaaggccgatggtttagttgaggaagctattgcccagctgttatgcataccggggcaggatttctcccggaccgctgcagggaggcgggtgcggatcatgcgcaccagcatggcgactttgacccagacaatggatgacattgctgctcagcaatgtgttgcttag

SEQ ID NO: 97550 - DNA, 285 bp, Glycine max
  Peptide Sequence Number=SeqID_214328
atgggtttgaatatagaaaaattgaagaacatcgtcattagtcttgagatggcgacgacagtggaggtggaggttaggaaggtggtggtggtatcggagccaatggttgtggtggaggttcaagagaggatgacactcaggttagcaaattgcattgtaatggcattctacacagaaaggcaaaattattcattctcttatcgttggtgtcctacaaagggctctattgcttggccaatcatgtctggaacctcatcacgagtgacagtggtgggttgtgcataa

SEQ ID NO: 97551 - DNA, 736 bp, Glycine max
  Peptide Sequence Number=SeqID_214329
atgtccaaatcttgtggatttgggatgaccggccctctcgatgagttgatctcttgctttctcataagggtggacccttgggtacttgtacctatcacctttagaggactacacgtcctcgccttgagaggactacatgtcctcgccatcagaggactacatgtcctcgccatcagaggacttcatgtccttgccatcagagggctgcacgccctcacctccagaggactacctgtcctcgccttgagagggctacacgccctcaccttggatattagttaccctcaccaagggctgcacgccctcaccttcagaggactacacgtcctcgccttgagagggctacacgccctcaccttgggtacttgtacctatcaccttgagaggactacatgtcctccccatcaaaggactgcatgtcctcaacttgagaggactacatgtcctcgccatcataggacctcatgccctcgccttgaaaggcaacatgtcctcaccttcagagggctgcacgccctcacctctagaggactacgtgtcctcgccttgagagggctgcacgccctcaccttgggtactagttaccctcaacgtcagaggactgcacgtcctcgccttgagaggactacacgtcctcaccatcagagggctgcacgcccttacctccagaggactacatgtcctcgccttgagagggctacacgccctcaccttgggtactactttaccctcaccc

SEQ ID NO: 97552 - DNA, 279 bp, Glycine max
  Peptide Sequence Number=SeqID_214330
atgaatggagagtcattttgggtgatggccagcaccacaccaacttgggtaagcctaggcacaagtggaaaggtgatacgagcatctcgtaatatttcttcacatttgcatgttaacactttctttgttaaagcatcagggcaggtgccaacatttgctaggtccatgatcatatcttctcacaatcaaggaatgggagggggggttaaggaggataagatggcgaagcctcaaccaccaccccgcgtccggctaaagactataaagaagcactcctag

SEQ ID NO: 97553 - DNA, 240 bp, Glycine max
  Peptide Sequence Number=SeqID_214331
atggaagttgtgcttccatttgaggtggagattcattctttaataatcctagtagagttaggatcggaagaagcagagtgggcccaggcacgctttgatcaattaaatcttatcgaggtgccacaggttcaaaaggatcaccgaggtaaatgggccccaaactatgaaggatcatttgttgtgaataaggctttctcaggaggagcattgttgcttatgaacatggacgatgaagagtag

SEQ ID NO: 97554 - DNA, 579 bp, Glycine max
  Peptide Sequence Number=SeqID_214332
atggctctgaagaagcttcttgctaaaaaggctaggaaggccaccacaggggagggatccagtgcagccccacaagcggagattgagtttgatggacaccatttccgaagcgaggagcatcagcatcgtttcaaagtgatttcggattggtctttcctcaaagaaagacaggtccaactaagagaaagagagtacacagaattccaagtggaggtttccaggaggcagtggacccagttgatagagcccatggctaagtatgaccctgagatagtcatggagttctatgcaaacacctggctcactaaagaaagagtcatggataaacgctcctgggtacggggccaatggatcccctatgatgaagatgctatcaaccaattcctgggacatgcattggtcctagaaaaggggcagcattgtgaatacactaaaagaagaagccaggtcttaggttttgatgaagaggccataggccagcaattgtgcttcccaggacaggattttgcgcggagcgtgactggaaggcgggtgcggatcatgcgcactagtatgaccactttgacccaaattggatga

SEQ ID NO: 97555 - DNA, 999 bp, Glycine max
  Peptide Sequence Number=SeqID_214333
atgcgcaaacactatgagtacgaagtcggtcacttcgaaaacgccatcgaggtgccgtcggataccttccgcgatcagctgccgatggcggtggagatgctgcaggacagcaaagacaaaaacatcgtcatgtactgcaccggcggcattcgctgtgaaaaagccagcgcctatatgctgcacaacggctttaaaaacatctaccacgtggaaggcgggatcatcgagtacgcccgcaaagcgaaagagcaggggttgccgatgaagtttatcggcaaaaacttcgtgttcgatgagcgcatgggcgagcgtatttccgacgatgtgatcgccaactgccaccagtgcggggcgccgtgcgacacccacaccaactgcaaaaacgacggttgccacctgctgttcattcagtgcccgagctgcgccgccaagtttgaagggtgctgcagcgagatttgccgcgaagagctgaagctgccgcgcgaagagcaacgcgcgcgccgtgctggccgggaaaacggccccggccgccaagccgggcttttttacttatttctcgcgcacgccttctacggagatgatcagctcaacgtcttgcgacgccgggcccagatcggtggtgatgccgaaatctttcagcttgatcttgccgttggcttcaaagccggcgcggtagccgccccacggatcgttgccctggccaatcagtttggcgtccagcgtaaccggtttggtcacgccgttcagcgtcaggttaccgaccactgcataaccgtcgccgcttttcttcacttcggtggattcaaacttggcctgcttgttcttctccacgttgaggaactcggcgctgcgcaggtgcttgtcgcgttcggcgtggttggtgtcgacgctggcggtattgatggtcacgttgactttgtccttggacggatctttttcgtcgaaggtgaagccgccgtcgaagtctttaaagctgccgtacagccagctgtagcccag

SEQ ID NO: 97556 - DNA, 147 bp, Glycine max
  Peptide Sequence Number=SeqID_214334
atggaggaatctggaatattcttcatggaagacgcacccatgagcctcgcctcgctcacctgcgaaagggggccctatacccaggtccctgggaatttaaggagtggaggtgaatctatggtcatgctaggtctccaacttgcttga

SEQ ID NO: 97557 - DNA, 600 bp, Glycine max
  Peptide Sequence Number=SeqID_214335
atgccgcgatccggcacgcaggaactggacgaggcccgcatcgccgaggtcatcgccgccttcgccgccagtgcggtgcgcgccgagcgcctgggcttcgagctgatcgagctgcatgccgcgcacggctatctgctgcacccagttcctgtcgccgctgagcaaccgccgcaccgatggctatggtggctcgctgccgaacccgcctgcgccctgctggtggaagtgttcgacgcgagcgaagcgctggcccaggtgctggacgcgcgcggctgcaatttcctgcatgtctccagcggcggcctggacgagcgccagaagatcaccgtcggtcccggctaccaggtgccgtttgcggcggcgatcaaggccaaggtgcgcatgccggtcatcgcggtgggcatgatcaccgagcccgagcaggccgaatcgatcctgcgccatcgccacgccgatgccgtggccctggcgcgcggcatcctctacgacccgcgctggccgtggcacgccaccgccgcactgcgcgacagcgtggaaccggcgccgcagtatctgcgctgcgagccgcgcgacgcgcgcggcgtgttcaaggcgcgctga

SEQ ID NO: 97558 - DNA, 456 bp, Glycine max
  Peptide Sequence Number=SeqID_214336
atgaagaacggtggaaaatcttcacgaaatcgcccacggaaacgtctcggaagcattacgaaagcatctcggcttggattttcttcacggaaaatttttttctcactaagtttaagtgaatctcagataccaggagggggaaaagagggaggtggttgccgcccacctcgcccagaagaactttatgaattacgtaacgatacttgttttctttccgtaatgtcacgaaactttacggattacgcaaccatcccccctttgacttccggaatgttacagaactttatggattgcgcaataatgcttcctttcgactcccgacatgtcgcagaacttcacggattgcctaacgatgggtgtcaagtacctcgaagcggtcaagtgaaggtagcatcccaccaaacagatggtccccggatgaaattagggtatgacaccaaggtcacatatttatag

SEQ ID NO: 97559 - DNA, 1386 bp, Glycine max
  Peptide Sequence Number=SeqID_214337
atgacgaagaatagaaaaagcagcatatacaaaggcacgacaaatgatgacattgacgaatgtaagacaaccaatcatacatgcataagccaaaacaattgtctcaacaccaatggatcctacgaatgtttctgtccaaaggggcgatccggaaatggaaaaaaggaagaagggtgccaccaaaaagatgttaccaaggttgtcataggagtagcagcaggaattgttattctatgtgtagggactacctcattgtacttgatataccagaaaagaaaactcaacaaacttagacagaaatactttcaacagaatggtggttccattttgctacagaaactctctacaagagaaaactcttcccaaattcaaattttcacacaacaagaactaaagaaggccactaacaactttgacgagagcttaatcattggcaaaggaggttttggtacagttttcaaagggcatctagcggataacagaattgttgctatcaagaagtccaaaatagttgataagagccaaagtgaacaatttgctaacgaggtgattgttctatcccaaatcaatcatagaaatgtggtcaaactcttgggatgctgtttagagacagaagttcctttacttgtttatgaatttgttaacaatggtacccttttcgatttcatacacaccgaaagaaaggtaaatgatgcgacttggaaaacccgtgtaaggatagcagccgaggcggctggagctctatcatatctacattcagaagcatcaatacccattatccacagagatgtaaagtctgctaacatcctgttagatgacacttacactgccaaagtgtctgattttggagcttctagatttattccacttgatcaaactgaattagctacaatcgtgcaaggaactattggttacttggacccagagtacatgcaaacaagccaactaactgagaaaagtgatgtatatagctttggggcagtgcttgtagagatgttaacaggggagaagccttattcttttggcaggcctgaggagaaaagaagtcttgctaaccactttctatgttgcttaaaagaggatcgcctgttcgatgttcttcaagtcggcattttgaatgaagaaaatgaaaaggagattaagaaagttgctattcttgctgcgaagtgcttgagagttaatggggaggaaagacctagtatgaaggaagtggcgatggagttggagatgcatcagtggattaatacagacccaaatgtaaaggagactgattacttggttcatgaggcatcatctaacatttatgagcctggtgatagcagctgccatcaagagtatgacagcattacggatcaaataccacctgctttgggtgatggaagatga

SEQ ID NO: 97560 - DNA, 237 bp, Glycine max
  Peptide Sequence Number=SeqID_214338
atgggattgatggccatgttgatgcggatgcaactagccctgatacaagtggtgttggtgattgtgttggcaaggatgggaactgtagcagttaaccaaaccctgcttggctgcccaagcacttgtggaagtgttccaattccaaatccatttggaataggcaaatcatctgaaaccggtgacaactgtttcttggagggagcattggagctcacttgcgatgatggcaccaattaa

SEQ ID NO: 97561 - DNA, 675 bp, Glycine max
  Peptide Sequence Number=SeqID_214339
atgctattaaagcatctagagtcgtcgcttcttgctaccgctgtggcgctccgttacacacttccgatgccgatgcccctggctacgttgaattttggaagcatcatttttgctgaatttcgaaacgctgattgtgtgcgtgctatgttgcagaagaagaaacaccaccaacttcgaaccgttctgtgtaggcggtgccgacttttgtctcatggcaagatgataactgtcgttggagggcacggaggatatcttggcggtaaattattcgccactgctgaagagcttcgagaaaagttgtctcacctgcgtcacgagaaagctctaatcgtcaaattggaacttctatatctgtatggttttgtcattgatgataacacagatgactatctcatggtccactatccaacagaaacaattaatacaatttctttttctgagtccaaaacccagcttcttgaaatgcagaaggctgaaatgagatgtcttttacccaaaacttcattggataatggattttttccattaaacacccaaaacagtgaagaaaataacaagtccaaagctgatgaggacaaggcaaggaataagggcaaggaacctttagaaggacttggaggacctatgacaagggttagaacaaagaaggccaaggaagctcttcaacagtgttaa

SEQ ID NO: 97562 - DNA, 185 bp, Glycine max
  Peptide Sequence Number=SeqID_214340
aacttgtaaaaggattttacaagatagtggaactctcaagcgggttgcttggggactggacgttggcacaaggggcgcaggatctgtatctgcgcatttacccactcagggcgcagaatctgtatctgcgcgtttacccactcagcttgctatcatgcttcgagtcttagagatagcaaaagaaa

SEQ ID NO: 97563 - DNA, 291 bp, Glycine max
  Peptide Sequence Number=SeqID_214341
atgtcaacttcggtttttaagaaaattgaggttaatttcacacacataaaattggtttttaacttttgctacaccttgaagacttgtctcctcctctcctttgaccccactccctctcctgaatctccgcctagcctcctctccactttccttaacggtgttactatcggtgttgagccaacattggatgttgaactggtcgtaggtgactccagtggagaggctgataggggatttcatgatgttgagggagatagggcacttgaagaagctaggaacaattatgcatag

SEQ ID NO: 97564 - DNA, 1197 bp, Glycine max
  Peptide Sequence Number=SeqID_214342
atggttatcgttggagccgcagctggatttgttattctattcgtggggactgctatgccgtacttaatataccaaaaaaggaagctcgtcaaactaaaagagaaattctttcagcaaaatggtggtttgattttgttacagaaactctctacatcggaaaagtcctcccgttttatgcaaattttcacagaagaagaactaaagaaggccacccgcgattttgatgagagttcaatcgttggcaaaggaggttttggtacagttttcaaaggatttctagaagataacagaactgtagctatcaagaaatccaaaatagttgatgacaaccaaaaggaacaattcattaatgaggtgattgttctatcccaaatcaaccataggaatgtggtcagactcttgggatgttgtttagagacaaaagttcctttattggtatatgaatttgttaacaatggcaccctttttgatttgatacacactgaaagaaccgtgaatggtgcaacttggaaaacacgtgtaaggatagcagcagaggccgctggagctctatcatatctgcactcagaagcctcaattcccattatccacagagatgtgaagactgctaacatcctcttggataacacttacactgccaaagtgtcggattttggagcttcaatattgattccacttgatcaaactgcattatccacatttgtgcaaggaacttttggctatttagacccagagtacgtgcaaacaggccaactaacggagaaaagtgatgtgtacagctttggggcagtgcttatagagctgttaacaggggagaaaccttattcctttggcaagcctggagagaaaaaaaatctagccaaccactttctatctagcttgaaagaggatcgcctagttgatgttctacaagttggaattttgaatgaagaaaatgaaaaggagattaagaaggtagcttttcttgctgcaaagtgcttgagacttaaaggggaagaaaggcctagcatgaaggaagttgcaatagagttgcagaagcatcacttgattaatacagacccaaatcaaaaggagaatgaataccagctggttcatgaggcaccatctaacatttatgagtccggtgatagcaacagccatcaagggcttggcagcattggggatcaagtactagctgctatgaatgatggaagatga

SEQ ID NO: 97565 - DNA, 315 bp, Glycine max
  Peptide Sequence Number=SeqID_214343
atgccacagttgccagttgctagctacggccctacaccaaaggggagggctcagtgcacttgttcagtgagagcaacacttcatacaatcatgctgaaaggttcttggaggaaacagtgcttgcttttaactcttcttgcttttgttgttctatcagaaggatcaagattacctaaggagtactgggaacagatgatgccaaagaagctaccttctccttcctcttctccctccaaaggcacgaattcagtgtcgccttcatcttccttgaccacgaaaaatgatggtcttcctatgtcagatggaaaggtctaa

SEQ ID NO: 97566 - DNA, 1474 bp, Glycine max
  Peptide Sequence Number=SeqID_214344
atggaacacttgcaactgagccagacgttaatgtttgcattggccctcgtagtagtagctgttgcacctcatcaaaccctttctgcaatactaaaccaaaacctccctggctgcaattccacttgtggaaatattgaaattccatatccattcggtataggctactcatctacacccgatcaacgaccctgtttctttgagcccaagtttagtctcacttgcgaaaactccacattaatatggggtaatgtcgagattttaagcataagcctcccagcgcagcaaatggacgtattgttttgggtctcacagttttgcaatgacacaaatgacaacttcccctggatgcaaacattcaacttcagcatttcaaggaaggaaaacaagttcatgaccgttggctgcgacagttttggcgtactcaacagtttttccgacaatagcacatattcaactgggtgtctaacaagatgctatggcaacgagttgaagattgacgatggaacgtgttccggaatagggtgttgccggatggatattcctcctcgaatgagggatatcgagataagagcatctatcttctccaattcgatgccagagtgggaaaactgcagctattcctttgttgcaaaacaagactcgtacaacttttcaacctctcatttgcgagggtttccacagacgagcttccccttggttcttgattggaccgtaggacaccaaaagtgtaaagcatccgagagtagagacgactacgcatgcaggagcaatagctattgcgatgacacagactctgacattgactatggttaccgatgcagatgtaaggatggctatgaaggaaacccatatcttggctgcacagacattgacgaatgtaagacaggcaatcatacatgcataagtgaaaaaaattgtctcaactccaatggatcccaccgatgtttctgtccaaaggggcaatccggaaatggaacaaaaggagtagggtgccaccaaaaagatttagttaccaaggttgtcatgggagtaggagcaggaatttttattctatttatggggactactttattgtacttgatataccagaaaaagaaactcatcaaacttagagagaaatactttcagcagaatggcggttccattttgctacagcagctctctagaagagaaaattcatcccaggttactcaaattttcacagaagaacaactaaagaaggccaccaacaacttcgacgagagcttgatcattggaagtggaggttatggtacagttttcaaaggatttctagcagataacaacagaactgtagctatcaagaagtcaaaaatagttgatgagagccaaaaggaacaattcattaacgagattattgttttatcccaaatcaatcacaggaatgtggtcaaactcttgggttgctgtttagagagagaagttcctttacttgtttatgaatttgttaataatg

SEQ ID NO: 97567 - DNA, 277 bp, Glycine max
  Peptide Sequence Number=SeqID_214345
atgactattgaagaatccattcatgtttcctttgatgagtctgatgttatttctccaagaaaggatgtgttagacgatgtttcagatttcttagaagagatgcatactcatgaaagggattctaaaaggaaaagagatgaaagcaatgaggattctcaggactatgaaactaaagtaaacaatgatcttccaaaggagtggaaagcttccagaaatcatccttttgacaacataatcagtaatatctcaaaagaggtagcatttgaactacctcaag

SEQ ID NO: 97568 - DNA, 541 bp, Glycine max
  Peptide Sequence Number=SeqID_214346
ggtgatcagcgttctcgttcacgaagccaaccgagtagctcatgggaaggagcatgtgagggagaaggaccaaacttcgtctcttcgaacggagcccagatcttccagcccccgtgcctacctttactcaatgctcctgaagtccgaaaaggagactgagtggacagggggcacggaagttaagttacagaaatggctaccgataggcggattgacgcatctgagcaggcagggaatacttagtgcttggaatatgaatgctatgaggcttgggcgagagagcagccagcaccttcaacagccagtaggacagatgccgagacggattcccccagattcaagattagggatttgtctggctggtgttcagccaatggcttttgtcttcgggtgccttgcctttaagttaaggcttcgttccactcctcttctgtcgctctcatctctgcctttcatttacatagatatctccttcttttcccactcgatagggcagcgcttggagaggggagctaggcagggaagagccgttcaggctgta

SEQ ID NO: 97569 - DNA, 216 bp, Glycine max
  Peptide Sequence Number=SeqID_214347
atgtcattgcctagcgctgttcatgtgttctcccttatcaagtgcgaagcttctggtgactgggaagcacgttattctgttgttttccagatcggttccttcgccaaaagaaaaaaaagaagaagtagagatgagagtcgtcattgcgaaaagggcaagacggacgaaatcagtcctatctttgctttcctcttatctccgatgagaggtaagtaa

SEQ ID NO: 97570 - DNA, 616 bp, Glycine max
  Peptide Sequence Number=SeqID_214348
gactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactggggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccag

SEQ ID NO: 97571 - DNA, 458 bp, Glycine max
  Peptide Sequence Number=SeqID_214349
atggctccagaagaattagagcagctgactcaacaaatcaaggaccaactggaggagtcgatcacagaaaaaatccattcacaaggacttgcactgcctccagagcctaaggtttgtccctcagcttctcgtgtcggcacaaaggggagttgtgttgatccctcaccgaccgatccagacacgggtgactcagacaaatgcgggttgtacatcgaagaaaatccttcccgcctggttgccctaggaagagtttatgagggatccacagtggttcacaacatccctttgttgcatggccaagtgaaggttgctgttgaggaggttaaagatgcagaggctcccattcctgtacccactgacgagacagctatgtctccagcaaaacctccagatgggccggatcctcaggttatgtgggatgctaccgtgttcggggtgtttaatgaacacttcccaag

SEQ ID NO: 97572 - DNA, 313 bp, Glycine max
  Peptide Sequence Number=SeqID_214350
atggaagcggtactcccgtttgaggtagaggtcccttcccaaaagatactagcggaatcaggcctagaagaatcagagtgggctcaaacacgctacgaccaactcaaccttattgaagggctttttggggggtggggggctctggtgctcaccaacatggatggcgaggagctaccctcgcccgtgaactctgatgttgttaagcgtcctcactttggttttaaaccacatgcagtttgtgataacctgagccctttcgctcagttcatggggggcaggatcgtcttaggcaacggtcagaggtcgagacaag

SEQ ID NO: 97573 - DNA, 867 bp, Glycine max
  Peptide Sequence Number=SeqID_214351
ttggtgctggtgctttaattgtttgcttggatgatgaaattacgactgaaacagttgaaggtatcgtcaagctaaaagctgaattagatcctgaaacaacacaagtagtctttaaagatgaaagttttgctgatgaccgagttaagacaaacgcaattcagatcttgaaacaagctaatatcaatgatgttaaaagacaagaaatattccaatcgaatttttctgtttcctctaatgcacttgcgagcgaacaattaggattattttccagaaataatgatattggtgtagcaaatgctcttacccttctacctgaagagctttatgaaaatacacgaaacgttcagcttattaatggattgcctcaaactgaaacgtcaaaacaagctcttccaagcctcgattttactatcgaaatggaaacggggacaggtaaaacctacgtctatcttcgtagtgtattcgagctgaatcagaaatatgggctaaccaagttcatcattgttgttccgtcagttgcgattaaagagggggtctataaatccctgcaaattacagaagagcattttagaaaagaatttaagaacgttcagtatgactactttgtatacgactcttcaaagcgtgagcaagtaagaaacttcgcaacgaatgattatattcagattatggtcatcaacattgacgctttcagtaagtctttcactgatccagagaaagagactactgcaaacttgattcaccgaaccgatgatcgattgaatggtatgaagccgattgagttcattcaagcgactaatcctgttgttttgattgatgaacctcaatctgtaacatctacagctaatcgtaaaaatgctattgcca

SEQ ID NO: 97574 - DNA, 429 bp, Glycine max
  Peptide Sequence Number=SeqID_214352
atgcgtacctccgacaaaataggaacaacagccactaataaaacttcaaatacggaacacgggaccaccaaatcttcaaatacttcacttcacgggaccaccaacagactgctgaagggaccaccaccgaaacaacagcaaacgaaagaaacaaacaaagcaaacggaagaagaaacaaagcaaacggaagaagaaacaaagcaaacggaagaagaaacaaagaaagcgcaaagcttcttccggaagacaatggaattcttccggaagaagcttcttccggaaacattccggatgacgttcttccggaaattgtctgtgagtatttccggaagacacaaattaatcttccggaagaagattcttccggaaactttccggaaaaattatttccggaacttttccggaagaaccttcttccggaagaataa

SEQ ID NO: 97575 - DNA, 435 bp, Glycine max
  Peptide Sequence Number=SeqID_214353
atgaccttgttagaatttatgtctcatgagaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatggagaagtttctagggttgactgctacttga

SEQ ID NO: 97576 - DNA, 2586 bp, Glycine max
  Peptide Sequence Number=SeqID_214354
atggcttcaagatcatatgctaatctctttgacttagctagtggagactttcttgattttccttgccccccaagagcccttccgagggttatgaccgttcctggaattatttcagacctggatggttatggctgtaacgacggggattcagatgttagctcttctggatgtagggagcggaaaatcattgtggcaaacatgttgccagtgcaggctaaaagagatatagaaactgctaaatgggtcttcagttgggatgaggattcaattttattacaattaaaagacggtttttctgctgatacagaggtaatctatgtgggttctctcaaggttgaaatagatgcctgtgagcaggatgcagttgctcagagattgctggatgaatttaattgtgtacctacctttctaccccatgatctccaaaaaaggttctaccttggattttgtaagcagcaactttggcctctctttcattatatgctacccatatgcccagatcacggtgatcgctttgaccgtatactttggcaggcttatgtttctgcaaacaaaatatttgcagacaaggtcatggaagtaattaatcctgatgatgattttgtttgggttcatgattatcacttaatggttttgcctactttcttgaggaagcgatataatcgggttaaacttgggttttttctgcatagtcctttcccttcatctgaaatctaccgaactttaccagtaagggatgaaattttgaggggattgttgaactctgatttaattggctttcatacatttgattatgctcgccactttctttcttgctgcagtagaatgctaggtctagactatgaatctaagcggggacatatagggcttgattactttggccgcactatatttattaaaatcttgcctgtaggcattcacatgggtaggcttgaatctgtgttaaatctttcgtctacatctgctaagctaaaagaggttcaggaagagtttaaggataagaaagtaattcttggtgttgatgacatggatatttttaagggcattagtctgaaacttctagctgtggagcatctgctgcagcagaatccagatttgcagggcaaagttgtcctagttcaaattgtaaatcctgcaaggggctcagggaaggatgttcaggaagcaaagaatgaaacatattcaattgcccagaggatcaatgatacatatagctcaaataattatcagccagtcattctcattgaccgtcctgttcctcactttgagaagagtgcctattatgctgtagctgaatgttgcattgtcaatgctgtaagggatggtatgaacttagtcccatacaaatatattgtctgcagacagggaactgctcaactagatgaagcattgggtagaaaaagtgattctccttgtacaagcatgcttgttgtgtctgagttcattggttgttcaccttctcttagtggggcaataagggtcaatccgtggaacatagatgccgtagccgatgctatgtatgcagccctgactatgagtgattcagagaagcagttgcgccatgagaaacactatcggtatgtgagttctcatgatgtggcatattgggcgcgcagctttatgctggatttggagagagcctgcaaagatcattacaccaaaagatgctggggatttggtttgggcttggggttcagagttgtttctctttctcatggttttaggaagttgtcagttgaccatattgtttcagcatacaagagaaccaatagaagggccatctttcttgattatgatggtactgttgtaccacagtcttccataagtaaaaaccccagccctgaagtcatctccgtcttaaatgctctatgtaacgatcccaagaatattttgttcattgttagtgggaggggaaaggattcactgagtgaatggtttacatcatgccaaatgctgggacttgcagcagaacatgggtactttttaaggtggaacaaagattctgaatgggaagcaagtcacttgtctgcagaccttgattggaaaaagatggtggaacctgtcatgcagttgtatacagaatcaaccgatggttctaatattgaagttaaggagagtgctttggtgtggcatcatcaagatgcagaccctgattttggttcttgccaagccaaagaattgttggatcacttggaaagtgtgcttgctaatgaaccagcagctgttacgagaggccagcatattgttgaagttaagccacagggaataagcaagggtttggtagctgaacaggttcttatgaccatggttaatggtgccaatccaccagattttgtgctgtgcattggagatgataggtccgacgaggacatgtttgagagcattttgaggacggttacgtgcccgtcattaccatcagctccagagatctttgcctgcactgtgggtaggaagcctagcaaggccaagtattttcttgatgatgcttctgatgttgtgaagttgcttcagggccttgctgcttcatccaatccaaaacccaggcttcttgctcattctcaagtctcttttgagagcacagtttga
